United States Patent
Beisel et al.

(10) Patent No.: US 11,439,712 B2
(45) Date of Patent: Sep. 13, 2022

(54) METHODS AND COMPOSITIONS FOR RNA-DIRECTED REPRESSION OF TRANSCRIPTION USING CRISPR-ASSOCIATED GENES

(71) Applicant: North Carolina State University, Raleigh, NC (US)

(72) Inventors: Chase Beisel, Raleigh, NC (US); Michelle Luo, Cary, NC (US)

(73) Assignee: North Carolina State University, Raleigh, NC (US)

(*) Notice: Subject to any disclaimer, the term of this patent is extended or adjusted under 35 U.S.C. 154(b) by 0 days.

(21) Appl. No.: 15/302,655

(22) PCT Filed: Apr. 7, 2015

(86) PCT No.: PCT/IB2015/052515
§ 371 (c)(1),
(2) Date: Oct. 7, 2016

(87) PCT Pub. No.: WO2015/155686
PCT Pub. Date: Oct. 15, 2015

(65) Prior Publication Data
US 2017/0028083 A1 Feb. 2, 2017

Related U.S. Application Data

(60) Provisional application No. 62/058,365, filed on Oct. 1, 2014, provisional application No. 61/976,883, filed on Apr. 8, 2014.

(51) Int. Cl.
| *A61K 48/00* | (2006.01) |
| *C12N 15/72* | (2006.01) |
| *C12N 9/22* | (2006.01) |
| *C12N 15/63* | (2006.01) |
| *C12N 15/10* | (2006.01) |
| *C12N 15/11* | (2006.01) |

(52) U.S. Cl.
CPC .............. *A61K 48/005* (2013.01); *C12N 9/22* (2013.01); *C12N 15/102* (2013.01); *C12N 15/111* (2013.01); *C12N 15/63* (2013.01); *C12N 15/72* (2013.01); *C12N 2310/20* (2017.05); *C12N 2320/30* (2013.01)

(58) Field of Classification Search
CPC .... C12N 2310/20; C12N 9/22; C12N 15/113; C12N 2800/80
See application file for complete search history.

(56) References Cited

U.S. PATENT DOCUMENTS

| 8,697,359 | B1 | 4/2014 | Zhang |
| 9,023,649 | B2 | 5/2015 | Mali et al. |
| 9,260,723 | B2 | 2/2016 | Mali et al. |
| 2006/0199190 | A1 | 9/2006 | Russell et al. |
| 2009/0007301 | A1 | 1/2009 | Wintz et al. |
| 2013/0288251 | A1 | 10/2013 | Horvath et al. |
| 2014/0068797 | A1 | 3/2014 | Doudna et al. |
| 2014/0113376 | A1* | 4/2014 | Sorek .................... C12N 15/113 435/471 |
| 2014/0186958 | A1* | 7/2014 | Zhang ...................... C12N 9/22 435/462 |
| 2014/0273233 | A1 | 9/2014 | Chen et al. |
| 2014/0315985 | A1* | 10/2014 | May ..................... A61K 38/465 514/44 R |
| 2014/0356867 | A1 | 12/2014 | Peter et al. |
| 2014/0356956 | A1 | 12/2014 | Church et al. |
| 2015/0050699 | A1 | 2/2015 | Siksnys et al. |
| 2015/0056628 | A1 | 2/2015 | Russell et al. |
| 2015/0064138 | A1 | 3/2015 | Lu et al. |
| 2015/0093473 | A1 | 4/2015 | Barrangou et al. |
| 2015/0098954 | A1 | 4/2015 | Hyde et al. |
| 2015/0132263 | A1 | 5/2015 | Liu et al. |
| 2015/0291961 | A1 | 10/2015 | Siksnys et al. |
| 2015/0315576 | A1 | 11/2015 | Caliando et al. |
| 2015/0353901 | A1 | 12/2015 | Liu et al. |
| 2016/0017366 | A1 | 1/2016 | Chen et al. |
| 2016/0024510 | A1 | 1/2016 | Bikard et al. |
| 2016/0186152 | A1 | 6/2016 | Brouns et al. |

(Continued)

FOREIGN PATENT DOCUMENTS

| EP | 2860267 | 4/2015 |
| WO | 2006/113709 | 10/2006 |

(Continued)

OTHER PUBLICATIONS

Qi et al., Repurposing CRISPR as an RNA-Guided Platform for Sequence-Specific Control of Gene Expression; Cell, vol. 152, pp. 1173-1183, 2013.*
Beloglazova et al., Structure and activity of the Cas3 HD nuclease MJ0384, an effector enzyme of the CRISPR interference; EMBO Journal, vol. 30, pp. 4616-4627, 2011 (Year: 2011).*
Luo, Michelle Lynn Understanding and exploiting the properties of Type I CRISPR-Cas systems. 2016. Dissertation submitted to the Graduate Faculty of North Carolina State University in partial fulfillment of the requirements for the degree of Doctor of Philosophy. 167 pages. (Year: 2016).*
Lou et al. The CRISPR RNA-guided surveillance complex in *Escherichia coli* accommodates extended RNA spacers. Published online May 12, 2016. Nucleic Acids Research. vol. 44, No. 15, pp. 7385-7394. (Year: 2016).*

(Continued)

*Primary Examiner* — Antonio Galisteo Gonzalez
(74) *Attorney, Agent, or Firm* — Myers Bigel, P.A.

(57) ABSTRACT

The present invention is directed to methods and compositions for targeted gene silencing that provide the ability to not only repress expression but to modulate the repression of expression of one or more target genes. In one aspect, a recombinant nucleic acid molecule is provided comprising a nucleotide sequence encoding a subset of CRISPR-cas polypeptides, or functional fragments thereof, from a type-I CRISPR-cas system. In some aspects, a recombinant nucleic acid of the invention comprises a nucleotide sequence encoding three or more Type I Cascade polypeptides having substantial identity to a type I Cascade polypeptide.

17 Claims, 12 Drawing Sheets

Specification includes a Sequence Listing.

(56) References Cited

U.S. PATENT DOCUMENTS

| | | | |
|---|---|---|---|
| 2016/0186213 A1 | 6/2016 | Zhang et al. | |
| 2016/0186214 A1* | 6/2016 | Brouns | C12N 15/66 435/91.5 |
| 2016/0289700 A1 | 10/2016 | Barrangou et al. | |
| 2016/0333348 A1 | 11/2016 | Clube et al. | |
| 2016/0345578 A1 | 12/2016 | Barrangou et al. | |
| 2017/0002339 A1 | 1/2017 | Barrangou et al. | |
| 2017/0196225 A1 | 7/2017 | Clube et al. | |
| 2017/0246221 A1 | 8/2017 | Clube et al. | |
| 2017/0275648 A1 | 9/2017 | Barrangou et al. | |
| 2018/0064114 A1 | 3/2018 | Clube | |
| 2018/0064115 A1 | 3/2018 | Clube et al. | |
| 2018/0070594 A1 | 3/2018 | Clube et al. | |
| 2018/0084785 A1 | 3/2018 | Clube | |
| 2018/0084786 A1 | 3/2018 | Clube | |
| 2018/0146681 A1 | 5/2018 | Clube | |
| 2018/0155729 A1 | 6/2018 | Beisel et al. | |
| 2018/0200387 A1 | 7/2018 | Porteus | |
| 2018/0258411 A1 | 9/2018 | Kadiyala et al. | |
| 2018/0273937 A1 | 9/2018 | Beisel et al. | |

FOREIGN PATENT DOCUMENTS

| | | | |
|---|---|---|---|
| WO | WO 2010/054154 | 5/2010 | |
| WO | 2010/075424 | 7/2010 | |
| WO | WO 2010/075424 | 7/2010 | |
| WO | WO 2013/098244 | 7/2013 | |
| WO | 2013/141680 | 9/2013 | |
| WO | WO 2013176772 | 11/2013 | |
| WO | WO 2013/188638 | 12/2013 | |
| WO | WO 2013188522 | 12/2013 | |
| WO | WO 2014/022702 | 2/2014 | |
| WO | WO 2014/071235 | 5/2014 | |
| WO | WO 2014065596 | 5/2014 | |
| WO | WO-2014093479 A1 * | 6/2014 | C12N 15/63 |
| WO | WO 2014110006 | 7/2014 | |
| WO | WO 2014113493 | 7/2014 | |
| WO | WO 2014/124226 | 8/2014 | |
| WO | WO 2014144155 | 9/2014 | |
| WO | WO 2014144592 | 9/2014 | |
| WO | WO 2014150624 | 9/2014 | |
| WO | WO 2014186686 | 11/2014 | |
| WO | 2014/204727 | 12/2014 | |
| WO | WO 2014191128 | 12/2014 | |
| WO | WO 2014191518 | 12/2014 | |
| WO | WO 2014201015 | 12/2014 | |
| WO | WO 20142014727 | 12/2014 | |
| WO | WO 2015021353 | 2/2015 | |
| WO | WO 2015026886 | 2/2015 | |
| WO | WO 2015/034872 | 3/2015 | |
| WO | WO 2015035139 | 3/2015 | |
| WO | WO 2015040402 | 3/2015 | |
| WO | WO 2015/053995 | 4/2015 | |
| WO | WO 2015/070193 | 5/2015 | |
| WO | WO 2015077290 | 5/2015 | |
| WO | 2015/089486 | 6/2015 | |
| WO | WO 2015089277 | 6/2015 | |
| WO | WO 2015089406 | 6/2015 | |
| WO | 2015112896 A2 | 7/2015 | |
| WO | WO 2015116686 | 8/2015 | |
| WO | WO 2015119941 | 8/2015 | |
| WO | WO 2015 139139 | 9/2015 | |
| WO | 2015/159068 | 10/2015 | |
| WO | WO 2015/148680 | 10/2015 | |
| WO | WO 2015/155686 | 10/2015 | |
| WO | WO 2015/159086 | 10/2015 | |
| WO | WO 2015/159087 | 10/2015 | |
| WO | WO 2015153791 | 10/2015 | |
| WO | WO 2015153889 | 10/2015 | |
| WO | WO 2015153940 | 10/2015 | |
| WO | WO 2015155686 | 10/2015 | |
| WO | WO 2015160683 | 10/2015 | |
| WO | WO 2015189693 | 12/2015 | |
| WO | WO 2015200555 | 12/2015 | |
| WO | 2016/084088 | 6/2016 | |
| WO | WO 2016/084088 | 6/2016 | |
| WO | 2016/177682 | 11/2016 | |
| WO | 2018/196361 | 12/2016 | |
| WO | 2017/027423 | 2/2017 | |
| WO | 2017/066497 | 4/2017 | |
| WO | 2017112620 | 6/2017 | |
| WO | 2017/147507 | 8/2017 | |
| WO | 2018217981 | 11/2018 | |

OTHER PUBLICATIONS

Barrangou R. "CRISPR-Cas systems and RNA-guided interference", *Wiley interdisciplinary reviews, RNA* (2013) 4: pp. 267-278.

Barrangou R., et al. "CRISPR: new horizons in phage resistance and strain identification" *Annu Rev Food Sci Technol* (2012) 3, pp. 143-162.

Barrangou R., et al. "CRISPR-Cas systems: prokaryotes upgrade to adaptive immunity", *Mol Cell* (2014) 54(2): pp. 234-244.

Barrangou, R. "Diversity of CRISPR-Cas immune systems and molecular machines", *Genome Biology* (2015) 16:247, 11 pages.

Barrangou, R., et al. "CRISPR provides acquired resistance against viruses in prokaryotes", *Science* (2007) 315(5819): pp. 1709-1712.

Bhaya et al. "CRISPR-Cas Systems in Bacteria and Archaea: Versatile Small RNAs for Adaptive Defense and Regulation", *Annu. Rev. Genet.* (2011) 45: pp. 273-297.

Bikard D. et al. "Programmable repression and activation of bacterial gene expression using an engineered CRISPR-Cas system" *Nucleic Acids Res* (2013) 41(15): pp. 7429-7437.

Bikard D., et al. "CRISPR interference can prevent natural transformation and virulence acquisition during in vivo bacterial infection", *Cell Host & Microbe* (2012), 10 pages.

Bikard D., et al. "Exploiting CRISPR-Cas nucleases to produce sequence-specific antimicrobial", *Nature Biotechnology* 2014, 6 pages.

Briner et al. "Guide RNA Functional Modules Direct Cas9 Activity and Orthogonality", *Molecular Cell.* (2014) 56(2): pp. 333-339.

Briner AE, Barrangou R. "*Lactobacillus buchneri* Genotyping on the Basis of Clustered Regularly Interspaced Short Palindromic Repeat (CRISPR) Locus Diversity", *Appl Environ Microbiol.* 80:994-1001, (2014).

Brouns SJJ, et al. "Small CRISPR RNAs guide antiviral defense in prokaryotes", *Science* (2008) 321:5891, pp. 960-964.

Carte et al. "The three major types of CRISPR-Cas systems function independently in CRISPR RNA biogenesis in *Streptococcus thermophilus*", *Molecular Microbiology*, 93(1), pp. 98-112 (2014).

Chylinski at al. "The tracrRNA and Cas9 families of type II CRISPR-Cas immunity systems", *RNA Biology*, 10:5 (2013) pp. 726-737.

Chylinski et al. "Classification and evolution of type II CRISPR-Cas Systems", *Nucleic Acids Research*, (2014) 15 pages.

Citorik R., et al. "Sequence-specific antimicrobials using efficiently delivered RNA-guided nucleases", *Nature Biotechnology* 2014, 7 pages.

Cong et al. "Multiplex Genome Engineering Using CRISPR/Cas Systems" *Science* (2013) vol. 339 (6121): pp. 819-823.

Darmon E, Leach DF "Bacterial Genome Instability", *Microbiol. Mol. Biol.* Rev. (2014) vol. 78, pp. 1-39.

Deltcheva, E. et al. "CRISPR Rna maturation by trans-encoded small RNA and host factor RNase III", *Nature*, vol. 471, (Mar. 2011) pp. 602-607.

Doench et al. "Rational design of highly active sgRNAs for CRISPR-Cas9-mediated gene inactivation", *Nature Biotechnology*, 32:12 (2014) 8 pages.

Edgar R., et al. "The *Escherichia call* CRISPR System Protects from Lysogenization, Lysogens, and Prophage Induction", *Journal of Bacteriology* (2010), vol. 192, No. 23, pp. 6292-6294.

Estvelt et al. "Orthogonal Cas9 proteins for RNA-guided gene regulation and editing", *Nature Methods*, 10:11 (2013) pp. 1116-1121.

Fonfara, I. et al. "Phylogeny of Cas9 determines functional exchangeability of dual-RNA and Cas9 among orthologous type II CRISPR-Cas systems", *Nucleic Acids Res* (2013) 14 pages.

(56) References Cited

OTHER PUBLICATIONS

Fu et al. "Improving CRISPR-Cas nuclease specificity using truncated guide RNAs", *Nature Biotechnology*, 32:3 (2013) 9 pages.
Garneau Je, et al. "The CRISPR/Cas bacterial immune system cleaves bacteriophage and plasmid DNA" *Nature* (2010) 468(7320): pp. 67-71.
Gasiunas et al. "Cas9-crRNA ribonucleoprotein complex mediates specific DNA cleavage for adaptive immunity in bacteria", *Proc. Natl. Acad. Sci.* (2012), 109:E2579-E2586.
Gilbert, L. A. et al. "CRISPR-Mediated Modular RNA-Guided Regulation of Transcription in Eukaryotes", *Cell* 154 (2013) pp. 442-451.
Gilbert et al. "Genome-Scale CRISPR-Mediated Control of Gene Repression and Activation", *Cell*, 159 (2014) pp. 647-661.
Gomaa AA, et al. "Programmable Removal of Bacterial Strains by Use of Genome-Targeting CRISPR-Cas Systems", *mBio* (2014), 5(1):e00928-13.
Haurwitz et al. "Sequence- and Structure-Specific RNA Processing by a CRISPR Endonuclease", *Science* (2010) 329: pp. 1355-1358.
Horvath and Barrangou "CRISPR/Cas, the Immune System of Bacteria and Archaea", *Science* (2010) 327, pp. 167-170.
Horvath, P. et al. "Diversity, Activity, and Evolution of CRISPR Loci in *Streptococcus thermophilus*", *J Bacteriol.* 190 (2008) pp. 1401-1412.
Hsu et al. "DNA targeting specificity of RNA-guided Cas9 nucleases", *Nature Biotechnology*, 31:9 (2013) pp. 827-834.
Jiang, W. et al. "Dealing with the Evolutionary Downside of CRISPR Immunity: Bacteria and Beneficial Plasmids", *PLOS Genetics* (2013) vol. 9, issue 9, 13 pages.
Jiang, W. et al. "RNA-guided editing of bacterial genomes using CRISPR-Cas systems", *Nat. Biotechnol.* (2013) vol. 31, pp. 233-239.
Jinek et al. "A Programmable Dual-RNA-Guided DNA Endonuclease in Adaptive Bacterial Immunity", *Science* (2012) vol. 337, pp. 816-821.
Jinek, M. et al.,"Structures of Cas9 endonucleases reveal RNA-mediated conformational activation", *Science* (2014) vol. 343, 6176, 28 pages.
Karvelis et al. "crRNA and tracrRNA guide Cas9-mediated DNA interference in *Streptococcus thermophilus*", *RNA Biol.* (2013) vol. 10: pp. 841-851.
Kobayashi K, et al. "Essential *Bacillus subtilis* genes", *Proc. Natl. Acad. Sci. U.S.A.* (2003) vol. 100, pp. 4678-4683.
Labrie SJ et al. "Bacteriophage resistance mechanisms" *Nat. Rev. Microbiol* (2010) vol. 8, pp. 317-327.
Luo, M. et al., "Repurposing endogenous type I CRISPR-Cas systems for programmable gene repression", *Nucleic Acid Research* (2014) 8 pages.
Magadan et al. "Cleavage of Phage DNA by the *Streptococcus thermophilus* CRISPR3-Cas System", *PLoS One* (2012) 7:e40913, 8 pages.
Mahillon J. et al. "Insertion sequences", *Microbiol Mol Biol Rev* (1998) vol. 62(3): pp. 725-774.
Makarova and Koonin "Annotation and Classification of CRISPR-Cas Systems", *Methods Mol Biol.* (2015), 1311: pp. 47-75.
Makarova et al. "An updated evolutionary classification of CRISPR-Cas systems", *Nat Rev Microbiol.* 13:722-736 (2015), 15 pages.
Makarova et al. "Unification of Cas protein families and a simple scenario for the origin and evolution of CRISPRCas systems", *Biol Direct.* (2011) vol. 6:38, 27 pages.
Makarova, K. S. et al. "Evolution and classification of the CRISPR-Cas systems", *Nat Rev Microbiol* (2011) vol. 9, pp. 467-477.
Marraffini and Sontheimer "CRISPR Interference Limits Horizontal Gene Transfer in *Staphylococci* by Targeting DNA", *Science* (2008) vol. 322: pp. 1843-1845.
Mojica, F. et al. "Short motif sequences determine the targets of the prokaryotic CRISPR defence system", *Microbiology* (2009) vol. 155, 8 pages.
Nishimasu, H., et al. "Crystal Structure of Cas9 in Complex with Guide RNA and Target DNA", *Cell* (2014) vol. 156, pp. 935-949.

Oh JH and van Pijkeren JP "CRISPR-Cas9-assisted recombineering in *Lactobacillus reuteri*", *Nucleic Acids Res* (2014) vol. 10.1093/nar/gku623.
Qi, L. S. et al. "Repurposing CRISPR as an RNA-Guided Platform for Sequence-Specific Control of Gene Expression", *Cell* 152, 1173-1183 (2013), 11 pages.
Sander JD, and Joung JK. "CRISPR-Cas systems for editing, regulating and targeting genomes", *Nat. Biotechnol.* (2014) vol. 32, pp. 347-355.
Sapranauskas et al. "The *Streptococcus thermophilus* CRISPR/Cas system provides immunity in *Escherichia coli*", *Nucleic Acid Res.* (2011) vol. 39: pp. 9275-9282.
Selle K, Barrangou R. "Harnessing CRISPR-Cas systems for bacterial genome editing", *Cell Press: Trends Microbiol.* (2015) vol. 23(4): pp. 225-232.
Selle, K. et al. "CRISPR-based screening of genomic island excision events in bacteria", *Proc Natl Acad Sci USA;* (2015); 112(26): pp. 8076-8081.
Selle, K. et al., "CRISPR-Based Technologies and the Future of Food Science", *Journal of Food Science* (2015) vol. 80, 6 pages.
Semenova et al. "Interference by clustered regularly interspaced short palindromic repeat (CRISPR) RNA is governed by a seed sequence", *PNAS,* 108:25 (2011) 6 pages.
Sinkuna, T. et al. "In vitro reconstitution of Cascade-mediated CRISPR immunity in *Streptococcus thermophilus*", *The EMBO Journal* (2013) vol. 32, pp. 385-394.
Stern, A. et al., "Self-targeting by CRISPR: gene regulation of autoimmunity", *Cell Press: Trends in Genetics,* (2010) vol. 26, No. 8, 6 pages.
Sternberg et al. "DNA interrogation by the CRISPR RNA-guided endonuclease Cas9", *Nature,* vol. 507, (2014) 17 pages.
Terns and Terns "CRISPR-based adaptive immune systems", *Curr. Opin. Microbiol.* (2011) vol. 14: pp. 321-327.
Vercoe RB, et al. "Cytotoxic chromosomal targeting by CRISPR/Cas systems can reshape bacterial genomes and expel or remodel pathogenicity islands", *PLoS Genet* (2013) vol. 9(4):e1003454.
Westra et al. "The CRISPRs, They Are A-Changin': How Prokaryotes Generate Adaptive Immunity", *Annu. Rev. Genet.* (2012) vol. 46: pp. 311-339.
Notification of Transmittal of the International Search Report and the Written Opinion of the International Searching Authority, or the Declaration, PCT/US2016/034812, dated Sep. 15, 2016, 9 pages.
Notification of International Preliminary Report on Patentability corresponding to International Application No. PCT/IB2015/052515; dated Oct. 12, 2016, 7 pages.
Notification and Transmittal of International Search Report and Written Opinion of the International Searching Authority for International Application No. PCT/IB2015/052515; dated Oct. 10, 2015; 12 pages.
Beisel CL et al. A CRISPR design for next-generation antimicrobials. Genome Biology. 2014; 15: 516, 4 pages.
Citorik RJ et al. "Sequence-specific antimicrobials using efficiently delivered RNA-gulding nucleases Supplemental Material." Nature Biotechnology. Sep. 21, 2014; 32(11): 1141-1145. DOI:10.1038/nbt.3011, 14 pages.
Liu S et al. Complete genome sequence of Lactobacillus buchneri NRRL B-30929, a novel strain from a commercial ethanol plant. Journal of Bacteriology. Aug. 2011: 193(15): 4019-4020.
Liu S et al. NCBI (2011) CRISPR-associated protein, Csn1 family [Lactobacillus buchneri], pp. 1-3.
Final Office Action, U.S. Appl. No. 15/113,656, dated Jul. 30, 2018, 8 pages.
Ajdic et al. "hypothetical protein SMU_1405c [*Streptococcus mutans* UA159]", Proc. Natl. Acad. Sci. U.S.A. 99 (22), 14434-14439 (2002) URL: https://www.ncbi.nlm.nih.gov/protein/NP_721764.1/, retrieved Jul. 20, 2018.
Cochrane Kyla et al., "Complete genome sequences and analysis of the Fusobacterium nucleatum subspecies animalis 7-1 bacteriophage PHIFunu1 and PHIFunu2", Anaerobe, 38:125-129 (2016).
Dupuis Me et al., "CRISPR-Cas and restriction-modification systems are compatible and increase phage resistance", Nat Commun., vol. 4, p. 2087 (2013).

(56) References Cited

OTHER PUBLICATIONS

Heinl, Stefan et al. "Insights into the completely annotated genome of Lactobacillus buchneri CD034, a strain isolated from stable grass silage", Journal of Biotechnology, 161:153-166 (2012).
International Search Report and Written Opinion for PCT/US2015/047136 dated Nov. 26, 2015, 10 pages.
Karvelis, Tautvydas et al., "crRNA and tracerRNK guide Cas9-mediated DNA interference in *Streptococcus thermophilus*," RNA Biology, 2013, vol. 10, Issue 5, pp. 841-851.
Karvelis, Tautvydas et al., "Programmable DNA cleavage in vitro by Cas9," Biochem. Soc. Trans. 2013, vol. 41, part 6, pp. 1401-1406.
Marcotte, H. et al. "Proteomes—Lactobacillus gasseri DSM 14869", NCBI Reference Sequence CP006803, (2013) URL: https://www.uniprot.org/proteomes/UP000217220, retrieved Jul. 20, 2018.
Nale Janet Y. et al., "Diverse temperate bacteriophage carriage in Clostridium difficile 027 strains", PLoS One, 7(5) 1-9 (2012).
Notificaton and Transmittal of International Search Report and Written Opinion of the International Searching Authority for International Application No. PCT/IB2015/052516; dated Oct. 10, 2016; 12 pages.
Novagen "pCDF-1b Vector" Sep. 10, 2003, Retrieved from the Internet on Sep. 1, 2015, at http://www.helmholtz-muenchen.de/fieadmin/PEPF/pCDF_vectors/pCDF-1b_map.pdf, 2 pages.
Ramakrishna Suresh et al. "Gene disruption by cell-penetrating peptide-mediated delivery of Cas9 protein and guide RNA", Genome Research, 24:1020-1027 (2014).
Seed Kimberley D. et al., "A bacteriophage encodes its own CRISPR/Cas adaptive response to evade host innate immunity", Nature, 494:7438, pp. 469-491 (2013).
Uchiyama Jumpei et al., "Charactenzation of Helicobacter pylori bacteriophage KHP30", Applied and environmental mioroblology, 79(10):3176-3184 (2013).
Wiedenheft et al. "RNA-guided complex from a bacterial immune system enhances target recognition through seed sequence interactions", PNAS, 108:36 (2011) 7 pages.
Written Opinion and International Search Report corresponding to International Application No. PCT/US2016/037493, dated Sep. 15, 2016, 8 pages.
Written Opinion of the Intemnational Search Report regarding International Application No. PCT/US2016/067657, dated Mar. 6, 2017, 9 pages.
Milani C et al. Genomic encyclopedia of type strains of the genus *Bifidobacterium*. Applied and Environmental Microbiology. Oct. 2014; 80(20): 6290-6302.
Database GenBank [online]. NBI, U.S. National Library of Medicine. Aug. 6, 2014. "CRISPER-associated protein, Csn1 family[Bifidobacterium bombi DSM 19703]." XP002785852, retrieved from NCBI accession No. GenBank: KFF31259. Database accession No. KFF31259. 1 page.
International Search Report and Written Opinion, PCT/US2018/034322, dated Sep. 13, 2018, 7 pages.
Final Office Action, U.S. Appl. No. 16/153,052, dated Dec. 26, 2018, 14 pages.
Office Action, U.S. Appl. No. 15/032,985, dated Feb. 5, 2019, 11 pages.
Rath D et al. The CRISPR-Cas immune system: Biology, mechanisms and applications. Biochimie. 2015;117: 119-128.
Spath K et al. Lactobacillus plantarum and Lactobacillus buchneri as expression systems: Evaluation of different origins of replication for the design of suitable shuttle vectors. Mol. Biotechnol. 2012; 52: 40-48.
Grissa I et al. The CRISPRdb database and tools to display CRISPRs and to generate dictionaries of spacers and repeats. BMC Bioinformatics. 2007; 8(172): pp. 1-10.
Cong et al. Supplementary Materials for "Multiplex Genome Engineering Using CRISPR/Cas Systems" Science, 339 (6121):819-823 (2013).
Office Action, U.S. Appl. No. 15/113,656, dated Mar. 11, 2019, 22 pages.
Boudry et al. "Function of CRISPR-Cas System of the Human Pathogen Clostridium difficile" mBio, 6(5):1-15 2015.
Edgar et al. Supplemental Material "The *Escherichia coli* CRISPR System Protects from Lysogenization, Lysogens, and Prophage Induction" Journal of Bacteriology, 192(23): 6292-6294 2010.
Shinkai "Structure and Function of CRISPR-Cas System" Seibutsu Butsuri, 54(5):247-252 (2014) Abstract Only.
Extended European Search Report regarding European Application No. EP19196063, dated Jun. 26, 2020 12 pages.
Third Party Observations corresponding to European Patent Application No. 16804164.8, dated Jul. 24, 2019 60 pages.
Third Party Observations corresponding to European Patent Application No. 16812275.2, dated May 15, 2020 108 pages.
International Preliminary Report on Patentability Notification, PCT/US2018/034322, dated Dec. 5, 2019, 7 pages.
International Search Report and Written Opinion corresponding to PCT/US2019/52883, dated Dec. 23, 2019, 9 pages.
Internatianal Search Report and Written Opinion corresponding to PCT/US2019/52878, dated Dec. 27, 2019, 14 pages.
International Search Report and Written Opinion corresponding to PCT/US2019/52864, dated Dec. 17, 2019, 15 pages.
International Search Report and Written Opinion corresponding to PCT/US2019/52861, dated Feb. 12, 2020, 18 pages.
GenBank Accession No. FN692037.1, "Lactobacillus crispatus ST1 complete genome, strain ST1" Feb. 27, 2015.
Ojala et al. "Comparative genomics of Lactobacillus crispatus suggests novel mechanisms for the competitive exclusion of Garnerella vaginalis" BNC Genomics, 15:1070 (2014).
Gasiunas et al. "Molecular mechanisms of CRISPR-mediated microbial immunity" Cellular and Molecular Life Sciences, 71:449-465 (2014).
Jackson et al. "Crystal structure of the CRISPR RNA-guided surveillance complex from *Escherichia coli*" Science, 345(6203):1473-1479 (2014).
Westra et al., "CRISPR Immunity Relies on the Consecutive Binding and Degradation of Negatively Supercoiled Invader DNA by Cascade and Cas3" Molecular Cell, 46:595-605 (2012).
Hidalgo-Cantabrana et al. "Genome editing using the endogenous type I CRISPR-Cas system in Lactobacillus crispatus" PNAS, 116)32):15774-15783 (2019).
Yosef et al. "High-temperature protein G is essential for activity of the *Escherichia coli* clustered regularly interspaced short palindromic repeats (CRISPR)/Cas system" Proc Nat Acad Sci, 108(50):20136-20141 (2011).
Sanozky-Dawes et al. "Occurrence and activity of a type II CRISPR-Cas system in Lactobacillus gasseri" Microbiology, 161:1752-1761 2015.
Anderson et al. "Lactobacillus gasseri CRISPR-Cas9 characterization In Vitro reveals a flexible mode of protospacer-adjacent motif recognition" PLOS ONE, 13(2) 14 pages 2018.
Gutierrez et al. "Predicting CRISPR-Cas9 activity in *E. coli*" bioRxviv, https://doi.org/10.1101/308148, pp. 1-22 2018.
Hochstrassera et al. "CasA mediates Cas3-catalyzed target degradation during CRISPR RNA-guided interference" PNAS, 111(18):6618-23 2014.
Nizet et al. "Bacterial sepsis and meningitis" Remington and Klein's Infectious diseases of the fetus and newborn infant, 8th Edition, pp. 217-271 2011.
Verco et al. "Cytotoxic Chromosomal Targeting by CRISPR/Cas Systems Can Reshape Bacterial Genomes and Expel or Remodel Pathogenicity Islands" PLOS Genetics, 9(4):1-13 2013.
Brouns et al. "Small CRISPR RNAs Guide Antiviral Defense in Prokaryotes" Science, 321 (5891):960-964 2008.
Cady et al. "The CRISPR/Cas Adaptive Immune System of Pseudomonas aeruginosa Mediates Resistance to Naturally Occurring and Engineered Phages" J. Bacteriol., 194(21):5728-5738 2012.
Erdmann et al., "Selective and hyperactive uptake of foreign DNA by adaptive immune systems of an archaeon via two distinct mechanisms" Mol Microbiol, 85(6):1044-1056 2012.
Gleditzsch et al. "Modulating the Cascade architecture of a minimal Type I-F CRISPR-Cas system" Nucleic Acids Res., 44(12):5872-5882 2016.

(56) References Cited

OTHER PUBLICATIONS

Grissa et al. "The CRISPRdb database and tools to display CRISPRs and to generate dictionaries of spacers and repeats" BMC Informatics, 8(172) 10 pages 2007.
Kuznedelov et al. "Altered stoichiometry *Escherichia coli* Cascade complexes with shortened CRISPR RNA spacers are capable of interference and primed adaptation" Nucleic Acids Res., 44(22):10849-10861 2016.
Maier et al. "Essential requirements for the detection and degradation of invaders by the Haloferax volcanii CRISPR/Cas system I-B" RNA Biology, 10(5):865-874 2013.
Marakova et al. "Evolution and classification of the CRISPR-Cas systems" Nat. Rev. Microbiol., 9(6):467-477 2011.
Nam et al. "Cas5d protein processes pre-crRNA and assembles into a Cascade-like interference complex in Subtype I-C/Dvulg CRISPR-Cas system" Structure, 20(9):1574-1584 2012.
Scholz et al. "CRISPR-Cas Systems in the *Cyanobacterium synechocystis* sp. PCC6803 Exhibit Distinct Processing Pathways Involving at Least Two Cas6 and a Cmr2 Protein" PLosONE, 8(2) 15 pages 2013.
Chauthaiwale, V. M. et al. "Bacteriophage Lamda as a Cloning Vector" Microbiological Reviews, 56(4):577-591 (1992).
Dang, Y. et al. "Optimizing sgRNA structure to improve CRISPR-Cas9 knockout efficiency" Genome Biology, 16(280):1-10 (2015).
Edgar, R. et al. "Reversing Bacterial Resistance to Antibiotics by Phage-Mediated Delivery of Dominant Sensitive Genes" Applied and Environmental Microbiology, 78(3):744-751 (2011).
Extended European Search Report corresponding to European Patent Application No. 18806333.3 (8 pages) (dated Feb. 9, 2021).
Third Party Observation filed in European Patent Application No. 16804164.8 dated Feb. 19, 2021, 15 pages.
Third Party Observation filed in European Patent Application No. 16812275.2 dated Feb. 19, 2021, 38 pages.
Yosef, I. et al. "Temperate and lytic bacteriophages programmed to sensitize and kill antibiotic-resistant bacteria" PNAS, 112(23):7267-7272 (2015).
Sashital et al. "Mechanism of foreign DNA selection in a bacterial adaptive immune system" Mol Cell., 46 (5):6061-615 2012.
Third Party Observations corresponding to U.S. Appl. No. 15/735,028, dated Aug. 30, 2019 17 pages.

* cited by examiner

METHODS AND COMPOSITIONS FOR RNA-DIRECTED REPRESSION OF TRANSCRIPTION USING CRISPR-ASSOCIATED GENES

STATEMENT OF PRIORITY

This application is a 35 U.S.C. § 371 national phase application of International Application Serial No. PCT/IB2015/052515, filed Apr. 7, 2015, which claims the benefit, under 35 U.S.C. § 119 (a) of U.S. Provisional Patent Application No. 61/976,883, filed Apr. 8, 2014, and U.S. Provisional Patent Application No. 62/058,365, filed Oct. 1, 2014, the entire contents of each of which are incorporated by reference herein.

SEQUENCE LISTING STATEMENT

A Sequence Listing in ASCII text format, submitted under 37 C.F.R. § 1.821, entitled 5051-861_ST25.txt, 60,109,388 bytes in size, generated on Nov. 29, 2020 and filed via EFS-Web, is provided in lieu of a paper copy. The Sequence Listing is incorporated herein by reference into the specification for its disclosures.

FIELD OF THE INVENTION

The invention relates to a synthetic CRISPR-Cas system and methods of use thereof for repression and modulation of gene expression.

BACKGROUND OF THE INVENTION

Clustered Regularly Interspaced Short Palindromic Repeats (CRISPR), in combination with CRISPR-associated genes (cas) constitute the CRISPR-Cas system, which confers adaptive immunity in many bacteria and most archaea. CRISPR-mediated immunization occurs through the integration of DNA from invasive genetic elements such as plasmids and phages that can be used to thwart future infections by invaders containing the same sequence.

CRISPR-Cas systems consist of CRISPR arrays of short DNA "repeats" interspaced by hypervariable "spacer" sequences and a set of flanking cas genes. The system acts by providing adaptive immunity against invasive genetic elements such as phage and plasmids through the sequence-specific targeting and interference of foreign nucleic acids (Barrangou et al. 2007. *Science.* 315:1709-1712; Brouns et al. 2008. *Science* 321:960-4; Horvath and Barrangou. 2010. *Science.* 327:167-70; Marraffini and Sontheimer. 2008. *Science.* 322:1843-1845; Bhaya et al. 2011. *Annu. Rev. Genet.* 45:273-297; Terns and Terns. 2011. *Curr. Opin. Microbiol.* 14:321-327; Westra et al. 2012. *Annu. Rev. Genet.* 46:311-339; Barrangou R. 2013. *RNA.* 4:267-278). Typically, invasive DNA sequences are acquired as novel "spacers" (Barrangou et al. 2007. *Science.* 315:1709-1712), each paired with a CRISPR repeat and inserted as a novel repeat-spacer unit in the CRISPR locus. The "spacers" are acquired by the Cas1 and Cas2 proteins universal to all CRISPR-Cas systems (Makarova et al. 2011. *Nature Rev. Microbiol.* 9:467-477; Yosef et al. 2012. *Nucleic Adds Res.* 40:5569-5576), with involvement by the Cas4 protein in some systems (Plagens et al. 2012. *J. Bact.* 194: 2491-2500; Zhang et al. 2012. *PLoS One* 7:e47232). The resulting repeat-spacer array is transcribed as a long pre-CRISPR RNA (pre-crRNA) (Brouns et al. 2008. *Science* 321:960-4), which is processed into CRISPR RNAs (crRNAs) that drive sequence-specific recognition of DNA or RNA. Specifically, crRNAs guide nucleases towards complementary targets for sequence-specific nucleic acid cleavage mediated by Cas endonucleases (Gameau et al. 2010. *Nature.* 468:67-71; Haurwitz et al. 2010. *Science.* 329:1355-1358; Sapranauskas et al. 2011. *Nucleic Acid Res.* 39:9275-9282; Jinek et al. 2012. *Science.* 337:816-821; Gasiunas et al. 2012. *Proc. Natl. Acad. Sci.* 109:E2579-E2586; Magadan et al. 2012. *PLoS One.* 7:e40913; Karvelis et al. 2013. *RNA Biol.* 10:841-851).

These widespread systems occur in nearly half of bacteria (~46%) and the large majority of archaea (~90%). They are classified into three main types (Makarova et al. 2011. *Nature Rev. Microbiol.* 9:467-477; Makarova et al. 2013. *Nucleic Acid Res.* 41:4360-4377) based on the cas gene content, organization and variation in the biochemical processes that drive crRNA biogenesis, and Cas protein complexes that mediate target recognition and cleavage. The type I systems are the most prevalent in bacteria and in archaea (Makarova et al. 2011. *Nature Rev. Microbiol.* 9:467-477) and target DNA (Brouns et al. 2008. *Science* 321:960-4). A complex of 3-8 Cas proteins called the CRISPR associated complex for antiviral defense (Cascade) process the pre-crRNAs (Brouns et al. 2008. *Science* 321: 960-4), retaining the crRNA to recognize DNA sequences called "protospacers" that are complementary to the spacer portion of the crRNA. Aside from complementarity between the crRNA spacer and the protospacer, targeting requires a protospacer-adjacent motif (PAM) located at the 5' end of the protospacer (Mojica et al. 2009. *Microbiology* 155:733-740; Sorek et al. 2013. *Ann. Rev. Biochem.* 82:237-266). For type I systems, the PAM is directly recognized by Cascade (Sashital et al. 2012. *Mol. Cell* 46:606-615; Westra et al. 2012. *Mol. Cell* 46:595-605). The exact PAM sequence that is required can vary between different type I systems and can be identified through established bioinformatics and experimental procedures (Esvelt et al. 2013. *Nat. Methods* 10:1116-11121; Jiang et al. 2013. *Nat. Biotechnol.* 31:233-239; Mojica et al. 2009. *Microbiology* 155:733-740). Once a protospacer is recognized, Cascade generally recruits the endonuclease Cas3, which cleaves and degrades the target DNA (Sinkunas et al. 2011. *EMBO J.* 30:1335-1342; Sinkunas et al. 2013. *EMBO J.* 32:385-394).

Interference requires that all of the Cas proteins comprising the complex, the Cas3 protein, and the CRISPR array be expressed. In most organisms, these proteins appear to be constitutively expressed, although, in a few examples, some of these proteins are inducibly expressed. For instance, in *Escherichia coli*, the genes encoding the complex are encoded in a single operon that is repressed under normal growth conditions. However, repression of the operon can be eliminated through deletion of the repressor H-NS (Pul et al. 2010. *Mol. Microbiol.* 75:1495-1512; Westra et al. 2010. *Mol. Microbiol.* 77:1380-1393).

The present disclosure provides methods and compositions for targeted gene silencing that provide the ability to not only repress expression but to modulate the repression of expression of one or more target genes.

SUMMARY OF THE INVENTION

In one aspect, a recombinant nucleic acid molecule is provided comprising a nucleotide sequence encoding a subset of CRISPR-cas polypeptides, or functional fragments thereof, from a type-I CRISPR-cas system. In some aspects, a recombinant nucleic acid of the invention comprises a nucleotide sequence encoding three or more Type I Cascade polypeptides having substantial identity to a type I Cascade polypeptide. In still other aspects, the three or more type-I Cascade polypeptides, or functional fragments thereof, can be fused to form a single polypeptide.

In another aspect, a recombinant nucleic acid molecule is provided comprising a nucleotide sequence having substantial similarity to: (a) a nucleotide sequence encoding a Cas6b polypeptide, a nucleotide sequence encoding a Cas8b (Csh1) polypeptide, a nucleotide sequence encoding a Cas7 (Csh2) polypeptide and a nucleotide sequence encoding a Cas5 polypeptide (type I-B); (b) a nucleotide sequence encoding a Cas5d polypeptide, a nucleotide sequence encoding a Cas8c (Csd1) polypeptide, and a nucleotide sequence encoding a Cas7 (Csd2) polypeptide (type I-C); (c) a nucleotide sequence encoding a Cse1 (CasA) polypeptide, a nucleotide sequence encoding a Cse2 (CasB) polypeptide, a nucleotide sequence encoding a Cas7 (CasC) polypeptide, a nucleotide sequence encoding a Cas5 (CasD) polypeptide and a nucleotide sequence encoding a Cas6e (CasE) polypeptide (type I-E); (d) a nucleotide sequence encoding a Cys1 polypeptide, a nucleotide sequence encoding a Cys2 polypeptide, a nucleotide sequence encoding a Cas7 (Cys3) polypeptide and a nucleotide sequence encoding a Cas6f polypeptide (type I-F); (e) a nucleotide sequence encoding a Cas7 (Csa2) polypeptide, a nucleotide sequence encoding a Cas8a1 (Csx13) polypeptide or a Cas8a2 (Csx9) polypeptide, a nucleotide sequence encoding a Cas5 polypeptide, a nucleotide sequence encoding a Csa5 polypeptide, a nucleotide sequence encoding a Csa5 polypeptide, a nucleotide sequence encoding a Cas6a polypeptide, a nucleotide sequence encoding a Cas3' polypeptide, and a nucleotide sequence encoding a Cas3" polypeptide having no nuclease activity (type I-A); and/or (f) a nucleotide sequence encoding a Cas10d (Csc3) polypeptide, a nucleotide sequence encoding a Csc2 polypeptide, a nucleotide sequence encoding a Csc1 polypeptide, a nucleotide sequence encoding a Cas6d polypeptide (type I-D).

A further aspect of the invention provides a recombinant Clustered Regularly Interspaced Short Palindromic Repeats (CRISPR) RNA comprising at least one spacer nucleotide sequence linked at its 3' end to a repeat nucleotide sequence, wherein said at least one spacer nucleotide sequence optionally comprises at its 5' end at least one additional nucleotide.

An additional aspect of the invention provides a recombinant CRISPR array comprising two or more repeat nucleotide sequences and one or more spacer nucleotide sequence(s), wherein each spacer nucleotide sequence in said CRISPR array linked at its 5' end and at its 3' end to a repeat nucleotide sequence.

Another aspect of the invention provides a method for repressing the expression (e.g., reducing transcription) of a target nucleotide sequence, comprising: introducing into an organism a recombinant nucleic acid molecule of this invention and at least one recombinant CRISPR array of this invention, thereby repressing the expression of said target nucleotide sequence in said organism. A further aspect provides a method for modulating (increasing/decreasing) the repression of a target gene, wherein the at least one recombinant CRISPR array introduced into the organism comprises at least two spacer nucleotide sequences each comprising a nucleotide sequence that is complementary to a different target nucleotide sequence from a single target gene, thereby modulating the repression of said target gene. A still further aspect provides a method for repressing the expression of at least two genes in an organism, wherein the at least one recombinant CRISPR array comprises at least two spacer nucleotide sequences each comprising a nucleotide sequence that is complementary to a different target nucleotide sequence from a different target gene, thereby repressing the expression of at least two genes in said organism.

A further aspect of the invention comprises a method of repressing the expression (reducing transcription) of a bacterium or archaeon target nucleotide sequence, comprising: disrupting an endogenous cas3 nucleotide sequence in a bacterium or archaeon, wherein the disrupted endogenous cas3 nucleotide sequence is not present, or is present but not expressed and/or is expressed but non-functional; and introducing into said bacterium or archaeon at least one expression cassette comprising the recombinant CRISPR array of this invention, thereby repressing the expression of said bacterium or target nucleotide sequence. In some embodiments, the method further comprises modulating (increasing/decreasing) the repression (e.g., the reduction in transcription) of the target gene, wherein at least one recombinant CRISPR array comprises at least two spacer nucleotide sequences each comprising a nucleotide sequence that is complementary to a different target nucleotide sequence from a single target gene, thereby modulating the repression of said bacterium or archaeon target gene. A still further aspect comprises repressing the expression of at least two target genes in a bacterium or archaeon, wherein at least one recombinant CRISPR array comprises at least two spacer nucleotide sequences each comprising a nucleotide sequence that is complementary to a different target nucleotide sequence from a different target gene and the bacterium or archaeon comprises a disrupted endogenous cas3 nucleotide sequence, thereby repressing the expression of at least two target genes of said bacterium or archaeon.

Further provided herein are expression cassettes, cells, and kits comprising the recombinant nucleic acid molecules, CRISPR arrays, and/or nucleotide sequences of the invention.

These and other aspects of the invention are set forth in more detail in the description of the invention below.

BRIEF DESCRIPTION OF THE DRAWINGS

FIG. 4A provides the genetic locus of the Type I-E system. The cas3 gene is located upstream of the casABCDE operon encoding the Cascade protein complex. The two downstream genes cas1 and cas2 are involved in spacer acquisition. The native spacer array is composed of identical repeats (white ovals) and intervening spacers (dotted and hatched ovals). FIG. 4B shows the mechanism of DNA destruction based on previous work (Sorek et al. (2013) Annu. Rev. Biochem., 82, 237-266; Barrangou et al. (2007) Science, 315, 1709-17122). The transcribed array is processed into individual crRNAs by Cascade. The spacer portion of the array is then used to identify complementary DNA sequences flanked by a PAM (white circle). DNA binding leads to recruitment of Cas3, which cleaves and degrades the target DNA.

FIG. 5A shows conversion of the Type I-E CRISPR-Cas system into a programmable repressor. The deletion of cas3 and insertion of a constitutive promoter upstream of the Cascade operon allows crRNA-directed DNA binding without cleavage. FIG. 5B shows a putative mechanism of crRNA-directed gene repression. Cascade processes the transcribed CRISPR array into individual crRNAs. The Cascade-crRNA complex then binds target DNA sequences (dotted line) flanked by a PAM (white circle), leading to transcriptional repression.

FIG. 7A shows targeted silencing of plasmid-based GFP expression. The gfp gene is under the control of the lacZ promoter in the low-copy plasmid pUA66-lacZ. Each spacer sequence (medium gray lines) and PAM (black circle) matches the closest strand of the protospacer. RBS, ribosome-binding site. FIG. 7B shows location-dependent and strand-dependent repression of GFP expression. BW25113 Δcas3::cat harboring the medium-copy pUA66-lacZ and the indicated single-spacer plasmid were subjected to flow cytometry analysis following induction with IPTG and L-arabinose. The non-targeting mviM spacer serves as a negative control. Repression is calculated as the ratio of the autofluorescence-subtracted fluorescence for the inducible no-spacer plasmid (pcrRNA.ind) and each single-spacer plasmid. FIG. 7C shows the reversibility of gene silencing. BW25113 Δcas3::cat cells harboring pUA66-lacZ and either the no-spacer plasmid (pcrRNA.ind, white circles) or the T2 single-spacer plasmid (T2, hashmark circles) were pre-induced with only IPTG and switched to both IPTG and L-arabinose (left) or were pre-induced with both IPTG and L-arabinose and switched to only IPTG (right). Following the inducer switch at t=0, the autofluorescence-subtracted fluorescence for individual cells and the turbidity of the culture were followed over time. GFP fluorescence was about 10-fold lower for cells with the targeting plasmid versus the spacer-free plasmid, which was attribute to leaky expression from the $P_{araB}$ promoter under these growth conditions (Afroz et al. (2014) TACS Synth. Biol., 10.1021/sb400162z). Values represent geometric mean and S.E.M. from independent experiments starting with three separate colonies. Error bars in C are smaller than the symbols.

FIG. 8A shows GFP fluorescence of BW25113 (top) or BW25113 ΔCRISPR-Cas (bottom) harboring pUA66-lacZ and the indicated plasmid. Cells were grown for ~3-4 hours in M9 minimal medium containing 0.2% casamino acids, 0.4% glycerol, 0.2% L-arabinose, and 0.1 mM IPTG to $ABS_{600}$~0.2 prior to flow cytometry analysis. The reported values are the absolute fluorescence minus autofluorescence from cells lacking GFP. FIG. 8B shows transformation efficiencies in the presence or absence of cas3. BW25113 Δcas3::cat or NM500 cas3' cells harboring pUA66-lacZ were transformed with 50 ng of the indicated plasmid and plated on LB agar with ampicillin, kanamycin, IPTG, and L-arabinose, and the number of colonies was counted. The differences in transformation efficiencies between strains were attributed to switching cuvette manufacturers. FIG. 8C shows GFP repression following excision of the resistance cassette or in the presence of cas3. BW25113 Δcas3 or NM500 cas3$_+$ cells harboring pUA66-lacZ and pCRISPR.ind, pCRISPR.ind-T2 (T2), pCRISPR.ind-NT2 (NT2), or pCRISPR.ind-mviM (mviM) were grown as indicated for FIG. 8A. Repression is calculated as the ratio of the autofluorescence-subtracted fluorescence for pcrRNA.ind and each single-spacer plasmid. See FIGS. 7A-7C for more information. Values represent the geometric mean and S.E.M. from independent experiments with three colonies.

FIG. 10, panel A shows targeting operons responsible for sugar catabolism. Spacers were designed to target the promoter of each catabolic operon required for growth on its cognate sugar. FIG. 10, panel B shows repression of promoter activity. Repression is calculated as the ratio of the autofluorescence-subtracted fluorescence for the constitutive no-spacer plasmid (pcrRNA.con) and each single-spacer or multi-spacer plasmid. Values represent geometric mean and S.E.M. from independent experiments with three colonies. FIG. 10, panel C shows repression of endogenous genes. MG1655 Δcas3::cat cells harboring the indicated single-spacer plasmid were harvested for total RNA following induction with the cognate sugar and subjected to qRT-PCR analysis. Repression is calculated as the ratio of the relative mRNA levels from the no-spacer plasmid (pcrRNA.con) and the indicated single-spacer plasmid. Values represent the geometric mean and S.E.M. for quadruple technical replicates. FIG. 10, panel D shows targeted suppression of growth. MG1655 Δcas3::cat cells harboring the indicated single-spacer or mufti-spacer plasmid were grown on each sugar as the sole carbon source turbidity was measured after 24 hours of growth. Values represent the geometric mean of the measured $ABS_{600}$ values from independent experiments starting with three separate colonies.

FIG. 11A shows individual $ABS_{600}$ values for the growth assays. The data represent those shown in FIG. 10, panel D with the exception of the last column showing growth in media containing four sugars. Dots represent individual measurements from independent cultures. FIG. 11B provides doubling times of MG1655 Δcas3 cells harboring the constitutive pcrRNA.con plasmid grown in minimal medium with the indicated sugar as the sole carbon source. Values represent the geometric mean and S.E.M. from independent experiments with three colonies.

FIG. 12A shows the construct and the location of the protospacer. See FIG. 7A for more information. FIG. 12B shows that repression is increased by increasing the length of spacer and decreased by decreasing the spacer length.

FIG. 20A shows the *B. halodurans* Type I-C Cascade operon (above) and the CRISPR guiding the Cascade complex to silence GFP expression by targeting the lac promoter (below); FIG. 20B shows fluorescence measurements of cultures by flow cytometry analysis.

DETAILED DESCRIPTION

Figure 1:
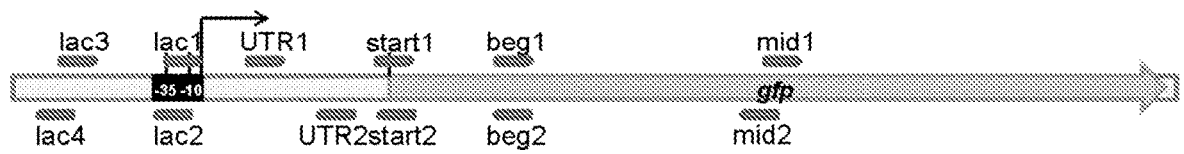
FIG. 1 shows the region of interest in the plasmid pUA66lacZ that encodes fluorescent GFP polypeptide under control of the LacZ promoter. The long arrow indicates the coding region of gfp. The thin black arrow indicates the start of transcription with the −35 and −10 elements of the promoter outlined in black. Each spacer on the top matches the top strand or the coding strand (and therefore, binds the bottom strand or non-coding strand). Similarly each spacer on the bottom matches the bottom strand or the non-coding strand (and therefore, binds the top strand). The established PAM AAG or AGG is located at the 5' end of each protospacer.

The present invention now will be described hereinafter with reference to the accompanying drawings and examples, in which embodiments of the invention are shown. This description is not intended to be a detailed catalog of all the different ways in which the invention may be implemented, or all the features that may be added to the instant invention. For example, features illustrated with respect to one embodiment may be incorporated into other embodiments, and features illustrated with respect to a particular embodiment may be deleted from that embodiment. Thus, the invention contemplates that in some embodiments of the invention, any feature or combination of features set forth herein can be excluded or omitted. In addition, numerous variations and additions to the various embodiments suggested herein will be apparent to those skilled in the art in light of the instant disclosure, which do not depart from the instant invention. Hence, the following descriptions are intended to illustrate some particular embodiments of the invention, and not to exhaustively specify all permutations, combinations and variations thereof.

Unless otherwise defined, all technical and scientific terms used herein have the same meaning as commonly understood by one of ordinary skill in the art to which this invention belongs. The terminology used in the description of the invention herein is for the purpose of describing particular embodiments only and is not intended to be limiting of the invention.

All publications, patent applications, patents and other references cited herein are incorporated by reference in their entireties for the teachings relevant to the sentence and/or paragraph in which the reference is presented.

Unless the context indicates otherwise, it is specifically intended that the various features of the invention described herein can be used in any combination. Moreover, the present invention also contemplates that in some embodiments of the invention, any feature or combination of features set forth herein can be excluded or omitted. To illustrate, if the specification states that a composition comprises components A, B and C, it is specifically intended that any of A, B or C, or a combination thereof, can be omitted and disclaimed singularly or in any combination.

As used in the description of the invention and the appended claims, the singular forms "a," 'an' and "the" are intended to include the plural forms as well, unless the context clearly indicates otherwise.

Also as used herein, "and/or" refers to and encompasses any and all possible combinations of one or more of the associated listed items, as well as the lack of combinations when interpreted in the alternative (or).

The term "about," as used herein when referring to a measurable value such as a dosage or time period and the like refers to variations of ±20%, ±10%, ±5%, ±1%, ±0.5%, or even ±0.1% of the specified amount.

As used herein, phrases such as "between X and Y" and "between about X and Y" should be interpreted to include X and Y. As used herein, phrases such as "between about X and Y" mean "between about X and about Y" and phrases such as "from about X to Y" mean "from about X to about Y."

The term "comprise," "comprises" and "comprising" as used herein, specify the presence of the stated features, integers, steps, operations, elements, and/or components, but do not preclude the presence or addition of one or more other features, integers, steps, operations, elements, components, and/or groups thereof.

As used herein, the transitional phrase "consisting essentially of" means that the scope of a claim is to be interpreted to encompass the specified materials or steps recited in the claim and those that do not materially affect the basic and novel characteristic(s) of the claimed invention. Thus, the term "consisting essentially of" when used in a claim of this invention is not intended to be interpreted to be equivalent to "comprising."

As used herein, "chimeric" refers to a nucleic acid molecule or a polypeptide in which at least two components are derived from different sources (e.g., different organisms, different coding regions).

"Complement" as used herein can mean 100% complementarity or identity with the comparator nucleotide sequence or it can mean less than 100% complementarity (e.g., about 50%, 51%, 52%, 53%, 54%, 55%, 56%, 57%, 58%, 59%, 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99%, and the like, complementarity).

The terms "complementary" or "complementarity," as used herein, refer to the natural binding of polynucleotides under permissive salt and temperature conditions by base-pairing. For example, the sequence "5'-A-G-T-3'" binds to the complementary sequence "5'-T-C-A-3'." Complementarity between two single-stranded molecules may be "partial," in which only some of the nucleotides bind, or it may be complete when total complementarity exists between the single stranded molecules. The degree of complementarity between nucleic acid strands has significant effects on the efficiency and strength of hybridization between nucleic acid strands.

As used herein, "contact," contacting," "contacted," and grammatical variations thereof, refers to placing the components of a desired reaction together under conditions suitable for carrying out the desired reaction (e.g., integration, transformation, site-specific cleavage (nicking, cleaving), amplifying, site specific targeting of a polypeptide of interest and the like). The methods and conditions for carrying out such reactions are well known in the art (See, e.g., Gasiunas et al. (2012) *Proc. Natl. Acad. Sci.* 109: E2579-E2586; M. R. Green and J. Sambrook (2012) Molecular Cloning: A Laboratory Manual. 4th Ed., Cold Spring Harbor Laboratory Press, Cold Spring Harbor, N.Y.).

As used herein, type I Clustered Regularly Interspaced Short Palindromic Repeats (CRISPR)-associated complex for antiviral defense (Cascade) refers to a complex of polypeptides involved in processing of pre-crRNAs and subsequent binding to the target DNA in type I CRISPR-Cas systems. These polypeptides include, but are not limited to, the Cascade polypeptides of type I subtypes I-A, I-B, I-C, 1-D, I-E and I-F. Non-limiting examples of type I-A polypeptides include Cas7 (Csa2), Cas8a1 (Csx13), Cas8a2 (Csx9), Cas5, Csa5, Cas6a, Cas3' and/or a Cas3". Non-limiting examples of type I-B polypeptides include Cas6b, Cas8b (Csh1), Cas7 (Csh2) and/or Cas5. Non-limiting examples of type-IC polypeptides include Cas5d, Cas8c (Csd1), and/or Cas7 (Csd2). Non-limiting examples of type-ID polypeptides include Cas10d (Csc3), Csc2, Csc1, and/or Cas6d. Non-limiting examples of type I-E polypeptides include Cse1 (CasA), Cse2 (CasB), Cas7 (CasC), Cas5 (CasD) and/or Cas6e (CasE). Non-limiting examples of type I-F polypeptides include Cys1, Cys2, Cas7 (Cys3) and/or Cas6f (Csy4). Thus, in some embodiments of this invention, a recombinant nucleic acid comprises, consists essentially of, consists of a nucleotide sequence encoding a subset of type-I Cascade polypeptides that function to process a CRISPR array and subsequently bind to a target DNA using the spacer of the processed CRISPR RNA as a guide.

A"fragment" or "portion" of a nucleotide sequence will be understood to mean a nucleotide sequence of reduced length relative (e.g., reduced by 1, 2, 3, 4, 5, 6, 7, 8, 9, 10, 11, 12, 13, 14, 15, 16, 17, 18, 19, 20 or more nucleotides) to a reference nucleic acid or nucleotide sequence and comprising, consisting essentially of and/or consisting of a nucleotide sequence of contiguous nucleotides identical or almost identical (e.g., 50%, 51%, 52%, 53%, 54%, 55%, 56%, 57%, 58%, 59%, 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99% identical) to the reference nucleic acid or nucleotide sequence. Such a nucleic acid fragment or portion according to the invention may be, where appropriate, included in a larger polynucleotide of which it is a constituent. In some embodiments, a fragment of a polynucleotide can be a fragment that encodes a polypeptide that retains its function (e.g., encodes a fragment of a Type-1 Cascade polypeptide that is reduce in length as compared to the wild type polypeptide but which retains at least one function of a Type-1 Cascade protein (e.g., process CRISPR RNAs, bind DNA and/or form a complex).

As used herein, the term "gene" refers to a nucleic acid molecule capable of being used to produce mRNA, tRNA, rRNA, miRNA, anti-microRNA, regulatory RNA, and the like. Genes may or may not be capable of being used to produce a functional protein or gene product. Genes can include both coding and non-coding regions (e.g., introns, regulatory elements, promoters, enhancers, termination sequences and/or 5' and 3' untranslated regions). A gene may be "isolated" by which is meant a nucleic acid that is substantially or essentially free from components normally found in association with the nucleic acid in its natural state. Such components include other cellular material, culture medium from recombinant production, and/or various chemicals used in chemically synthesizing the nucleic acid.

A"hairpin sequence" as used herein, is a nucleotide sequence comprising hairpins. A hairpin (e.g., stem-loop, fold-back) refers to a nucleic acid molecule having a secondary structure that includes a region of nucleotides that form a single strand that are further flanked on either side by a double stranded-region. Such structures are well known in the art. As known in the art, the double stranded region can comprise some mismatches in base pairing or can be perfectly complementary. In some embodiments, a repeat nucleotide sequence comprises, consists essentially of, consists of a hairpin sequence that is located within said repeat nucleotide sequence (i.e., at least one nucleotide (e.g., one, two, three, four, five, six, seven, eight, nine, ten, or more) of the repeat nucleotide sequence is present on either side of the hairpin that is within said repeat nucleotide sequence).

A"heterologous" or a "recombinant" nucleotide sequence is a nucleotide sequence not naturally associated with a host cell into which it is introduced, including non-naturally occurring multiple copies of a naturally occurring nucleotide sequence.

Different nucleic acids or proteins having homology are referred to herein as "homologues." The term homologue includes homologous sequences from the same and other species and orthologous sequences from the same and other species. "Homology" refers to the level of similarity between two or more nucleic acid and/or amino acid sequences in terms of percent of positional identity (i.e., sequence similarity or identity). Homology also refers to the concept of similar functional properties among different nucleic acids or proteins. Thus, the compositions and methods of the invention further comprise homologues to the nucleotide sequences and polypeptide sequences of this invention. "Orthologous," as used herein, refers to homologous nucleotide sequences and/or amino acid sequences in different species that arose from a common ancestral gene during speciation. A homologue of a nucleotide sequence of this invention has a substantial sequence identity (e.g., at least about 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99%, and/or 100%) to said nucleotide sequence of the invention.

As used herein, hybridization, hybridize, hybridizing, and grammatical variations thereof, refer to the binding of two complementary nucleotide sequences or substantially complementary sequences in which some mismatched base pairs are present. The conditions for hybridization are well known in the art and vary based on the length of the nucleotide sequences and the degree of complementarity between the nucleotide sequences. In some embodiments, the conditions of hybridization can be high stringency, or they can be medium stringency or low stringency depending on the amount of complementarity and the length of the sequences to be hybridized. The conditions that constitute low, medium and high stringency for purposes of hybridization between nucleotide sequences are well known in the art (See, e.g., Gasiunas et al. (2012) *Proc. Natl. Acad. Sci.* 109:E2579-E2586; M. R. Green and J. Sambrook (2012) Molecular Cloning: A Laboratory Manual. 4th Ed., Cold Spring Harbor Laboratory Press, Cold Spring Harbor, N.Y.).

As used herein, the terms "increase," "increasing," "increased," "enhance," "enhanced," "enhancing," and "enhancement" (and grammatical variations thereof) describe an elevation of at least about 5%, 10%, 15%, 20%, 25%, 50%, 75%, 100%, 150%, 200%, 300%, 400%, 500%, 750%, 1000%, 2500%, 5000%, 10,000%, 20,000% or more as compared to a control (e.g., a CRISPR array targeting a particular gene having, for example, more spacer nucleotide sequences targeting different regions of that gene and therefore having increased repression of that gene as compared to a CRISPR array targeting the same gene but having, for example, fewer spacer nucleotide sequences targeting different regions of that gene).

A "native" or "wild type" nucleic acid, nucleotide sequence, polypeptide or amino acid sequence refers to a naturally occurring or endogenous nucleic acid, nucleotide sequence, polypeptide or amino acid sequence. Thus, for example, a "wild type mRNA" is a mRNA that is naturally occurring in or endogenous to the organism. A "homologous" nucleic acid sequence is a nucleotide sequence naturally associated with a host cell into which it is introduced.

Also as used herein, the terms "nucleic acid," "nucleic acid molecule," "nucleic acid construct," "nucleotide sequence" and "polynucleotide" refer to RNA or DNA that is linear or branched, single or double stranded, or a hybrid thereof. The term also encompasses RNA/DNA hybrids. When dsRNA is produced synthetically, less common bases, such as inosine, 5-methylcytosine, 6-methyladenine, hypoxanthine and others can also be used for antisense, dsRNA, and ribozyme pairing. For example, polynucleotides that contain C-5 propyne analogues of uridine and cytidine have been shown to bind RNA with high affinity and to be potent antisense inhibitors of gene expression. Other modifications, such as modification to the phosphodiester backbone, or the 2'-hydroxy in the ribose sugar group of the RNA can also be made. The nucleic acid constructs of the present disclosure can be DNA or RNA, but are preferably DNA. Thus, although the nucleic acid constructs of this invention may be described and used in the form of DNA, depending on the intended use, they may also be described and used in the form of RNA.

A "synthetic" nucleic acid or nucleotide sequence, as used herein, refers to a nucleic acid or nucleotide sequence that is not found in nature but is constructed by the hand of man and as a consequence is not a product of nature.

As used herein, the term "nucleotide sequence" refers to a heteropolymer of nucleotides or the sequence of these nucleotides from the 5' to 3' end of a nucleic acid molecule and includes DNA or RNA molecules, including cDNA, a DNA fragment or portion, genomic DNA, synthetic (e.g., chemically synthesized) DNA, plasmid DNA, mRNA, and anti-sense RNA, any of which can be single stranded or double stranded. The terms "nucleotide sequence" "nucleic acid," "nucleic acid molecule," "oligonucleotide" and "polynucleotide" are also used interchangeably herein to refer to a heteropolymer of nucleotides. Except as otherwise indicated, nucleic acid molecules and/or nucleotide sequences provided herein are presented herein in the 5' to 3' direction, from left to right and are represented using the standard code for representing the nucleotide characters as set forth in the U.S. sequence rules, 37 CFR §§ 1.821-1.825 and the World Intellectual Property Organization (WIPO) Standard ST.25. A "5' region" as used herein can mean the region of a polynucleotide that is nearest the 5' end. Thus, for example, an element in the 5' region of a polynucleotide can be located anywhere from the first nucleotide located at the 5' end of the polynucleotide to the nucleotide located halfway through the polynucleotide. A "3' region" as used herein can mean the region of a polynucleotide that is nearest the 3' end. Thus, for example, an element in the 3' region of a polynucleotide can be located anywhere from the first nucleotide located at the 3' end of the polynucleotide to the nucleotide located halfway through the polynucleotide.

As used herein, the term "percent sequence identity" or "percent identity" refers to the percentage of identical nucleotides in a linear polynucleotide sequence of a reference ("query") polynucleotide molecule (or its complementary strand) as compared to a test ("subject") polynucleotide molecule (or its complementary strand) when the two sequences are optimally aligned. In some embodiments, "percent identity" can refer to the percentage of identical amino acids in an amino acid sequence.

A "target nucleotide sequence" refers to the portion of the target gene that is complementary to the spacer sequence of the recombinant CRISPR array.

As used herein, the terms "reduce," "reduced," "reducing," "reduction," "diminish," "suppress," and "decrease" (and grammatical variations thereof), describe, for example, a decrease of at least about 5%, 10%, 15%, 20%, 25%, 35%, 50%, 75%, 80%, 85%, 90%, 95%, 97%, 98%, 99%, or 100% as compared to a control. In particular embodiments, the reduction results in no or essentially no (i.e., an insignificant amount, e.g., less than about 10% or even less than about 5%) detectable activity or amount. Thus, in some embodiments, a mutation in a Cas3 nuclease can reduce the nuclease activity of the Cas3 by at least about 90%, 95%, 97%, 98%, 99%, or 100% as compared to a control (e.g., wild-type Cas3).

In other embodiments, as used herein, modulating repression can result in a decrease in repression as compared to a control (e.g., a CRISPR array targeting a particular gene having, for example, fewer spacer nucleotide sequences targeting different regions of that gene and therefore having decreased repression of that gene as compared to a CRISPR array targeting the same gene but having, for example, more spacer nucleotide sequences targeting different regions of that gene; or a CRISPR array targeting a particular gene having, for example, a spacer nucleotide sequence with less complementarity for a target sequence having decreased repression of that gene as compared to a CRISPR array, for example, targeting the same sequence with greater complementarity for the target sequence. In further embodiments, a control can also comprise a CRISPR array that does not target any gene, a CRISPR array that targets an entirely unrelated gene or no CRISPR array at all. Thus, in some embodiments, reduced repression as compared to a control can be reduced by about 5% to about 100% (e.g., about 5%, 10%, 15%, 20%, 25%, 35%, 50%, 75%, 80%, 85%, 90%, 95%, 97%, 98%, 99%, or 100%, or any range or value therein). In other embodiments, reduced repression as compared to a control can be reduced by about 1.1 fold to about 10,000 fold (e.g., about 1.1, 1.5, 2, 3, 4, 5, 6, 7, 8, 9, 10, 15, 20, 25, 30, 35, 40, 45, 50, 55, 60, 65, 70, 75, 80, 85, 90, 95, 100, 150, 200, 250, 300, 350, 400, 450, 500, 750, 1000, 1500, 2000, 2500, 3000, 3500, 4000, 4500, 5000, 5500, 6000, 6500, 7000, 7500, 8000, 8500, 9000, 9500, 10,000 fold and the like, and any range or value therein). Thus, in some embodiments, reduced repression as compared to a control can be greater than 1 fold. In other embodiments, reduced repression as compared to a control can be about 2 fold to about 100 fold, about 10 fold to about 100 fold, about 20 fold to about 100 fold, about 20 fold to about 1000 fold, about 50 fold to about 1000 fold, about 100 fold to about 1000 fold, about 500 fold to about 2000 fold, about 500 fold to about 5000 fold, about 2500 fold to about 7500 fold, about 5000 fold to about 10,000 fold, and the like, or any value or range therein.

A "repeat nucleotide sequence" as used herein refers to any known repeat sequence of any wild-type CRISPR Type I loci or can be a synthetic repeat sequence having a different nucleotide sequence than those known in the art but sharing similar structure to that of the wild-type repeat nucleotide sequences of a hairpin structure with a loop region. Thus, in some embodiments, a repeat nucleotide sequence can be identical to or substantially identical to a repeat sequence from a wild-type CRISPR Type I loci. In some embodiments, a repeat nucleotide sequence can comprise a portion of a wild type repeat nucleotide sequence (e.g., 1, 2, 3, 4, 5, 6, 7, 8, 9, 10, 11, 12, 13, 14, 15 or more contiguous nucleotides of a wild type repeat nucleotide sequence). In some embodiments, a repeat sequence comprises, consists essentially of, or consists of at least one nucleotide (e.g., 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 45, 50, 55, 60, 65, 70, 75, 80, 85, 90, 95, 100, or more nucleotides, or any range therein). In other embodiments, a repeat sequence comprises, consists essentially of, or consists of at least about one to about 150 nucleotides. In still other embodiments, a repeat sequence comprises, consists essentially of, or consists of at least about one nucleotide to about 100 nucleotides, or any range or value therein. In further embodiments, a repeat sequence can comprise, consist essentially of, or consist of about 3 nucleotides to about 100 nucleotides, about 10 nucleotides to about 100 nucleotides, about 15 nucleotides to about 100 nucleotides, about 20 to about 50 nucleotides, about 20 to about 40 nucleotides, about 20 to about 30 nucleotides, about 30 to about 40 nucleotides, about 25 to about 40 nucleotides, about 25 to about 45 nucleotides, and/or about 25 to about 50 nucleotides, or any range or value therein. In representative embodiments, a repeat sequence can comprise, consist essentially of, or consist of about 25 nucleotides to about 38 nucleotides, or any range or value therein. In still further embodiments, a repeat sequence can comprise, consist essentially of, or consist of about 29 nucleotides. In yet further embodiments, the repeat sequence can comprise, consist essentially of, or consist of a hairpin only having at least about 20 to 30 nucleotides in length. In still other embodiments, a repeat sequence comprises, consists essentially of, or consists of at least about at least three nucleotides. When more than one spacer nucleotide sequence is present in a CRISPR array, each spacer nucleotide sequence is separated from another by "repeat nucleotide sequences." Thus, in some representative embodiments, a repeat nucleotide sequence linked to the 5' end of a spacer nucleotide sequence can be about three nucleotides in length (e.g., 3, 4, 5, 6, 7, 8, 9, 10 nucleotides or more) and have at least 90% identity (e.g., at least 90%, 91%, 92%, 93%, 94%, 95%, 96%, 97%, 98%, 99%, or more) to the same region (e.g., 5' end) of a wild type repeat nucleotide sequence. In other embodiments, the portion of a repeat sequence linked to the 3' end of a spacer sequence can have three or more nucleotides having at least about 50% or more identity to a wild type repeat nucleotide sequence. In yet further embodiments, a repeat sequence can comprise, consist essentially of, or consist of a hairpin only having at least about 20 to 30 nucleotides in length.

A "CRISPR array" as used herein means a nucleic acid molecule that comprises at least two repeat nucleotide sequence, or a portion thereof, and at least one spacer sequence, wherein one of the two repeat nucleotide sequences, or a portion thereof, is linked to the 5' end of the spacer nucleotide sequence and the other of the two repeat nucleotide sequences, or portion thereof, is linked to the 3' end of the spacer nucleotide sequence. In a recombinant CRISPR array, the combination of repeat nucleotide sequences and spacer nucleotide sequences is synthetic, made by man and not found in nature.

As used herein "sequence identity" refers to the extent to which two optimally aligned polynucleotide or peptide sequences are invariant throughout a window of alignment of components, e.g., nucleotides or amino acids. "Identity" can be readily calculated by known methods including, but not limited to, those described in: Computational Molecular Biology (Lesk, A. M., ed.) Oxford University Press, New York (1988); Biocomputing: Informatics and Genome Projects (Smith, D. W., ed.) Academic Press, New York (1993); Computer Analysis of Sequence Data, Part I (Griffin, A. M., and Griffin, H. G., eds.) Humana Press, New Jersey (1994); Sequence Analysis in Molecular Biology (von Heinje, G., ed.) Academic Press (1987); and Sequence Analysis Primer (Gribskov, M. and Devereux, J., eds.) Stockton Press, New York (1991).

A "spacer nucleotide sequence" as used herein is a nucleotide sequence that is complementary to a target nucleotide sequence on a target gene. In some embodiments, a spacer nucleotide sequence of this invention can be about 15 nucleotides to about 150 nucleotides in length. In other embodiments, a spacer nucleotide sequence of this invention can be about 15 nucleotides to about 100 nucleotides in length (e.g., about 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100 nucleotides or more). In some particular embodiments, a spacer nucleotide sequence can be a length of about 8 to about 150 nucleotides, about 8 to about 100 nucleotides, about 8 to about 50 nucleotides, about 8 to about 40 nucleotides, about 8 to about 30 nucleotides, about 8 to about 25 nucleotides, about 8 to about 20 nucleotides, about 10 to about 50 nucleotides, about 10 to about 40, about 10 to about 30, about 10 to about 25, about 10 to about 20, about 15 to about 50, at least about 8, at least about 10, at least about 15, at least about 20, at least about 25, at least about 30, at least about 35, at least about 40, at least about 50, at least about 60, at least about 70, at least about 80, at least about 90, at least about 100, at least about 110, at least about 120, at least about 130, at least about 140, at least about 150 nucleotides in length, or more, and any value or range therein.

In further embodiments a spacer sequence can be complementary to (fully (100%) complementary) or substantially complementary (substantially complementary) (e.g., at least 50% identical (e.g., 50%, 51%, 52%, 53%, 54%, 55%, 56%, 57%, 58%, 59%, 60%, 61%, 62%, 63%, 64%, 65%, 66%, 67%, 68%, 69%, 70%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99%, or more)) to a target nucleotide sequence of a target gene. Thus, in some embodiments, the spacer nucleotide sequence can have one, two, three, four, or five mismatches that can be contiguous or noncontiguous. In representative embodiments, the spacer nucleotide sequence can have 50% complementarity to a target nucleotide sequence of a target gene. In further embodiments, the spacer nucleotide sequence can have 70% complementarity to a target nucleotide sequence of a target gene. In still further embodiments, the spacer nucleotide sequence can have 80% complementarity to a target nucleotide sequence of a target gene. In other embodiments, the spacer nucleotide sequence can have 85% complementarity, 90% complementarity, 95%, 96%, 97%, 98%, 99% complementarity, and the like, to a target nucleotide sequence of a target gene. In particular embodiments, the spacer nucleotide sequence can be 100% complementary to a target nucleotide sequence of a target gene. In particular embodiments, a spacer sequence has complete complementarity or substantial complementarity over a region of a target nucleotide sequence that is at least about 8 nucleotides to about 150 nucleotides in length. In some embodiments, the 5' region of a spacer nucleotide sequence can be complementary to a target nucleotide sequence while the 3' region of said spacer can be substantially complementary to the said target nucleotide sequence. Accordingly, in some embodiments, the 5' region of a spacer nucleotide sequence (e.g., the first 8 nucleotides at the 5' end, the first 10 nucleotides at the 5' end, the first 15 nucleotides at the 5' end, the first 20 nucleotides at the 5' end) has about 75% identity or more (75% to about 100% identity) to a target nucleotide sequence, while the remainder of the spacer nucleotide sequence can have about 50% or more complementarity to the target nucleotide sequence. Thus, for example, the first 8 nucleotides at the 5' end of a spacer nucleotide sequence can be 100% complementary to the target nucleotide sequence or it can have one or two mutations and therefore can be about 88% identical or about 75% complementary to a target nucleotide sequence, respectively, while the remainder of the spacer nucleotide sequence can be at least about 50% or more complementary to the target nucleotide sequence.

As used herein, the phrase "substantially identical," or "substantial identity" in the context of two nucleic acid molecules, nucleotide sequences or protein sequences, refers to two or more sequences or subsequences that have at least about 50%, 51%, 52%, 53%, 54%, 55%, 56%, 57%, 58%, 59%, 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99%, and/or 100% nucleotide or amino acid residue identity, when compared and aligned for maximum correspondence, as measured using one of the following sequence comparison algorithms or by visual inspection. In particular embodiments, substantial identity can refer to two or more sequences or subsequences that have at least about 70%, at least about 75%, at least about 80%, at least about 85%, at least about 90%, at least about 95, 96, 96, 97, 98, or 99% identity.

For sequence comparison, typically one sequence acts as a reference sequence to which test sequences are compared. When using a sequence comparison algorithm, test and reference sequences are entered into a computer, subsequence coordinates are designated if necessary, and sequence algorithm program parameters are designated. The sequence comparison algorithm then calculates the percent sequence identity for the test sequence(s) relative to the reference sequence, based on the designated program parameters.

Optimal alignment of sequences for aligning a comparison window are well known to those skilled in the art and may be conducted by tools such as the local homology algorithm of Smith and Waterman, the homology alignment algorithm of Needleman and Wunsch, the search for similarity method of Pearson and Lipman, and optionally by computerized implementations of these algorithms such as GAP, BESTFIT, FASTA, and TFASTA available as part of the GCG® Wisconsin Package® (Accelrys Inc., San Diego, Calif.). An "identity fraction" for aligned segments of a test sequence and a reference sequence is the number of identical components which are shared by the two aligned sequences divided by the total number of components in the reference sequence segment, i.e., the entire reference sequence or a smaller defined part of the reference sequence. Percent sequence identity is represented as the identity fraction multiplied by 100. The comparison of one or more polynucleotide sequences may be to a full-length polynucleotide sequence or a portion thereof, or to a longer polynucleotide sequence. For purposes of this invention "percent identity" may also be determined using BLASTX version 2.0 for translated nucleotide sequences and BLASTN version 2.0 for polynucleotide sequences.

Software for performing BLAST analyses is publicly available through the National Center for Biotechnology Information. This algorithm involves first identifying high scoring sequence pairs (HSPs) by identifying short words of length W in the query sequence, which either match or satisfy some positive-valued threshold score T when aligned with a word of the same length in a database sequence. T is referred to as the neighborhood word score threshold (Altschul et al., 1990). These initial neighborhood word hits act as seeds for initiating searches to find longer HSPs containing them. The word hits are then extended in both directions along each sequence for as far as the cumulative alignment score can be increased. Cumulative scores are calculated using, for nucleotide sequences, the parameters M (reward score for a pair of matching residues; always >0) and N (penalty score for mismatching residues; always <0). For amino acid sequences, a scoring matrix is used to calculate the cumulative score. Extension of the word hits in each direction are halted when the cumulative alignment score falls off by the quantity X from its maximum achieved value, the cumulative score goes to zero or below due to the accumulation of one or more negative-scoring residue alignments, or the end of either sequence is reached. The BLAST algorithm parameters W, T, and X determine the sensitivity and speed of the alignment. The BLASTN program (for nucleotide sequences) uses as defaults a wordlength (W) of 11, an expectation (E) of 10, a cutoff of 100, M=5, N=−4, and a comparison of both strands. For amino acid sequences, the BLASTP program uses as defaults a wordlength (W) of 3, an expectation (E) of 10, and the BLOSUM62 scoring matrix (see Henikoff & Henikoff, *Proc. Natl. Acad. Sci. USA* 89: 10915 (1989)).

In addition to calculating percent sequence identity, the BLAST algorithm also performs a statistical analysis of the similarity between two sequences (see, e.g., Karlin & Altschul, *Proc. Nat'l. Acad. Sci. USA* 90: 5873-5787 (1993)). One measure of similarity provided by the BLAST algorithm is the smallest sum probability (P(N)), which provides an indication of the probability by which a match between two nucleotide or amino acid sequences would occur by chance. For example, a test nucleic acid sequence is considered similar to a reference sequence if the smallest sum probability in a comparison of the test nucleotide sequence to the reference nucleotide sequence is less than about 0.1 to less than about 0.001. Thus, in some embodiments of the invention, the smallest sum probability in a comparison of the test nucleotide sequence to the reference nucleotide sequence is less than about 0.001.

Two nucleotide sequences can also be considered to be substantially complementary when the two sequences hybridize to each other under stringent conditions. In some representative embodiments, two nucleotide sequences considered to be substantially complementary hybridize to each other under highly stringent conditions.

"Stringent hybridization conditions" and "stringent hybridization wash conditions" in the context of nucleic acid hybridization experiments such as Southern and Northern hybridizations are sequence dependent, and are different under different environmental parameters. An extensive guide to the hybridization of nucleic acids is found in Tijssen *Laboratory Techniques in Biochemistry and Molecular Biology—Hybridization with Nucleic Acid Probes* part I chapter 2 "Overview of principles of hybridization and the strategy of nucleic acid probe assays" Elsevier, New York (1993). Generally, highly stringent hybridization and wash conditions are selected to be about 5° C. lower than the thermal melting point ($T_m$) for the specific sequence at a defined ionic strength and pH.

The $T_m$ is the temperature (under defined ionic strength and pH) at which 50% of the target sequence hybridizes to a perfectly matched probe. Very stringent conditions are selected to be equal to the $T_m$ for a particular probe. An example of stringent hybridization conditions for hybridization of complementary nucleotide sequences which have more than 100 complementary residues on a filter in a Southern or northern blot is 50% formamide with 1 mg of heparin at 42° C., with the hybridization being carried out overnight. An example of highly stringent wash conditions is 0.1 SM NaCl at 72° C. for about 15 minutes. An example of stringent wash conditions is a 0.2×SSC wash at 65° C. for 15 minutes (see, Sambrook, infra, for a description of SSC buffer). Often, a high stringency wash is preceded by a low stringency wash to remove background probe signal. An example of a medium stringency wash for a duplex of, e.g., more than 100 nucleotides, is 1×SSC at 45° C. for 15 minutes. An example of a low stringency wash for a duplex of, e.g., more than 100 nucleotides, is 4-6×SSC at 40° C. for 15 minutes. For short probes (e.g., about 10 to 50 nucleotides), stringent conditions typically involve salt concentrations of less than about 1.0 M Na ion, typically about 0.01 to 1.0 M Na ion concentration (or other salts) at pH 7.0 to 8.3, and the temperature is typically at least about 30° C. Stringent conditions can also be achieved with the addition of destabilizing agents such as formamide. In general, a signal to noise ratio of 2× (or higher) than that observed for an unrelated probe in the particular hybridization assay indicates detection of a specific hybridization. Nucleotide sequences that do not hybridize to each other under stringent conditions are still substantially identical if the proteins that they encode are substantially identical. This can occur, for example, when a copy of a nucleotide sequence is created using the maximum codon degeneracy permitted by the genetic code.

The following are examples of sets of hybridization/wash conditions that may be used to clone homologous nucleotide sequences that are substantially identical to reference nucleotide sequences of the invention. In one embodiment, a reference nucleotide sequence hybridizes to the "test" nucleotide sequence in 7% sodium dodecyl sulfate (SDS), 0.5 M $NaPO_4$, 1 mM EDTA at 50° C. with washing in 2×SSC, 0.1% SDS at 50° C. In another embodiment, the reference nucleotide sequence hybridizes to the "test" nucleotide sequence in 7% sodium dodecyl sulfate (SDS), 0.5 M $NaPO_4$, 1 mM EDTA at 50° C. with washing in 1×SSC, 0.1% SDS at 50° C. or in 7% sodium dodecyl sulfate (SDS), 0.5 M $NaPO_4$, 1 mM EDTA at 50° C. with washing in 0.5×SSC, 0.1% SDS at 50° C. In still further embodiments, the reference nucleotide sequence hybridizes to the "test" nucleotide sequence in 7% sodium dodecyl sulfate (SDS), 0.5 M $NaPO_4$, 1 mM EDTA at 50° C. with washing in 0.1×SSC, 0.1% SDS at 50° C., or in 7% sodium dodecyl sulfate (SDS), 0.5 M $NaPO_4$, 1 mM EDTA at 50° C. with washing in 0.1×SSC, 0.1% SDS at 65° C.

In some aspects, a target nucleotide sequence is located adjacent to or flanked by a PAM (protospacer adjacent motif). While PAMs are often specific to the particular CRISPR-Cas system, a PAM sequence can be determined by those skilled in the art through established experimental and computational approaches. Thus, for example, experimental approaches include targeting a sequence flanked by all possible nucleotides sequences and identifying sequence members that do not undergo targeting, such as through in vitro cleavage of target DNA (Patanayak et al. 2013. *Nat. Biotechnol.* 31:839-843) or the transformation of target plasmid DNA (Esvelt et al. 2013. *Nat. Methods* 10:1116-1121; Jiang et al. 2013. *Nat. Biotechnol.* 31:233-239). In some aspects, a computational approach can include performing BLAST searches of natural spacers to identify the original target DNA sequences in bacteriophages or plasmids and aligning these sequences to determine conserved sequences adjacent to the target sequence (Briner and Barrangou. 2014. *Appl. Environ. Microbiol.* 80:994-1001; Mojica et al. 2009. *Microbiology* 155:733-740).

Any nucleotide sequence and/or recombinant nucleic acid molecule of this invention can be codon optimized for expression in any species of interest. Codon optimization is well known in the art and involves modification of a nucleotide sequence for codon usage bias using species-specific codon usage tables. The codon usage tables are generated based on a sequence analysis of the most highly expressed genes for the species of interest. When the nucleotide sequences are to be expressed in the nucleus, the codon usage tables are generated based on a sequence analysis of highly expressed nuclear genes for the species of interest. The modifications of the nucleotide sequences are determined by comparing the species specific codon usage table with the codons present in the native polynucleotide sequences. As is understood in the art, codon optimization of a nucleotide sequence results in a nucleotide sequence having less than 100% identity (e.g., 50%, 60%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99%, and the like) to the native nucleotide sequence but which still encodes a polypeptide having the same function as that encoded by the original nucleotide sequence. Thus, in representative embodiments of the invention, the nucleotide sequence and/or recombinant nucleic acid molecule of this invention can be codon optimized for expression in the particular organism/species of interest.

In some embodiments, the recombinant nucleic acids molecules, nucleotide sequences and polypeptides of the invention are "isolated." An "isolated" nucleic acid molecule, an "isolated" nucleotide sequence or an "isolated" polypeptide is a nucleic acid molecule, nucleotide sequence or polypeptide that, by the hand of man, exists apart from its native environment and is therefore not a product of nature. An isolated nucleic acid molecule, nucleotide sequence or polypeptide may exist in a purified form that is at least partially separated from at least some of the other components of the naturally occurring organism or virus, for example, the cell or viral structural components or other polypeptides or nucleic acids commonly found associated with the polynucleotide. In representative embodiments, the isolated nucleic acid molecule, the isolated nucleotide sequence and/or the isolated polypeptide is at least about 1%, 5%, 10%, 20%, 30%, 40%, 50%, 60%, 70%, 80%, 90%, 95%, or more pure.

In other embodiments, an isolated nucleic acid molecule, nucleotide sequence or polypeptide may exist in a non-native environment such as, for example, a recombinant host cell. Thus, for example, with respect to nucleotide sequences, the term "isolated" means that it is separated from the chromosome and/or cell in which it naturally occurs. A polynucleotide is also isolated if it is separated from the chromosome and/or cell in which it naturally occurs in and is then inserted into a genetic context, a chromosome and/or a cell in which it does not naturally occur (e.g., a different host cell, different regulatory sequences, and/or different position in the genome than as found in nature). Accordingly, the recombinant nucleic acid molecules, nucleotide sequences and their encoded polypeptides are "isolated" in that, by the hand of man, they exist apart from their native environment and therefore are not products of nature, however, in some embodiments, they can be introduced into and exist in a recombinant host cell.

In any of the embodiments described herein, the recombinant CRISPR arrays, nucleotide sequences, and/or nucleic acid molecules of the invention can be operatively associated with a variety of promoters, terminators and other regulatory elements for expression in various organisms or cells. Thus, in representative embodiments, at least one promoter and/or terminator can be operably linked to a recombinant nucleic acid molecule and/or a recombinant CRISPR array of the invention. Any promoter useful with this invention can be used and includes, for example, promoters functional with the organism of interest as well as constitutive, inducible, developmentally regulated, tissue-specific/preferred-promoters, and the like, as described herein. A regulatory element as used herein can be endogenous or heterologous. In some embodiments, an endogenous regulatory element derived from the subject organism can be inserted into a genetic context in which it does not naturally occur (e.g., a different position in the genome than as found in nature), thereby producing a recombinant or non-native nucleic acid.

By "operably linked" or "operably associated" as used herein, it is meant that the indicated elements are functionally related to each other, and are also generally physically related. Thus, the term "operably linked" or "operably associated" as used herein, refers to nucleotide sequences on a single nucleic acid molecule that are functionally associated. Thus, a first nucleotide sequence that is operably linked to a second nucleotide sequence, means a situation when the first nucleotide sequence is placed in a functional relationship with the second nucleotide sequence. For instance, a promoter is operably associated with a nucleotide sequence if the promoter effects the transcription or expression of said nucleotide sequence. Those skilled in the art will appreciate that the control sequences (e.g., promoter) need not be contiguous with the nucleotide sequence to which it is operably associated, as long as the control sequences function to direct the expression thereof. Thus, for example, intervening untranslated, yet transcribed, sequences can be present between a promoter and a nucleotide sequence, and the promoter can still be considered "operably linked" to the nucleotide sequence.

A "promoter" is a nucleotide sequence that controls or regulates the transcription of a nucleotide sequence (i.e., a coding sequence) that is operably associated with the promoter. The coding sequence may encode a polypeptide and/or a functional RNA. Typically, a "promoter" refers to a nucleotide sequence that contains a binding site for RNA polymerase and directs the initiation of transcription. In general, promoters are found 5', or upstream, relative to the start of the coding region of the corresponding coding sequence. The promoter region may comprise other elements that act as regulators of gene expression. These include, but are not limited to, a −35 element consensus sequence and a −10 consensus sequence (Simpson. 1979. *Proc. Natl. Acad. Sci. U.S.A.* 76:3233-3237). In mammalian cells, this includes a TATA box consensus sequence, and often a CAAT box consensus sequence (Breathnach and Chambon. 1981. *Annu. Rev. Biochem.* 50:349). In plants, the CAAT box may be substituted by the AGGA box (Messing et al. 1983. in Genetic Engineering of Plants, T. Kosuge, C. Meredith and A. Hollaender (eds.), Plenum Press, pp. 211-227).

Promoters can include, for example, constitutive, inducible, temporally regulated, developmentally regulated, chemically regulated, tissue-preferred and/or tissue-specific promoters for use in the preparation of recombinant nucleic acid molecules, i.e., "chimeric genes" or "chimeric polynucleotides." These various types of promoters are known in the art.

Thus, in some embodiments, repression can be made constitutive, inducible, temporally regulated, developmentally regulated, chemically regulated, tissue-preferred and/or tissue-specific promoters using the recombinant nucleic acid constructs of the invention operatively linked to the appropriate promoter functional in an organism of interest. In representative embodiments, repression can be made reversible using the recombinant nucleic acid constructs of the invention operatively linked to, for example, an inducible promoter functional in an organism of interest.

The choice of promoter will vary depending on the quantitative, temporal and spatial requirements for expression, and also depending on the host cell to be transformed. Promoters for many different organisms are well known in the art. Based on the extensive knowledge present in the art, the appropriate promoter can be selected for the particular host organism of interest. Thus, for example, much is known about promoters upstream of highly constitutively expressed genes in model organisms and such knowledge can be readily accessed and implemented in other systems as appropriate.

Exemplary promoters include, but are not limited to, promoters functional in eukaryotes and prokaryotes including but not limited to, plants, bacteria, fungi, archaea, animals, and mammals. For example, promoters useful with archaea include, but are not limited to, *Haloferax volcanii* tRNA(Lys) promoter (Palmer et al. *J. Bacteriol.* 1995. 177(7):1844-1849), *Pyrococcus furiosus* gdh promoter (Waege et al. 2010. *Appl. Environ. Microbiol.* 76:3308-3313), *Sulfolobus sulfataricus* 16S/23S rRNA gene core promoter (DeYoung et al. 2011. *FEMS Microbiol. Lett.* 321:92-99).

Exemplary promoters useful with yeast can include a promoter from phosphoglycerate kinase (PGK), glyceraldehyde-3-phosphate dehydrogenase (GAP), triose phosphate isomerase (TPI), galactose-regulon (GAL1, GAL10), alcohol dehydrogenase (ADH1, ADH2), phosphatase (PHO5), copper-activated metallothionine (CUP1), MFα1, PGK/α2 operator, TPI/α2 operator, GAP/GAL, PGK/GAL, GAP/ADH2, GAP/PHO5, iso-1-cytochrome c/glucocorticoid response element (CYC/GRE), phosphoglycerate kinase/angrogen response element (PGK/ARE), transcription elongation factor EF-1α (TEF1), triose phosphate dehydrogenase (TDH3), phosphoglycerate kinase 1 (PGK1), pyruvate kinase 1 (PYK1), and/or hexose transporter (HXT7) (See, Romanos et al. *Yeast* 8:423-488 (1992); and Partow et al. *Yeast* 27:955-964 (2010)).

In additional embodiments, a promoter useful with bacteria can include, but is not limited to, L-arabinose inducible (araBAD, $P_{BAD}$) promoter, any lac promoter, L-rhamnose inducible (rhaP$_{BAD}$) promoter, T7 RNA polymerase promoter, trc promoter, tac promoter, lambda phage promoter ($p_L$, $p_L$-9G-50), anhydrotetracycline-inducible (tetA) promoter, trp, lpp, phoA, recA, proU, cst-1, cadA, nar, lpp-lac, cspA, T7-lac operator, T3lac operator, T4 gene 32, T5-lac operator, nprM-lac operator, Vhb, Protein A, corynebacterial-*E. coli* like promoters, thr, hom, diphtheria toxin promoter, sig A, sig B, nusG, SoxS, katb, α-amylase (Pamy), Ptms, P43 (comprised of two overlapping RNA polymerase a factor recognition sites, σA, σB), Ptms, P43, rplK-rplA, ferredoxin promoter, and/or xylose promoter. (See, K. Terpe *Appl. Microbiol, Biotechnol.* 72:211-222 (2006); Hannig et al. Trends in Biotechnology 16:54-60 (1998); and Srivastava Protein Expr Purif 40:221-229 (2005)).

Non-limiting examples of a promoter functional in a plant include the promoter of the RubisCo small subunit gene 1 (PrbcS1), the promoter of the actin gene (Pactin), the promoter of the nitrate reductase gene (Pnr) and the promoter of duplicated carbonic anhydrase gene 1 (Pdca1) (See, Walker et al. *Plant Cell Rep.* 23:727-735 (2005); Li et al. *Gene* 403:132-142 (2007); Li et al. *Mol Biol. Rep.* 37:1143-1154 (2010)). PrbcS1 and Pactin are constitutive promoters and Pnr and Pdca1 are inducible promoters. Pnr is induced by nitrate and repressed by ammonium (Li et al. *Gene* 403:132-142 (2007)) and Pdca1 is induced by salt (Li et al. *Mol Biol. Rep.* 37:1143-1154 (2010)).

Examples of constitutive promoters useful for plants include, but are not limited to, cestrum virus promoter (cmp) (U.S. Pat. No. 7,166,770), the rice actin 1 promoter (Wang et al. (1992) *Mol. Cell. Biol.* 12:3399-3406; as well as U.S. Pat. No. 5,641,876), CaMV 35S promoter (Odell et al. (1985) *Nature* 313:810-812), CaMV 19S promoter (Lawton et al. (1987) *Plant Mol. Biol.* 9:315-324), nos promoter (Ebert et al. (1987) *Proc. Natl. Acad. Sci USA* 84:5745-5749), Adh promoter (Walker et al. (1987) *Proc. Natl. Acad. Sci. USA* 84:6624-6629), sucrose synthase promoter (Yang & Russell (1990) *Proc. Natl. Acad. Sci. USA* 87:4144-4148), and the ubiquitin promoter. The constitutive promoter derived from ubiquitin accumulates in many cell types. Ubiquitin promoters have been cloned from several plant species for use in transgenic plants, for example, sunflower (Binet et al., 1991. *Plant Science* 79: 87-94), maize (Christensen et al., 1989. *Plant Molec. Biol.* 12: 619-632), and *Arabidopsis* (Norris et al. 1993. *Plant Molec. Biol.* 21:895-906). The maize ubiquitin promoter (UbiP) has been developed in transgenic monocot systems and its sequence and vectors constructed for monocot transformation are disclosed in the patent publication EP 0 342 926. The ubiquitin promoter is suitable for the expression of the nucleotide sequences of the invention in transgenic plants, especially monocotyledons. Further, the promoter expression cassettes described by McElroy et al. (*Mol. Gen. Genet.* 231: 150-160 (1991)) can be easily modified for the expression of the nucleotide sequences of the invention and are particularly suitable for use in monocotyledonous hosts.

In some embodiments, tissue specific/tissue preferred promoters can be used for expression of a heterologous polynucleotide in a plant cell. Non-limiting examples of tissue-specific promoters include those associated with genes encoding the seed storage proteins (such as s-conglycinin, cruciferin, napin and phaseolin), zein or oil body proteins (such as oleosin), or proteins involved in fatty acid biosynthesis (including acyl carrier protein, stearoyl-ACP desaturase and fatty acid desaturases (fad 2-1)), and other nucleic acids expressed during embryo development (such as Bce4, see, e.g., Kridl et al. (1991) Seed Sci. Res. 1:209-219; as well as EP Patent No. 255378). Additional examples of plant tissue-specific/tissue preferred promoters include, but are not limited to, the root hair-specific cis-elements (RHEs) (Kim et al. *The Plant Cell* 18:2958-2970 (2006)), the root-specific promoters RCc3 (Jeong et al. *Plant Physiol.* 153:185-197 (2010)) and RB7 (U.S. Pat. No. 5,459, 252), the lectin promoter (Lindstrom et al. (1990) Der. Genet. 11:160-167; and Vodkin (1983) *Prog. Clin. Biol. Res.* 138:87-98), corn alcohol dehydrogenase 1 promoter (Dennis et al. (1984) *Nucleic Acids Res.* 12:3983-4000), and/or S-adenosyl-L-methionine synthetase (SAMS) (Vander Mijnsbrugge et al. (1996) *Plant and Cell Physiology*, 37(8): 1108-1115).

In addition, promoters functional in chloroplasts can be used. Non-limiting examples of such promoters include the bacteriophage T3 gene 9 5' UTR and other promoters disclosed in U.S. Pat. No. 7,579,516. Other promoters useful with the invention include but are not limited to the S-E9 small subunit RuBP carboxylase promoter and the Kunitz trypsin inhibitor gene promoter (Kti3).

In some embodiments of the invention, inducible promoters can be used. Thus, for example, chemical-regulated promoters can be used to modulate the expression of a gene in an organism through the application of an exogenous chemical regulator. Regulation of the expression of nucleotide sequences of the invention via promoters that are chemically regulated enables the RNAs and/or the polypeptides of the invention to be synthesized only when, for example, a crop of plants are treated with the inducing chemicals. Depending upon the objective, the promoter may be a chemical-inducible promoter, where application of a chemical induces gene expression, or a chemical-repressible promoter, where application of the chemical represses gene expression. In some aspects, a promoter can also include a light-inducible promoter, where application of specific wavelengths of light induce gene expression (Levskaya at al. 2005. *Nature* 438:441-442). In other aspects, a promoter can include a light-repressible promoter, where application of specific wavelengths of light repress gene expression (Ye et al. 2011. *Science* 332:1565-1568).

Chemical inducible promoters useful with plants are known in the art and include, but are not limited to, the maize In2-2 promoter, which is activated by benzenesulfonamide herbicide safeners, the maize GST promoter, which is activated by hydrophobic electrophilic compounds that are used as pre-emergent herbicides, and the tobacco PR-1a promoter, which is activated by salicylic acid (e.g., the PR1a system), steroid-responsive promoters (see, e.g., the glucocorticoid-inducible promoter in Schena et al. (1991) *Proc. Natl. Acad. Sci. USA* 88, 10421-10425 and McNellis et al. (1998) *Plant J.* 14, 247-257) and tetracycline-inducible and tetracycline-repressible promoters (see, e.g., Gatz at al. (1991) *Mol. Gen. Genet.* 227, 229-237, and U.S. Pat. Nos. 5,814,618 and 5,789,156, Lac repressor system promoters, copper-inducible system promoters, salicylate-inducible system promoters (e.g., the PR1a system), glucocorticoid-inducible promoters (Aoyama et al. (1997) *Plant J.* 11:605-612), and ecdysone-inducible system promoters.

In some particular embodiments, promoters useful with algae include, but are not limited to, the promoter of the RubisCo small subunit gene 1 (PrbcS1), the promoter of the actin gene (Pactin), the promoter of the nitrate reductase gene (Pnr) and the promoter of duplicated carbonic anhydrase gene 1 (Pdca1) (See, Walker et al. *Plant Cell Rep.* 23:727-735 (2005); Li et al. *Gene* 403:132-142 (2007); Li et al. *Mol Biol. Rep.* 37:1143-1154 (2010)), the promoter of the $\sigma^{70}$-type plastid rRNA gene (Prm), the promoter of the psbA gene (encoding the photosystem-II reaction center protein D1) (PpsbA), the promoter of the psbD gene (encoding the photosystem-II reaction center protein D2) (PpsbD), the promoter of the psaA gene (encoding an apoprotein of photosystem 1) (PpsaA), the promoter of the ATPase alpha subunit gene (PatpA), and promoter of the RuBisCo large subunit gene (PrbcL), and any combination thereof (See, e.g., De Cosa et al. *Nat. Biotechnol.* 19:71-74 (2001); Daniell et al. *BMC Biotechnol.* 9:33 (2009); Muto et al. *BMC Biotechnol.* 9:26 (2009); Surzycki et al. *Biologicals* 37:133-138 (2009)).

In further embodiments, a promoter useful with this invention can include, but is not limited to, pol III promoters such as the human U6 small nuclear promoter (U6) and the human H1 promoter (H1) (Mäkinen et al. *J Gene Med.* 8(4):433-41 (2006)), and pol II promoters such as the CMV (Cytomegalovirus) promoter (Barrow et al. *Methods in Mol. Biol.* 329:283-294 (2006)), the SV40 (Simian Virus 40)-derived initial promoter, the EF-1α (Elongation Factor-1α) promoter, the Ubc (Human Ubiquitin C) promoter, the PGK (Murine Phosphoglycerate Kinase-1) promoter and/or constitutive protein gene promoters such as the β-actin gene promoter, the tRNA promoter and the like.

Moreover, tissue-specific regulated nucleic acids and/or promoters as well as tumor-specific regulated nucleic acids and/or promoters have been reported. Thus, in some embodiments, tissue-specific or tumor-specific promoters can be used. Some reported tissue-specific nucleic acids include, without limitation, B29 (B cells), CD14 (monocytic cells), CD43 (leukocytes and platelets), CD45 (hematopoietic cells), CD68 (macrophages), desmin (muscle), elastase-1 (pancreatic acinar cells), endoglin (endothelial cells), fibronectin (differentiating cells and healing tissues), FLT-1 (endothelial cells), GFAP (astrocytes), GPIIb (megakaryocytes), ICAM-2 (endothelial cells), INF-β (hematopoietic cells), Mb (muscle), NPHSI (podocytes), OG-2 (osteoblasts, SP-B (lungs), SYN1 (neurons), and WASP (hematopoietic cells). Some reported tumor-specific nucleic acids and promoters include, without limitation, AFP (hepatocellular carcinoma), CCKAR (pancreatic cancer), CEA (epithelial cancer), c-erbB2 (breast and pancreatic cancer), COX-2, CXCR4, E2F-1, HE4, LP, MUC1 (carcinoma), PRC1 (breast cancer), PSA (prostate cancer), RRM2 (breast cancer), survivin, TRP1 (melanoma), and TYR (melanoma).

In some embodiments, inducible promoters can be used in mammalian cells. Examples of inducible promoters include, but are not limited to, tetracycline repressor system promoters, Lac repressor system promoters, copper-inducible system promoters, salicylate-inducible system promoters (e.g., the PR1a system), glucocorticoid-inducible promoters, and ecdysone-inducible system promoters.

In some embodiments, a nucleic acid construct of the invention can be an "expression cassette" or can be comprised within an expression cassette. As used herein, "expression cassette" means a recombinant nucleic acid molecule comprising a nucleotide sequence of interest (e.g., the recombinant nucleic acid molecules and CRISPR arrays of the invention), wherein said nucleotide sequence is operably associated with at least a control sequence (e.g., a promoter). Thus, some aspects of the invention provide expression cassettes designed to express the nucleotides sequences of the invention (e.g., the recombinant nucleic acid molecules and/or the recombinant CRISPR arrays).

An expression cassette comprising a nucleotide sequence of interest may be chimeric, meaning that at least one of its components is heterologous with respect to at least one of its other components. An expression cassette may also be one that is naturally occurring but has been obtained in a recombinant form useful for heterologous expression.

An expression cassette also can optionally include a transcriptional and/or translational termination region (i.e., termination region) that is functional in the selected host cell. A variety of transcriptional terminators are available for use in expression cassettes and are responsible for the termination of transcription beyond the heterologous nucleotide sequence of interest and correct mRNA polyadenylation. The termination region may be native to the transcriptional initiation region, may be native to the operably linked nucleotide sequence of interest, may be native to the host cell, or may be derived from another source (i.e., foreign or heterologous to the promoter, to the nucleotide sequence of interest, to the host, or any combination thereof). In some embodiments of this invention, terminators can be operably linked to the recombinant nucleic acid molecule and CRISPR array of the invention.

An expression cassette also can include a nucleotide sequence for a selectable marker, which can be used to select a transformed host cell. As used herein, "selectable marker" means a nucleotide sequence that when expressed imparts a distinct phenotype to the host cell expressing the marker and thus allows such transformed cells to be distinguished from those that do not have the marker. Such a nucleotide sequence may encode either a selectable or screenable marker, depending on whether the marker confers a trait that can be selected for by chemical means, such as by using a selective agent (e.g., an antibiotic and the like), or on whether the marker is simply a trait that one can identify through observation or testing, such as by screening (e.g., fluorescence). Of course, many examples of suitable selectable markers are known in the art and can be used in the expression cassettes described herein.

In addition to expression cassettes, the nucleic acid molecules and nucleotide sequences described herein can be used in connection with vectors. The term "vector" refers to a composition for transferring, delivering or introducing a nucleic acid (or nucleic acids) into a cell. A vector comprises a nucleic acid molecule comprising the nucleotide sequence(s) to be transferred, delivered or introduced. Vectors for use in transformation of host organisms are well known in the art. Non-limiting examples of general classes of vectors include but are not limited to a viral vector, a plasmid vector, a phage vector, a phagemid vector, a cosmid vector, a fosmid vector, a bacteriophage, an artificial chromosome, or an *Agrobacterium* binary vector in double or single stranded linear or circular form which may or may not be self transmissible or mobilizable. A vector as defined herein can transform prokaryotic or eukaryotic host either by integration into the cellular genome or exist extrachromosomally (e.g. autonomous replicating plasmid with an origin of replication). Additionally included are shuttle vectors by which is meant a DNA vehicle capable, naturally or by design, of replication in two different host organisms, which may be selected from actinomycetes and related species, bacteria and eukaryotic (e.g. higher plant, mammalian, yeast or fungal cells). In some representative embodiments, the nucleic acid in the vector is under the control of, and operably linked to, an appropriate promoter or other regulatory elements for transcription in a host cell. The vector may be a bi-functional expression vector which functions in multiple hosts. In the case of genomic DNA, this may contain its own promoter or other regulatory elements and in the case of cDNA this may be under the control of an appropriate promoter or other regulatory elements for expression in the host cell. Accordingly, the nucleic acid molecules of this invention (e.g., the recombinant nucleic acid molecules and/or the recombinant CRISPR arrays) and/or expression cassettes comprising the nucleic acid molecules of this invention can be comprised in vectors as described herein and as known in the art.

As used herein, the terms "contacting," "introducing," "delivering," and "administering" refer to a process by which the recombinant nucleic acid molecules and/or recombinant CRISPR arrays of the present invention are delivered to a cell or a subject, in order to repress expression or modify the repression of expression of one or more target genes in the cell or subject. The recombinant nucleic acid molecules and/or recombinant CRISPR arrays may be administered in a number of ways, including, but not limited to, direct introduction into a cell (i.e., intracellularty) and/or extracellular introduction into a cavity, interstitial space, regional circulation feeding a particular organ or tissue, or into a tissue or structure (e.g., a tumor).

"Introducing," "introduce," "introduced" (and grammatical variations thereof) in the context of a polynucleotide of interest means presenting the nucleotide sequence of interest to the host organism or cell of said organism (e.g., host cell) in such a manner that the nucleotide sequence gains access to the interior of a cell and includes such terms as transformation," "transfection," and/or "transduction." Where more than one nucleotide sequence is to be introduced these nucleotide sequences can be assembled as part of a single polynucleotide or nucleic acid construct, or as separate polynucleotide or nucleic acid constructs, and can be located on the same or different expression constructs or transformation vectors. Accordingly, these polynucleotides can be introduced into cells in a single transformation event, in separate transformation events, or, for example, they can be incorporated into an organism by conventional breeding protocols. Thus, in some aspects of the present invention one or more nucleic acid constructs of this invention (e.g., a recombinant nucleic acid molecule, a recombinant CRISPR array, and the like) can be introduced into a host organism or a cell of said host organism.

The terms "transformation," "transfection," and "transduction" as used herein refer to the introduction of a heterologous nucleic acid into a cell. Such introduction into a cell may be stable or transient. Thus, in some embodiments, a host cell or host organism is stably transformed with a nucleic acid molecule of the invention. In other embodiments, a host cell or host organism is transiently transformed with a recombinant nucleic acid molecule of the invention.

"Transient transformation" in the context of a polynucleotide means that a polynucleotide is introduced into the cell and does not integrate into the genome of the cell.

By "stably introducing" or "stably introduced" in the context of a polynucleotide introduced into a cell is intended that the introduced polynucleotide is stably incorporated into the genome of the cell, and thus the cell is stably transformed with the polynucleotide.

"Stable transformation" or "stably transformed" as used herein means that a nucleic acid molecule is introduced into a cell and integrates into the genome of the cell. As such, the integrated nucleic acid molecule is capable of being inherited by the progeny thereof, more particularly, by the progeny of multiple successive generations. "Genome" as used herein also includes the nuclear, the plasmid and the plastid genome, and therefore includes integration of the nucleic acid construct into, for example, the chloroplast or mitochondrial genome. Stable transformation as used herein can also refer to a transgene that is maintained extrachromasomally, for example, as a minichromosome or a plasmid.

Transient transformation may be detected by, for example, an enzyme-linked immunosorbent assay (ELISA) or Western blot, which can detect the presence of a peptide or polypeptide encoded by one or more transgene introduced into an organism. Stable transformation of a cell can be detected by, for example, a Southern blot hybridization assay of genomic DNA of the cell with nucleic acid sequences which specifically hybridize with a nucleotide sequence of a transgene introduced into an organism (e.g., a plant, a mammal, an insect, an archaea, a bacterium, and the like). Stable transformation of a cell can be detected by, for example, a Northern blot hybridization assay of RNA of the cell with nucleic acid sequences which specifically hybridize with a nucleotide sequence of a transgene introduced into a plant or other organism. Stable transformation of a cell can also be detected by, e.g., a polymerase chain reaction (PCR) or other amplification reactions as are well known in the art, employing specific primer sequences that hybridize with target sequence(s) of a transgene, resulting in amplification of the transgene sequence, which can be detected according to standard methods Transformation can also be detected by direct sequencing and/or hybridization protocols well known in the art.

Accordingly, in some embodiments, the nucleotide sequences, constructs, expression cassettes can be expressed transiently and/or they can be stably incorporated into the genome of the host organism.

A recombinant nucleic acid molecule and/or CRISPR array of the invention can be introduced into a cell by any method known to those of skill in the art. Exemplary methods of transformation or transfection include biological methods using viruses and bacteria (e.g., *Agrobacterium*), physicochemical methods such as electroporation, floral dip methods, particle or ballistic bombardment, microinjection, whiskers technology, pollen tube transformation, calcium-phosphate-mediated transformation, nanoparticle-mediated transformation, polymer-mediated transformation including cyclodextrin-mediated and polyethyleneglycol-mediated transformation, sonication, infiltration, as well as any other electrical, chemical, physical (mechanical) and/or biological mechanism that results in the introduction of nucleic acid into a cell, including any combination thereof.

In some embodiments of the invention, transformation of a cell comprises nuclear transformation. In other embodiments, transformation of a cell comprises plastid transformation (e.g., chloroplast transformation). In still further embodiments, the recombinant nucleic acid molecule or CRISPR array of the invention can be introduced into a cell via conventional breeding techniques.

Procedures for transforming both eukaryotic and prokaryotic organisms are well known and routine in the art and are described throughout the literature (See, for example, Jiang et al. 2013. *Nat. Biotechnol.* 31:233-239; Ran et al. *Nature Protocols* 8:2281-2308 (2013))

A nucleotide sequence therefore can be introduced into a host organism or its cell in any number of ways that are well known in the art. The methods of the invention do not depend on a particular method for introducing one or more nucleotide sequences into the organism, only that they gain access to the interior of at least one cell of the organism. Where more than one nucleotide sequence is to be introduced, they can be assembled as part of a single nucleic acid construct, or as separate nucleic acid constructs, and can be located on the same or different nucleic acid constructs. Accordingly, the nucleotide sequences can be introduced into the cell of interest in a single transformation event, or in separate transformation events, or, alternatively, where relevant, a nucleotide sequence can be incorporated into a plant, as part of a breeding protocol.

The present invention is directed to compositions and methods for targeted gene silencing or more particularly for repressing expression and/or modulating the repression of expression in an organism of interest or cell thereof or in a cell free system.

Accordingly, in one aspect of the invention, a recombinant nucleic acid molecule is provided that comprises a nucleotide sequence encoding a subset of type I CRISPR-Cas polypeptides involved in the CRISPR associated complex for antiviral defense (Cascade) process. The type-I Cascade polypeptides that are useful with this invention process CRISPR arrays to produce a processed RNA that is then used to bind the complex to a DNA that is complementary to a spacer in the processed RNA. In some embodiments, the Cascade polypeptides that are involved in acquisition are not comprised in a nucleic acid molecule of the invention (e.g., Cas1, Cas2). Any such subset of Cascade polypeptides from a type I CRISPR-cas system known in the art or those later discovered can be comprised in a recombinant nucleic acid molecule of this invention. Such polypeptides can be identified, for example, via BLAST searching.

Thus, in some aspects of the invention, a recombinant nucleic acid molecule is provided comprising, consisting essentially of, or consisting of a nucleotide sequence encoding a subset of CRISPR-Cas polypeptides from a type I CRISPR-Cas system. In particular embodiments, a recombinant nucleic acid of the invention comprises, consists essentially of, consists of a nucleotide sequence encoding three or more type I Cascade polypeptides having substantial identity to a wild type I Cascade polypeptide (e.g., at least 80%; about 80%, 85%, 90%, 95%, 96%, 97%, 98%, 99%, 100%, and any range or value therein). In some embodiments, a recombinant nucleic acid of the invention comprises, consists essentially of, or consists of a nucleotide sequence encoding functional fragments of said three or more type-I Cascade polypeptides. As used herein, a functional fragment of a type I Cascade polypeptide means a polypeptide reduced in length as compared to the wild type polypeptide but which can still function as a type I Cascade protein (e.g., process CRISPR RNAs, bind DNA and/or form a complex). In further embodiments, a recombinant nucleic acid of the invention can comprise, consist essentially of, or consist of a nucleotide sequence encoding a fusion of two or more type I Cascade polypeptides, or functional fragments thereof, or any combination thereof.

In a representative embodiment, a recombinant nucleic acid molecule is provided comprising, consisting essentially of, or consisting of a nucleotide sequence having substantial identity to: (a) a nucleotide sequence encoding a Cas6b polypeptide, a nucleotide sequence encoding a Cas8b (Csh1) polypeptide, a nucleotide sequence encoding a Cas7 (Csh2) polypeptide and a nucleotide sequence encoding a Cas5 polypeptide (Type I-B); (b) a nucleotide sequence encoding a Cas5d polypeptide, a nucleotide sequence encoding a Cas8c (Csd1) polypeptide, and a nucleotide sequence encoding a Cas7 (Csd2) polypeptide (Type I-C); (c) a nucleotide sequence encoding a Cse1 (CasA) polypeptide, a nucleotide sequence encoding a Cse2 (CasB) polypeptide, a nucleotide sequence encoding a Cas7 (CasC) polypeptide, a nucleotide sequence encoding a Cas5 (CasD) polypeptide and a nucleotide sequence encoding a Cas6e (CasE) polypeptide (Type I-E); (d) a nucleotide sequence encoding a Cys1 polypeptide, a nucleotide sequence encoding a Cys2 polypeptide, a nucleotide sequence encoding a Cas7 (Cys3) polypeptide and a nucleotide sequence encoding a Cas6f polypeptide (Type I-F); (e) a nucleotide sequence encoding a Cas7 (Csa2) polypeptide, a nucleotide sequence encoding a Cas8a1 (Csx13) polypeptide or a Cas8a2 (Csx9) polypeptide, a nucleotide sequence encoding a Cas5 polypeptide, a nucleotide sequence encoding a Csa5 polypeptide, a nucleotide sequence encoding a Cas6a polypeptide, a nucleotide sequence encoding a Cas3' polypeptide, and a nucleotide sequence encoding a Cas3" polypeptide having no nuclease activity (Type I-A); and/or (f) a nucleotide sequence encoding a Cas10d (Csc3) polypeptide, a nucleotide sequence encoding a Csc2 polypeptide, a nucleotide sequence encoding a Csc1 polypeptide, a nucleotide sequence encoding a Cas6d polypeptide (Type I-D).

In representative embodiments of the invention, a nucleotide sequence encoding a Cas6b polypeptide includes, but is not limited to, a nucleotide sequence encoding the amino acid sequence of SEQ ID NO:18, SEQ ID NO:19 and/or SEQ ID NO:20; a nucleotide sequence encoding a Cas8b (Csh1) polypeptide includes, but is not limited to, a nucleotide sequence encoding the amino acid sequence of SEQ ID NO:21 and/or SEQ ID NO:22; a nucleotide sequence encoding a Cas7 (Csh2) polypeptide includes, but is not limited to, a nucleotide sequence encoding the amino acid sequence of SEQ ID NO:23 and/or SEQ ID NO:24; a nucleotide sequence encoding a Cas5 polypeptide includes, but is not limited to, a nucleotide sequence encoding the amino acid sequence of SEQ ID NO:25 and/or SEQ ID NO:26; a nucleotide sequence encoding a Cas5d polypeptide includes, but is not limited to, a nucleotide sequence encoding the amino acid sequence of SEQ ID NO:27 and/or SEQ ID NO:28; a nucleotide sequence encoding a Cas8c (Csd1) polypeptide includes, but is not limited to, a nucleotide sequence encoding the amino acid sequence of SEQ ID NO:29 and/or SEQ ID NO:30; a nucleotide sequence encoding a Cas7 (Csd2) polypeptide includes, but is not limited to, a nucleotide sequence encoding the amino acid sequence of SEQ ID NO:31 and/or SEQ ID NO:32; a nucleotide sequence encoding a Cse1 (CasA) polypeptide includes, but is not limited to, a nucleotide sequence encoding the amino acid sequence of SEQ ID NO:41 and/or SEQ ID NO:42; a nucleotide sequence encoding a Cse2 (CasB) polypeptide includes, but is not limited to, a nucleotide sequence encoding the amino acid sequence of SEQ ID NO:43 and/or SEQ ID NO:44; a nucleotide sequence encoding a Cas7 (CasC) includes, but is not limited to, a nucleotide sequence encoding the amino acid sequence of SEQ ID NO:45 and/or SEQ ID NO:46; a nucleotide sequence encoding a Cas5 (CasD) polypeptide includes, but is not limited to, a nucleotide sequence encoding the amino acid sequence of SEQ ID NO:47 and/or SEQ ID NO:48; a nucleotide sequence encoding a Cas6e (CasE) polypeptide includes, but is not limited to, a nucleotide sequence encoding the amino acid sequence of SEQ ID NO:49 and/or SEQ ID NO:50; a nucleotide sequence encoding a Cys1 polypeptide includes, but is not limited to, a nucleotide sequence encoding the amino acid sequence of SEQ ID NO:51 and/or SEQ ID NO:52; a nucleotide sequence encoding a Cys2 polypeptide includes, but is not limited to, a nucleotide sequence encoding the amino acid sequence of SEQ ID NO:53 and/or SEQ ID NO:54; a nucleotide sequence encoding a Cas7 (Cys3) polypeptide includes, but is not limited to, a nucleotide sequence encoding the amino acid sequence of SEQ ID NO:55 and/or SEQ ID NO:56; a nucleotide sequence encoding a Cas6f polypeptide includes, but is not limited to, a nucleotide sequence encoding the amino acid sequence of SEQ ID NO:57 and/or SEQ ID NO:58; a nucleotide sequence encoding a Cas7 (Csa2) polypeptide includes, but is not limited to, a nucleotide sequence encoding the amino acid sequence of SEQ ID NO:1, SEQ ID NO:2 and/or SEQ ID NO:3; a nucleotide sequence encoding a Cas8a1 (Csx13) polypeptide includes, but is not limited to, a nucleotide sequence encoding the amino acid sequence of SEQ ID NO:4; a nucleotide sequence encoding a Cas8a2 (Csx9) polypeptide includes, but is not limited to, a nucleotide sequence encoding the amino acid sequence of SEQ ID NO: 5, and/or SEQ ID NO: 6; a nucleotide sequence encoding a Cas5 polypeptide includes, but is not limited to, a nucleotide sequence encoding the amino acid sequence of SEQ ID NO:7, SEQ ID NO:8 and/or SEQ ID NO:9; a nucleotide sequence encoding a Cas6a polypeptide includes, but is not limited to, a nucleotide sequence encoding the amino acid sequence of SEQ ID NO:10 and/or SEQ ID NO:11; a nucleotide sequence encoding a Cas3' polypeptide includes, but is not limited to, a nucleotide sequence encoding the amino acid sequence of SEQ ID NO:12, SEQ ID NO:13 and/or SEQ ID NO:14; a nucleotide sequence encoding a Cas3" polypeptide includes, but is not limited to, a nucleotide sequence encoding the amino acid sequence of SEQ ID NO:15, SEQ ID NO:16 and/or SEQ ID NO:17; a nucleotide sequence encoding a Cas10d (Csc3) polypeptide includes, but is not limited to, a nucleotide sequence encoding the amino acid sequence of SEQ ID NO:33 and/or SEQ ID NO:34; a nucleotide sequence encoding a Csc2 polypeptide includes, but is not limited to, a nucleotide sequence encoding the amino acid sequence of SEQ ID NO:35 and/or SEQ ID NO:36; a nucleotide sequence encoding a Csc1 polypeptide includes, but is not limited to, a nucleotide sequence encoding the amino acid sequence of SEQ ID NO:37 and/or SEQ ID NO:38; and/or a nucleotide sequence encoding a Cas6d polypeptide includes, but is not limited to, a nucleotide sequence encoding the amino acid sequence of SEQ ID NO:39 and/or SEQ ID NO:40.

Additional amino acid and nucleotide sequences encoding type I Cascade polypeptides can be identified by the skilled artisan using methods routine in the art for identifying homologues, as for example, screening the NCBI GenBank database using the amino acid sequence, gene name, or protein family of a known Cascade polypeptide. Accordingly, further non-limiting examples of a Type I polypeptides include the following as identified by their GenBank accession numbers.

Thus, for example, Type I-A cas7/csa2 polypeptides include, but are not limited to, GenBank accession number ACP34796.1, ACV25240.1, ADC69851.1, ADX81774.1, ADX84848.1, BAB84980.2, Q97Y91.1, YP_002831441.1, YP_003128740.1, YP_003458587.1, YP_005844988.1, and/or YP_005848062.

In other embodiments, Type I-A cas8a1/csx13 polypeptides include, but are not limited to, GenBank accession number as set forth in Table 6.

TABLE 6

Type I-A cas8a1/csx13 polypeptide accession numbers
(the sequence identifier for each accession number, in the order provided in
Table 6, is SEQ ID NOs: 341-640).

AAL95378.1, AAZ69290.1, ABG85850.1, ABP67977.1, ABQ90254.1, ABR48349.1, ABS22299.1,
ABU59349.1, ABX07704.1, ABY36145.1, ACD66304.1, ACD89534.1, ACI19672.1, ACI21434.1,
ACK40458.1, ACL23511.1, ACM54569.1, ACM59280.1, ACN98336.1, ACO02971.1, ACS24737.1,
ACV38707.1, ACV61808.1, ADC88653.1, ADG13584.1, ADG71319.1, ADH59814.1, ADI02112.1,
ADI26429.1, ADL41486.1, ADP74262.1, ADQ08188.1, ADQ41858.1, ADU97573.1, ADY55689.1,
AEA46792.1, AEE48384.1, AEF19060.1, AEF93612.1, AEH24640.1, AEH47542.1, AEH91548.1,
AEN78299.1, AEO02602.1, AEO38050.1, AEV69187.1, AFA49668.1, AFL94587.1, AFS77693.1,
AGF58568.1, AGG14993.1, AGG15485.1, AGI39652.1, AGI39866.1, AGR03384.1, AGR15961.1,
AGR27586.1, CBL20527.1, CBY03036.1, CBY48110.1, CCY59072.1, CDB20969.1, CDC03261.1,
CDC19289.1, CDC79971.1, CDC92385.1, CDC93207.1, CDE55652.1, CDI49498.1, CDI64710.1,

TABLE 6-continued

Type I-A cas8a1/csx13 polypeptide accession numbers
(the sequence identifier for each accession number, in the order provided in
Table 6, is SEQ ID NOs: 341-640).

EAY25594.1, EDK88416.1, EDO58922.1, EDR97019.1, EDS77895.1, EDT23081.1, EDU38639.1,
EEG35956.1, EEG37130.1, EEO38468.1, EEP60017.1, EES51331.1, EEW20706.1, EEW67155.1,
EEX23204.1, EFD25239.1, EFE87452.1, EFG27734.1, EFG95262.1, EFH05799.1, EFH17183.1,
EFH93278.1, EFI68562.1, EFK93763.1, EFL54064.1, EFM38861.1, EFR88687.1, EFR88692.1,
EFS01187.1, EFS20741.1, EFS21645.1, EFS24401.1, EFS28319.1, EFV16756.1, EGG91964.1,
EGL83969.1, EGY80091.1, EHJ36418.1, EHL19483.1, EHN61774.1, EHR79718.1, EIJ72305.1,
EJP23274.1, EJU08078.1, EJU19990.1, EKA92426.1, EKU43637.1, EMS70152.1, ERI07860.1,
ERI93854.1, ERM91451.1, ERT47389.1, EUJ23986.1, EUJ39372.1, EUJ57885.1, NP_604079.1,
WP_002187923.1, WP_002702613.1, WP_002835744.1, WP_002838037.1, WP_002840042.1,
WP_003019330.1, WP_003364961.1, WP_003374705.1, WP_003488957.1, WP_003693852.1,
WP_003721305.1, WP_003731260.1, WP_003733577.1, WP_003745650.1, WP_003770616.1,
WP_004066403.1, WP_004228702.1, WP_004456286.1, WP_004628964.1, WP_004820498.1,
WP_005345375.1, WP_005366755.1, WP_005896414.1, WP_005903146.1, WP_005917190.1,
WP_005957249.1, WP_005969637.1, WP_005971576.1, WP_006806657.1, WP_007502704.1,
WP_007547872.1, WP_008118711.1, WP_008401177.1, WP_008794388.1, WP_008800820.1,
WP_008801714.1, WP_008821022.1, WP_009005906.1, WP_009081463.1, WP_009200361.1,
WP_009220010.1, WP_009264828.1, WP_009371070.1, WP_009423366.1, WP_009528186.1,
WP_009528502.1, WP_009531670.1, WP_009643660.1, WP_009926150.1, WP_009926261.1,
WP_010248767.1, WP_010479701.1, WP_010528951.1, WP_010680292.1, WP_010885339.1,
WP_011012263.1, WP_011016968.1, WP_011249418.1, WP_011591962.1, WP_011917899.1,
WP_011956601.1, WP_012063325.1, WP_012094492.1, WP_012121773.1, WP_012192593.1,
WP_012258798.1, WP_012459381.1, WP_012465415.1, WP_012546150.1, WP_012548304.1,
WP_012574443.1, WP_012581885.1, WP_012615877.1, WP_012673661.1, WP_012675210.1,
WP_012984910.1, WP_012991060.1, WP_013100330.1, WP_013144989.1, WP_013149500.1,
WP_013175514.1, WP_013289493.1, WP_013400575.1, WP_013404326.1, WP_013433573.1,
WP_013538358.1, WP_013624559.1, WP_013683464.1, WP_013749292.1, WP_013876765.1,
WP_013905697.1, WP_014073500.1, WP_014091943.1, WP_014255749.1, WP_014357265.1,
WP_014601720.1, WP_014788228.1, WP_014835335.1, WP_014966830.1, WP_015394877.1,
WP_015526375.1, WP_015756524.1, WP_015769055.1, WP_015864171.1, WP_015906759.1,
WP_019416834.1, WP_021623245.1, WP_021654356.1, WP_022172991.1, WP_022302635.1,
WP_022304353.1, WP_022588389.1, WP_023438295.1, YP_001181168.1, YP_001276204.1,
YP_001320008.1, YP_001375294.1, YP_001433367.1, YP_001547832.1, YP_001636534.1,
YP_001930858.1, YP_001942513.1, YP_002249829.1, YP_002249954.1, YP_002351072.1,
YP_002461947.1, YP_002570895.1, YP_002572053.1, YP_002728803.1, YP_002731103.1,
YP_002950003.1, YP_003163698.1, YP_003190431.1, YP_003472780.1, YP_003616548.1,
YP_003633518.1, YP_003671006.1, YP_003675825.1, YP_003702677.1, YP_003839472.1,
YP_003988873.1, YP_003993557.1, YP_004027471.1, YP_004152214.1, YP_004265690.1,
YP_004341507.1, YP_004445257.1, YP_004496524.1, YP_004587623.1, YP_004603183.1,
YP_004623912.1, YP_004832235.1, YP_005047111.1, YP_005270557.1, YP_005946606.1,
YP_005964502.1, YP_005970332.1, YP_006424381.1, YP_006680968.1, YP_006692468.1,
YP_006787540.1, YP_007457822.1, YP_007500036.1, YP_007500528.1, YP_007679670.1,
YP_007679884.1, YP_007784190.1, YP_008273810.1, YP_008282081.1, YP_008299753.1,
YP_008428017.1, YP_008773535.1, YP_303870.1, and/or YP_698243.1

In some embodiments, type I-A cas8a2/csx9 polypeptides include, but are not limited to, GenBank accession number as set forth in Table 7.

TABLE 7

Type I-A cas8a2/csx9 polypeptide accession numbers
(the sequence identifier for each accession number, in the order provided in
Table 7, is SEQ ID NOs: 641-666).

ACS33798.1, ACV25238.1, ADC69853.1, ADV65298.1, AEH24649.1,
AFK22399.1, AFL66344.1, EHR79726.1, Q57830.1, WP_004066420.1,
WP_010479713.1, WP_010868141.1, WP_010885009.1,
WP_011249406.1, WP_012980762.1, WP_013905706.1,

TABLE 7-continued

Type I-A cas8a2/csx9 polypeptide accession numbers
(the sequence identifier for each accession number, in the order provided in
Table 7, is SEQ ID NOs: 641-666).

WP_014733925.1, WP_015791971.1, YP_002959662.1,
YP_003128738.1, YP_003458589.1, YP_004176780.1,
YP_004623921.1, YP_006354474.1, YP_006401919.1,
and/or YP_008428007.1

In some embodiments, type I-A cas5 polypeptides include, but are not limited to, GenBank accession number as set forth in Table 8.

TABLE 8

Type I-A cas5 polypeptide accession numbers
(the sequence identifier for each accession number, in the order provided in
Table 8, is SEQ ID NOs: 667-871).

AAB89384.1, AAB98378.1, AAK41635.1, AAK41674.1, AAK42188.1, AAL62628.1, AAL80765.1,
ABG65171.1, ABM80500.1, ABN69435.1, ABP50706.1, ABP95303.1, ABU82316.1, ACB07186.1,
ACH62180.1, ACL11102.1, ACP34797.1, ACP37659.1, ACP37697.1, ACP45051.1, ACP49135.1,
ACP54855.1, ACP54893.1, ACR41523.1, ACS33795.1, ACV25239.1, ACX92458.1, ADB86650.1,
ADC66006.1, ADC69852.1, ADG91075.1, ADM27731.1, ADN51066.1, ADT83453.1, ADX81773.1,
ADX84849.1, ADY01599.1, AEB95257.1, AEC52734.1, AEE94621.1, AEM38302.1, AET32402.1,

TABLE 8-continued

Type I-A cas5 polypeptide accession numbers
(the sequence identifier for each accession number, in the order provided in
Table 8, is SEQ ID NOs: 667-871).

AFA39173.1, AFH42056.1, AFK51440.1, AFL66341.1, AFL66901.1, AFN03430.1, AFU57333.1,
AFU57334.1, AGJ61863.1, AHC52233.1, BAA30015.1, BAA80223.2, BAB64981.1, BAB67760.1,
BAD84641.1, BAJ48045.1, BAJ48055.1, BAJ50845.1, BAN89822.1, CAB49935.1, CAT72675.1,
CCC81887.1, CCE70433.1, EDX76563.1, EFL34103.1, EGK04694.1, EHP69910.1, EWG06386.1,
G4RJZ2.1, NP_070697.1, NP_126704.1, NP_142843.2, NP_147810.2, NP_247356.1, NP_342845.1,
NP_342884.1, NP_343398.1, NP_375872.1, NP_378651.1, NP_558446.1, NP_578370.1, Q57827.1,
Q97WW2.1, Q97Y92.1, Q97YC6.1, WP_002364198.1, WP_003992208.1, WP_006100291.1,
WP_006844672.1, WP_009070154.1, WP_009988394.1, WP_009991627.1, WP_010479711.1,
WP_010729831.1, WP_010866247.1, WP_010868142.1, WP_010869881.1, WP_010879365.1,
WP_010885010.1, WP_010923406.1, WP_010977963.1, WP_010980734.1, WP_011007100.1,
WP_011011761.1, WP_011249407.1, WP_011583112.1, WP_011821818.1, WP_011838626.1,
WP_011900613.1, WP_012021090.1, WP_012123280.1, WP_012309083.1, WP_012608443.1,
WP_012710927.1, WP_012710964.1, WP_012717742.1, WP_012718680.1, WP_012966345.1,
WP_012980761.1, WP_013129668.1, WP_013303381.1, WP_013336791.1, WP_013466751.1,
WP_013604761.1, WP_013737755.1, WP_013749284.1, WP_013776536.1, WP_014025979.1,
WP_014127142.1, WP_014288230.1, WP_014346690.1, WP_014511987.1, WP_014513745.1,
WP_014557205.1, WP_014737690.1, WP_014767242.1, WP_014777797.1, WP_015580743.1,
WP_015791972.1, WP_015858907.1, WP_016730681.1, WP_016731906.1, WP_016732169.1,
WP_016732175.1, WP_018033623.1, WP_018192944.1, WP_018193690.1, WP_020265384.1,
WP_020511164.1, WP_020864070.1, WP_021968299.1, WP_022071463.1, WP_022541099.1,
WP_024084610.1, WP_024265300.1, YP_001012845.1, YP_001040343.1, YP_001153358.1,
YP_001191227.1, YP_001435723.1, YP_001736869.1, YP_002225090.1, YP_002428469.1,
YP_002828957.1, YP_002828995.1, YP_002831442.1, YP_002836973.1, YP_002841057.1,
YP_002842900.1, YP_002842938.1, YP_002914191.1, YP_002959659.1, YP_003128739.1,
YP_003419020.1, YP_003436281.1, YP_003458588.1, YP_003650027.1, YP_003859611.1,
YP_003902117.1, YP_004070676.1, YP_004245101.1, YP_004409741.1, YP_004424738.1,
YP_004458919.1, YP_004780554.1, YP_004892965.1, YP_005084654.1, YP_005259780.1,
YP_005644059.1, YP_005644987.1, YP_005648063.1, YP_005841508.1, YP_006363578.1,
YP_006401916.1, YP_006402476.1, YP_006491722.1, YP_006860990.1, YP_006860991.1,
YP_007864863.1, YP_008603756.1, YP_008797475.1, YP_008948135.1, and/or YP_182865.1

In still other embodiments, type I-A csa5 polypeptides include, but are not limited to, GenBank accession number as set forth in table 9.

In some embodiments, type I-A cas6a polypeptides include, but are not limited to, GenBank accession number CCC39326.1 (SEQ ID NO:325), Q57820.1 (SEQ ID

TABLE 9

Type I-A csa5 polypeptide accession numbers
(the sequence identifier for each accession number, in the order provided in
Table 9, is SEQ ID NOs: 872-1042).

AAB89385.1, AAK41676.1, AAK42186.1, ABB24054.1, ABK78026.1, ABM80502.1, ABN69433.1,
ABP95305.1, ABR33799.1, ABU82318.1, ACB07184.1, ACI21287.1, ACL11104.1, ACP34795.1,
ACP37695.1, ACP45049.1, ACP49137.1, ACP54891.1, ACR41521.1, ACV25241.1, ADB86648.1,
ADC69850.1, ADX81775.1, ADX84847.1, AEB07988.1, AEB95255.1, AEE94623.1, AEE95241.1,
AEH24646.1, AEM38381.1, AFK22402.1, AGI51452.1, AGJ61865.1, AHC52235.1, BAA30017.1,
BAB67758.1, BAD84643.1, BAE63890.1, BAJ48057.1, BAJ50847.1, CAB49937.1, CAQ41128.1,
CAT72674.1, CBX31380.1, CCE70435.1, EEK52966.1, EEQ91179.1, EGE82524.1, EGL20033.1,
EHN78776.1, EHP69908.1, EHR79724.1, ELS34753.1, ENU25210.1, ENV11469.1, ENX58900.1,
ENX61893.1, EOR09267.1, EPD82015.1, ESU14071.1, EWG06384.1, G4RJZ0.1, NP_070695.1,
NP_126706.1, NP_142845.1, NP_342886.1, NP_343396.1, NP_378649.1, O28409.1, Q97Y90.1,
WP_000270013.1, WP_002746890.1, WP_002764565.1, WP_004066416.1, WP_004652132.1,
WP_004801272.1, WP_005202326.1, WP_005323045.1, WP_007388860.1, WP_008426480.1,
WP_009070150.1, WP_009625124.1, WP_009671504.1, WP_009990722.1, WP_009991624.1,
WP_010479707.1, WP_010868144.1, WP_010879363.1, WP_010885012.1, WP_010923408.1,
WP_010923715.1, WP_010980732.1, WP_011249409.1, WP_011357926.1, WP_011821820.1,
WP_011838624.1, WP_011968951.1, WP_012021092.1, WP_012123282.1, WP_012309081.1,
WP_012546006.1, WP_012608445.1, WP_012710962.1, WP_012713193.1, WP_012715848.1,
WP_012717744.1, WP_012718679.1, WP_012980759.1, WP_013482651.1, WP_013705101.1,
WP_013737753.1, WP_013776538.1, WP_013779675.1, WP_013905703.1, WP_014026058.1,
WP_014511989.1, WP_014513743.1, WP_014733928.1, WP_015791974.1, WP_016162949.1,
WP_016729979.1, WP_016731904.1, WP_018033625.1, WP_018192942.1, WP_018193688.1,
WP_018541940.1, WP_019324664.1, WP_020265382.1, WP_020265487.1, WP_020268818.1,
WP_020269141.1, WP_020864072.1, WP_021052469.1, WP_024084612.1, XP_001825023.2,
XP_002259861.1, XP_790100.2, YP_001012847.1, YP_001040341.1, YP_001191229.1,
YP_001308755.1, YP_001435725.1, YP_001736867.1, YP_002248920.1, YP_002428471.1,
YP_002828993.1, YP_002831440.1, YP_002836971.1, YP_002841059.1, YP_002842936.1,
YP_002914189.1, YP_003128741.1, YP_003419018.1, YP_003458586.1, YP_004369169.1,
YP_004409739.1, YP_004458921.1, YP_004462063.1, YP_004623918.1, YP_004780633.1,
YP_005644989.1, YP_005648061.1, YP_006354477.1, YP_007864865.1, YP_008428011.1,
YP_008474533.1, YP_008797477.1, YP_008948137.1, YP_182867.1, YP_375097.1, and/or
YP_876330.1

NO:326), Q97Y96.1 (SEQ ID NO:327), and/or YP_005839101.1 (SEQ ID NO:328).

In further embodiments, type I-A cas3' polypeptides include, but are not limited to, GenBank accession number NP_147808.1 (SEQ ID NO:329), NP_343399.1 (SEQ ID NO:330), and/or CCC81888.1 (SEQ ID NO:331).

In still further embodiments, type I-A cas3" polypeptides include, but are not limited to, GenBank accession number NP_147807.1 (SEQ ID NO:332), NP_343400.1 (SEQ ID NO:333), and/or CCC81889.1 (SEQ ID NO:334).

In some embodiments, type I-B cas6b polypeptides include, but are not limited to, GenBank accession number Q8U3R3.1 (SEQ ID NO:335), Q97WV8.1 (SEQ ID NO:336), Q58631.1 (SEQ ID NO:337), YP_003533663.1 (SEQ ID NO:338), YP_002534242.1 (SEQ ID NO:339), and/or YP_002534249.1 (SEQ ID NO:340).

In other embodiments, type I-B cas8b/csh1 polypeptides include, but are not limited to, GenBank accession number as set forth in Table 10.

TABLE 10

Type I-B cas8b/csh1 polypeptide accession numbers
(the sequence identifier for each accession number, in the order provided in
Table 10, is SEQ ID NOs: 1043-1158).

ACB09368.1, ACV11630.1, ACV48938.1, AEM58842.1, AFK21437.1, AFO56172.1, AFZ74575.1,
AGB03160.1, AGF96002.1, AGF96003.1, AGO61197.1, AGX43472.1, AHB67946.1, AHG05445.1,
BAL52721.1, CCK87449.1, CCK90903.1, CCK96290.1, CCK98531.1, CCQ33713.1, EAY30146.1,
EDR99204.1, EEP56084.1, EES90449.1, EFH07552.1, EFH15423.1, EHP85065.1, EID43009.1,
ELY41482.1, ELY72601.1, ELY83890.1, ELY91754.1, ELY96632.1, ELZ04987.1, ELZ16933.1,
ELZ40751.1, ELZ42764.1, ELZ59537.1, ELZ60426.1, ELZ68872.1, ELZ72052.1, ELZ72263.1,
ELZ84579.1, ELZ88967.1, ELZ93658.1, ELZ97246.1, ELZ99739.1, EMA18803.1, EMA25147.1,
EMA34109.1, EMA56841.1, EMA69343.1, EMT39606.1, ERJ06790.1, ESP86779.1, ETA67346.1,
ETI90104.1, GAC90881.1, WP_003377299.1, WP_003380931.1, WP_003413122.1, WP_004046328.1,
WP_004060812.1, WP_004064662.1, WP_004971283.1, WP_005533726.1, WP_005576677.1,
WP_006165794.1, WP_006168574.1, WP_006601038.1, WP_006648207.1, WP_006653096.1,
WP_006673617.1, WP_007188933.1, WP_007736473.1, WP_007982327.1, WP_008094396.1,
WP_008164964.1, WP_008320680.1, WP_008324580.1, WP_008444873.1, WP_008452268.1,
WP_008524855.1, WP_008572456.1, WP_008847067.1, WP_009887249.1, WP_011099685.1,
WP_011222266.1, WP_011722697.1, WP_012310881.1, WP_012660067.1, WP_014030718.1,
WP_014555903.1, WP_014863256.1, WP_015763780.1, WP_015789204.1, WP_018129134.1,
WP_018258161.1, WP_021373546.1, WP_021403257.1, WP_021412247.1, WP_022615726.1,
WP_022746620.1, WP_023396040.1, YP_001739051.1, YP_003130363.1, YP_003178645.1,
YP_004785826.1, YP_006351424.1, YP_006540248.1, YP_007179024.1, YP_007249667.1,
YP_008142098.1, YP_008377024.1, YP_008675509.1, and/or YP_008874106.1

In some embodiments, type I-B cas7/csh2 polypeptides include, but are not limited to, GenBank accession number as set forth in Table 11.

TABLE 11

Type I-B cas7/csh2 polypeptide accession numbers
(the sequence identifier for each accession number, in the order provided in
Table 11, is SEQ ID NOs: 1159-1209).

ABR54140.1, ACB09369.1, ACN13664.1, ACV11629.1, ACV48939.1,
AEK19972.1, AEM58841.1, AFK21438.1, AHB67947.1, AHD18305.1,
CCQ33714.1, ERJ06791.1, WP_004046327.1, WP_004060811.1,
WP_004082348.1, WP_004966754.1, WP_004971285.1,
WP_005533725.1, WP_006168573.1, WP_007188932.1,
WP_007982329.1, WP_008164963.1, WP_008320681.1,
WP_008324577.1, WP_008524853.1, WP_008572454.1,
WP_011032514.1, WP_011222267.1, WP_011972043.1,

TABLE 11-continued

Type I-B cas7/csh2 polypeptide accession numbers
(the sequence identifier for each accession number, in the order provided in
Table 11, is SEQ ID NOs: 1159-1209).

WP_012310882.1, WP_012660066.1, WP_012662913.1,
WP_013999402.1, WP_014030717.1, WP_015763781.1,
WP_015789203.1, WP_018258160.1, WP_020220934.1,
YP_001322752.1, YP_001739052.1, YP_002534251.1,
YP_002601828.1, YP_003130362.1, YP_003178646.1,
YP_003533665.1, YP_004742715.1, YP_004785825.1,
YP_006351425.1, YP_008377025.1, YP_008874107.1, and/or
YP_008991099.1

In some embodiments, Type I-B cas5 polypeptides include, but are not limited to, GenBank accession number as set forth in Table 12.

TABLE 12

Type I-B cas5 polypeptide accession numbers
(the sequence identifier for each accession number, in the order provided in
Table 12, is SEQ ID NOs: 1210-2372).

AAB85576.1, AAC06653.1, AAD36863.1, AAM30258.1, AAO36023.1, AAR38875.1, AAV44423.1,
ABB15084.1, ABE52050.1, ABG03245.1, ABI69104.1, ABI69807.1, ABJ60926.1, ABK14430.1,

TABLE 12-continued

Type I-B cas5 polypeptide accession numbers
(the sequence identifier for each accession number, in the order provided in
Table 12, is SEQ ID NOs: 1210-2372).

ABN54398.1, ABO35079.1, ABP65713.1, ABP65962.1, ABR30222.1, ABR54141.1, ABR56648.1,
ABS22297.1, ABS51485.1, ABV32774.1, ABX32567.1, ABY93797.1, ACB09370.1, ACI18906.1,
ACJ33146.1, ACJ75703.1, ACJ76380.1, ACK41910.1, ACL21951.1, ACL70272.1, ACM22886.1,
ACM61724.1, ACN13665.1, ACN98723.1, ACO03885.1, ACR79388.1, ACS23234.1, ACS24735.1,
ACS90540.1, ACV11628.1, ACV25245.1, ACV38705.1, ACV48940.1, ACV61810.1, ACV63756.1,
ACV64956.1, ACX52109.1, ACX77838.1, ACZ43322.1, ADB39857.1, ADC46646.1, ADC69846.1,
ADD03494.1, ADE01943.1, ADF51863.1, ADG07364.1, ADG07375.1, ADG13848.1, ADG83329.1,
ADH59812.1, ADH61863.1, ADI26431.1, ADI36186.1, ADI61856.1, ADL06864.1, ADL41488.1,
ADL43515.1, ADL70072.1, ADO35161.1, ADO45628.1, ADP74264.1, ADP76109.1, ADQ08186.1,
ADQ08235.1, ADQ14922.1, ADQ41856.1, ADQ41963.1, ADQ42006.1, ADQ47253.1, ADQ47299.1,
ADR19819.1, ADU51672.1, ADU92812.1, ADU97575.1, ADV78761.1, ADY32338.1, ADY55691.1,
AEB69537.1, AEB77226.1, AEE14450.1, AEE90320.1, AEE97376.1, AEF18280.1, AEF19062.1,
AEG14078.1, AEG14216.1, AEG46351.1, AEG61211.1, AEH25122.1, AEH47544.1, AEH49390.1,
AEH51742.1, AEH54512.1, AEI14613.1, AEJ40709.1, AEK19971.1, AEK72019.1, AEM58840.1,
AEM74922.1, AEM74971.1, AEN78297.1, AEP01119.1, AER66005.1, AEV68770.1, AEV69185.1,
AEW01076.1, AEW06746.1, AFK07935.1, AFK21439.1, AFK21704.1, AFK85421.1, AFL96011.1,
AFM22198.1, AFO56174.1, AFU57333.1, AFV12619.1, AFZ74577.1, AGA59189.1, AGB20226.1,
AGC68638.1, AGC68870.1, AGF58566.1, AGG14995.1, AGH93292.1, AGI39650.1, AGI39868.1,
AGL00110.1, AGL00360.1, AGL50734.1, AGR27754.1, AGT06852.1, AGY75623.1, AHB67948.1,
AHD18306.1, AHF79950.1, AHG05447.1, AHJ12409.1, BAA29240.1, BAI69702.1, BAI70178.1,
BAI80034.1, BAI81693.1, CAB05527.1, CAJ69873.1, CBA65392.1, CBE06412.1, CBH26573.1,
CBL06453.1, CBL20525.1, CBL28677.1, CBV37093.1, CBV37147.1, CBV37210.1, CCA14225.1,
CCC40225.1, CCK87447.1, CCK87792.1, CCK88323.1, CCK90901.1, CCK91258.1, CCK91758.1,
CCK94930.1, CCK95461.1, CCK96292.1, CCK98529.1, CCK98870.1, CCK99454.1, CCL02782.1,
CCL08295.1, CCL10367.1, CCL11550.1, CCL15413.1, CCL19412.1, CCL23335.1, CCL26733.1,
CCL30689.1, CCL34647.1, CCL35213.1, CCL38536.1, CCL39060.1, CCL43259.1, CCL47272.1,
CCL50402.1, CCL54352.1, CCL58497.1, CCL61502.1, CCL66040.1, CCL69962.1, CCL73647.1,
CCL77343.1, CCL80653.1, CCL81172.1, CCL84107.1, CCL84682.1, CCL88857.1, CCL91964.1,
CCL92530.1, CCL96800.1, CCP24803.1, CCQ33715.1, CCZ35983.1, CDC34386.1, CDG37685.1,
CDH46485.1, CDI49617.1, CDM67379.1, EAU00173.1, EDU38641.1, EEA85700.1, EEB35642.1,
EEB73082.1, EEB76591.1, EEC57350.1, EEG35954.1, EEG37132.1, EEM80237.1, EEM86545.1,
EEO34258.1, EEO38466.1, EEO39221.1, EEO43827.1, EEP56330.1, EEQ26091.1, EES49281.1,
EES63309.1, EES76423.1, EES90262.1, EES90483.1, EEU11824.1, EEU61362.1, EEV18896.1,
EEW20241.1, EEX23202.1, EFB38349.1, EFB61539.1, EFC90518.1, EFE87454.1, EFG03490.1,
EFG27736.1, EFG95260.1, EFH05801.1, EFH07554.1, EFH07717.1, EFH15421.1, EFH16150.1,
EFH17185.1, EFH93276.1, EFI68560.1, EFJ68937.1, EFK40166.1, EFK93738.1, EFL54048.1,
EFQ22711.1, EFQ45709.1, EFS01189.1, EFS20743.1, EFS21647.1, EFS24403.2, EFS26650.1,
EFS28321.1, EFV21399.1, EFW90577.1, EFX83389.1, EGC74256.1, EGC84815.1, EGJ42919.1,
EGL83971.1, EGL83996.1, EGM53068.1, EGN41570.1, EGN64312.1, EGO87701.1, EGQ22908.1,
EGQ80953.1, EGQ80954.1, EGV32623.1, EGY80083.1, EGZ43696.1, EHI55262.1, EHI57521.1,
EHI79000.1, EHJ01148.1, EHJ25274.1, EHJ27821.1, EHJ35719.1, EHJ36416.1, EHL03878.1,
EHL13042.1, EHL19481.1, EHL79449.1, EHM00796.1, EHM89754.1, EHM91459.1, EHN62646.1,
EHO09810.1, EHO40937.1, EHO68882.1, EHO77292.1, EHQ30579.1, EHQ45000.1, EHQ46727.1,
EID43007.1, EJN53432.1, EJX26016.1, EKA92428.1, EKU43639.1, ELY41480.1, ELY72599.1,
ELY73832.1, ELY83892.1, ELY91752.1, ELZ04989.1, ELZ16931.1, ELZ59539.1, ELZ60428.1,
ELZ71860.1, ELZ72261.1, ELZ89350.1, ELZ97244.1, ELZ99741.1, EMA72145.1, EMA34111.1,
EPC07705.1, EQB84124.2, EQE01732.1, EQE03339.1, EQE03948.1, EQE05304.1, EQE07512.1,
EQE08412.1, EQE15241.1, EQE18540.1, EQE21462.1, EQE26379.1, EQE32669.1, EQE38502.1,
EQE42083.1, EQE43177.1, EQE44313.1, EQE47253.1, EQE53152.1, EQE56671.1, EQE60307.1,
EQE60899.1, EQE61751.1, EQE68275.1, EQE73582.1, EQE77127.1, EQE79062.1, EQE90139.1,
EQE90276.1, EQE90964.1, EQE95151.1, EQF02571.1, EQF02867.1, EQF04763.1, EQF09813.1,
EQF13623.1, EQF18498.1, EQF25384.1, EQF30949.1, EQF36165.1, EQF38901.1, EQF44618.1,
EQF48772.1, EQF50396.1, EQF51993.1, EQF60175.1, EQF60780.1, EQF66131.1, EQF67188.1,
EQF68274.1, EQF74295.1, EQF75097.1, EQF79635.1, EQF86680.1, EQF87551.1, EQF94119.1,
EQF94458.1, EQF99415.1, EQG00993.1, EQG08939.1, EQG09378.1, EQG17676.1, EQG18642.1,
EQG22092.1, EQG27623.1, EQG31829.1, EQG32967.1, EQG33291.1, EQG39236.1, EQG43179.1,
EQG44913.1, EQG51716.1, EQG55903.1, EQG59371.1, EQG64721.1, EQG67977.1, EQG74365.1,
EQG77054.1, EQG80757.1, EQG82489.1, EQG90008.1, EQG92006.1, EQG93624.1, EQH01839.1,
EQH02774.1, EQH07310.1, EQH11134.1, EQH17403.1, EQH28778.1, EQH34061.1, EQH34296.1, EQH35981.1, EQH40011.1, EQH47226.1, EQH49250.1, EQH54011.1, EQH59206.1,
EQH60286.1, EQH63975.1, EQH67919.1, EQH69652.1, EQH74804.1, EQH79337.1, EQH81451.1,
EQH88358.1, EQH92873.1, EQH97194.1, EQH98214.1, EQH98657.1, EQI04921.1, EQI09869.1,
EQI11163.1, EQI20937.1, EQI20989.1, EQI27274.1, EQI33531.1, EQI37445.1, EQI39861.1,
EQI45210.1, EQI50521.1, EQI54642.1, EQI57315.1, EQI58425.1, EQI64544.1, EQI65626.1,
EQI72802.1, EQI77848.1, EQI78279.1, EQI78482.1, EQI85053.1, EQI90256.1, EQI94963.1,
EQI95828.1, EQI99103.1, EQJ05444.1, EQJ06157.1, EQJ09401.1, EQJ14706.1, EQJ15344.1,
EQJ16768.1, EQJ23077.1, EQJ28979.1, EQJ33651.1, EQJ34573.1, EQJ39165.1, EQJ44701.1,
EQJ45565.1, EQJ55006.1, EQJ55505.1, EQJ57779.1, EQJ66394.1, EQJ67361.1, EQJ77085.1,
EQJ77540.1, EQJ80734.1, EQJ82551.1, EQJ87869.1, EQJ89135.1, EQJ89796.1, EQJ94704.1,
EQK00393.1, EQK02221.1, EQK04295.1, EQK11853.1, EQK14515.1, EQK15563.1, EQK16873.1,
EQK21904.1, EQK26713.1, EQK27485.1, EQK30841.1, EQK33182.1, EQK32445.1, EQK37615.1,
EQK64317.1, EQK68374.1, EQK70289.1, EQK72808.1, EQK74231.1, EQK74942.1, EQK80483.1,
EQK85815.1, EQK86186.1, EQK86596.1, EQL07765.1, ERH10110.1, ERJ06792.1, ERM24612.1,
ERM26943.1, ERM33457.1, ERM34409.1, ERM35045.1, ERM45721.1, ERM46920.1, ERM47348.1,
ERT39868.1, ERT41605.1, ETZ26411.1, EUB15686.1, EUB26806.1, EUB30975.1, EUB36180.1,
EUJ23988.1, EUJ32650.1, EUJ39373.1, EUJ45451.1, NP_142172.1, NP_213256.1, NP_229597.1,

TABLE 12-continued

Type I-B cas5 polypeptide accession numbers
(the sequence identifier for each accession number, in the order provided in
Table 12, is SEQ ID NOs: 1210-2372).

NP_276215.1, NP_497019.1, NP_632586.1, NP_782086.1, NP_963314.1, WP_000372921.1,
WP_000643645.1, WP_000643646.1, WP_001276288.1, WP_002090051.1, WP_002097354.1,
WP_002187918.1, WP_002193569.1, WP_002204284.1, WP_002599337.1, WP_002656857.1,
WP_002695760.1, WP_002729366.1, WP_002736261.1, WP_002756406.1, WP_002835742.1,
WP_002838002.1, WP_002840022.1, WP_002926177.1, WP_003019326.1, WP_003253164.1,
WP_003352579.1, WP_003371725.1, WP_003377369.1, WP_003377740.1, WP_003380933.1,
WP_003383461.1, WP_003393814.1, WP_003413402.1, WP_003416594.1, WP_003422614.1,
WP_003424503.1, WP_003430916.1, WP_003439785.1, WP_003442545.1, WP_003480768.1,
WP_003488960.1, WP_003511800.1, WP_003537505.1, WP_003538011.1, WP_003646797.1,
WP_003650047.1, WP_003651915.1, WP_003693854.1, WP_003728517.1, WP_003745655.1,
WP_003868742.1, WP_003871404.1, WP_004032886.1, WP_004043128.1, WP_004046326.1,
WP_004053330.1, WP_004060810.1, WP_004064674.1, WP_004082347.1, WP_004228695.1,
WP_004399633.1, WP_004454740.1, WP_004628952.1, WP_004804177.1, WP_004814809.1,
WP_004816081.1, WP_004820504.1, WP_004839794.1, WP_004966755.1, WP_004971286.1,
WP_004972493.1, WP_005041358.1, WP_005345379.1, WP_005348718.1, WP_005533724.1,
WP_005541006.1, WP_005546401.1, WP_005557131.1, WP_005576674.1, WP_005584763.1,
WP_005659292.1, WP_005816131.1, WP_005817562.1, WP_005869135.1, WP_005903141.1,
WP_005910162.1, WP_005917186.1, WP_005937046.1, WP_005948317.1, WP_005957039.1,
WP_005969641.1, WP_005971580.1, WP_005977421.1, WP_006114886.1, WP_006165797.1,
WP_006168572.1, WP_006186929.1, WP_006258367.1, WP_006299857.1, WP_006305874.1,
WP_006320564.1, WP_006441124.1, WP_006521012.1, WP_006523429.1, WP_006565554.1,
WP_006567721.1, WP_006569796.1, WP_006648205.1, WP_006653094.1, WP_006673619.1,
WP_006782618.1, WP_006788405.1, WP_006884525.1, WP_006928014.1, WP_007039823.1,
WP_007043770.1, WP_007044908.1, WP_007188931.1, WP_007220333.1, WP_007286909.1,
WP_007305584.1, WP_007429321.1, WP_007473124.1, WP_007502661.1, WP_007502706.1,
WP_007736477.1, WP_007982330.1, WP_008094400.1, WP_008118714.1, WP_008164961.1,
WP_008194420.1, WP_008210714.1, WP_008286679.1, WP_008286997.1, WP_008320682.1,
WP_008324576.1, WP_008444868.1, WP_008452273.1, WP_008512433.1, WP_008524852.1,
WP_008538511.1, WP_008565745.1, WP_008572452.1, WP_008576913.1, WP_008694964.1,
WP_008702877.1, WP_008706837.1, WP_008791536.1, WP_008793026.1, WP_008793806.1,
WP_008800822.1, WP_008801716.1, WP_008821024.1, WP_008847069.1, WP_008908200.1,
WP_008910044.1, WP_008976788.1, WP_009005907.1, WP_009056604.1, WP_009171795.1,
WP_009186589.1, WP_009251670.1, WP_009264825.1, WP_009290820.1, WP_009361658.1,
WP_009423364.1, WP_009448529.1, WP_009524579.1, WP_009528284.1, WP_009528500.1,
WP_009531618.1, WP_009609715.1, WP_009643649.1, WP_009650627.1, WP_009890657.1,
WP_009898076.1, WP_009903199.1, WP_010297529.1, WP_010349458.1, WP_010416802.1,
WP_010478263.1, WP_010539053.1, WP_010680294.1, WP_010747304.1, WP_010876711.1,
WP_010880194.1, WP_010884280.1, WP_011032513.1, WP_011099683.1, WP_011153017.1,
WP_011222268.1, WP_011345042.1, WP_011406022.1, WP_011406529.1, WP_011460587.1,
WP_011499197.1, WP_011563263.1, WP_011591964.1, WP_011641199.1, WP_011641887.1,
WP_011695827.1, WP_011722695.1, WP_011731898.1, WP_011868533.1, WP_011876919.1,
WP_011915679.1, WP_011915922.1, WP_011972044.1, WP_011973780.1, WP_011992225.1,
WP_012002255.1, WP_012056583.1, WP_012094490.1, WP_012108278.1, WP_012209664.1,
WP_012310883.1, WP_012547538.1, WP_012574445.1, WP_012580096.1, WP_012580506.1,
WP_012582995.1, WP_012636455.1, WP_012660065.1, WP_012662914.1, WP_012674044.1,
WP_012676124.1, WP_012749051.1, WP_012876353.1, WP_012928368.1, WP_012955597.1,
WP_012963882.1, WP_012964358.1, WP_012980755.1, WP_012984912.1, WP_012996180.1,
WP_013007282.1, WP_013008930.1, WP_013035118.1, WP_013071006.1, WP_013076647.1,
WP_013076658.1, WP_013100593.1, WP_013121323.1, WP_013144991.1, WP_013149498.1,
WP_013150996.1, WP_013179914.1, WP_013274916.1, WP_013289495.1, WP_013291509.1,
WP_013299028.1, WP_013378496.1, WP_013400577.1, WP_013401699.1, WP_013404324.1,
WP_013404370.1, WP_013406000.1, WP_013431321.1, WP_013431364.1, WP_013433571.1,
WP_013433674.1, WP_013433716.1, WP_013452028.1, WP_013495975.1, WP_013522865.1,
WP_013538360.1, WP_013611556.1, WP_013624561.1, WP_013720552.1, WP_013720767.1,
WP_013756175.1, WP_013777244.1, WP_013781803.1, WP_013789006.1, WP_013821593.1,
WP_013821731.1, WP_013842963.1, WP_013860398.1, WP_013886103.1, WP_013906178.1,
WP_013932950.1, WP_013987427.1, WP_013999401.1, WP_014011704.1, WP_014030716.1,
WP_014043370.1, WP_014043409.1, WP_014097198.1, WP_014121669.1, WP_014162428.1,
WP_014220988.1, WP_014255349.1, WP_014255747.1, WP_014357263.1, WP_014255905.1,
WP_014731690.1, WP_014733230.1, WP_014757342.1, WP_014789642.1, WP_014807423.1,
WP_014863258.1, WP_014958324.1, WP_014966832.1, WP_015017880.1, WP_015051481.1,
WP_015255924.1, WP_015312651.1, WP_015359322.1, WP_015359550.1, WP_015394875.1,
WP_015411188.1, WP_015419281.1, WP_015425006.1, WP_015526373.1, WP_015556824.1,
WP_015562678.1, WP_015738986.1, WP_015756526.1, WP_015758448.1, WP_015759626.1,
WP_015763782.1, WP_015769053.1, WP_015789202.1, WP_015791978.1, WP_015849757.1,
WP_015864169.1, WP_015868054.1, WP_015908968.1, WP_015919205.1, WP_015944885.1,
WP_016357733.1, WP_016647300.1, WP_016749617.1, WP_016677943.1, WP_016777739.1,
WP_016779144.1, WP_016994003.1, WP_017189923.1, WP_017434389.1, WP_017552095.1,
WP_017554266.1, WP_017810384.1, WP_017826607.1, WP_017859611.1, WP_017873805.1,
WP_017890209.1, WP_017894954.1, WP_017950341.1, WP_017980957.1, WP_018060553.1,
WP_018130449.1, WP_018153317.1, WP_018154663.1, WP_018198202.1, WP_018206663.1,
WP_018212753.1, WP_018258159.1, WP_018336665.1, WP_018449895.1, WP_018590790.1,
WP_018621541.1, WP_018676647.1, WP_018713222.1, WP_018963747.1, WP_019117053.1,
WP_019118942.1, WP_019279291.1, WP_019416835.1, WP_019419612.1, WP_019540683.1,
WP_019555032.1, WP_019989965.1, WP_020005376.1, WP_020220935.1, WP_020253928.1,
WP_020448804.1, WP_020537507.1, WP_020597827.1, WP_020764874.1, WP_020765660.1,

TABLE 12-continued

Type I-B cas5 polypeptide accession numbers
(the sequence identifier for each accession number, in the order provided in
Table 12, is SEQ ID NOs: 1210-2372).

WP_020774541.1, WP_020807610.1, WP_021107120.1, WP_021253690.1, WP_021269704.1,
WP_021283464.1, WP_021359474.1, WP_021362775.1, WP_021363719.1, WP_021365608.1,
WP_021366837.1, WP_021370585.1, WP_021371379.1, WP_021373544.1, WP_021376075.1,
WP_021376238.1, WP_021377151.1, WP_021377511.1, WP_021385852.1, WP_021397104.1,
WP_021401513.1, WP_021408544.1, WP_021412493.1, WP_021412801.1, WP_021418533.1,
WP_021423807.1, WP_021780359.1, WP_021836910.1, WP_021875388.1, WP_021914500.1,
WP_021941129.1, WP_021988548.1, WP_022048652.1, WP_022070399.1, WP_022070968.1,
WP_022169013.1, WP_022172989.1, WP_022213074.1, WP_022228560.1, WP_022234505.1,
WP_022298983.1, WP_022302637.1, WP_022343367.1, WP_022431365.1, WP_022477154.1,
WP_022588387.1, WP_022670961.1, WP_022711582.1, WP_022745992.1, WP_022746618.1,
WP_022748671.1, WP_022819291.1, WP_022846698.1, WP_022854086.1, WP_022855920.1,
WP_022856208.1, WP_023037412.1, WP_023039491.1, WP_023039733.1, WP_023438404.1,
WP_023484747.1, WP_023844484.1, WP_023991513.1, XP_003208052.1, XP_004141494.1,
YP_001039591.1, YP_001089497.1, YP_001097294.1, YP_001111907.1, YP_001178904.1,
YP_001179153.1, YP_001305607.1, YP_001322753.1, YP_001325260.1, YP_001375292.1,
YP_001405996.1, YP_001408163.1, YP_001469838.1, YP_001568890.1, YP_001664133.1,
YP_001739053.1, YP_002250044.1, YP_002315131.1, YP_002335044.1, YP_002335721.1,
YP_002352524.1, YP_002460387.1, YP_002509267.1, YP_002534252.1, YP_002574497.1,
YP_002581621.1, YP_002601829.1, YP_002728848.1, YP_002731106.1, YP_002940392.1,
YP_002948500.1, YP_002950001.1, YP_002994889.1, YP_003128745.1, YP_003130361.1,
YP_003163696.1, YP_003178647.1, YP_003190433.1, YP_003192379.1, YP_003193579.1,
YP_003215318.1, YP_003215785.1, YP_003219292.1, YP_003238959.1, YP_003252320.1,
YP_003324144.1, YP_003388656.1, YP_003423538.1, YP_003432903.1, YP_003433379.1,
YP_003458582.1, YP_003463661.1, YP_003478056.1, YP_003495790.1, YP_003497449.1,
YP_003533666.1, YP_003584059.1, YP_003590508.1, YP_003590519.1, YP_003616812.1,
YP_003641230.1, YP_003671008.1, YP_003675823.1, YP_003677874.1, YP_003707159.1,
YP_003728008.1, YP_003824487.1, YP_003839474.1, YP_003841501.1, YP_003853156.1,
YP_003877866.1, YP_003958124.1, YP_003988875.1, YP_003990720.1, YP_003993555.1,
YP_003993604.1, YP_003995276.1, YP_004025072.1, YP_004025118.1, YP_004027469.1,
YP_004027576.1, YP_004027619.1, YP_004051982.1, YP_004102399.1, YP_004130955.1,
YP_004152216.1, YP_004185144.1, YP_004252518.1, YP_004265692.1, YP_004385355.1,
YP_004385601.1, YP_004437581.1, YP_004459627.1, YP_004464198.1, YP_004471952.1,
YP_004515879.1, YP_004516017.1, YP_004546497.1, YP_004569898.1, YP_004587625.1,
YP_004589471.1, YP_004603181.1, YP_004624394.1, YP_004660838.1, YP_004720452.1,
YP_004742714.1, YP_004761696.1, YP_004785824.1, YP_004799899.1, YP_004799948.1,
YP_004832233.1, YP_004859899.1, YP_004932102.1, YP_005010479.1, YP_005046694.1,
YP_005047109.1, YP_005258418.1, YP_005270555.1, YP_005511921.1, YP_005839932.1,
YP_006199528.1, YP_006199999.1, YP_006347178.1, YP_006351426.1, YP_006353779.1,
YP_006391020.1, YP_006425805.1, YP_006444523.1, YP_006540250.1, YP_006761819.1,
YP_006860990.1, YP_006921118.1, YP_006932081.1, YP_006950412.1, YP_007179026.1,
YP_007214187.1, YP_007270779.1, YP_007299923.1, YP_007373248.1, YP_007373480.1,
YP_007457820.1, YP_007489272.1, YP_007500038.1, YP_007647092.1, YP_007679668.1,
YP_007679886.1, YP_007784188.1, YP_007827923.1, YP_007835090.1, YP_007943786.1,
YP_007944036.1, YP_007978159.1, YP_008285600.1, YP_008377026.1, YP_008406928.1,
YP_008698879.1, YP_008773654.1, YP_008874108.1, YP_008915223.1, YP_008991100.1,
YP_134129.1, YP_360969.1, YP_398447.1, YP_519003.1, YP_519038.1, YP_565800.1, YP_643057.1,
YP_754475.1, YP_755178.1, YP_815364.1, and/or YP_878707.1

In some embodiments, Type I-C cas5d polypeptides include, but are not limited to, GenBank accession number as set forth in Table 13.

TABLE 13

Type I-C cas5d polypeptide accession numbers
(the sequence identifier for each accession number, in the order provided in
Table 13, is SEQ ID NOs: 2373-2973).

AAN47887.1, AAS71465.1, AAU93027.1, AAW74125.1, ABA05200.1, ABB24156.1, ABB28271.1,
ABB31305.1, ABC21630.1, ABD12699.1, ABE48872.1, ABF32471.1, ABF34436.1, ABF36361.1,
ABF38347.1, ABF88231.1, ABM29988.1, ABN07020.1, ABO49538.1, ABP81369.1, ABQ92672.1,
ABR74840.1, ABR74645.1, ACA16216.1, ACD60966.1, ACL75831.1, ACM21758.1, ACO79325.1,
ACR11997.1, ADD28250.1, ADK85026.1, ADP88372.1, ADX47760.1, ADY55247.1, ADY61451.1,
ADY61692.1, ADZ26350.1, AEB11036.1, AEC00930.1, AEE12857.1, AEE17592.1, AEF93427.1,
AEG01411.1, AEG34528.1, AEH55427.1, AEI38602.1, AEO47325.1, AER01367.1, AER57692.1,
AEY65499.1, AFM23519.1, AFM40489.1, AFY70023.1, AGB03721.1, AGC48888.1, AGF80046.1,
AGH38686.1, AGK13303.1, AGK17629.1, AHC14003.1, AHC19699.1, AHG83784.1, AHG86670.1,
BAE67552.1, BAF39966.1, BAF60174.1, BAG13699.1, BAL68714.1, BAM02852.1, CAI07977.1,
CAP54006.1, CBA17364.1, CCF16785.1, CCF67638.1, CCG39875.1, CCI63164.1, CCK83453.1,
CCO74227.1, CCP41950.1, CCU72640.1, CCU78371.1, CCW39407.1, CCX48117.1, CCX73938.1,
CCY00154.1, CCY02819.1, CCY33507.1, CCZ32691.1, CCZ61766.1, CCZ62159.1, CCZ84350.1,
CDA15005.1, CDA52082.1, CDA89887.1, CDB26704.1, CDB62743, CDC12997.1, CDC50441.1,
CDC62359.1, CDD04553.1, CDD57368.1, CDD59788.1, CDD98974.1, CDE11994.1, CDE46264.1,

TABLE 13-continued

Type I-C cas5d polypeptide accession numbers
(the sequence identifier for each accession number, in the order provided in
Table 13, is SEQ ID NOs: 2373-2973).

CDE57765.1, CDF15831.1, CDI43446.1, EAQ36306.1, EAT02164.1, EAW36788.1, EBA01539.1,
EDN01971.1, EDN73323.1, EDN76105.1, EDN84715.1, EDP14354.1, EDP25154.1, EDS00205.1,
EDS06800.1, EDT45690.1, EDY32905.1, EDY96625.1, EEA82743.1, EEF65984.1, EEF76899.1,
EEG30526.1, EEG33494.1, EEG56415.1, EEG71148.1, EEG75123.1, EEG96116.1, EEK17367.1,
EEN82611.1, EEO46556.1, EEO62000.1, EEP28832.1, EEP68243.1, EEQ48800.1, EEQ57500.1,
EER56004.1, EES74000.1, EET16694.2, EET44432.1, EET62042.1, EEV89051.1, EEX49287.1,
EEX75937.1, EEY11080.1, EEZ20539.1, EEZ74756.1, EEZ75907.1, EFA89364.1, EFB90880.1,
EFC51247.1, EFC87155.1, EFE11615.1, EFE27918.2, EFF66131.1, EFH21870.1, EFP59912.1,
EFR33752.1, EFR34549.1, EFR37025.1, EFR40957.1, EFR44859.1, EFT83495.1, EFV01200.1,
EFW29035.1, EGB18208.1, EGC03292.1, EGC18025.1, EGC88888.1, EGN35867.1, EGN46214.1,
EGV28562.1, EGZ49812.1, EHJ47330.1, EHQ07660.1, EHQ62726.1, EHQ90704.1, EIA28593.1,
EIA30742.1, EIC02345.1, EIG30391.1, EIG54632.1, EIJ33768.1, EIJ71548.1, EIJ72649.1, EIJ78013.1,
EIK41596.1, EIQ00066.1, EIQ82361.1, EIT84251.1, EIT88137.1, EIW20398.1, EIW25543.1,
EIW30558.1, EIW33390.1, EIW37237.1, EIY19180.1, EJF40816.1, EJG08368.1, EJL40220.1,
EJN54261.1, EJO19217.1, EJO71191.1, EJO77909.1, EJP02512.1, EJP15600.1, EJP31579.1,
EJP85726.1, EJR26612.1, EJR51643.1, EJR72343.1, EJR80197.1, EJS99959.1, EJU16729.1,
EJU25585.1, EJV73300.1, EJW17219.1, EKD25943.1, EKE30555.1, EKF43331.1, EKF36597.1,
EKM99102.1, EKN16809.1, EKN28426.1, EKN66244.1, EKN88372.1, EKN97010.1, EKO05463.1,
EKO14413.1, EKO24496.1, EKO52394.1, EKO59410.1, EKO69592.1, EKO85513.1, EKO94714.1,
EKP04538.1, EKP23618.1, EKP78025.1, EKP85221.1, EKP95534.1, EKQ39148.1, EKQ47929.1,
EKQ85360.1, EKR06490.1, EKR19532.1, EKR25214.1, EKR36497.1, EKR44692.1, EKR54130.1,
EKR74668.1, EKR81621.1, EKT63594.1, EKU24260.1, EKU70788.1, EKU87705.1, EKX89481.1,
EKX93849.1, EKX95308.1, EKY02929.1, ELK39519.1, ELQ17187.1, ELR65960.1, EMB53450.1,
EMB56302.1, EMB59747.1, EMB80077.1, EMB82084.1, EMB86593.1, EMB91875.1, EMB92064.1,
EMB98504.1, EMC28293.1, EMC29746.1, EMC55689.1, EMC60782.1, EME03979.1, EMF35391.1,
EMF42537.1, EMF73168.1, EMG11434.1, EMG19652.1, EMI28181.1, EMI63036.1, EMI71643.1,
EMJ34610.1, EMJ52878.1, EMJ58561.1, EMJ63192.1, EMJ69822.1, EMJ72472.1, EMJ80487.1,
EMJ91108.1, EMK06063.1, EMK07518.1, EMK16097.1, EMK18463.1, EMK26085.1, EMM84360.1,
EMM90741.1, EMM95783.1, EMM98819.1, EMN05664.1, EMN10273.1, EMN27475.1, EMN31752.1,
EMN36998.1, EMN40224.1, EMN50554.1, EMN52177.1, EMN64664.1, EMN64895.1, EMN71239.1,
EMN74221.1, EMN81741.1, EMN86854.1, EMN94812.1, EMN98288.1, EMO03582.1, EMO16704.1,
EMO29549.1, EMO34946.1, EMO42449.1, EMO51779.1, EMO65720.1, EMO77648.1, EMO79157.1,
EMO89088.1, EMO95187.1, EMP06745.1, EMP59158.1, EMP62865.1, EMS72177.1, EMS78533.1,
EMS83941.1, EMS85265.1, EMY05817.1, EMY23092.1, EMY55686.1, EMZ33824.1, ENO72457.1,
ENO77317.1, ENO81519.1, ENO88271.1, ENZ10232.1, ENZ16947.1, ENZ39043.1, ENZ43232.1,
ENZ45620.1, ENZ47416.1, ENZ54159.1, ENZ69350.1, EOA56068.1, EOH98199.1, EOO33053.1,
EOP18423.1, EOP32138.1, EOP44811.1, EOP55656.1, EOP60321.1, EOP87876.1, EOQ6053.1,
EOS00147.1, EOS28523.1, EOS50042.1, EOS54453.1, EOS63279.1, EOS64688.1, EOS73779.1,
EOS81387.1, EOT59712.1, EPD37767.1, EPD56031.1, EPD62541.1, EPD77060.1, EPE60577.1,
EPE83066.1, EPF25861.1, EPG50259.1, EPL64359.1, EPP16776.1, EPP17871.1, EPT71507.1,
EPT84064.1, EPU02094.1, EPU03828.1, EPU52082.1, EPU54910.1, EPU81442.1, EPU87008.1,
EPU94208.1, EPU97405.1, EPV01336.1, EPV02195.1, EPV09631.1, EPV18668.1, EPV22733.1,
EPV25619.1, EPV40784.1, EPV50545.1, EPV51910.1, EPV55807.1, EPV62103.1, EPV65175.1,
EPV98861.1, EPW00870.1, EPW07126.1, EPW16761.1, EPW44453.1, EPW59772.1, EPW65049.1,
EPW65528.1, EPW80674.1, EPW81318.1, EPW82924.1, EPW86859.1, EPX25333.1, EPX29203.1,
EPY00286.1, EPZ01875.1, EPZ27872.1, EPZ29478.1, EPZ29867.1, EPZ46610.1, EQA71137.1,
EQA92571.1, ERF77711.1, ERH28583.1, ERH28850.1, ERH97080.1, ERI04267.1, ERI61373.1,
ERI68386.1, ERJ00271.1, ERJ69593.1, ERJ89572.1, ERJ93149.1, ERK03389.1, ERK56583.1,
ERK64508.1, ERK89621.1, ERL04025.1, ERL17229.1, ERP31666.1, ERP96324.1, ERS87977.1,
ERV42109.1, ERV60145.1, ERY77980.1, ESA51291.1, ESQ15434.1, EST51947.1, ESU95723.1,
ETA80090.1, ETD20913.1, ETE90141.1, ETI70720.1, GAB60573.1, GAC40772.1, GAD39350.1,
GAE10003.1, NP_710869.1, WP_000448696.1, WP_002270820.1, WP_002284930.1,
WP_003680283.1, WP_004260232.1, WP_004448864.1, WP_004757770.1, WP_005487698.1,
WP_006966953.1, WP_007465278.1, WP_008224256.1, WP_009605936.1, WP_009729418.1,
WP_009784757.1, WP_010259997.1, WP_010543173.1, WP_011257746.1, WP_011315193.1,
WP_011388584.1, WP_011556938.1, WP_011743510.1, WP_011745279.1, WP_011787403.1,
WP_011914754.1, WP_011959009.1, WP_012033149.1, WP_012062878.1, WP_012073022.1,
WP_012222310.1, WP_012331626.1, WP_014436072.1, WP_015164989.1, WP_015286683.1,
WP_015405728.1, WP_015432824.1, WP_015487358.1, WP_015924973.1, WP_016217545.1,
WP_016229737.1, WP_016271358.1, WP_016293318.1, WP_016309858.1, WP_016313870.1,
WP_016314947.1, WP_016323949.1, WP_016439663.1, WP_016441069.1, WP_016453851.1,
WP_016478058.1, WP_016480397.1, WP_017690352.1, WP_018887427.1, WP_018916770.1,
WP_019604447.1, WP_021495565.1, WP_021615274.1, WP_021615581.1, WP_021625750.1,
WP_021631528.1, WP_021636852.1, WP_021659784.1, WP_021666376.1, WP_021685844.1,
WP_021687360.1, WP_021774882.1, WP_021932607.1, WP_022180174.1, WP_023389231.1,
WP_023411381.1, WP_023967437.1, WP_023988272.1, YP_001030287.1, YP_001174211.1,
YP_001212543.1, YP_001278622.1, YP_001319499.1, YP_001344580.1, YP_001600359.1,
YP_001768650.1, YP_001915498.1, YP_002018512.1, YP_002505811.1, YP_002538859.1,
YP_002800300.1, YP_002828.1, YP_003074489.1, YP_003377358.1, YP_003507270.1,
YP_003807620.1, YP_004236327.1, YP_004265248.1, YP_004271473.1, YP_004271714.1,
YP_004294512.1, YP_004367146.1, YP_004414389.1, YP_004440723.1, YP_004442025.1,
YP_004496339.1, YP_004513910.1, YP_004673775.1, YP_004931733.1, YP_005147304.1,
YP_005444749.1, YP_005641655.1, YP_005704010.1, YP_005987350.1, YP_006047122.1,
YP_006250657.1, YP_006720033.1, YP_007102451.1, YP_007250228.1, YP_007364572.1,
YP_007469699.1, YP_007548477.1, YP_007682877.1, YP_007894110.1, YP_007899159.1,
YP_008086287.1, YP_008911632.1, YP_088180.1, YP_113169.1, YP_199510.1, YP_318552.1,

TABLE 13-continued

Type I-C cas5d polypeptide accession numbers
(the sequence identifier for each accession number, in the order provided in
Table 13, is SEQ ID NOs: 2373-2973).

YP_375199.1, YP_379314.1, YP_425917.1, YP_434017.1, YP_449826.1, YP_482428.1, YP_525132.1,
YP_544713.1, YP_635132.1, YP_910048.1, YP_911887.1, and/or YP_961176.1

In some embodiments, Type I-C cas8c/csd1 polypeptides include, but are not limited to, GenBank accession number as set forth in Table 14.

TABLE 14

Type I-C cas8c/csd1 polypeptide accession numbers
(the sequence identifier for each accession number, in the order provided in
Table 14, is SEQ ID NOs: 2974-3847).

ABA05199.1, ABB24157.1, ABB28270.1, ABB31306.1, ABC18826.1, ABC21631.1, ABD12700.1,
ABD71602.1, ABE48873.1, ABF44540.1, ABF90712.1, ABI59275.1, ABI67812.1, ABK46006.1,
ABL65462.1, ABM29987.1, ABN07019.1, ABO49539.1, ABP37314.1, ABQ92671.1, ABR47841.1,
ABR74967.1, ACA16217.1, ACB33428.1, ACB59636.1, ACD60967.1, ACE84720.1, ACF43896.1,
ACG61922.1, ACI51408.1, ACL08916.1, ACM01819.1, ACM21757.1, ACO32176.1, ACO79324.1,
ACR12476.1, ACS96760.1, ACV55941.1, ACV64359.1, ACV76426.1, ACX95670.1, ADB10233.1,
ADB47146.1, ADD28249.1, ADD43241.1, ADE15051.1, ADE85054.1, ADG82737.1, ADH65195.1,
ADI02309.1, ADI14779.1, ADK80204.1, ADK85027.1, ADO43028.1, ADP70486.1, ADP88373.1,
ADU21656.1, ADU26220.1, ADU44692.1, ADV45013.1, ADW17643.1, ADX47761.1, ADY55248.1,
ADY61450.1, ADY61691.1, ADZ26349.1, AEB11037.1, AEC00929.1, AEE12858.1, AEE17591.1,
AEF28113.1, AEF93428.1 AEG01412.1, AEG34529.1, AEG59677.1, AEH52451.1, AEH55428.1,
AEI38601.1, AEI64170.1, AEJ20057.1, AEM41208.1, AEN97652.1, AEO47326.1, AEP00022.1,
AER57693.1, AET67442.1, AEV30965.1, AEY65500.1, AFI86060.1, AFI87838.1, AFK56997.1,
AFM23520.1, AFM40490.1, AFU17710.1, AFY70024.1, AFY93137.1, AFY97160.1, AGA59292.1,
AGB03720.1, AGB28831.1, AGC48887.1, AGF80045.1, AGG05730.1, AGH38687.1, AGH40905.1,
AGI32649.1, AGI35531.1, AGK06311.1, AGK13351.1, AGK17701.1, AGL03421.1, AGQ24918.1,
AGQ37969.1, AGQ40483.1, AGR74823.1, AGS46823.1, AHB48174.1, AHF04637.1, AHG75933.1,
AHG77943.1, AHG79312.1, AHG81512.1, AHG83783.1, AHG86052.1, AHG86671.1, AHJ19773.1,
BAG13700.1, BAK19890.1, BAK56463.1, BAK66415.1, BAK79792.1, BAK81139.1, BAL68715.1,
BAN13313.1, BAN59902.1, CBK76220.1, CBK91609.1, CBK92830.1, CBK99509.1, CBL17827.1,
CBL34516.1, CCE23846.1, CCF67637.1, CCG39876.1, CCI63163.1, CCQ74034.1, CCQ93019.1,
CCU78373.1, CCW39408.1, CCY14613.1, CCY86584.1, CCZ32692.1, CCZ61765.1, CCZ84351.1,
CDA52083.1, CDA72500.1, CDB26703.1, CDB62744.1, CDC38727.1, CDC50442.1, CDD54040.1,
CDD59789.1, CDE06406.1, CDE11995.1, CDE34088.1, CDE46265.1, CDF23237.1, CDI43445.1,
EDN01972.1, EDN76104.1, EDN84716.1, EDP25155.1, EDS00206.1, EDS06799.1, EDT45691.1,
EDY32906.1, EDY84711.1, EDY96624.1, EEA82742.1, EEF66037.1, EEF76900.1, EEG30525.1,
EEG33493.1, EEG56416.1, EEG71147.1, EEG75122.1, EEG96117.1, EEK17397.1, EEN82623.1,
EEO46555.1, EEO62001.1, EEP28831.1, EEP68242.1, EEQ48799.1, EEQ57499.1, EER55952.1,
EES74001.1, EET16693.1, EET44433.1, EET62043.1, EEV89052.1, EEX49286.1, EEX75938.1,
EEZ20540.1, EEZ75908.1, EFA89355.1, EFB90881.1, EFC51246.1, EFC87154.1, EFC91098.1,
EFE11614.1, EFE27917.1, EFE93114.1, EFF66130.1, EFH21871.1, EFI35152.1, EFR33734.1,
EFR34562.1, EFR36958.1, EFR40986.1, EFR44838.1, EFT83496.1, EFV01199.1, EFW29036.1,
EGB16323.1, EGB18207.1, EGB94719.1, EGC03294.1, EGC16024.1, EGC76280.1, EGC88882.1,
EGD49242.1, EGJ10201.1, EGN46212.1, EGO64861.1, EGQ14153.1, EGQ77215.1, EGT75761.1,
EGT79805.1, EGT80245.1, EGT82116.1, EGV28563.1, EGV37140.1, EGV37199.1, EGW49962.1,
EGW53125.1, EGX28856.1, EGX72598.1, EGY32747.1, EGY34069.1, EGY34246.1, EGY35532.1,
EGY35533.1, EGY37221.1, EGY37222.1, EGY38194.1, EGY38195.1, EGY38196.1, EGY39574.1,
EGY39515.1, EGY39871.1, EGY41443.1, EGY43833.1, EGY43834.1, EGY46702.1, EGY53774.1,
EGY61571.1, EGY70644.1, EGY70863.1, EGY70864.1, EGZ44570.1, EGZ49813.1, EHB62323.1,
EHB89139.1, EHE98230.1, EHF02460.1, EHG19004.1, EHG22081.1, EHG23346.1, EHG32769.1,
EHJ47329.1, EHK89719.1, EHM10679.1, EHM13739.1, EHM50511.1, EHM53517.1, EHO85750.1,
EHP86556.1, EHQ07661.1, EHQ90703.1, EIA21871.1, EIA23998.1, EIA23999.1, EIA26371.1,
EIA26756.1, EIA28592.1, EIA30743.1, EIC02344.1, EIC21113.1, EIG54631.1, EIJ33767.1, EIL98038.1,
EIM57402.1, EIQ00067.1, EIT88136.1, EIW20397.1, EIW25544.1, EIW30557.1, EIW33391.1,
EIW37238.1, EJG08367.1, EJL40221.1, EKD25944.1, EKD37960.1, EKD69492.1, EKD96705.1,
EKM99103.1, EKP95535.1, EKU24259.1, EKX89480.1, EKX93848.1, EKX94125.1, EKX95307.1,
EKY02930.1, ELQ17186.1, ELR65961.1, ELT53857.1, ELT54756.1, ELT58107.1, ELT59489.1,
EME03980.1, EMI28182.1, EMS72167.1, EPE60583.1, EPL64358.1, EPR34125.1, EPR43457.1,
EPT71506.1, EPU52081.1, EPU54909.1, EPU81441.1, EPU87009.1, EPU94207.1, EPU97404.1,
EPV01335.1, EPV02196.1, EPV09632.1, EPV18667.1, EPV22732.1, EPV25620.1, EPV35742.1,
EPV40783.1, EPV50546.1, EPV51909.1, EPV55808.1, EPV65176.1, EPV98862.1, EPW00871.1,
EPW07125.1, EPW16760.1, EPW44452.1, EPW59771.1, EPW65048.1, EPW65529.1, EPW80673.1,
EPW82925.1, EPW86858.1, EPX25332.1, EPX29204.1, EPY00287.1, EPZ01876.1, EPZ27871.1,
EPZ29477.1, EPZ29668.1, EQA92570.1, ERH28584.1, ERH28851.1, ERI04266.1, ERI61374.1,
ERI68076.1, ERI68387.1, ERI74757.1, ERJ00272.1, ERJ69594.1, ERJ89573.1, ERJ93148.1,
ERK56584.1, ERK64509.1, ERK89620.1, ERL04024.1, ESR08823.1, ETA80089.1, ETD02079.1,
ETD77753.1, ETD86666.1, ETE54111.1, EWS78075.1, GAF23122.1, WP_000345443.1,
WP_000345444.1, WP_002568438.1, WP_002595865.1, WP_002606245.1, WP_002703148.1,
WP_002707716.1, WP_002725660.1, WP_002773709.1, WP_002849082.1, WP_002930618.1,
WP_002989033.1, WP_003044513.1, WP_003051949.1, WP_003062221.1, WP_003465420.1,

TABLE 14-continued

Type I-C cas8c/csd1 polypeptide accession numbers
(the sequence identifier for each accession number, in the order provided in
Table 14, is SEQ ID NOs: 2974-3847).

WP_003680670.1, WP_003685597.1, WP_003708651.1, WP_003713924.1, WP_003744750.1,
WP_003746232.1, WP_003754490.1, WP_003758690.1, WP_003762755.1, WP_003777776.1,
WP_003781698.1, WP_003797746.1, WP_004040744.1, WP_004093890.1, WP_004284051.1,
WP_004285513.1, WP_004331271.1, WP_004333880.1, WP_004397038.1, WP_004513242.1,
WP_004520755.1, WP_004612294.1, WP_004617478.1, WP_004625421.1, WP_004826227.1,
WP_004853850.1, WP_005487699.1, WP_005540295.1, WP_005540298.1, WP_005540835.1,
WP_005550134.1, WP_005552081.1, WP_005552083.1, WP_005555120.1, WP_005556489.1,
WP_005557287.1, WP_005563370.1, WP_005563372.1, WP_005563373.1, WP_005565164.1,
WP_005565917.1, WP_005567427.1, WP_005578608.1, WP_005579127.1, WP_005582661.1,
WP_005586615.1, WP_005587225.1, WP_005610783.1, WP_005626995.1, WP_005635205.1,
WP_005636526.1, WP_005642817.1, WP_005646984.1, WP_005660279.1, WP_005702613.1,
WP_005703627.1, WP_005759025.1, WP_005806400.1, WP_005820512.1, WP_005846119.1,
WP_005856772.1, WP_005927103.1, WP_005955348.1, WP_006116165.1, WP_006194036.1,
WP_006248108.1, WP_006250670.1, WP_006252735.1, WP_006253508.1, WP_006269870.1,
WP_006306919.1, WP_006521533.1, WP_006599002.1, WP_006689561.1, WP_006693577.1,
WP_006695539.1, WP_006786410.1, WP_006860504.1, WP_006872858.1, WP_006903556.1,
WP_006986820.1, WP_007042344.1, WP_007363024.1, WP_007364828.1, WP_007439947.1,
WP_007439948.1, WP_007465280.1, WP_007489325.1, WP_007524562.1, WP_007708673.1,
WP_007785240.1, WP_007863415.1, WP_007892671.1, WP_007931218.1, WP_008104116.1,
WP_008387836.1, WP_008398233.1, WP_008437583.1, WP_008494662.1, WP_008519402.1,
WP_008523302.1, WP_008664695.1, WP_008687427.1, WP_008816402.1, WP_008870466.1,
WP_008974804.1, WP_008979465.1, WP_009002351.1, WP_009109519.1, WP_009117236.1,
WP_009117700.1, WP_009151516.1, WP_009164689.1, WP_009180733.1, WP_009213700.1,
WP_009245301.1, WP_009255682.1, WP_009257010.1, WP_009278655.1, WP_009303812.1,
WP_009311471.1, WP_009350456.1, WP_009427626.1, WP_009437516.1, WP_009438895.1,
WP_009441727.1, WP_009605933.1, WP_009646998.1, WP_009657051.1, WP_009658389.1,
WP_009666494.1, WP_009796705.1, WP_009856766.1, WP_009880809.1, WP_009984821.1,
WP_010245161.1, WP_010259993.1, WP_010372414.1, WP_010381903.1, WP_010543172.1,
WP_010603693.1, WP_010621278.1, WP_010626368.1, WP_010922511.1, WP_010932805.1,
WP_010959997.1, WP_011052556.1, WP_011074659.1, WP_011134781.1, WP_011174430.1,
WP_011176708.1, WP_011200164.1, WP_011257745.1, WP_011284986.1, WP_011285646.1,
WP_011315192.1, WP_011358029.1, WP_011362035.1, WP_011388585.1, WP_011392033.1,
WP_011396662.1, WP_011478970.1, WP_011528830.1, WP_011529386.1, WP_011556937.1,
WP_011634098.1, WP_011715062.1, WP_011743508.1, WP_011743509.1, WP_011745278.1,
WP_011787404.1, WP_011877368.1, WP_011890537.1, WP_011914755.1, WP_011959008.1,
WP_012062879.1, WP_012073023.1, WP_012222309.1, WP_012331627.1, WP_012346190.1,
WP_012508383.1, WP_012515198.1, WP_012553887.1, WP_012560835.1, WP_012613091.1,
WP_012678341.1, WP_012701708.1, WP_012743317.1, WP_012771280.1, WP_012817718.1,
WP_012823706.1, WP_012917358.1, WP_012938135.1, WP_013013751.1, WP_013032917.1,
WP_013067033.1, WP_013120747.1, WP_013159709.1, WP_013175711.1, WP_013178147.1,
WP_013253668.1, WP_013258480.1, WP_013300568.1, WP_013384679.1, WP_013418890.1,
WP_013448701.1, WP_013484590.1, WP_013497833.1, WP_013502809.1, WP_013548690.1,
WP_013559648.1, WP_0135962371, WP_013624119.1, WP_013630167.1, WP_013647393.1,
WP_013703092.1, WP_013759293.1, WP_013760347.1, WP_013809681.1, WP_013819641.1,
WP_013841448.1, WP_013858350.1, WP_013902815.1, WP_013903479.1, WP_013937331.1,
WP_013945609.1, WP_013969347.1, WP_014017910.1, WP_014076066.1, WP_014080658.1,
WP_014094599.1, WP_014096166.1, WP_014161866.1, WP_014184259.1, WP_014271804.1,
WP_014312879.1, WP_014323747.1, WP_014511147.1, WP_014612477.1, WP_014677805.1,
WP_014702219.1, WP_014702545.1, WP_014747986.1, WP_014826497.1, WP_015164990.1,
WP_015353140.1, WP_015405727.1, WP_015406748.1, WP_015423228.1, WP_015432825.1,
WP_015450165.1, WP_015484658.1, WP_015517329.1, WP_015558733.1, WP_015565151.1,
WP_015567095.1, WP_015572965.1, WP_015724184.1, WP_015759046.1, WP_015818588.1,
WP_015860138.1, WP_015895951.1, WP_015921089.1, WP_016480398.1, WP_016510768.1,
WP_016687509.1, WP_017113403.1, WP_017116852.1, WP_017117513.1, WP_017119023.1,
WP_017364194.1, WP_017551361.1, WP_017647433.1, WP_017907376.1, WP_018305950.1,
WP_018366929.1, WP_018465584.1, WP_018652891.1, WP_019273185.1, WP_019314884.1,
WP_019703287.1, WP_019802801.1, WP_019802802.1, WP_020880188.1, WP_020886853.1,
WP_021133647.1, WP_021615275.1, WP_021615582.1, WP_021625749.1, WP_021631529.1,
WP_021636853.1, WP_021637096.1, WP_021640899.1, WP_021666785.1, WP_021666377.1,
WP_021685845.1, WP_021687359.1, WP_021751294.1, WP_021774881.1, WP_021906521.1,
WP_022009885.1, WP_022033203.1, WP_022049339.1, WP_022108014.1, WP_022127777.1,
WP_022177038.1, WP_022202383.1, WP_022264214.1, WP_022272155.1, WP_022356883.1,
WP_022363356.1, WP_022402825.1, WP_022410982.1, WP_022427821.1, WP_022445691.1,
WP_022512574.1, WP_022654264.1, WP_022656791.1, WP_022681041.1, WP_023389232.1,
WP_023514069.1, WP_023786786.1, WP_023921140.1, WP_024105343.1, WP_024108605.1,
WP_024109517.1, YP_001112364.1, YP_001130816.1, YP_001174212.1, YP_001278621.1,
YP_001319500.1, YP_001344581.1, YP_001768651.1, YP_001790193.1, YP_001812653.1,
YP_001915499.1, YP_001956161.1, YP_001982916.1, YP_002018513.1, YP_002122935.1,
YP_002276023.1, YP_002436384.1, YP_002526320.1, YP_002538858.1, YP_002753896.1,
YP_002800299.1, YP_003006847.1, YP_003074488.1, YP_003182330.1, YP_003192982.1,
YP_003227010.1, YP_003262717.1, YP_003361057.1, YP_003398461.1, YP_003507269.1,
YP_003512334.1, YP_003527438.1, YP_003577461.1, YP_003640638.1, YP_003686703.1,
YP_003702874.1, YP_003705322.1, YP_003802798.1, YP_003807621.1, YP_003964328.1,
YP_004011585.1, YP_004090951.1, YP_004104290.1, YP_004109425.1, YP_004162599.1,
YP_004194934.1, YP_004236328.1, YP_004265249.1, YP_004271472.1, YP_004271713.1,
YP_004294511.1, YP_004367147.1, YP_004414388.1, YP_004440722.1, YP_004442026.1,

TABLE 14-continued

Type I-C cas8c/csd1 polypeptide accession numbers
(the sequence identifier for each accession number, in the order provided in
Table 14, is SEQ ID NOs: 2974-3847).

YP_004496340.1, YP_004513911.1, YP_004544963.1, YP_004567837.1, YP_004665248.1,
YP_004673774.1, YP_004698565.1, YP_004771205.1, YP_004834872.1, YP_004839584.1,
YP_004857065.1, YP_004858802.1, YP_004917438.1, YP_004931734.1, YP_004969957.1,
YP_005053777.1, YP_005063975.1, YP_005147305.1, YP_005169126.1, YP_005641656.1,
YP_005668368.1, YP_005704011.1, YP_005795204.1, YP_006047123.1, YP_006250658.1,
YP_006285892.1, YP_006287670.1, YP_006373979.1, YP_006445784.1, YP_006465822.1,
YP_006720034.1, YP_006815949.1, YP_006905221.1, YP_007096664.1, YP_007102452.1,
YP_007214290.1, YP_007250227.1, YP_007296337.1, YP_007318535.1, YP_007364571.1,
YP_007469698.1, YP_007483072.1, YP_007548478.1, YP_007593345.1, YP_007666157.1,
YP_007669039.1, YP_007773723.1, YP_007829835.1, YP_007837793.1, YP_007840045.1,
YP_007841640.1, YP_007848218.1, YP_007881808.1, YP_007894109.1, YP_007899158.1,
YP_007947097.1, YP_008086288.1, YP_008145544.1, YP_008219474.1, YP_008221969.1,
YP_008233396.1, YP_008338545.1, YP_008866150.1, YP_009171.1, YP_113168.1, YP_318551.1,
YP_375200.1, YP_379313.1, YP_425918.1, YP_429369.1, YP_525133.1, YP_544714.1, YP_603709.1,
YP_635131.1, YP_747240.1, YP_867412.1, YP_910046.1, YP_910047.1, YP_911886.1, and/or
YP_961175.1

In some embodiments, Type I-C cas7/csd2 polypeptides include, but are not limited to, GenBank accession number as set forth in Table 15.

TABLE 15

Type I-C cas7/csd2 polypeptide accession numbers
(the sequence identifier for each accession number, in the
order provided in Table 15, is SEQ ID NOs: 3848-4371).

ABA05198.1, ABB24158.1, ABB28269.1, ABB31307.1, ABC18825.1, ABC21632.1, ABD12701.1,
ABD71603.1, ABF44539.1, ABI59274.1, ABI67813.1, ABK46001.1, ABM29986.1, ABN07018.1,
ABO49540.1, ABP37315.1, ABQ92670.1, ABR47842.1, ABR74647.1, ACB33427.1, ACB59637.1,
ACD60968.1, ACE85492.1, ACG61923.1, ACI51409.1, ACL08917.1, ACL20219.1, ACM21756.1,
ACO79323.1, ACR11071.1, ACS96761.1, ACV55940.1, ACV64358.1, ACV76427.1, ACX95669.1,
ADB47147.1, ADD28248.1, ADD43240.1, ADE15052.1, ADH65194.1, ADI02308.1,
ADI14780.1, ADK80205.1, ADK85028.1, ADN01352.1, ADO43029.1, ADP88374.1, ADU21657.1,
ADU26219.1, ADU44693.1, ADV45012.1, ADW17644.1, ADX47762.1, ADY55249.1, ADY61449.1,
ADY61690.1, ADZ26348.1, AEA19527.1, AEA19528.1, AEA19529.1, AEA19530.1, AEA19531.1,
AEA19532.1, AEC00928.1, AEE12859.1, AEE17590.1, AEF93429.1, AEG01413.1, AEG59678.1,
AEH55429.1, AEI38600.1, AEJ20056.1, AEM41209.1, AEN97651.1, AEO47327.1, AEP00021.1,
AER57694.1, AET67443.1, AEV30966.1, AEW77431.1, AEY65501.1, AFI86059.1, AFI87839.1,
AFM23521.1, AFM40491.1, AFU17709.1, AFV38402.1, AFV71911.1, AFY70025.1, AFY93136.1,
AGA59293.1, AGB03719.1, AGB28832.1, AGF80044.1, AGH38688.1, AGK06312.1, AGK13352.1,
AGK17702.1, AGK70468.1, AGL03420.1, AGS46824.1, AHB48173.1, AHG79313.1, AHG81511.1,
AHG83782.1, AHG86672.1, BAG13701.1, BAK19891.1, BAK56464.1, BAK66416.1, BAL68716.1,
BAN13314.1, CBA17366.1, CBK76221.1, CBK91610.1, CBK92829.1, CBK99510.1, CBL17828.1,
CBL19923.1, CBL34517.1, CCE23038.1, CCE23845.1, CCG39877.1, CCH29339.1, CCH68439.1,
CCI63162.1, CCQ74035.1, CCQ75831.1, CCQ78091.1, CCQ93985.1, CCU72638.1, CCU78374.1,
CCW39409.1, CCW41577.1, CCX50886.1, CCY14614.1, CCY42897.1, CCZ62161.1, CDA15003.1,
CDA52084.1, CDA72501.1, CDB26702.1, CDB29308.1, CDB98427.1, CDC38734.1, CDC50443.1,
CDC67800.1, CDD54041.1, CDD59790.1, CDD98976.1, CDE06407.1, CDE11996.1, CDE34087.1,
CDE80446.1, CDF15829.1, CDF27765.1, EDY82084.1, EEG33491.1, EEL61422.1, EEL61569.1,
EEL61570.1, EEL61625.1, EEM13962.1, EEM56162.1, EEV24884.1, EEV89053.1, EFB90882.1,
EFC91099.1, EFI35153.1, EFV34597.1, EGA91855.1, EGA93920.1, EGB16324.1, EGB94720.1,
EGC76281.1, EGD26423.1, EGD49243.1, EGE48067.1, EGJ10200.1, EGJ38118.1, EGK58601.1,
EGN35864.1, EGT75762.1, EGT79804.1, EGT80243.1, EGV28564.1, EGV37198.1, EGW49963.1,
EGW53124.1, EGX28855.1, EGX72599.1, EGY31355.1, EGY32746.1, EGY34247.1, EGY35534.1,
EGY38197.1, EGY39516.1, EGY39870.1, EGY41444.1, EGY43831.1, EGY43832.1, EGY46703.1,
EGY61572.1, EGY70645.1, EGY70862.1, EGZ49814.1, EHB62324.1, EHF02461.1, EHG19005.1,
EHG23345.1, EHK89720.1, EHK89932.1, EHM10678.1, EHM13738.1, EHO85751.1, EHP86557.1,
EHQ07662.1, EHQ90702.1, EIA23997.1, EIA26370.1, EIA26757.1, EIA28591.1, EIA30744.1,
EIC02343.1, EIC21112.1, EIG54630.1, EIJ33766.1, EIL98037.1, EIM57403.1, EIQ00068.1, EIT84253.1,
EIW20396.1, EIW25545.1, EIW30556.1, EIW33392.1, EIW37239.1, EJG08366.1, EJL40222.1,
EJS99961.1, EJW17221.1, EKD37966.1, EKE30553.1, EKF36591.1, EKM99104.1, EKP95536.1,
EKT63592.1, ELK39521.1, ELQ17185.1, ELR65962.1, ELT58108.1, ELT59490.1, EMB14047.1,
EME03981.1, EMI28183.1, EMI57443.1, EMS72154.1, ENO77319.1, EPE60578.1, EPR34124.1,
EPR43458.1, EPY00288.1, ERK89619.1, ETD02080.1, ETD77754.1, ETD86665.1, ETE54112.1,
ETE90143.1, ETE90144.1, GAE10005.1, GAF06946.1, WP_000462625.1, WP_000467673.1,
WP_001167480.1, WP_002063064.1, WP_002063097.1, WP_002063098.1, WP_002166872.1,
WP_002182191.1, WP_002183179.1, WP_002725662.1, WP_003345765.1, WP_003465419.1,
WP_003504657.1, WP_004260238.1, WP_004625408.1, WP_005487700.1, WP_005540837.1,
WP_005563374.1, WP_005565165.1, WP_005567428.1, WP_005582660.1, WP_005635207.1,
WP_005660281.1, WP_005758893.1, WP_005876727.1, WP_005966189.1, WP_006116164.1,
WP_006475674.1, WP_006903557.1, WP_007042345.1, WP_007294885.1, WP_007427673.1,
WP_007439946.1, WP_007465282.1, WP_007524600.1, WP_007931217.1, WP_008224253.1,

TABLE 15-continued

Type I-C cas7/csd2 polypeptide accession numbers
(the sequence identifier for each accession number, in the
order provided in Table 15, is SEQ ID NOs: 3848-4371).

WP_008387837.1, WP_008494663.1, WP_008664697.1, WP_008675255.1, WP_008709260.1,
WP_008910923.1, WP_009151515.1, WP_009796706.1, WP_010357662.1, WP_010543171.1,
WP_010621279.1, WP_011194447.1, WP_011237670.1, WP_011315191.1, WP_011362034.1,
WP_011388586.1, WP_011418637.1, WP_011466166.1, WP_011529385.1, WP_011715063.1,
WP_011959007.1, WP_012033147.1, WP_012073024.1, WP_012222308.1, WP_012488051.1,
WP_012553888.1, WP_012648484.1, WP_012817719.1, WP_013013750.1, WP_013067034.1,
WP_013071005.1, WP_013159708.1, WP_013175710.1, WP_013384680.1, WP_013502810.1,
WP_013624120.1, WP_013759292.1, WP_013945608.1, WP_013987428.1, WP_014076067.1,
WP_014147834.1, WP_014148633.1, WP_014167735.1, WP_014481879.1, WP_014481880.1,
WP_014481881.1, WP_014808677.1, WP_014840104.1, WP_015099452.1, WP_015164991.1,
WP_015405726.1, WP_015423229.1, WP_015432826.1, WP_015487356.1, WP_015517330.1,
WP_015525790.1, WP_015558734.1, WP_015565152.1, WP_015567096.1, WP_015572966.1,
WP_015604457.1, WP_015817183.1, WP_016480399.1, WP_016502589.1, WP_016566412.1,
WP_018276375.1, WP_018289542.1, WP_018465585.1, WP_019271084.1, WP_019403925.1,
WP_019604445.1, WP_020880189.1, WP_020886852.1, WP_021133648.1, WP_021906522.1,
WP_021932605.1, WP_022033513.1, WP_022074734.1, WP_022108015.1, WP_022127778.1,
WP_022177037.1, WP_022180176.1, WP_022228954.1, WP_022272156.1, WP_022272615.1,
WP_022287597.1, WP_022356884.1, WP_022363357.1, WP_022400170.1, WP_022402826.1,
WP_022410983.1, WP_022427820.1, WP_022475428.1, WP_022506622.1, WP_022513469.1,
WP_022659417.1, WP_022681040.1, WP_023514068.1, WP_023786785.1, WP_023921138.1,
WP_023967440.1, YP_001112365.1, YP_001130817.1, YP_001278620.1, YP_001319501.1,
YP_001344582.1, YP_001790192.1, YP_001812654.1, YP_001915500.1, YP_001956162.1,
YP_001982915.1, YP_002122936.1, YP_002276024.1, YP_002436385.1, YP_002458655.1,
YP_002538857.1, YP_002800298.1, YP_003006848.1, YP_003074487.1, YP_003182329.1,
YP_003192981.1, YP_003227011.1, YP_003262716.1, YP_003377360.1, YP_003398462.1,
YP_003507268.1, YP_003512333.1, YP_003527439.1, YP_003640637.1, YP_003686702.1,
YP_003702873.1, YP_003705323.1, YP_003802799.1, YP_003807622.1, YP_003873625.1,
YP_003964329.1, YP_004090950.1, YP_004104291.1, YP_004109426.1, YP_004162598.1,
YP_004194935.1, YP_004236329.1, YP_004265250.1, YP_004271471.1, YP_004271712.1,
YP_004294510.1, YP_004414387.1, YP_004440721.1, YP_004442027.1, YP_004496341.1,
YP_004513912.1, YP_004544964.1, YP_004621357.1, YP_004673773.1, YP_004698564.1,
YP_004771206.1, YP_004834873.1, YP_004839583.1, YP_004858801.1, YP_004916632.1,
YP_004917437.1, YP_004931735.1, YP_004949175.1, YP_004969958.1, YP_005053778.1,
YP_005063976.1, YP_005147306.1, YP_005169127.1, YP_005569631.1, YP_005569632.1,
YP_005569633.1, YP_005569634.1, YP_005569635.1, YP_005569636.1, YP_005704012.1,
YP_005795205.1, YP_006047124.1, YP_006250659.1, YP_006285891.1, YP_006287671.1,
YP_006445785.1, YP_006465823.1, YP_006720035.1, YP_006815948.1, YP_006905220.1,
YP_006933355.1, YP_006950855.1, YP_007036212.1, YP_007096663.1, YP_007102453.1,
YP_007214291.1, YP_007250226.1, YP_007296338.1, YP_007469697.1, YP_007548479.1,
YP_007682875.1, YP_007773724.1, YP_007783586.1, YP_007829836.1, YP_007837794.1,
YP_007840046.1, YP_007841639.1, YP_007848219.1, YP_007881809.1, YP_007894108.1,
YP_007899157.1, YP_007922620.1, YP_007947096.1, YP_008086289.1, YP_008117179.1,
YP_008866149.1, YP_425919.1, YP_603708.1, YP_747239.1, YP_867413.1, and/or YP_961174.1

In other embodiments, Type I-D cas10d/csc3 polypeptides include, but are not limited to, GenBank accession number as set forth in Table 16.

TABLE 16

Type I-D cas10d/csc3 polypeptide accession numbers
(the sequence identifier for each accession number, in the
order provided in Table 16, is SEQ ID NOs: 4372-4678).

AAT42592.1, AAY81179.1, ABA23770.1, ABD41580.1, ABK15325.1, ABL78722.1, ABX04869.1,
ACB00885.1, ACC81235.1, ACK64599.1, ACK70149.1, ACK85929.1, ACL15520.1, ACL44816.1,
ACM59081.1, ACR73139.1, ACS42755.1, ACU99472.1, ACX52862.1, ACX71879.1, ADB86684.1,
ADE15986.1, ADL12353.1, ADN17498.1, ADX82113.1, AEF95767.1, AEH06114.1, AEJ60972.1,
AEM74230.1, AEN04685.1, AFV12097.1, AFW97300.1, AFY31720.1, AFY33388.1, AFY42101.1,
AFY46832.1, AFY52834.1, AFY78761.1, AFY84408.1, AFY85315.1, AFZ00744.1, AFZ09738.1,
AFZ11796.1, AFZ33068.1, AFZ37989.1, AFZ42915.1, AFZ57017.1, AGE71797.1, AGE74069.1,
AGF53569.1, AGJ62073.1, AGY58207.1, AHE60848.1, AHE97755.1, AHF03469.1, BAB77928.1,
BAD01914.1, BAG02893.1, BAM01333.1, CAI49724.1, CAO91121.1, CBK91863.1, CBN54050.1,
CCC39328.1, CCH94174.1, CCH99027.1, CCI01087.1, CCI08755.1, CCI14109.1, CCI18602.1,
CCI20994.1, CCI26602.1, CCI35031.1, CDF59229.1, CDL45977.1, EAW34720.1, EDX77067.1,
EFA70017.1, EFA71317.1, EFA72475.1, EFH90018.1, EFK07866.1, EFO81885.1, EGZ43965.1,
EHC10665.1, EIJ32870.1, EKV02087.1, ELR97242.1, ELS48634.1, ELW63880.1, ELY96080.1,
ELY97118.1, ELZ94462.1, ELZ96024.1, EMA56573.1, EPF21994.1, EPZ17369.1, ERT08778.1,
ERT67946.1, ESA33790.1, GAD53621.1, GAF34918.1, NP_485602.1, NP_942300.1, WP_000498810.1,
WP_000498811.1, WP_000498823.1, WP_000498826.1, WP_000498833.1, WP_001313298.1,
WP_001343599.1, WP_001351044.1, WP_001369667.1, WP_001372648.1, WP_001379189.1,
WP_001380057.1, WP_001382434.1, WP_001409955.1, WP_001410894.1, WP_001413967.1,
WP_001419560.1, WP_001424845.1, WP_001433649.1, WP_001544092.1, WP_002706834.1,

TABLE 16-continued

Type I-D cas10d/csc3 polypeptide accession numbers
(the sequence identifier for each accession number, in the
order provided in Table 16, is SEQ ID NOs: 4372-4678).

WP_002742885.1, WP_002755924.1, WP_002762263.1, WP_002766201.1, WP_002778662.1,
WP_002784663.1, WP_002788625.1, WP_002791884.1, WP_002797933.1, WP_002800251.1,
WP_005371068.1, WP_006099180.1, WP_006111345.1, WP_006275556.1, WP_006277053.1,
WP_006423429.1, WP_006516472.1, WP_006529931.1, WP_006560838.1, WP_006600197.1,
WP_006647394.1, WP_006651365.1, WP_006788289.1, WP_007274330.1, WP_007353277.1,
WP_007736985.1, WP_007907034.1, WP_009343568.1, WP_009458810.1, WP_009555193.1,
WP_009786737.1, WP_010995731.1, WP_011153681.1, WP_011176808.1, WP_011278681.1,
WP_011320852.1, WP_011323345.1, WP_011448844.1, WP_011696704.1, WP_011752987.1,
WP_012189772.1, WP_012266046.1, WP_012308500.1, WP_012409229.1, WP_012593876.1,
WP_012599092.1, WP_012616839.1, WP_012627889.1, WP_012660273.1, WP_012744509.1,
WP_012819425.1, WP_012952622.1, WP_013033838.1, WP_013277799.1, WP_013334248.1,
WP_013798376.1, WP_013866300.1, WP_014042852.1, WP_014050466.1, WP_014101101.1,
WP_014434559.1, WP_014512278.1, WP_014555212.1, WP_014624350.1, WP_015050974.1,
WP_015081721.1, WP_015112327.1, WP_015116412.1, WP_015127542.1, WP_015129198.1,
WP_015137288.1, WP_015145060.1, WP_015151025.1, WP_015151920.1, WP_015178944.1,
WP_015190935.1, WP_015197391.1, WP_015201918.1, WP_015211902.1, WP_015213666.1,
WP_015224793.1, WP_015580875.1, WP_015739739.1, WP_015783165.1, WP_015857614.1,
WP_015952816.1, WP_016515572.1, WP_016863180.1, WP_016865349.1, WP_016949545.1,
WP_017306101.1, WP_017311493.1, WP_017323373.1, WP_017326894.1, WP_017652462.1,
WP_017659640.1, WP_017662195.1, WP_017662202.1, WP_017714173.1, WP_017720463.1,
WP_017740219.1, WP_017750003.1, WP_018034883.1, WP_018084460.1, WP_018398405.1,
WP_018399542.1, WP_018632664.1, WP_018666493.1, WP_019490247.1, WP_019503800.1,
WP_020200336.1, WP_020221133.1, WP_020505200.1, WP_020560715.1, WP_021247655.1,
WP_021547740.1, WP_021572945.1, WP_022738936.1, WP_023051696.1, WP_023065124.1,
WP_023075355.1, WP_023173331.1, WP_024191264.1, WP_024261066.1, YP_001544997.1,
YP_001658085.1, YP_001736140.1, YP_001866178.1, YP_002370755.1, YP_002377017.1,
YP_002423857.1, YP_002465243.1, YP_002483177.1, YP_002567678.1, YP_002939660.1,
YP_002966032.1, YP_003136308.1, YP_003239712.1, YP_003246361.1, YP_003419054.1,
YP_003528373.1, YP_003827418.1, YP_003899564.1, YP_004483832.1, YP_004575892.1,
YP_004799207.1, YP_004807058.1, YP_004863880.1, YP_005443230.1, YP_005645327.1,
YP_005839103.1, YP_006044689.1, YP_006920596.1, YP_006998407.1, YP_007049251.1,
YP_007053381.1, YP_007064554.1, YP_007066222.1, YP_007074429.1, YP_007082318.1,
YP_007088328.1, YP_007089235.1, YP_007118154.1, YP_007130228.1, YP_007136716.1,
YP_007141306.1, YP_007151360.1, YP_007155927.1, YP_007167129.1, YP_007434945.1,
YP_007437217.1, YP_007452953.1, YP_007773977.1, YP_007865076.1, YP_008711914.1,
YP_022785.1, YP_256472.1, YP_324663.1, YP_327280.1, YP_503299.1, YP_843965.1, and/or
YP_920725.1

In some embodiments, Type I-D csc2 polypeptides include, but are not limited to, GenBank accession number as set forth in Table 17.

TABLE 17

Type I-D csc2 polypeptide accession numbers
(the sequence identifier for each accession number, in the
order provided in Table 17, is SEQ ID NOs: 4679-4985).

AAT42592.1, AAY81179.1, ABA23770.1, ABD41580.1, ABK15325.1, ABL78722.1, ABX04869.1,
ACB00885.1, ACC81235.1, ACK64599.1, ACK70149.1, ACK85929.1, ACL15520.1, ACL44816.1,
ACM59081.1, ACR73139.1, ACS42755.1, ACU99472.1, ACX52862.1, ACX71879.1, ADB86684.1,
ADE15986.1, ADL12353.1, ADN17498.1, ADX82113.1, AEF95767.1, AEH06114.1, AEJ60972.1,
AEM74230.1, AEN04685.1, AFV12097.1, AFW97300.1, AFY31720.1, AFY33388.1, AFY42101.1,
AFY46832.1, AFY52834.1, AFY78761.1, AFY84408.1, AFY85315.1, AFZ00744.1, AFZ09738.1,
AFZ11796.1, AFZ33068.1, AFZ37989.1, AFZ42915.1, AFZ57017.1, AGE71797.1, AGE74069.1,
AGF53569.1, AGJ62073.1, AGY58207.1, AHE60848.1, AHE97755.1, AHF03469.1, BAB77928.1,
BAD01914.1, BAG02893.1, BAM01333.1, CAI49724.1, CAO91121.1, CBK91863.1, CBN54050.1,
CCC39328.1, CCH94174.1, CCH99027.1, CCI01087.1, CCI08755.1, CCI14109.1, CCI18602.1,
CCI20994.1, CCI26602.1, CCI35031.1, CDF59229.1, CDL45977.1, EAW34720.1, EDX77067.1,
EFA70017.1, EFA71317.1, EFA72475.1, EFH90018.1, EFK07866.1, EFO81885.1, EGZ43965.1,
EHC10665.1, EIJ32870.1, EKV02087.1, ELR97242.1, ELS48634.1, ELW63880.1, ELY96080.1,
ELY97118.1, ELZ94462.1, ELZ96024.1, EMA56573.1, EPF21994.1, EPZ17369.1, ERT08778.1,
ERT67946.1, ESA33790.1, GAD53621.1, GAF34918.1, NP_485602.1, NP_942300.1 WP_000498810.1,
WP_000498811.1, WP_000498823.1, WP_000498826.1, WP_000498833.1, WP_001313298.1,
WP_001343599.1, WP_001351044.1, WP_001369667.1, WP_001372648.1, WP_001379189.1,
WP_001380057.1, WP_001382434.1, WP_001409955.1, WP_001410894.1, WP_001413967.1,
WP_001419560.1, WP_001424845.1, WP_001433649.1, WP_001544092.1, WP_002706834.1,
WP_002742885.1, WP_002755924.1, WP_002762263.1, WP_002766201.1, WP_002778662.1,
WP_002784663.1, WP_002788625.1, WP_002791884.1, WP_002797933.1, WP_002800251.1,
WP_005371068.1, WP_006099180.1, WP_006111345.1, WP_006275556.1, WP_006277053.1,
WP_006423429.1, WP_006516472.1, WP_006529931.1, WP_006560838.1, WP_006600197.1,
WP_006647394.1, WP_006651365.1, WP_006788289.1, WP_007274330.1, WP_007353277.1,
WP_007736985.1, WP_007907034.1, WP_009343568.1, WP_009458810.1, WP_009555193.1,

TABLE 17-continued

Type I-D csc2 polypeptide accession numbers
(the sequence identifier for each accession number, in the
order provided in Table 17, is SEQ ID NOs: 4679-4985).

WP_009786737.1, WP_010995731.1, WP_011153681.1, WP_011176808.1, WP_011278681.1,
WP_011320852.1, WP_011323345.1, WP_011448844.1, WP_011696704.1, WP_011752987.1,
WP_012189772.1, WP_012266046.1, WP_012308500.1, WP_012409229.1, WP_012593876.1,
WP_012599092.1, WP_012616839.1, WP_012627889.1, WP_012660273.1, WP_012744509.1,
WP_012819425.1, WP_012952622.1, WP_013033838.1, WP_013277799.1, WP_013334248.1,
WP_013798376.1, WP_013866300.1, WP_014042852.1, WP_014050466.1, WP_014101101.1,
WP_014434559.1, WP_014512278.1, WP_014555212.1, WP_014624350.1, WP_015050974.1,
WP_015081721.1, WP_015112327.1, WP_015116412.1, WP_015127542.1, WP_015129198.1,
WP_015137288.1, WP_015145060.1, WP_015151025.1, WP_015151920.1, WP_015178944.1,
WP_015190935.1, WP_015197391.1, WP_015201918.1, WP_015211902.1, WP_015213666.1,
WP_015224793.1, WP_015580875.1, WP_015739739.1, WP_015783165.1, WP_015857614.1,
WP_015952816.1, WP_016515572.1, WP_016863180.1, WP_016865349.1, WP_016949545.1,
WP_017306101.1, WP_017311493.1, WP_017323373.1, WP_017326894.1, WP_017652462.1,
WP_017659640.1, WP_017662195.1, WP_017662202.1, WP_017714173.1, WP_017720463.1,
WP_017740219.1, WP_017750003.1, WP_018034883.1, WP_018084460.1, WP_018398405.1,
WP_018399542.1, WP_018632664.1, WP_018666493.1, WP_019490247.1, WP_019503800.1,
WP_020200336.1, WP_020221133.1, WP_020505200.1, WP_020560715.1, WP_021247655.1,
WP_021547740.1, WP_021572945.1, WP_022738936.1, WP_023051696.1, WP_023065124.1,
WP_023075355.1, WP_023173331.1, WP_024191264.1, WP_024261066.1, YP_001544997.1,
YP_001658085.1, YP_001736140.1, YP_001866178.1, YP_002370755.1, YP_002377017.1,
YP_002423857.1, YP_002465243.1, YP_002483177.1, YP_002567678.1, YP_002939660.1,
YP_002966032.1, YP_003136308.1, YP_003239712.1, YP_003246361.1, YP_003419054.1,
YP_003528373.1, YP_003827418.1, YP_003899564.1, YP_044483832.1, YP_004575892.1,
YP_004799207.1, YP_004807058.1, YP_004863880.1, YP_005443230.1, YP_005645327.1,
YP_005839103.1, YP_006044689.1, YP_006920596.1, YP_006984407.1, YP_007049251.1,
YP_007053381.1, YP_007064554.1, YP_007066222.1, YP_007074429.1, YP_007082318.1,
YP_007088328.1, YP_007089235.1, YP_007118154.1, YP_007130228.1, YP_007136716.1,
YP_007141306.1, YP_007151360.1, YP_007155927.1, YP_007167129.1, YP_007434945.1,
YP_007437217.1, YP_007452953.1, YP_007773977.1, YP_007865076.1, YP_008711914.1,
YP_022785.1, YP_256472.1, YP_324665.1, YP_327280.1, YP_503299.1, YP_843965.1, and/or
YP_920725.1

In some embodiments, Type I-D csc1 polypeptides include, but are not limited to, GenBank accession number as set forth in Table 18.

TABLE 18

Type I-D csc1 polypeptide accession numbers
(the sequence identifier for each accession number, in the
order provided in Table 18, is SEQ ID NOs: 4986-5234).

AAT42591.1, AAY81178.1, ABA23771.1, ABD41579.1, ABK15326.1, ABL78721.1, ABX04870.1,
ACB00884.1, ACC81234.1, ACK64598.1, ACK70150.1, ACL15521.1, ACL44817.1, ACM59082.1,
ACU99471.1, ACX71878.1, ADB86683.1, ADL12354.1, ADN17497.1, ADX82112.1, AEF95768.1,
AEH06113.1, AEM74229.1, AEN04684.1, AFW97299.1, AFY31719.1, AFY33387.1, AFY42100.1,
AFY46831.1, AFY52835.1, AFY78762.1, AFY84407.1, AFY85316.1, AFZ00745.1, AFZ09739.1,
AFZ11797.1, AFZ19098.1, AFZ27301.1, AFZ33069.1, AFZ37988.1, AFZ42914.1, AFZ57016.1,
AGD98072.1, AGE71796.1, AGE74068.1, AGF53570.1, AGJ62072.1, AGY58208.1, BAB77929.1,
BAD01915.1, BAG02894.1, CAI49725.1, CAO91122.1, CBN54051.1, CCC39329.1, CCH94173.1,
CCH99028.1, CCI01088.1, CCI08756.1, CCI14108.1, CCI18601.1, CCI20996.1, CCI26604.1,
CCI35030.1, CDF59228.1, EAW34719.1, EDX73941.1, EDX77236.1, EFA70018.1, EFA71316.1,
EFA72474.1, EFH90017.1, EFO81886.1, EGG83583.1, EHC10666.1, EKQ70618.1, EKV02088.1,
ELR97241.1, ELS48633.1, ELY96081.1, ELY97117.1, ELZ94461.1, ELZ96025.1, EMA56572.1,
EPF21993.1, ERT08676.1, ESA33791.1, GAD53620.1, NP_485603.1, NP_942301.1, WP_002742884.1,
WP_002755922.1, WP_002762264.1, WP_002766203.1, WP_002784661.1, WP_002788624.1,
WP_002791885.1, WP_003447113.1, WP_006099350.1, WP_006102703.1, WP_006111344.1,
WP_006275555.1, WP_006277054.1, WP_006516473.1, WP_006529930.1, WP_006560839.1,
WP_006600196.1, WP_006651366.1, WP_007274331.1, WP_007353278.1, WP_007736984.1,
WP_007907033.1, WP_009343567.1, WP_009458811.1, WP_009555192.1, WP_009757367.1,
WP_009786736.1, WP_010219108.1, WP_010656181.1, WP_010995732.1, WP_011153682.1,
WP_011176807.1, WP_011278680.1, WP_011320853.1, WP_011323346.1, WP_011448843.1,
WP_011696705.1, WP_011752986.1, WP_012189773.1, WP_012266047.1, WP_012308499.1,
WP_012409228.1, WP_012593875.1, WP_012599093.1, WP_012616840.1, WP_012627890.1,
WP_012660274.1, WP_012819424.1, WP_012952621.1, WP_013277800.1, WP_013334247.1,
WP_013798377.1, WP_013866299.1, WP_014042851.1, WP_014050465.1, WP_014512277.1,
WP_014555213.1, WP_014326326.1, WP_015081720.1, WP_015112327.1, WP_015116413.1, WP_015127541.1,
WP_015129197.1, WP_015137287.1, WP_015145061.1, WP_015151024.1, WP_015151921.1,
WP_015178945.1, WP_015183241.1, WP_015190936.1, WP_015197392.1, WP_015201919.1,
WP_015210536.1, WP_015211901.1, WP_015213665.1, WP_015224792.1, WP_015370562.1,
WP_015580874.1, WP_015783164.1, WP_016515571.1, WP_016863181.1, WP_016865350.1,
WP_016872951.1, WP_016949544.1, WP_017306100.1, WP_017311494.1, WP_017323374.1,
WP_017326893.1, WP_017652461.1, WP_017659641.1, WP_017662197.1, WP_017662203.1,

TABLE 18-continued

Type I-D csc1 polypeptide accession numbers
(the sequence identifier for each accession number, in the
order provided in Table 18, is SEQ ID NOs: 4986-5234).

WP_017714174.1, WP_017720462.1, WP_017740218.1, WP_017750004.1, WP_018034884.1,
WP_018084461.1, WP_018398406.1, WP_018399543.1, WP_018666491.1, WP_019490248.1,
WP_019503801.1, WP_020200335.1, WP_020221134.1, WP_022738938.1, WP_023065022.1,
WP_023075356.1, WP_023173332.1, YP_001544998.1, YP_001658086.1, YP_001736139.1,
YP_001866177.1, YP_002370754.1, YP_002377018.1, YP_002465244.1, YP_002483178.1,
YP_002567679.1, YP_003136307.1, YP_003246360.1, YP_003419053.1, YP_003827419.1,
YP_003899563.1, YP_004483833.1, YP_004575891.1, YP_004799206.1, YP_004807057.1,
YP_005645326.1, YP_005839104.1, YP_006998406.1, YP_007049250.1, YP_007053382.1,
YP_007064553.1, YP_007066221.1, YP_007074428.1, YP_007082319.1, YP_007088327.1,
YP_007089236.1, YP_007118155.1, YP_007122504.1, YP_007130229.1, YP_007136717.1,
YP_007141307.1, YP_007149981.1, YP_007151359.1, YP_007155926.1, YP_007167128.1,
YP_007391825.1, YP_007434944.1, YP_007437216.1, YP_007452954.1, YP_007865075.1,
YP_008711915.1, YP_022784.1, YP_256471.1, YP_324666.1, YP_327281.1, YP_503298.1,
YP_843966.1, YP_920724.1

In some embodiments, type 1-D cas6d polypeptides include, but are not limited to, GenBank accession number YP_503301.1 (SEQ ID NOs:39), and/or YP_327278.1 (SEQ ID NOs:40).

In other embodiments, Type I-E cse1/casA polypeptides include, but are not limited to, GenBank accession number as set forth in Table 19.

TABLE 19

Type I-E cse1/casA polypeptide accession numbers
(the sequence identifier for each accession number, in the
order provided in Table 19, is SEQ ID NOs: 5235-6111).

AAC75802.1, AAR34761.1, ABA88210.1, ACL06607.1, ADB13717.1, ADI84212.1, ADP38753.1,
ADR37700.1, ADY27677.1, AEB06539.1, AEB11721.1, AEB71776.1, AEC02347.1, AEJ53445.1,
AFH39942.1, AFL72519.1, AFM27182.1, AFR99214.1, AFV75987.1, AGB27118.1, AGQ58154.1,
AGQ66822.1, AGQ74241.1, AGQ78969.1, AGQ87241.1, AGS64000.1, AGW09894.1, AGX11571.1,
AGX34769.1, AHB45480.1, AHB94781.1, CCK86079.1, CCX87057.1, EDN80091.1, EDP20981.1,
EEB22224.1, EEB34860.1, EEH65617.1, EEI14200.1, EEI27966.1, EEI78888.1, EEI86603.1,
EEP20787.1, EET77376.1, EEW16905.1, EEW42244.1, EEW53942.1, EEX47611.1, EEZ61815.1,
EFA23032.1, EFB87472.1, EFB90862.1, EFD84089.1, EFD93805.1, EFE06764.1, EFF79646.1,
EFH10702.1, EFI89986.1, EFJ64185.1, EFJ75314.1, EFJ78692.1, EFJ85026.1, EFJ97185.1,
EFK01968.1, EFK08613.1, EFK13801.1, EFK21927.1, EFK32764.1, EFK39592.1, EFK47880.1,
EFK52819.1, EFK65277.1, EFK74802.1, EFL93068.1, EFM24727.1, EFM43106.1, EFO58465.1,
EFO71177.1, EFQ06779.1, EFQ22973.1, EFQ47738.1, EFQ49137.1, EFQ52099.1, EFS88256.1,
EFT11292.1, EFT25766.1, EFT64288.1, EFT66652.1, EFU34517.1, EFU63288.1, EFU77566.1,
EFX55034.1, EGB85502.1, EGC81877.1, EGE70488.1, EGF23574.1, EGF57391.1, EGF60537.1,
EGG33817.1, EGG50904.1, EGJ06274.1, EGL13335.1, EGL36663.1, EHI77348.1, EHO49963.1,
EHQ05138.1, EIC19435.1, EIC29373.1, EID50558.1, EIE98892.1, EIG78874.1, EIH03922.1,
EIH21856.1, EIH33564.1, EIH43625.1, EIH53908.1, EIH65188.1, EIH76837.1, EIH89440.1, EII01915.1,
EII11996.1, EII24897.1, EII34511.1, EII46454.1, EII55459.1, EIJ03929.1, EIJ14858.1, EIM64765.1,
EIN19700.1, EIN21473.1, EIN21900.1, EIN36944.1, EIN38077.1, EIN40216.1, EIN52181.1, EIN55483.1,
EIN58777.1, EIN69733.1, EIN73954.1, EIN74349.1, EIN86510.1, EIN93695.1, EIN95421.1, EIN98712.1,
EIO11891.1, EIO12436.1, EIO15244.1, EIO26602.1, EIO35235.1, EIO35910.1, EIO36499.1,
EIO48182.1, EIO55978.1, EIO56220.1, EIO62659.1, EIO70811.1, EIO73008.1, EIO81517.1,
EIO90647.1, EIO93918.1, EIO95550.1, EIP08618.1, EIP08964.1, EIP13149.1, EIP22622.1, EIP26482.1,
EIP31367.1, EIP38412.1, EIP43370.1, EIP51977.1, EIP54293.1, EIP58464.1, EIP66206.1, EIP76257.1,
EIP77689.1, EIV92934.1, EJN52394.1, EJU32173.1, EKG98245.1, EKH00137.1, EKH03277.1,
EKH12298.1, EKH15516.1, EKH23467.1, EKH29555.1, EKH35394.1, EKH39836.1, EKH45833.1,
EKH51234.1, EKH56934.1, EKH66297.1, EKH68815.1, EKH74466.1, EKH82251.1, EKH86929.1,
EKH90629.1, EKH99479.1, EKI05873.1, EKI08568.1, EKI36919.1, EKI40772.1, EKI49588.1,
EKI60112.1, EKI64089.1, EKI68328.1, EKI75986.1, EKI79310.1, EKI85620.1, EKI93279.1, EKI96030.1,
EKJ04229.1, EKJ08783.1, EKJ13733.1, EKJ23816.1, EKJ24259.1, EKJ33912.1, EKJ39701.1,
EKJ41438.1, EKJ50521.1, EKJ56867.1, EKJ59593.1, EKK25398.1, EKK25683.1, EKK26848.1,
EKK43173.1, EKK53359.1, EKK55962.1, EKK65125.1, EKK69921.1, EKK73971.1, EKK84922.1,
EKO32513.1, EKO79131.1, EKP14571.1, EKQ92399.1, EKQ99848.1, EKR63516.1, EKR75188.1,
EKR90048.1, EKS02017.1, EKS09390.1, EKS99224.1, EKT00177.1, EKT12809.1, EKT14274.1,
EKT17197.1, EKT27020.1, EKT27533.1, EKT32171.1, EKT39313.1, EKT44823.1, EKV73580.1,
EKV75706.1, EKV77180.1, EKV89037.1, EKV91802.1, EKV95653.1, EKW07860.1, EKW08455.1,
EKW11945.1, EKW25815.1, EKW26225.1, EKW29160.1, EKW39951.1, EKW42672.1, EKW46451.1,
EKW54141.1, EKW60787.1, EKW62693.1, EKW73537.1, EKW76255.1, EKW80485.1, EKW88428.1,
EKW89455.1, EKY37317.1, EKY39009.1, ELV17238.1, ELV18608.1, ELV25663.1, ELV34236.1,
ELV34682.1, ELV39485.1, ELV48633.1, ELV51980.1, ELV54637.1, ELV67264.1, ELV67562.1,
ELV69368.1, ELV79850.1, ELV80618.1, ELV88789.1, ELV96183.1, ELV97125.1, ELW02419.1,
ELW10617.1, ELW13578.1, ELW17524.1, ELW26217.1, ELW31305.1, ELW35270.1, ELW40989.1,
EMF80096.1, EMF90493.1, EMH94948.1, EMI67337.1, EMI69736.1, EMJ47430.1, EMJ65147.1,
EMJ83278.1, EMK10454.1, EMK25488.1, EMM72287.1, EMM76994.1, EMM88578.1, EMN02660.1,
EMN23237.1, EMN46415.1, EMN58221.1, EMN90211.1, EMO14863.1, EMO23363.1, EMO33334.1,
EMO39045.1, EMO44218.1, EMO48220.1, EMO56134.1, EMO69676.1, EMO83287.1, EMO88887.1,
EMO99953.1, EMP03176.1, EMP69813.1, EMP80123.1, EMQ01915.1, EMR53802.1, EMS84265.1,

TABLE 19-continued

Type I-E cse1/casA polypeptide accession numbers
(the sequence identifier for each accession number, in the
order provided in Table 19, is SEQ ID NOs: 5235-6111).

EMS89950.1, EMU77117.1, EMU79863.1, EMU81925.1, EMU92000.1, EMU93518.1, EMU96753.1,
EMV05447.1, EMV10183.1, EMV20685.1, EMV20944.1, EMV31572.1, EMV37851.1, EMV40012.1,
EMV45281.1, EMV56148.1, EMV56284.1, EMV56703.1, EMV69991.1, EMV70936.1, EMV74436.1,
EMV84047.1, EMV88768.1, EMV92182.1, EMW01026.1, EMW01243.1, EMW07010.1, EMW17418.1,
EMW22260.1, EMW30606.1, EMW40792.1, EMW48039.1, EMW49825.1, EMW56697.1, EMW59913.1,
EMW66837.1, EMW73499.1, EMW77338.1, EMW78912.1, EMW94558.1, EMW98876.1, EMX07968.1,
EMX14130.1, EMX19224.1, EMX22618.1, EMX29304.1, EMX37758.1, EMX48579.1, EMX50486.1,
EMX52607.1, EMX61623.1, EMX68505.1, EMX68784.1, EMX74575.1, EMX87159.1, EMX92277.1,
EMZ62959.1, EMZ66591.1, EMZ68494.1, EMZ77563.1, EMZ83215.1, EMZ91186.1, EMZ95757.1,
ENA02804.1, ENA04452.1, ENA13951.1, ENA19514.1, ENA26189.1, ENA30282.1, ENA50834.1,
ENA63244.1, ENA67183.1, ENA77978.1, ENA79440.1, ENA81200.1, ENA92105.1, ENA94513.1,
ENA97212.1, ENB05958.1, ENB14774.1, ENB26894.1, ENB33400.1, ENB36542.1, ENB46916.1,
ENB50303.1, ENB54275.1, ENB68369.1, ENB69286.1, ENB70953.1, ENB74215.1, ENB86956.1,
ENB90833.1, ENB91040.1, ENB93839.1, ENB98051.1, ENC02948.1, ENC09611.1, ENC15003.1,
ENC16395.1, ENC23716.1, ENC30744.1, ENC31435.1, ENC39393.1, ENC45913.1, ENC53604.1,
ENC54573.1, ENC60390.1, ENC69953.1, ENC70105.1, ENC77975.1, ENC82714.1, ENC97848.1,
END01584.1, END09660.1, END13721.1, END21437.1, END25413.1, END31629.1, END39636.1,
END41653.1, END42391.1, END51642.1, END57071.1, END59213.1, END67056.1, END78179.1,
END78712.1, END81375.1, END91687.1, END97699.1, ENE06567.1, ENE08935.1, ENE21067.1,
ENE21659.1, ENE28700.1, ENE35155.1, ENE40418.1, ENE44978.1, ENE50645.1, ENE55965.1,
ENE62926.1, ENE64645.1, ENE70429.1, ENE76512.1, ENE80411.1, ENE85871.1, ENE92893.1,
ENE99559.1, ENF00392.1, ENF08349.1, ENF11291.1, ENF18240.1, ENF22923.1, ENF29687.1,
ENF33363.1, ENF39390.1, ENF45673.1, ENF50088.1, ENF50716.1, ENF61280.1, ENF67276.1,
ENF70641.1, ENF74816.1, ENF82094.1, ENF84651.1, ENF89282.1, ENF95862.1, ENG01924.1,
ENG03189.1, ENG11232.1, ENG15734.1, ENG15816.1, ENG24890.1, ENG29467.1, ENG32953.1,
ENG41297.1, ENG41796.1, ENG50476.1, ENG54481.1, ENG60849.1, ENG64006.1, ENG70197.1,
ENG76593.1, ENG81862.1, ENG94881.1, ENH01461.1, ENH01622.1, ENH16164.1, ENH17549.1,
ENH19105.1, ENH31379.1, ENH31607.1, ENH39003.1, ENH44707.1, ENH50513.1, ENH55857.1,
ENO64180.1, EPA89712.1, EPE82172.1, EPG58686.1, EPG75171.1, EPG81677.1, EPI42420.1,
EPI44037.1, EPI53337.1, EPI53372.1, EPI56336.1, EPI57192.1, EPI61099.1, EPI61158.1, EPI62386.1,
EPI66851.1, EPI68834.1, EPI71023.1, EPI82121.1, EPI84755.1, EPI87542.1, EPI96745.1, EPJ01395.1,
EPJ03484.1, EPJ11332.1, EPO19661.1, EPO86951.1, EQA24787.1, EQA60395.1, ERA58832.1,
ERB70896.1, ERB72237.1, ERB73419.1, ERB82599.1, ERB89436.1, ERB96681.1, ERB96885.1,
ERC04536.1, ERC12232.1, ERC16335.1, ERC19176.1, ERC27445.1, ERC33293.1, ERC38070.1,
ERC42733.1, ERC50095.1, ERC55908.1, ERC58904.1, ERC64561.1, ERC68390.1, ERC77314.1,
ERC81429.1, ERC84026.1, ERC93630.1, ERC97461.1, ERC97908.1, ERD08682.1, ERD13172.1,
ERD13495.1, ERD25528.1, ERD27720.1, ERD31330.1, ERD40007.1, ERD43427.1, ERD48231.1,
ERD57532.1, ERD59790.1, ERD62130.1, ERD70741.1, ERD75930.1, ERD79098.1, ERD86415.1,
ERD91415.1, ERE02668.1, ERE03502.1, ERE13280.1, ERE16916.1, ERE25907.1, ERE27664.1,
ERE32314.1, ERE40209.1, ERF87381.1, ERF89307.1, ERF94194.1, ERF98324.1, ERH14165.1,
ERH14495.1, ERH20067.1, ERH20459.1, ERH21168.1, ERH32724.1, ERH36678.1, ERJ75893.1,
ERJ83444.1, ERJ96446.1, ERN66754.1, ERN72164.1, ERN77269.1, ERN80222.1, ERN86671.1,
ERN89327.1, ERN90341.1, ERN96205.1, ERO01325.1, ERO03092.1, ERO11234.1, ERO19088.1,
ERO20372.1, ERO26621.1, ERO30440.1, ESA60137.1, ESA65714.1, ESA72996.1, ESA77456.1,
ESA86349.1, ESA88077.1, ESD00140.1, ESD09712.1, ESD21951.1, ESD26436.1, ESD31842.1,
ESD51509.1, ESD61895.1, ESD64308.1, ESD64392.1, ESD71331.1, ESD80284.1, ESD81866.1,
ESD83158.1, ESE11368.1, ESK58508.1, ESV51433.1, ETA02741.1, ETA89353.1, ETB86383.1,
ETC51273.1, ETC70942.1, ETD45571.1, ETD59789.1, ETE24479.1, ETE43683.1, ETI74543.1,
ETI79260.1, ETJ60188.1, ETJ80202.1, ETX32972.1, EUB32589.1, EWM59168.1, EYD84416.1,
EYR72872.1, NP_417240.1, Q46901.1, Q53VY1.1, WP_000086035.1, WP_000086036.1,
WP_000086037.1, WP_000086038.1, WP_000283634.1, WP_000312544.1, WP_000348836.1,
WP_000368576.1, WP_000368577.1, WP_000368578.1, WP_000368579.1, WP_000368581.1,
WP_000368582.1, WP_000368583.1, WP_000368584.1, WP_000368585.1, WP_000368586.1,
WP_000368587.1, WP_000368588.1, WP_000368589.1, WP_000484004.1, WP_000535130.1,
WP_000834842.1, WP_001084074.1, WP_001084076.1, WP_001084077.1, WP_001084078.1,
WP_001084079.1, WP_001084080.1, WP_001084081.1, WP_001084082.1, WP_001084083.1,
WP_001084084.1, WP_001084085.1, WP_001084086.1, WP_001084087.1, WP_001084088.1,
WP_001084089.1, WP_001084092.1, WP_001084093.1, WP_001084094.1, WP_001084095.1,
WP_001084096.1, WP_001084097.1, WP_001084098.1, WP_001084099.1, WP_001084100.1,
WP_001084101.1, WP_001084102.1, WP_001084104.1, WP_001084105.1, WP_001084106.1,
WP_001084109.1, WP_001084110.1, WP_001084111.1, WP_001084112.1, WP_001084113.1,
WP_001084115.1, WP_001084116.1, WP_001084117.1, WP_001242694.1, WP_001304057.1,
WP_001307969.1, WP_001313216.1, WP_001315810.1, WP_001317281.1, WP_001325175.1,
WP_001326095.1, WP_001331425.1, WP_001343650.1, WP_001347282.1, WP_001347764.1,
WP_001348410.1, WP_001380031.1, WP_001382398.1, WP_001383465.1, WP_001387009.1,
WP_001395991.1, WP_001416300.1, WP_001437794.1, WP_001522848.1, WP_001564555.1,
WP_002431961.1, WP_002514606.1, WP_002520770.1, WP_002546992.1, WP_002549141.1,
WP_003088905.1, WP_004074401.1, WP_004106702.1, WP_004109011.1, WP_004112666.1,
WP_004115350.1, WP_004118009.1, WP_004125152.1, WP_004127864.1, WP_004132146.1,
WP_004136185.1, WP_004138497.1, WP_004142783.1, WP_004574565.1, WP_004809665.1,
WP_004826834.1, WP_004835170.1, WP_005000855.1, WP_005154891.1, WP_006302702.1,
WP_006687055.1, WP_006733195.1, WP_006734900.1, WP_006735514.1, WP_006736346.1,
WP_008087876.1, WP_008534586.1, WP_008806236.1, WP_008864956.1, WP_009308515.1,
WP_009310573.1, WP_009344934.1, WP_009369774.1, WP_009428278.1, WP_009486039.1,
WP_009535625.1, WP_009994024.1, WP_012311912.1, WP_012602053.1, WP_012602845.1,
WP_012907164.1, WP_012914171.1, WP_012997655.1, WP_013990632.1, WP_014633160.1,

TABLE 19-continued

Type I-E cse1/casA polypeptide accession numbers
(the sequence identifier for each accession number, in the
order provided in Table 19, is SEQ ID NOs: 5235-6111).

WP_014839378.1, WP_016637266.1, WP_016838859.1, WP_019077566.1, WP_019842415.1,
WP_020759633.1, WP_020761306.1, WP_020839112.1, WP_020899160.1, WP_020973664.1,
WP_021600846.1, WP_021604023.1, WP_021604906.1, WP_021610204.1, WP_021610630.1,
WP_021613844.1, WP_021673649.1, WP_021676129.1, WP_021682641.1, WP_021868373.1,
WP_022630987.1, WP_023141767.1, WP_023147142.1, WP_023147143.1, WP_023154950.1,
WP_023156410.1, WP_023890965.1, WP_024143394.1, WP_024154924.1, WP_024156644.1,
WP_024218900.1, WP_024226281.1, WP_024229045.1, WP_024229851.1, WP_024255404.1,
WP_024258205.1, YP_003373984.1, YP_004049620.1, YP_004264312.1, YP_004367831.1,
YP_004372354.1, YP_004411729.1, YP_006059728.1, YP_006068308.1, YP_006412644.1,
YP_006449446.1, YP_006716675.1, YP_006724797.1, YP_006890377.1, YP_006972084.1,
YP_007277148.1, YP_008252271.1, YP_008253880.1, YP_008262077.1, YP_008267148.1,
YP_008307439.1, YP_008382200.1, YP_008565875.1, YP_008614581.1, and/or YP_008862373.1.

In some embodiments, Type I-E cse2/casB polypeptides include, but are not limited to, GenBank accession number as set forth in Table 20.

TABLE 20

Type I-E cse2/casB polypeptide accession numbers
(the sequence identifier for each accession number, in the
order provided in Table 20, is SEQ ID NOs: 6112-6823).

AAC75801.1, AAR34762.1, ABA88211.1, ACL06608.1, ADB14225.1, ADI84213.1, ADP38754.1,
ADR37699.1, ADY27680.1, AEB06540.1, AEB11722.1, AEB71777.1, AEC02348.1, AFH39943.1,
AFL72520.1, AFM27183.1, AFR99215.1, AFV75988.1, AGB27117.1, AGX34768.1, CCI86099.1,
CCK86080.1, CCX87058.1, EDN80089.1, EDP20980.1, EEB22225.1, EEH65616.1, EEI14201.1,
EEI27967.1, EEI78889.1, EEI86602.1, EEJ54448.1, EEP20786.1, EET77375.1, EEW16906.1,
EEW42243.1, EEW53943.1, EEX47612.1, EFA23033.1, EFB87473.1, EFB90861.1, EFD84088.1,
EFD93804.1, EFE06765.1, EFF79645.1, EFH10701.1, EFI89987.1, EFJ64186.1, EFJ75315.1,
EFJ78691.1, EFJ85027.1, EFJ97184.1, EFK01967.1, EFK08585.1, EFK13800.1, EFK21928.1,
EFK32765.1, EFK39599.1, EFK47879.1, EFK52820.1, EFK65276.1, EFK74803.1, EFL93067.1,
EFM24726.1, EFM43105.1, EFM50100.1, EFO58464.1, EFO71164.1, EFQ06780.1, EFQ22974.1,
EFQ47715.1, EFQ49115.1, EFQ52080.1, EFQ53859.1, EFS88257.1, EFT11291.1, EFT25767.1,
EFT64289.1, EFT66653.1, EFU34516.1, EFU63289.1, EFU77567.1, EFV94306.1, EFX55035.1,
EGB85503.1, EGC81860.1, EGE70489.1, EGF23575.1, EGF57390.1, EGF60538.1, EGG33809.1,
EGG50905.1, EGJ06275.1, EGL13349.1, EGL37879.1, EGR97358.1, EGS35782.1, EHI70394.1,
EHI77349.1, EHM12585.1, EHO49964.1, EHQ05137.1, EIC19434.1, EIC29372.1, EIC80106.1,
EIC97113.1, EIE98891.1, EIG78925.1, EIG93140.1, EIH01730.1, EIH21868.1, EIH32984.1, EIH43940.1,
EIH56207.1, EIH65347.1, EIH76747.1, EIH89338.1, EIH99538.1, EII13012.1, EII24837.1, EII35012.1,
EII46332.1, EII56124.1, EIJ03341.1, EIJ15160.1, EIM64764.1, EIN19762.1, EIN21472.1, EIN21899.1,
EIN36943.1, EIN38052.1, EIN40215.1, EIN52180.1, EIN55482.1, EIN58776.1, EIN69732.1, EIN73810.1,
EIN74348.1, EIN86302.1, EIN93752.1, EIN95379.1, EIN98707.1, EIO11869.1, EIO12466.1,
EIO15243.1, EIO26601.1, EIO35234.1, EIO35906.1, EIO36689.1, EIO56007.1, EIO56621.1,
EIO62658.1, EIO70785.1, EIO73007.1, EIO81613.1, EIO90645.1, EIO93917.1, EIO95544.1,
EIP08614.1, EIP08988.1, EIP12992.1, EIP22621.1, EIP26481.1, EIP31382.1, EIP38348.1, EIP43352.1,
EIP51902.1, EIP54292.1, EIP58366.1, EIP65857.1, EIP76256.1, EIP77688.1, EIV92933.1, EJF13177.1,
EJP19891.1, EKG98244.1, EKH00136.1, EKH03276.1, EKH12297.1, EKH15515.1, EKH23466.1,
EKH29554.1, EKH35393.1, EKH39835.1, EKH45718.1, EKH51233.1, EKH56805.1, EKH66296.1,
EKH68787.1, EKH74465.1, EKH82250.1, EKH86928.1, EKH99478.1, EKI05872.1, EKI36918.1,
EKI40771.1, EKI49527.1, EKI60205.1, EKI64088.1, EKI68327.1, EKI75985.1, EKI79309.1, EKI85619.1,
EKI93320.1, EKI96029.1, EKJ04228.1, EKJ08782.1, EKJ13732.1, EKJ23836.1, EKJ24258.1,
EKJ33911.1, EKJ39700.1, EKJ41366.1, EKJ50582.1, EKJ56866.1, EKJ59592.1, EKK25397.1,
EKK25898.1, EKK26847.1, EKK43172.1, EKK53358.1, EKK55961.1, EKK65124.1, EKK69920.1,
EKK73970.1, EKK84921.1, EKO32514.1, EKO79167.1, EKP14479.1, EKQ92379.1, EKQ99402.1,
EKR90051.1, EKS02270.1, EKS09451.1, EKV73579.1, EKV75705.1, EKV77179.1, EKV89036.1,
EKV91970.1, EKV95739.1, EKW07859.1, EKW08359.1, EKW11944.1, EKW25814.1, EKW26224.1,
EKW29159.1, EKW40128.1, EKW42671.1, EKW46450.1, EKW54140.1, EKW60875.1, EKW62692.1,
EKW73536.1, EKW76254.1, EKW80484.1, EKW88427.1, EKW89454.1, EKX91276.1, EKY37316.1,
EKY39008.1, ELV17237.1, ELV18607.1, ELV25662.1, ELV34157.1, ELV34681.1, ELV39484.1,
ELV48632.1, ELV51965.1, ELV54636.1, ELV67263.1, ELV67561.1, ELV69367.1, ELV79849.1,
ELV80617.1, ELV88788.1, ELV96182.1, ELV97124.1, ELW02418.1, ELW10616.1, ELW13577.1,
ELW17523.1, ELW26216.1, ELW31304.1, ELW35269.1, ELW40988.1, EMF90415.1, EMG01553.1,
EMH94921.1, EMI67328.1, EMI69776.1, EMJ47417.1, EMJ65176.1, EMJ83277.1, EMK10455.1,
EMN02648.1, EMN14473.1, EMN17149.1, EMN23273.1, EMN58106.1, EMO08717.1, EMO14814.1,
EMO23146.1, EMO33377.1, EMO44321.1, EMO48217.1, EMO56045.1, EMO62132.1, EMO69688.1,
EMO83302.1, EMO88885.1, EMP00062.1, EMP03359.1, EMP80130.1, EMQ01916.1, EMR12517.1,
EMR53801.1, EMU77116.1, EMU79862.1, EMU81924.1, EMU91999.1, EMU93517.1, EMU96752.1,
EMV05446.1, EMV10182.1, EMV20684.1, EMV20943.1, EMV31491.1, EMV37850.1, EMV40011.1,
EMV45280.1, EMV56146.1, EMV56282.1, EMV56702.1, EMV69990.1, EMV70935.1, EMV74435.1,
EMV84046.1, EMV88767.1, EMV92359.1, EMW01025.1, EMW01242.1, EMW07009.1, EMW17417.1,
EMW22259.1, EMW30605.1, EMW40791.1, EMW48038.1, EMW49824.1, EMW56696.1, EMW59912.1,
EMW66836.1, EMW73498.1, EMW77337.1, EMW78911.1, EMW94557.1, EMW98875.1, EMX07967.1,

TABLE 20-continued

Type I-E cse2/casB polypeptide accession numbers
(the sequence identifier for each accession number, in the
order provided in Table 20, is SEQ ID NOs: 6112-6823).

EMX14129.1, EMX18415.1, EMX22617.1, EMX29303.1, EMX37757.1, EMX48578.1, EMX50485.1, EMX52606.1, EMX61622.1, EMX68504.1, EMX68783.1, EMX75065.1, EMX84589.1, EMX87158.1, EMX92276.1, EMY78097.1, EMZ62958.1, EMZ66493.1, EMZ68492.1, EMZ77562.1, EMZ83214.1, EMZ91634.1, EMZ95756.1, ENA02803.1, ENA04451.1, ENA13950.1, ENA19688.1, ENA26190.1, ENA30281.1, ENA38834.1, ENA44310.1, ENA50872.1, ENA60929.1, ENA63243.1, ENA67182.1, ENA77976.1, ENA79438.1, ENA81176.1, ENA92104.1, ENA94512.1, ENA97211.1, ENB05957.1, ENB14773.1, ENB26893.1, ENB33482.1, ENB36541.1, ENB46917.1, ENB50302.1, ENB54274.1, ENB68370.1, ENB69287.1, ENB70954.1, ENB71214.1, ENB86955.1, ENB90079.1, ENB90832.1, ENC02947.1, ENC30743.1, ENC31434.1, ENC39392.1, ENC45912.1, ENC53603.1, ENC54572.1, ENC60389.1, ENC69952.1, ENC70104.1, ENC77942.1, ENC82713.1, ENC90461.1, ENC93692.1, ENC97847.1, END01583.1, END09659.1, END13720.1, END21262.1, END25412.1, END31628.1, END39635.1, END41652.1, END42390.1, END51641.1, END57070.1, END59212.1, END78711.1, END90767.1, END91686.1, END97698.1, ENE06540.1, ENE08934.1, ENE21066.1, ENE21658.1, ENE28699.1, ENE35067.1, ENE40417.1, ENE44977.1, ENE50644.1, ENE55964.1, ENE62925.1, ENE64644.1, ENE70428.1, ENE76511.1, ENE80410.1, ENE85836.1, ENE92892.1, ENE99558.1, ENF00391.1, ENF08348.1, ENF11290.1, ENF18239.1, ENF22922.1, ENF29686.1, ENF33362.1, ENF39389.1, ENF45672.1, ENF50087.1, ENF50715.1, ENF61279.1, ENF67275.1, ENF70640.1, ENF74815.1, ENF82093.1, ENF84696.1, ENF89281.1, ENF95861.1, ENG01923.1, ENG03100.1, ENG11224.1, ENG15748.1, ENG15815.1, ENG24889.1, ENG29466.1, ENG32898.1, ENG41296.1, ENG41795.1, ENG50475.1, ENG54480.1, ENG60848.1, ENG64005.1, ENG70196.1, ENG76592.1, ENG81863.1, ENG94882.1, ENG96097.1, ENH01621.1, ENH08104.1, ENH16163.1, ENH17556.1, ENH19104.1, ENH31378.1, ENH31606.1, ENH39002.1, ENH44706.1, ENH50512.1, ENH55856.1, ENO64043.1, EOY74104.1, EPA89749.1, EPE82201.1, EPG81745.1, EPI42421.1, EPI44036.1, EPI53338.1, EPI53371.1, EPI56335.1, EPI57191.1, EPI61100.1, EPI61157.1, EPI62385.1, EPI66850.1, EPI68833.1, EPI71022.1, EPI82120.1, EPI84754.1, EPI87541.1, EPI96744.1, EPJ01394.1, EPJ03483.1, EPJ11331.1, EPO19644.1, EPO86929.1, EQA60381.1, ERB70895.1, ERB72236.1, ERB73418.1, ERB82286.1, ERB89435.1, ERB96680.1, ERB96884.1, ERC04383.1, ERC12231.1, ERC16334.1, ERC19175.1, ERC27444.1, ERC33292.1, ERC38069.1, ERC42732.1, ERC50094.1, ERC55907.1, ERC58903.1, ERC64560.1, ERC68389.1, ERC77313.1, ERC81428.1, ERC84025.1, ERC93629.1, ERC97515.1, ERC97907.1, ERD08681.1, ERD13171.1, ERD13494.1, ERD25416.1, ERD27719.1, ERD31363.1, ERD40006.1, ERD43426.1, ERD48230.1, ERD57531.1, ERD59789.1, ERD62140.1, ERD70740.1, ERD75929.1, ERD79097.1, ERD86414.1, ERD91414.1, ERE02667.1, ERE13279.1, ERE16915.1, ERE25906.1, ERE27663.1, ERE32313.1, ERE40208.1, ERH14164.1, ERH14496.1, ERH20458.1, ERH21169.1, ERH32725.1, ERJ75892.1, ERJ83445.1, ERJ96447.1, ERT63128.1, ESA60138.1, ESA65715.1, ESA72995.1, ESA77457.1, ESA86350.1, ESA88076.1, ESD00139.1, ESD09711.1, ESD21950.1, ESD26437.1, ESD31841.1, ESD51510.1, ESD61896.1, ESD64309.1, ESD71330.1, ESD80443.1, ESD81867.1, ESD83159.1, ESE11367.1, ESK58509.1, ESS00990.1, ETA02742.1, ETA89352.1, ETJ98129.1, EWM59167.1, GADI7057.1, NP_417239.1, NP_952439.1, P76632.1, WP_000893379.1, WP_000893380.1, WP_000893381.1, WP_002514607.1, WP_002549205.1, WP_002887565.1, WP_003088903.1, WP_003611352.1, WP_003619871.1, WP_003711530.1, WP_004074400.1, WP_004106700.1, WP_004109007.1, WP_004112668.1, WP_004125154.1, WP_004127867.1, WP_004132148.1, WP_004136186.1, WP_004138509.1, WP_004167284.1, WP_004809666.1, WP_004826833.1, WP_004835154.1, WP_005371168.1, WP_005524431.1, WP_006002099.1, WP_006302703.1, WP_006733185.1, WP_006735505.1, WP_006736335.1, WP_006737999.1, WP_007124216.1, WP_008087921.1, WP_008462589.1, WP_008534588.1, WP_008864957.1, WP_009310572.1, WP_009344944.1, WP_009369773.1, WP_009429506.1, WP_009535624.1, WP_009560667.1, WP_009726976.1, WP_009994023.1, WP_010241931.1, WP_010942035.1, WP_011543822.1, WP_011678177.1, WP_012914172.1, WP_012997656.1, WP_013439419.1, WP_013990631.1, WP_014835009.1, WP_016637267.1, WP_016838861.1, WP_019776149.1, WP_020281497.1, WP_020484517.1, WP_020561454.1, WP_020759632.1, WP_020761305.1, WP_020973663.1, WP_021604022.1, WP_021604907.1, WP_021610631.1, WP_021613845.1, WP_021673648.1, WP_021676130.1, WP_021682642.1, WP_023269380.1, WP_023466229.1, WP_024261075.1, YP_003373985.1, YP_004049619.1, YP_004264315.1, YP_004367832.1, YP_004372355.1, YP_004411730.1, YP_006059729.1, YP_006412645.1, YP_006449447.1, YP_006716676.1, YP_006724798.1, YP_006890378.1, YP_006972085.1, and/or YP_007277147.1

In some embodiments, Type I-E cas7/casC polypeptides include, but are not limited to, GenBank accession number as set forth in Table 21.

TABLE 21

Type I-E cas7/casC polypeptide accession numbers
(the sequence identifier for each accession number, in the
order provided in Table 21, is SEQ ID NOs: 6824-7032).

AAC75800.1, ACL06610.1, ADB14459.1, ADP38755.1, ADR37698.1, AEB06541.1, AEC02350.1, AEJ53443.1, AFL73107.1, AFR99216.1, AGB27116.1, AGX34767.1, CCK86081.1, EDP20979.1, EEB22226.1, EEB34863.1, EEI14202.1, EEI27968.1, EEI64035.1, EEI78890.1, EEI86601.1, EEJ54447.1, EEP20785.1, EEW53944.1, EEW67653.1, EEX47613.1, EEZ61813.1, EFA23034.1, EFB87474.1, EFB90860.1, EFD93803.1, EFJ75316.1, EFJ78690.1, EFJ85028.1, EFJ97183.1, EFK01966.1, EFK08565.1, EFK21929.1, EFK32762.1, EFK39561.1, EFK47877.1, EFK52821.1,

TABLE 21-continued

Type I-E cas7/casC polypeptide accession numbers
(the sequence identifier for each accession number, in the
order provided in Table 21, is SEQ ID NOs: 6824-7032).

EFK65275.1, EFK66367.1, EFK74804.1, EFM24725.1, EFM43104.1, EFM49873.1, EFO58462.1,
EFQ06781.1, EFQ52086.1, EFQ53854.1, EFS88258.1, EFT11290.1, EFT25768.1, EFT64290.1,
EFT66654.1, EFU34515.1, EFU63290.1, EFU77568.1, EFX55036.1, EFY49863.1, EGB85504.1,
EGC81779.1, EGE70490.1, EGF23576.1, EGJ06276.1, EGL13344.1, EGL37416.1, EGS35793.1,
EHE85276.1, EHI77350.1, EHM12586.1, EHO49965.1, EIE98890.1, EIM64762.1, EIV92932.1,
EKX65601.1, EKX91277.1, EMH94975.1, EMR53800.1, EPI42422.1, EPI44035.1, EPI53339.1,
EPI53370.1, EPI56334.1, EPI57190.1, EPI61101.1, EPI61156.1, EPI62384.1, EPI66849.1, ERH20069.1,
ERH32726.1, ERJ75891.1, ERJ83446.1, ERJ96448.1, ESA60139.1, ESA65716.1, ESA72994.1,
ESA77458.1, ESA86351.1, ESA88075.1, ESD00138.1, ESD09710.1, ESD21949.1, ESD26438.1,
ESD31840.1, ESD51511.1, ESD61897.1, ESD64310.1, ESD64368.1, ESD71329.1, ESD80444.1,
ESD81868.1, ESD83160.1, ESE11366.1, ESK58510.1, ETA89351.1, ETE08829.1, ETE36803.1,
ETS24673.1, EWM59166.1, GAD17058.1, GAD17059.1, NP_417238.1, Q46899.1, WP_000064439.1,
WP_000064440.1, WP_000064441.1, WP_000064442.1, WP_000064443.1, WP_000064444.1,
WP_000064446.1, WP_000064447.1, WP_000064448.1, WP_000064450.1, WP_000064451.1,
WP_000210566.1, WP_000210567.1, WP_000210568.1, WP_002268123.1, WP_002438041.1,
WP_002514608.1, WP_002546993.1, WP_003088900.1, WP_004106698.1, WP_004109003.1,
WP_004112670.1, WP_004125156.1, WP_004127870.1, WP_004135188.1, WP_004136188.1,
WP_004138505.1, WP_004159615.1, WP_004167285.1, WP_004809667.1, WP_004826832.1,
WP_004835077.1, WP_005004478.1, WP_005920816.1, WP_005942576.1, WP_006002098.1,
WP_006302704.1, WP_006422698.1, WP_006591781.1, WP_006736340.1, WP_007594588.1,
WP_008087838.1, WP_008534589.1, WP_008750295.1, WP_008902366.1, WP_009314426.1,
WP_009344897.1, WP_009369771.1, WP_009429036.1, WP_009533382.1, WP_009535623.1,
WP_009663589.1, WP_009755578.1, WP_012289871.1, WP_012667164.1, WP_012914173.1,
WP_012997657.1, WP_013977922.1, WP_013990630.1, WP_014542122.1, WP_014633159.1,
WP_016637268.1, WP_016838863.1, WP_020281498.1, WP_020281499.1, WP_020759631.1,
WP_020761304.1, WP_020973662.1, WP_021600848.1, WP_021613846.1, WP_021673647.1,
WP_021676131.1, WP_021682643.1, WP_023888110.1, WP_024166819.1, YP_003373986.1,
YP_004049618.1, YP_004372356.1, YP_004411732.1, YP_006068306.1, YP_006413232.1,
YP_006724799.1, and/or YP_007277146.1

In some embodiments, Type I-E cas5/casD polypeptides include, but are not limited to, GenBank accession number as set forth in Table 22.

TABLE 22

Type I-E cas5/casD polypeptide accession numbers
(the sequence identifier for each accession number, in the
order provided in Table 22, is SEQ ID NOs: 7033-7251).

AAC75799.2, AAR34764.1, ABA88213.1, ACP32499.1, ADB14481.1, ADI66577.1, ADI84215.1,
ADP38756.1, ADR37697.1, ADY27682.1, AEB06542.1, AEB11724.1, AEB71779.1, AEC02351.1,
AFH39945.1, AFL72522.1, AFL73106.1, AFM27185.1, AFR99217.1, AFV75990.1, AGB27115.1,
AGE37472.1, AGX34766.1, CAQ05926.1, CCI86097.1, CCK86082.1, CDI66081.1, EDN80087.1,
EDP20978.1, EEB34864.1, EEH65614.1, EEI27969.1, EEI64036.1, EEI78891.1, EEI86600.1,
EEJ54446.1, EEP20784.1, EET77373.1, EEW16908.1, EEW42241.1, EEW53945.1, EEW67652.1,
EEX47614.1, EEZ61812.1, EFA23035.1, EFB87475.1, EFB90859.1, EFD84086.1, EFD93802.1,
EFE06767.1, EFF79643.1, EFH10699.1, EFI90756.1, EFJ64188.1, EFJ75317.1, EFJ78689.1,
EFJ85029.1, EFJ97182.1, EFK01965.1, EFK08634.1, EFK13798.1, EFK21930.1, EFK32759.1,
EFK39564.1, EFK47876.1, EFK52822.1, EFK66366.1, EFK74805.1, EFL93065.1, EFM24724.1,
EFM49979.1, EFO58461.1, EFQ06782.1, EFQ22977.1, EFQ47702.1, EFQ49119.1, EFQ52096.1,
EFS88259.1, EFT11289.1, EFT25769.1, EFT64291.1, EFT66655.1, EFU34514.1, EFU63291.1,
EFU77569.1, EFV94308.1, EFX55037.1, EGB85505.1, EGC81843.1, EGE70491.1, EGF23577.1,
EGF57388.1, EGF60540.1, EGG33807.1, EGG50907.1, EGJ06277.1, EGL13343.1, EGL38219.1,
EGS35926.1, EHI77351.1, EHM12587.1, EHO49966.1, EHQ05135.1, EIC19432.1, EIC29370.1,
EIE98889.1, EIM64761.1, EIV92931.1, EKW99768.1, EMH94966.1, EMR53799.1, EPI42423.1,
EPI44034.1, EPI53340.1, EPI53369.1, EPI56333.1, EPI57189.1, EPI61102.1, EPI61155.1, EPI62383.1,
EPI66848.1, EPI68831.1, EPI71020.1, EPI82118.1, EPI84752.1, EPI87539.1, EPI96742.1, EPJ01392.1,
EPJ03481.1, EPJ11329.1, ERH14162.1, ERH14498.1, ERH20070.1, ERH20456.1, ERH21171.1,
ERH32727.1, ERJ75890.1, ERJ83447.1, ERJ96449.1, ESA60140.1, ESA65717.1, ESA72993.1,
ESA77459.1, ESA86352.1, ESA88074.1, ESD00137.1, ESD09709.1, ESD21948.1, ESD26439.1,
ESD31839.1, ESD51512.1, ESD61898.1, ESD64311.1, ESD64369.1, ESD71328.1, ESD80445.1,
ESD81869.1, ESD83161.1, ESE11365.1, ESK58511.1, ETA02744.1, ETA89350.1, ETX32969.1,
GAD17060.1, NP_417237.2, NP_952441.1, Q46898.2, WP_004106696.1, WP_004109000.1,
WP_004112672.1, WP_004115346.1, WP_004125159.1, WP_004127874.1, WP_004136190.1,
WP_004138504.1, WP_005524251.1, WP_006302705.1, WP_008864959.1, WP_009429844.1,
WP_009550706.1, WP_009994022.1, WP_012914174.1, WP_016637269.1, WP_016838864.1,
WP_018637825.1, WP_020281500.1, WP_020759630.1, WP_020761303.1, WP_020973661.1,
WP_021600849.1, WP_021604020.1, WP_021604909.1, WP_021610202.1, WP_021610633.1,
WP_021613847.1, WP_021673646.1, WP_021676132.1, WP_021682644.1, WP_023140380.1,
WP_023156409.1, YP_001801360.1, YP_002834437.1, YP_003373987.1, YP_003718071.1,
YP_004049617.1, YP_004264317.1, YP_004367834.1, YP_004372357.1, YP_004411733.1,

TABLE 22-continued

Type I-E cas5/casD polypeptide accession numbers
(the sequence identifier for each accession number, in the
order provided in Table 22, is SEQ ID NOs: 7033-7251).

YP_006059731.1, YP_006412647.1, YP_006413231.1, YP_006449449.1, YP_006716678.1,
YP_006724800.1, YP_006890380.1, YP_006972087.1, YP_007277145.1, and/or YP_007417723.1

In some embodiments, Type I-E cas6e/case polypeptides include, but are not limited to, GenBank accession number as set forth in Table 23.

TABLE 23

Type I-E cas6e/case polypeptide accession numbers
(the sequence identifier for each accession number, in the
order provided in Table 23, is SEQ ID NOs: 7252-7520).

AAC75798.1, AAR34765.1, ACL06609.1, ADB14325.1, ADI66576.1, ADI84216.1, ADP38757.1,
ADR37696.1, ADY27683.1, AEB06543.1, AEB11725.1, AEB71780.1, AEC02349.1, AFH39946.1,
AFL72523.1, AFL73105.1, AFM27186.1, AFR99218.1, AFV75991.1, AGB27114.1, AGX34765.1,
CCI86096.1, CCK86083.1, CDC58447.1, CDI66082.1, EDN80086.1, EDP20977.1, EEB22228.1,
EEB34862.1, EEI14204.1, EEI27970.1, EEI64037.1, EEI77643.1, EEI78892.1, EEI86599.1,
EEJ54450.1, EEP20783.1, EET77372.1, EEW16909.1, EEW42240.1, EEW53946.1, EEW67651.1,
EEZ61811.1, EFA23036.1, EFB87476.1, EFD84085.1, EFD93801.1, EFE06768.1, EFF79642.1,
EFH10698.1, EFI90757.1, EFJ64189.1, EFJ75318.1, EFJ78688.1, EFJ85030.1, EFJ97190.1,
EFK01964.1, EFK08549.1, EFK13797.1, EFK21931.1, EFK32766.1, EFK39594.1, EFK47875.1,
EFK52823.1, EFK66365.1, EFK74806.1, EFL93064.1, EFM24723.1, EFM43102.1, EFM50285.1,
EFO58460.1, EFO71176.1, EFQ06783.1, EFQ22978.1, EFQ47730.1, EFQ49157.1, EFQ52112.1,
EFQ53869.1, EFS88260.1, EFT11288.1, EFT25770.1, EFT64292.1, EFT66656.1, EFU34513.1,
EFU63292.1, EFU77570.1, EFV94309.1, EFX55038.1, EGB85506.1, EGC81772.1, EGE70492.1,
EGF23578.1, EGF57387.1, EGF60541.1, EGG33808.1, EGG50908.1, EGJ06278.1, EGL13350.1,
EGL36080.1, EGS35882.1, EHE85271.1, EHI77352.1, EHQ05134.1, EIC19431.1, EIC29369.1,
EIE98888.1, EIM64763.1, EIV92930.1, EKX91280.1, EMH94952.1, EMR53798.1, EPI42424.1,
EPI44033.1, EPI52307.1, EPI53368.1, EPI56332.1, EPI57188.1, EPI61103.1, EPI61154.1, EPI62382.1,
EPI66847.1, EPI68830.1, EPI71019.1, EPI82117.1, EPI84751.1, EPI87538.1, EPI96741.1, EPJ01391.1,
EPJ03480.1, EPJ11328.1, EQC59007.1, EQM55565.1, ERC93626.1, ERH14161.1, ERH14499.1,
ERH20071.1, ERH20455.1, ERH21172.1, ERH32728.1, ERJ75889.1, ERJ83448.1, ERJ96450.1,
ESA60141.1, ESA65718.1, ESA72992.1, ESA77460.1, ESA86353.1, ESA88073.1, ESD00136.1,
ESD09708.1, ESD21947.1, ESD26440.1, ESD31838.1, ESD51513.1, ESD61899.1, ESD64312.1,
ESD64370.1, ESD71327.1, ESD80446.1, ESD81870.1, ESD83162.1, ESE11364.1, ESK58512.1,
ESS00993.1, ETA02745.1, ETA89349.1, ETX32968.1, EWM59164.1, NP_417236.1, NP_952442.1,
Q46897.1, WP_000275968.1, WP_000275969.1, WP_000275970.1, WP_002514610.1,
WP_002887563.1, WP_003088897.1, WP_003611355.1, WP_003619878.1, WP_003627701.1,
WP_003638535.1, WP_003680452.1, WP_003711544.1, WP_004106694.1, WP_004108997.1,
WP_004112674.1, WP_004125169.1, WP_004127877.1, WP_004132153.1, WP_004136192.1,
WP_004167288.1, WP_004271052.1, WP_004574564.1, WP_004809669.1, WP_004826830.1,
WP_004835071.1, WP_005524691.1, WP_006302706.1, WP_006499676.1, WP_006733194.1,
WP_006734894.1, WP_006735522.1, WP_006736351.1, WP_007124219.1, WP_007594585.1,
WP_008087967.1, WP_008462592.1, WP_008750297.1, WP_008753314.1, WP_008864960.1,
WP_008902364.1, WP_009344936.1, WP_009369769.1, WP_009427664.1, WP_009431210.1,
WP_009535621.1, WP_009560664.1, WP_009663637.1, WP_010241933.1, WP_010495835.1,
WP_011674074.1, WP_012391079.1, WP_012914175.1, WP_012997658.1, WP_013086434.1,
WP_013439422.1, WP_013977924.1, WP_013990628.1, WP_014082580.1, WP_014565815.1,
WP_014604239.1, WP_014633158.1, WP_014835008.1, WP_014939123.1, WP_016637270.1,
WP_016838866.1, WP_019776152.1, WP_019787555.1, WP_020758452.1, WP_020759629.1,
WP_020761302.1, WP_020973660.1, WP_021600850.1, WP_021604019.1, WP_021604910.1,
WP_021610201.1, WP_021610634.1, WP_021613848.1, WP_021673645.1, WP_021676133.1,
WP_021682645.1, WP_021816697.1, WP_022280995.1, WP_023140379.1, WP_023466234.1,
YP_003373988.1, YP_004049616.1, YP_004264318.1, YP_004367835.1, YP_004372358.1,
YP_004411731.1, YP_006059732.1, YP_006412648.1, YP_006413230.1, YP_006449450.1,
YP_006724801.1, YP_006890381.1, YP_006972088.1, and/or YP_007277144.1

In some embodiments, Type I-F cys1 polypeptides include, but are not limited to, GenBank accession number as set forth in Table 24.

TABLE 24

Type I-F cys1 polypeptide accession numbers
(the sequence identifier for each accession number, in the
order provided in Table 24, is SEQ ID NOs: 7521-8614).

AAK02389.1, AAM85292.1, AAO90474.1, AAQ59428.1, AAS62490.1, AAT03785.1, AAV89306.1,
ABA59201.1, ABE06378.1, ABG13929.1, ABG18390.1, ABJ00263.1, ABJ11602.1, ABM03215.1,
ABM25017.1, ABM40738.1, ABM57218.1, ABN73326.1, ABP40265.1, ABP60084.1, ABQ13774.1,

TABLE 24-continued

Type I-F cys1 polypeptide accession numbers
(the sequence identifier for each accession number, in the
order provided in Table 24, is SEQ ID NOs: 7521-8614).

ABS09366.1, ABS47563.1, ABS76912.2, ABS77281.1, ABX33857.1, ABX50537.1, ABX78740.1,
ABX85411.1, ABY68823.1, ACA67939.1, ACC89562.1, ACD38774.1, ACE60872.1, ACJ18399.1,
ACJ21001.1, ACJ42249.1, ACJ57095.1, ACO74062.1, ACQ92975.1, ACS84543.1, ACT05579.1,
ACV75133.1, ACX89392.1, ACY59063.1, ACY62906.1, ACZ78275.1, ADC72939.1, ADE14358.1,
ADE65025.1, ADE89458.1, ADG60301.1, ADH86222.1, ADJ29627.1, ADM99944.1, ADN71993.1,
ADR26230.1, ADT95524.1, ADU65668.1, ADV98275.1, ADX89043.1, ADX89502.1, ADZ83760.1,
ADZ92541.1, AEC02369.1, AEC18351.1, AEF92273.1, AEF99820.1, AEH62443.1, AEL09136.1,
AEL73392.1, AEO75099.1, AET15298.1, AEX04893.1, AEX51728.1, AFF23582.1, AFG36510.1,
AFH79569.1, AFH95464.1, AFI46138.1, AFI86378.1, AFI91858.1, AFJ02202.1, AFM64907.1,
AFN56495.1, AFP32551.1, AFR04904.1, AFT71809.1, AFZ95064.1, AFZ95067.1, AGA34092.1,
AGB80780.1, AGG09385.1, AGG09391.1, AGG31844.1, AGP49331.1, AGP56731.1, AGR05546.1,
AGR11302.1, AGR15392.1, AGR16666.1, AGR20776.1, AGR22558.1, AGR26149.1, AGR32635.1,
AGW13657.1, AGX88283.1, AHB09921.1, AHC77005.1, AHE63723.1, AHE99154.1, AHF01507.1,
AHH51210.1, BAH77673.1, BAL82648.1, CAE14086.1, CAG76579.1, CAH17083.1, CAH17369.1,
CAH21746.1, CAK96433.1, CAL21093.1, CAM85941.1, CAO95888.1, CAP75353.1, CAQ84811.1,
CAQ84824.1, CAR02242.1, CAR07056.1, CAS04772.1, CAX54608.1, CAY73257.1, CBA17527.1,
CBA76131.1, CBQ72655.1, CBV40988.1, CBX29755.1, CBY03554.1, CBY48580.1, CBY67065.1,
CBY69907.1, CBY72771.1, CBY75627.1, CCC73994.1, CCG18727.1, CCG19560.1, CCG88217.1,
CCH40236.1, CCI83946.1, CCJ84614.1, CCO00438.1, CCO24445.1, CCO63591.1, CCQ87260.1,
CCV12786.1, CCZ55232.1, CDD80271.1, CDF05512.1, CDG79719.1, CDH64393.1, EAL08156.1,
EAQ67604.1, EAT04042.1, EAT59333.1, EAX33530.2, EAZ67852.1, EAZ58295.1, EDM42113.1,
EDP21767.1, EDQ01683.1, EDQ48485.1, EDR35346.1, EDR37793.1, EDR45218.1, EDR48642.1,
EDR55883.1, EDU58856.1, EDV62110.1, EDZ65592.1, EEH84601.1, EEO29373.1, EEO76101.1,
EEO80178.1, EEO84410.1, EEO89852.1, EEP92231.1, EEQ03932.1, EER62392.1, EER62393.1,
EEV21941.1, EEW05501.1, EEW18398.1, EEW96609.1, EEX50304.1, EEX68259.1, EEY90281.1,
EFA49549.1, EFC58007.1, EFF94952.1, EFG00724.1, EFI23592.1, EFK42238.1, EFL78325.1,
EFL79684.1, EFM53867.1, EFM86281.1, EFM88414.1, EFM90572.1, EFM92759.1, EFM95005.1,
EFM97159.1, EFM99348.1, EFN01384.1, EFN03542.1, EFO58228.1, EFU46691.1, EFX91399.1,
EFX91400.1, EFX91401.1, EGB49277.1, EGB53896.1, EGB79047.1, EGC94951.1, EGE11094.1,
EGE12101.1, EGE14941.1, EGE19078.1, EGE19370.1, EGE21990.1, EGE24487.1, EGE25422.1,
EGE27751.1, EGF37989.1, EGJ07917.1, EGJ24489.1, EGJ59632.1, EGJ63887.1, EGM77974.1,
EGP02213.1, EGP02616.1, EGP02684.1, EGP02758.1, EGQ17530.1, EGS63957.1, EGW37653.1,
EGW90821.1, EGX68878.1, EGY35784.1, EGY36033.1, EGY38129.1, EGY39148.1, EGY39149.1,
EGY39150.1, EGY41122.1, EGY70947.1, EHG01971.1, EHJ94023.1, EHK42702.1, EHM40141.1,
EHM48029.1, EHN98428.1, EIA37119.1, EIC29311.1, EIE47040.1, EIF44409.1, EIK45283.1,
EIL54440.1, EIL76432.1, EIL89113.1, EIQ87550.1, EIQ88768.1, EIQ89495.1, EIR01144.1, EIR02488.1,
EIR05606.1, EIR16474.1, EIR17422.1, EIR19480.1, EIR30997.1, EIR32496.1, EIR33323.1, EIR45342.1,
EIR46426.1, EIR47972.1, EIR59153.1, EIR59982.1, EIR64115.1, EIR73557.1, EIR75601.1, EIR76606.1,
EIR87356.1, EIR89808.1, EIR91675.1, EIS03547.1, EIS03933.1, EIS05049.1, EIS16919.1, EIS17790.1,
EIS23399.1, EIS28664.1, EIS31268.1, EIS40840.1, EIS42738.1, EIS44211.1, EIS55614.1, EIS56044.1,
EIS60021.1, EIS66597.1, EIS73044.1, EIS76079.1, EIS78312.1, EIS86654.1, EIS90403.1, EIS94486.1,
EIS98162.1, EIT05329.1, EIT13607.1, EIT14717.1, EIT15457.1, EIT26164.1, EIT29053.1, EIT30491.1,
EIT40107.1, EIT44653.1, EIT45186.1, EIT55055.1, EIT56869.1, EIT62392.1, EJG22082.1, EJI84874.1,
EJO39737.1, EJP51268.1, EJS83105.1, EJS83187.1, EJS85444.1, EJS90168.1, EJS91482.1,
EJS92993.1, EJZ79575.1, EJZ80875.1, EJZ81232.1, EKA43936.1, EKA54579.1, EKA74315.1,
EKF84294.1, EKG52540.1, EKG57735.1, EKG62911.1, EKG63407.1, EKG52466.1, EKG59023.1,
EKK08278.1, EKK18197.1, EKK94023.1, EKL08413.1, EKL14868.1, EKL16051.1, EKL22305.1,
EKL39333.1, EKL48912.1, EKL93517.1, EKM01154.1, EKM08461.1, EKP55013.1, EKP56448.1,
EKS45299.1, EKT62227.1, EKX95270.1, ELC02438.1, ELC12192.1, ELC21170.1, ELC30642.1,
ELC31985.1, ELD54443.1, ELD92476.1, ELE13998.1, ELE25612.1, ELE34548.1, ELE51938.1,
ELE82361.1, ELE93036.1, ELF40642.1, ELF68854.1, ELF84511.1, ELF93397.1, ELF98793.1,
ELG17251.1, ELG28215.1, ELG56199.1, ELG59752.1, ELH17521.1, ELH33233.1, ELH65835.1,
ELH83714.1, ELH95193.1, ELH95740.1, ELI27976.1, ELI75034.1, ELI90641.1, ELJ31991.1,
ELJ44080.1, ELJ56850.1, ELJ58412.1, ELJ73178.1, ELT18755.1, ELY20637.1, EMI19651.1,
EMP51887.1, EMT98704.1, EMU01024.1, EMU07889.1, EMU33768.1, EMV25762.1, EMV41477.1,
EMV48349.1, EMV61751.1, EMV77001.1, EMV77660.1, EMV79454.1, EMW06845.1, EMW07144.1,
EMW11058.1, EMW22772.1, EMW28012.1, EMW63399.1, EMX55465.1, EMX95470.1, EMZ59014.1,
EMZ71046.1, ENA68768.1, ENA70831.1, ENO94850.1, ENU20823.1, ENU25384.1, ENU36865.1,
ENU64166.1, ENU64519.1, ENU68407.1, ENU79934.1, ENU84995.1, ENU90132.1,
ENU94465.1, ENV06534.1, ENV11505.1, ENV26808.1, ENV33520.1, ENV43130.1, ENV52235.1,
ENV66343.1, ENV79710.1, ENW17824.1, ENW17834.1, ENW36547.1, ENW39480.1, ENW64163.1,
ENW68335.1, ENW78806.1, ENW99800.1, ENX46545.1, ENY83744.1, ENZ96952.1, EOQ57500.1,
EOT14077.1, EOT16833.1, EOU37592.1, EOU39898.1, EOU82022.1, EOU82326.1,
EOV51400.1, EOV89558.1, EOV96440.1, EOW37719.1, EOW66748.1, EOX15982.1, EOX25496.1,
EPC00314.1, EPC10335.1, EPD43986.1, EPE65662.1, EPE66427.1, EPE67789.1, EPE69698.1,
EPE71676.1, EPE74056.1, EPE75489.1, EPP24157.1, EPP36537.1, EPP38603.1, EPR80937.1,
EPR81197.1, EPR88381.1, EPR88436.1, EPS74945.1, EQM86553.1, EQN06274.1, EQN09581.1,
EQN21673.1, EQN32966.1, EQN72751.1, EQN87317.1, EQO22615.1, EQO25947.1, EQO34067.1,
EQO52282.1, EQO63917.1, EQO87244.1, EQP27530.1, EQP52728.1, EQP62836.1, EQP80763.1,
EQQ42456.1, EQQ52930.1, EQR25824.1, EQR43473.1, EQR49983.1, EQR54852.1, EQR90841.1,
EQT05355.1, EQT30873.1, EQT84174.1, EQT86452.1, EQU02189.1, EQU15315.1, EQU15703.1,
EQU26653.1, EQU37326.1, EQU74182.1, EQU96772.1, EQV16497.1, EQV39105.1, EQV73991.1,
EQW35602.1, EQW74767.1, EQW95171.1, EQX30754.1, EQY04008.1, EQY05737.1, EQY46989.1,
EQY47415.1, EQZ21534.1, EQZ57880.1, EQZ59928.1, EQZ81916.1, ERA24939.1, ERA25706.1,
ERA94145.1, ERB37230.1, ERF78304.1, ERG16853.1, ERH80169.1, ERH80792.1, ERH82069.1,
ERH83949.1, ERH87746.1, ERL42546.1, ERO62439.1, ERO62440.1, ERO62441.1, ERP69291.1,

TABLE 24-continued

Type I-F cys1 polypeptide accession numbers
(the sequence identifier for each accession number, in the
order provided in Table 24, is SEQ ID NOs: 7521-8614).

ERP72010.1, ERP72732.1, ERP73551.1, ERP82386.1, ERT61752.1, ERU80871.1, ERU82775.1,
ERU95636.1, ERV23079.1, ERV32405.1, ERV45938.1, ERV90883.1, ERV92840.1, ERW05285.1,
ERW22632.1, ERW25389.1, ERW30733.1, ERW52654.1, ERW66576.1, ERW85641.1, ERW96792.1,
ERX11464.1, ERX57181.1, ERX57292.1, ERX68373.1, ERX76659.1, ERY56085.1, ERY93181.1,
ERY99967.1, ERZ00045.1, ERZ29314.1, ERZ42447.1, ESD40183.1, ESE13078.1, ESK35632.1,
ESK57655.1, ESM77259.1, ESM81556.1, ESN04281.1, ESN26373.1, ESN28523.1, ESN61384.1,
ESP24741.1, ESP31907.1, ESP34912.1, ESQ71810.1, EST01752.1, ETF26480.1, ETR82184.1,
ETR84943.1, ETU83908.1, ETU88442.1, ETV19934.1, ETV43751.1, ETV55561.1, ETY51218.1,
ETY53938.1, EUM12623.1, EVT85802.1, GAA37652.2, GAA60412.1, GAA79125.1, GAB03985.1,
GAC09608.1, GAC15832.1, GAC19767.1, GAC34440.1, GAC34441.1, GAE10394.1, GAF23543.1,
NP_245242.1, NP_669041.1, NP_819960.1, NP_901424.1, NP_929071.1, NP_993613.1, Q02ML9.1,
WP_000112420.1, WP_000399210.1, WP_000399211.1, WP_000415799.1, WP_000415800.1,
WP_000415801.1, WP_000415802.1, WP_000415803.1, WP_000415804.1, WP_000415805.1,
WP_000415806.1, WP_000415807.1, WP_000841017.1, WP_000841018.1, WP_000841019.1,
WP_000841020.1, WP_000841021.1, WP_000841022.1, WP_001063626.1, WP_001063627.1,
WP_001297315.1, WP_001516089.1, WP_001519631.1, WP_001546553.1, WP_001552676.1,
WP_001704454.1, WP_001706989.1, WP_001714017.1, WP_001953039.1, WP_001969798.1,
WP_001982950.1, WP_002216548.1, WP_002222491.1, WP_002225603.1, WP_002611226.1,
WP_002624011.1, WP_002802608.1, WP_002812358.1, WP_002923969.1, WP_003116911.1,
WP_003139224.1, WP_003143952.1, WP_003162917.1, WP_003464677.1, WP_003664170.1,
WP_003666003.1, WP_003667347.1, WP_003670775.1, WP_003672252.1, WP_003672780.1,
WP_003726678.1, WP_003727056.1, WP_003730930.1, WP_003738588.1, WP_004089534.1,
WP_004240705.1, WP_004279693.1, WP_004343803.1, WP_004349919.1, WP_004389634.1,
WP_004601700.1, WP_004601977.1, WP_004651370.1, WP_004652094.1, WP_004681365.1,
WP_004713756.1, WP_004728800.1, WP_004739558.1, WP_004752521.1, WP_004758712.1,
WP_004798546.1, WP_004801339.1, WP_004863337.1, WP_004895765.1, WP_004904254.1,
WP_004907049.1, WP_004918641.1, WP_004963263.1, WP_004998567.1, WP_005003488.1,
WP_005081844.1, WP_005081858.1, WP_005109633.1, WP_005163439.1, WP_005182494.1,
WP_005217654.1, WP_005346829.1, WP_005371072.1, WP_005497852.1, WP_005540027.1,
WP_005551775.1, WP_005551921.1, WP_005562569.1, WP_005562571.1, WP_005562575.1,
WP_005596018.1, WP_005600277.1, WP_005603468.1, WP_005606943.1, WP_005611354.1,
WP_005616691.1, WP_005623493.1, WP_005623497.1, WP_005623500.1, WP_005720634.1,
WP_005721278.1, WP_005725639.1, WP_005725806.1, WP_005742492.1, WP_005752986.1,
WP_005753650.1, WP_005756147.1, WP_005764761.1, WP_005769537.1, WP_005772797.1,
WP_005792703.1, WP_005792704.1, WP_005842408.1, WP_005879782.1, WP_005923785.1,
WP_005974986.1, WP_006045188.1, WP_006174403.1, WP_006331712.1, WP_006365989.1,
WP_006790330.1, WP_006912975.1, WP_007069542.1, WP_007106205.1, WP_007106206.1,
WP_007111959.1, WP_007117095.1, WP_007293313.1, WP_007620986.1, WP_007641675.1,
WP_007744292.1, WP_007749063.1, WP_007986846.1, WP_008135459.1, WP_008169482.1,
WP_008215108.1, WP_008247105.1, WP_008608781.1, WP_008698003.1, WP_008845637.1,
WP_008898789.1, WP_008911673.1, WP_009174232.1, WP_009288126.1, WP_009622501.1,
WP_009832551.1, WP_009875009.1, WP_009876497.1, WP_010106219.1, WP_010201103.1,
WP_010265207.1, WP_010279272.1, WP_010295110.1, WP_010318159.1, WP_010364313.1,
WP_010906577.1, WP_010957911.1, WP_011095181.1, WP_011135306.1, WP_011146070.1,
WP_011192626.1, WP_011212640.1, WP_011216754.1, WP_011240574.1, WP_011769775.1,
WP_011789484.1, WP_011803947.1, WP_011809225.1, WP_011927917.1, WP_011996910.1,
WP_011997338.1, WP_012016803.1, WP_012089885.1, WP_012104945.1, WP_012197494.1,
WP_012203143.1, WP_012220397.1, WP_012229482.1, WP_012303963.1, WP_012440590.1,
WP_012570060.1, WP_012570903.1, WP_012667183.1, WP_012696552.1, WP_012729574.1,
WP_012764362.1, WP_012768459.1, WP_012817199.1, WP_012886077.1, WP_012917520.1,
WP_012983811.1, WP_013032249.1, WP_013107620.1, WP_013163749.1, WP_013221692.1,
WP_013319367.1, WP_013330863.1, WP_013505553.1, WP_013657054.1, WP_013662443.1,
WP_013739764.1, WP_013747107.1, WP_013804306.1, WP_013818080.1, WP_014016721.1,
WP_014228623.1, WP_014325844.1, WP_014390883.1, WP_014424085.1, WP_014454507.1,
WP_014500608.1, WP_014509415.1, WP_014602882.1, WP_014658069.1, WP_014673057.1,
WP_014701307.1, WP_014703622.1, WP_014833996.1, WP_014848626.1, WP_014872888.1,
WP_014916577.1, WP_014995870.1, WP_015259208.1, WP_015337045.1, WP_015551640.1,
WP_015555715.1, WP_015670635.1, WP_015696920.1, WP_015731171.1, WP_015834854.1,
WP_015834867.1, WP_015862798.1, WP_016158984.1, WP_016232820.1, WP_016248534.1,
WP_016261857.1, WP_016418866.1, WP_016451883.1, WP_016504385.1, WP_016534110.1,
WP_016534296.1, WP_016534561.1, WP_016836896.1, WP_017004729.1, WP_017253215.1,
WP_017350190.1, WP_017395753.1, WP_017448229.1, WP_017466362.1, WP_017788587.1,
WP_018025761.1, WP_018076940.1, WP_018122277.1, WP_018125463.1, WP_018176610.1,
WP_018285446.1, WP_018298695.1, WP_018347332.1, WP_018414916.1, WP_018559989.1,
WP_018676856.1, WP_018719049.1, WP_019001601.1, WP_019022908.1, WP_019520403.1,
WP_019543109.1, WP_019671932.1, WP_019843462.1, WP_019935460.1, WP_019951122.1,
WP_019959484.1, WP_020161983.1, WP_020328487.1, WP_020355487.1, WP_020393891.1,
WP_020443856.1, WP_020566224.1, WP_020680648.1, WP_020870181.1, WP_021017051.1,
WP_021205340.1, WP_021325938.1, WP_021461779.1, WP_021496695.1, WP_021511678.1,
WP_021519928.1, WP_021531159.1, WP_021760540.1, WP_021986552.1, WP_022027307.1,
WP_022381641.1, WP_022498163.1, WP_022642198.1, WP_022642199.1, WP_022642200.1,
WP_022654589.1, WP_022775606.1, WP_022850861.1, WP_022852963.1, WP_023053042.1,
WP_023087478.1, WP_023091296.1, WP_023100320.1, WP_023103132.1, WP_023122499.1,
WP_023271486.1, WP_023320639.1, WP_023327012.1, WP_023337012.1, WP_023338204.1,
WP_023346464.1, WP_023593282.1, WP_023640697.1, WP_023655989.1, WP_024107197.1,
XP_001401634.1, XP_001584082.1, XP_003494537.1, XP_003665759.1, XP_004528093.1,

TABLE 24-continued

Type I-F cys1 polypeptide accession numbers
(the sequence identifier for each accession number, in the
order provided in Table 24, is SEQ ID NOs: 7521-8614).

YP_001052931.1, YP_001163238.1, YP_001176135.1, YP_001209096.1, YP_001367429.1,
YP_001400515.1, YP_001424468.1, YP_001425255.2, YP_001555797.1, YP_001562242.1,
YP_001596760.1, YP_001606220.1, YP_001651267.1, YP_001712944.1, YP_001720392.1,
YP_001873019.1, YP_001906786.1, YP_001968014.1, YP_002303544.1, YP_002306146.1,
YP_002320238.1, YP_002324895.1, YP_002347429.1, YP_002390702.1, YP_002396879.1,
YP_002555748.1, YP_002647858.1, YP_002757711.1, YP_002795071.1, YP_002892561.1,
YP_002955559.1, YP_002986365.1, YP_003003058.1, YP_003041554.1, YP_003041567.1,
YP_003225717.1, YP_003260999.1, YP_003334981.1, YP_003377521.1, YP_003461675.1,
YP_003526745.1, YP_003568287.1, YP_003626194.1, YP_003690841.1, YP_003761948.1,
YP_003884501.1, YP_003896173.1, YP_004112224.1, YP_004308958.1, YP_004314377.1,
YP_004411751.1, YP_004421248.1, YP_004490628.1, YP_004512320.1, YP_004766821.1,
YP_005019132.1, YP_005176267.1, YP_005199868.1, YP_005274576.1, YP_005362753.1,
YP_005432671.1, YP_005474217.1, YP_005505366.1, YP_005509299.1, YP_005522412.1,
YP_005620894.1, YP_005623562.1, YP_005639254.1, YP_005801628.1, YP_005975201.1,
YP_006100124.1, YP_006111505.1, YP_006119164.1, YP_006205237.1, YP_006218155.1,
YP_006239897.1, YP_006245601.1, YP_006284730.1, YP_006286210.1, YP_006292889.1,
YP_006482609.1, YP_006518017.1, YP_006559964.1, YP_006648157.1, YP_006672809.1,
YP_006675673.1, YP_006678529.1, YP_006681438.1, YP_006692986.1, YP_006754116.1,
YP_006822152.1, YP_007014582.1, YP_007217573.1, YP_007326546.1, YP_007342965.1,
YP_007506217.1, YP_007693219.1, YP_007821732.1, YP_007826786.1, YP_008163693.1,
YP_008275318.1, YP_008278180.1, YP_008282548.1, YP_008284800.1, YP_008285745.1,
YP_008289189.1, YP_008299286.1, YP_008301323.1, YP_008304316.1, YP_008570807.1,
YP_008590827.1, YP_008682386.1, YP_008685345.1, YP_008791660.1, YP_008981899.1,
YP_013608.1, YP_051769.1, YP_071020.1, YP_122343.1, YP_128164.1, YP_162417.1, YP_344731.1,
YP_539909.1, YP_647990.1, YP_651874.1, YP_790817.1, YP_851977.1, YP_942814.1, YP_963571.1,
YP_984814.1, and/or YP_996236.1

In some embodiments, Type I-F cys2 polypeptides include, but are not limited to, GenBank accession number as set forth in Table 25.

TABLE 25

Type I-F cys2 polypeptide accession numbers
(the sequence identifier for each accession number, in the
order provided in Table 25, is SEQ ID NOs: 8615-9867).

AAC65118.1, AAK02390.1, AAM85293.1, AAQ59427.1, AAS62489.1, AAV89307.2, ABA59202.1,
ABE06379.1, ABE06380.1, ABG13928.1, ABG18389.1, ABJ00264.1, ABJ11603.1, ABK50072.1,
ABM03216.1, ABM25016.1, ABM40737.1, ABM57217.1, ABN73325.1, ABO37086.1, ABP40264.1,
ABP60085.1, ABQ13203.1, ABS09365.1, ABS46484.1, ABS77509.1, ABS77769.2, ABU74104.1,
ABX33858.1, ABX50536.1, ABX84883.1, ABY68822.1, ACA67940.1, ACC89561.1, ACD38773.1,
ACD70553.1, ACE60871.1, ACH65834.1, ACJ19105.1, ACJ21002.1, ACJ27815.1, ACJ56177.1,
ACK48653.1, ACO74063.1, ACQ92976.1, ACS84542.1, ACT05580.1, ACV75132.1, ACX89391.1,
ACY59062.1, ACY62907.1, ACZ78274.1, ADC72940.1, ADE14359.1, ADE54031.1, ADE65024.1,
ADG60302.1, ADH86221.1, ADJ29628.1, ADM99943.1, ADR02760.1, ADR26231.1, ADR64330.1,
ADR64349.1, ADR64397.1, ADR64416.1, ADR64435.1, ADT68979.1, ADT95523.1, ADU65665.1,
ADV98276.1, ADX55812.1, ADX89042.1, ADX89501.1, ADZ92540.1, AEC02368.1, AEF92272.1,
AEF99821.1, AEH40082.1, AEH62442.1, AEL09137.1, AEL73393.1, AEO75098.1, AET15299.1,
AET92128.1, AEX04894.1, AEX24997.1, AEX51729.1, AEZ58314.1, AEZ59382.1, AEZ60447.1,
AFF23583.1, AFG36511.1, AFH95465.1, AFI46137.1, AFI86379.1, AFI91857.1, AFJ02201.1,
AFM64906.1, AFN56494.1, AFR04905.1, AFT71808.1, AFU66157.1, AGA34091.1, AGB12636.1,
AGB80781.1, AGG09386.1, AGG09392.1, AGK83770.1, AGN75345.1, AGN76322.1, AGQ92515.1,
AGU98412.1, AGW13658.1, AGX88282.1, AHB09920.1, AHC77004.1, AHE63724.1, AHE99153.1,
AHF01506.1, AHG62863.1, AHH51211.1, AHI99022.1, BAC62731.1, BAH15058.1, BAH77672.1,
BAL82649.1, BAM20857.1, CAE14087.1, CAG69249.1, CAG76580.1, CAH17084.1, CAH17368.1,
CAH21745.1, CAL21092.1, CAM85942.1, CAO95889.1, CAQ84810.1, CAR07057.1, CAX54609.1,
CAY73258.1, CBA17528.1, CBA76129.1, CBV40989.1, CBX29756.1, CBZ12648.1, CCC73993.1,
CCG18726.1, CCG19559.1, CCG88216.1, CCH40237.1, CCJ84615.1, CCO00437.1, CCO24444.1,
CCQ87261.1, CCZ55231.1, CDD80272.1, CDF05511.1, CDG79718.1, CDH64394.1, CDH64395.1,
EAQ67603.1, EAS64064.1, EAS76234.1, EAT04043.1, EAT33399.1, EAT59334.1, EAX33542.1,
EAZ52873.1, EAZ58296.1, EDK28162.1, EDM42114.1, EDM61554.1, EDM65937.1, EDQ01682.1,
EDR31165.1, EDR35344.1, EDR37791.1, EDR44816.1, EDR48641.1, EDR48745.1, EDR55852.1,
EDR59629.1, EDT07274.1, EDU58857.1, EDV62082.1, EDZ65397.1, EED26449.1, EEH60997.1,
EEH84600.1, EEO29372.1, EEO76100.1, EEO80177.1, EEO84409.1, EEO89851.1, EEP92232.1,
EEQ03933.1, EEV21942.1, EEW05502.1, EEW96608.1, EEX04036.1, EEX50303.1, EEX68260.1,
EEY43699.1, EEY55135.1, EEY90280.1, EFA49550.1, EFC58008.1, EFI23593.1, EFI34392.1,
EFL78324.1, EFL79685.1, EFM41492.1, EFM53866.1, EFM86280.1, EFM88413.1, EFM90571.1,
EFM92758.1, EFM95004.1, EFM97158.1, EFM99347.1, EFN01383.1, EFN03541.1, EFO35344.1,
EFO41582.1, EFO49823.1, EFO58227.1, EFO78344.1, EFU46689.1, EFU46690.1, EFV43216.2,
EFV45902.1, EFX91402.1, EFX91403.1, EGB49275.1, EGB49276.1, EGB53897.1, EGB79046.1,
EGD85262.1, EGE11095.1, EGE12102.1, EGE12619.1, EGE14942.1, EGE19077.1, EGE19369.1,
EGE21989.1, EGE24486.1, EGE25421.1, EGE27752.1, EGF40126.1, EGJ07916.1, EGJ59631.1,

TABLE 25-continued

Type I-F cys2 polypeptide accession numbers
(the sequence identifier for each accession number, in the
order provided in Table 25, is SEQ ID NOs: 8615-9867).

EGJ63888.1, EGK17297.1, EGM77973.1, EGP02214.1, EGP02617.1, EGP02827.1, EGS63958.1,
EGW44655.1, EGW90822.1, EGY35785.1, EGY38130.1, EGY39147.1, EGY41121.1, EGY70946.1,
EHG01972.1, EHG01973.1, EHJ62063.1, EHJ94022.1, EHK62470.1, EHM40142.1, EHM40143.1,
EHN98429.1, EHN98430.1, EIA37120.1, EIC20985.1, EIC29312.1, EIE47039.1, EIF30433.1,
EIF44410.1, EIK45282.1, EIL54441.1, EIL89114.1, EIQ04711.1, EIQ87532.1, EIQ88767.1, EIQ89494.1,
EIR01143.1, EIR02487.1, EIR05613.1, EIR16472.1, EIR17421.1, EIR19479.1, EIR30996.1, EIR32511.1,
EIR33322.1, EIR45359.1, EIR46447.1, EIR47971.1, EIR59136.1, EIR59981.1, EIR64114.1, EIR73558.1,
EIR75600.1, EIR76605.1, EIR87355.1, EIR89801.1, EIR91668.1, EIS03546.1, EIS03932.1, EIS05048.1,
EIS16926.1, EIS17791.1, EIS23398.1, EIS28665.1, EIS31267.1, EIS40839.1, EIS42734.1, EIS44210.1,
EIS55613.1, EIS56043.1, EIS60020.1, EIS66596.1, EIS73043.1, EIS76073.1, EIS78311.1, EIS86653.1,
EIS90404.1, EIS94485.1, EIS98161.1, EIT05328.1, EIT13606.1, EIT14716.1, EIT15455.1, EIT26170.1,
EIT29052.1, EIT30490.1, EIT40105.1, EIT44652.1, EIT45185.1, EIT55054.1, EIT56868.1, EIT62391.1,
EJG22853.1, EJH60544.1, EJI84873.1, EJJ29961.1, EJM51923.1, EJM65813.1, EJM74211.1,
EJO40234.1, EJP50675.1, EJS85445.1, EJS91481.1, EJS92992.1, EJZ16269.1, EJZ79576.1,
EJZ80876.1, EKA43935.1, EKA54578.1, EKA74427.1, EKE17716.1, EKF84295.1, EKG52541.1,
EKG57736.1, EKG62912.1, EKG63402.1, EKG72467.1, EKG93024.1, EKK08318.1, EKK18170.1,
EKK94024.1, EKL08414.1, EKL14869.1, EKL16052.1, EKL22306.1, EKL39436.1, EKL48989.1,
EKL93518.1, EKM01119.1, EKM08462.1, EKP54932.1, EKP56482.1, EKS45298.1, EKT62226.1,
EKU52245.1, EKX72657.1, EKX95269.1, ELC02439.1, ELC02440.1, ELC12193.1, ELC12194.1,
ELC21171.1, ELC30643.1, ELC31986.1, ELD54444.1, ELD92477.1, ELE13999.1, ELE14000.1,
ELE25613.1, ELE25614.1, ELE34549.1, ELE34550.1, ELE51939.1, ELE82362.1, ELE93037.1,
ELF40643.1, ELF68855.1, ELF84512.1, ELF93398.1, ELF93399.1, ELF98794.1, ELG17252.1,
ELG17253.1, ELG28216.1, ELG28217.1, ELG56200.1, ELG56201.1, ELG59753.1, ELG59754.1,
ELH17522.1, ELH33234.1, ELH65836.1, ELH83715.1, ELH95194.1, ELH95195.1, ELH95741.1,
ELH95742.1, ELI27977.1, ELI75035.1, ELI90642.1, ELJ31992.1, ELJ44081.1, ELJ44082.1, ELJ56851.1,
ELJ56852.1, ELJ58413.1, ELJ58414.1, ELJ73179.1, ELT18756.1, ELT56867.1, ELU49893.1,
ELX04694.1, ELY20636.1, EME59649.1, EMI19652.1, EMP51886.1, EMT98186.1, EMT98703.1,
EMU01025.1, EMU07890.1, EMU15105.1, EMU33767.1, EMV25763.1, EMV41478.1, EMV48350.1,
EMV61752.1, EMV77002.1, EMV77661.1, EMV79455.1, EMW06846.1, EMW07145.1, EMW11059.1,
EMW22773.1, EMW28013.1, EMW63400.1, EMX55466.1, EMX95471.1, EMZ59015.1, EMZ71020.1,
ENA68769.1, ENA70832.1, ENO94849.1, ENU20824.1, ENU25385.1, ENU26367.1, ENU36864.1,
ENU64164.1, ENU64518.1, ENU68406.1, ENU79933.1, ENU84695.1, ENU84994.1, ENU90131.1,
ENU94392.1, ENU94466.1, ENV06535.1, ENV11504.1, ENV23285.1, ENV26809.1, ENV33519.1,
ENV38701.1, ENV43129.1, ENV52234.1, ENV54186.1, ENV60435.1, ENV66342.1, ENV79711.1,
ENV88481.1, ENV99921.1, ENW17835.1, ENW36548.1, ENW39481.1, ENW64164.1, ENW68334.1,
ENW74528.1, ENW78805.1, ENW99799.1, ENX46544.1, ENZ96951.1, EOD78080.1, EOQ57499.1,
EOR06424.1, EOT14078.1, EOT16832.1, EOU37593.1, EOU37594.1, EOU39899.1, EOU39900.1,
EOU65599.1, EOU82023.1, EOU82024.1, EOU82327.1, EOV51401.1, EOV89559.1, EOV96441.1,
EOW37720.1, EOW66749.1, EOX15983.1, EOX15984.1, EOX25497.1, EPC00313.1, EPC10334.1,
EPD43985.1, EPE65661.1, EPE66428.1, EPE67790.1, EPE69699.1, EPE71677.1, EPE74057.1,
EPM42539.1, EPP24158.1, EPR80938.1, EPR81196.1, EPR88382.1, EPS74952.1, EQL85638.1,
EQL91070.1, EQM00498.1, EQM01690.1, EQM46391.1, EQM86552.1, EQN06272.1, EQN06273.1,
EQN09579.1, EQN09580.1, EQN21674.1, EQN21675.1, EQN32967.1, EQN72752.1, EQN72753.1,
EQN87316.1, EQO22616.1, EQO22617.1, EQO25948.1, EQO25949.1, EQO34068.1, EQO34069.1,
EQO52283.1, EQO63918.1, EQO63919.1, EQO87245.1, EQO87246.1, EQP27531.1, EQP27532.1,
EQP52729.1, EQP52730.1, EQP62837.1, EQP62838.1, EQP80764.1, EQP80765.1, EQQ42457.1,
EQQ42458.1, EQQ52931.1, EQQ52932.1, EQR25825.1, EQR25826.1, EQR43474.1, EQR49984.1,
EQR49985.1, EQR54853.1, EQR54854.1, EQR90839.1, EQR90840.1, EQT05353.1, EQT05354.1,
EQT30874.1, EQT30875.1, EQT84175.1, EQT84176.1, EQT86453.1, EQT86454.1, EQU02187.1,
EQU02188.1, EQU15316.1, EQU15701.1, EQU15702.1, EQU26654.1, EQU26655.1, EQU37327.1,
EQU37328.1, EQU74183.1, EQU74184.1, EQU96773.1, EQU96774.1, EQV16498.1, EQV16499.1,
EQV39103.1, EQV39104.1, EQV73992.1, EQW35603.1, EQW35604.1, EQW74766.1, EQW95169.1,
EQW95170.1, EQX30755.1, EQX30756.1, EQY04009.1, EQY04010.1, EQY05738.1, EQY05739.1,
EQY46990.1, EQY47416.1, EQZ21535.1, EQZ57878.1, EQZ57879.1, EQZ59929.1, EQZ59930.1,
EQZ81917.1, EQZ81918.1, ERA24940.1, ERA24941.1, ERA25707.1, ERA25708.1, ERA94143.1,
ERA94144.1, ERB37231.1, ERB37232.1, ERG09344.1, ERG16854.1, ERG53586.1, ERG59564.1,
ERH66546.1, ERL42547.1, ERO62442.1, ERP69292.1, ERP72009.1, ERP72731.1, ERP73550.1,
ERP82385.1, ERT12421.1, ERT61667.1, ERU80870.1, ERU82774.1, ERU95635.1, ERV23078.1,
ERV32404.1, ERV45937.1, ERV90882.1, ERV92839.1, ERW22631.1, ERW25388.1,
ERW30732.1, ERW52655.1, ERW66575.1, ERW85640.1, ERW96791.1, ERX11463.1, ERX57182.1,
ERX57291.1, ERX68374.1, ERX76658.1, ERY56084.1, ERY93180.1, ERY99966.1, ERZ00044.1,
ERZ29313.1, ERZ42446.1, ESD40182.1, ESE13076.1, ESE13077.1, ESK35633.1, ESK57656.1,
ESM77260.1, ESM81557.1, ESN04282.1, ESN26374.1, ESN52893.1, ESN61385.1, ESP24739.1,
ESP24740.1, ESP31908.1, ESP31909.1, ESP34910.1, ESP34911.1, ESQ71809.1, EST01751.1,
ESV68075.1, ESW43324.1, ETD57410.1, ETD60296.1, ETD64803.1, ETF26481.1, ETF26482.1,
ETJ46807.1, ETJ94590.1, ETQ64199.1, ETR05197.1, ETR05666.1, ETR14608.1, ETR84942.1,
ETS22726.1, ETT12868.1, ETT14317.1, ETT20303.1, ETU83909.1, ETU88441.1, ETV19933.1,
ETV55560.1, ETX25632.1, ETX50993.1, ETX59143.1, ETX78939.1, ETY51219.1, ETY51220.1,
ETY53939.1, ETY53940.1, EUC25474.1, EUC91105.1, EUC95220.1, EUD17216.1, EUL88077.1,
EUM12619.1, EUM12624.1, EVT81600.1, EVU15060.1, EWS67918.1, GAA59875.1, GAA60411.1,
GAA75156.1, GAA77962.1, GAA79126.1, GAA79127.1, GAB76061.1, GAC09609.1, GAC15831.1,
GAC19766.1, GAC34442.1, GAD77037.1, GAD89661.1, GAE10393.1, NP_218566.1, NP_245243.1,
NP_669042.1, NP_800898.1, NP_901423.1, NP_929072.1, NP_993612.1, O83163.1, Q02MM0.1,
WP_000092766.1, WP_000092767.1, WP_000092768.1, WP_000092769.1, WP_000120896.1,
WP_000120897.1, WP_000120898.1, WP_000120899.1, WP_000120900.1, WP_000120901.1,
WP_000120902.1, WP_000120903.1, WP_000120904.1, WP_000164158.1, WP_000164159.1,

TABLE 25-continued

Type I-F cys2 polypeptide accession numbers
(the sequence identifier for each accession number, in the
order provided in Table 25, is SEQ ID NOs: 8615-9867).

WP_001101620.1, WP_001101621.1, WP_001112159.1, WP_001194012.1, WP_001215683.1,
WP_001215684.1, WP_001377968.1, WP_001387630.1, WP_001516090.1, WP_001695684.1,
WP_001712676.1, WP_001982951.1, WP_002047792.1, WP_002211868.1, WP_002225497.1,
WP_002225602.1, WP_002430404.1, WP_002540931.1, WP_002802606.1, WP_002811940.1,
WP_002923967.1, WP_003116910.1, WP_003147065.1, WP_003159089.1, WP_003162918.1,
WP_003464680.1, WP_003662185.1, WP_003664172.1, WP_003673461.1, WP_003842036.1,
WP_004234138.1, WP_004279691.1, WP_004343804.1, WP_004389636.1, WP_004651372.1,
WP_004652095.1, WP_004662983.1, WP_004681363.1, WP_004713757.1, WP_004728798.1,
WP_004752519.1, WP_004758710.1, WP_004770611.1, WP_004798548.1, WP_004801338.1,
WP_004828410.1, WP_004863335.1, WP_004877063.1, WP_004895762.1, WP_004907047.1,
WP_004918642.1, WP_004928487.1, WP_004948466.1, WP_004963260.1, WP_004998564.1,
WP_005003490.1, WP_005024345.1, WP_005026491.1, WP_005048554.1, WP_005081860.1,
WP_005163437.1, WP_005217652.1, WP_005370438.1, WP_005371074.1, WP_005378542.1,
WP_005463135.1, WP_005472986.1, WP_005478157.1, WP_005497851.1, WP_005499642.1,
WP_005535624.1, WP_005540023.1, WP_005562567.1, WP_005596015.1, WP_005600276.1,
WP_005603467.1, WP_005606941.1, WP_005611344.1, WP_005614487.1, WP_005616689.1,
WP_005623503.1, WP_005623506.1, WP_005721279.1, WP_005725549.1, WP_005725807.1,
WP_005751236.1, WP_005753652.1, WP_005756148.1, WP_005764760.1, WP_005769535.1,
WP_005842409.1, WP_005879780.1, WP_005974983.1, WP_006033286.1, WP_006052519.1,
WP_006174405.1, WP_006365990.1, WP_006790331.1, WP_006790332.1, WP_007011900.1,
WP_007069541.1, WP_007106207.1, WP_007111958.1, WP_007117096.1, WP_007181148.1,
WP_007293314.1, WP_007460967.1, WP_007607346.1, WP_007620985.1, WP_007641673.1,
WP_007749065.1, WP_007815612.1, WP_007986848.1, WP_007990663.1, WP_007994009.1,
WP_008022977.1, WP_008129239.1, WP_008133919.1, WP_008135462.1, WP_008135464.1,
WP_008168509.1, WP_008169481.1, WP_008215111.1, WP_008220721.1, WP_008247106.1,
WP_008608780.1, WP_008698005.1, WP_008845636.1, WP_008869718.1, WP_008898788.1,
WP_008911672.1, WP_009095258.1, WP_009151388.1, WP_009174233.1, WP_009288125.1,
WP_009368458.1, WP_009514914.1, WP_009832550.1, WP_009875010.1, WP_009875011.1,
WP_009876498.1, WP_010106218.1, WP_010201102.1, WP_010279275.1, WP_010295112.1,
WP_010318158.1, WP_010364311.1, WP_010388189.1, WP_010554108.1, WP_010559723.1,
WP_010606800.1, WP_010631403.1, WP_010881575.1, WP_010906578.1, WP_011095182.1,
WP_011135305.1, WP_011146071.1, WP_011192625.1, WP_011212639.1, WP_011216755.1,
WP_011240575.1, WP_011525176.1, WP_011718588.1, WP_011769776.1, WP_011789483.1,
WP_011803946.1, WP_011809224.1, WP_011848336.1, WP_011927918.1, WP_011996911.1,
WP_011997339.1, WP_012016804.1, WP_012089884.1, WP_012104946.1, WP_012129694.1,
WP_012197493.1, WP_012203144.1, WP_012262739.1, WP_012303964.1, WP_012440591.1,
WP_012533314.1, WP_012570449.1, WP_012588885.1, WP_012667184.1, WP_012696553.1,
WP_012729575.1, WP_012764361.1, WP_012768460.1, WP_012817198.1, WP_012886076.1,
WP_012917521.1, WP_012983812.1, WP_013032250.1, WP_013042753.1, WP_013163748.1,
WP_013221693.1, WP_013319366.1, WP_013330864.1, WP_013465401.1, WP_013505551.1,
WP_013589020.1, WP_013662442.1, WP_013739763.1, WP_013804305.1, WP_013818081.1,
WP_013944828.1, WP_014016720.1, WP_014228624.1, WP_014234833.1, WP_014251761.1,
WP_014325845.1, WP_014342279.1, WP_014342713.1, WP_014390884.1, WP_014424086.1,
WP_014454508.1, WP_014500607.1, WP_014509416.1, WP_014658070.1, WP_014701306.1,
WP_014703621.1, WP_014848625.1, WP_014916578.1, WP_014995869.1, WP_015259207.1,
WP_015337044.1, WP_015551639.1, WP_015557714.1, WP_015670636.1, WP_015683962.1,
WP_015696921.1, WP_015731170.1, WP_015834853.1, WP_015862797.1, WP_016164443.1,
WP_016232821.1, WP_016248535.1, WP_016261858.1, WP_016360503.1, WP_016418865.1,
WP_016451882.1, WP_016504384.1, WP_016532754.1, WP_016785737.1, WP_016795643.1,
WP_017004728.1, WP_017019123.1, WP_017026497.1, WP_017031015.1, WP_017045320.1,
WP_017049067.1, WP_017064054.1, WP_017066106.1, WP_017089408.1, WP_017098522.1,
WP_017101566.1, WP_017108317.1, WP_017198528.1, WP_017216065.1, WP_017233561.1,
WP_017253164.1, WP_017395754.1, WP_017420289.1, WP_017448230.1, WP_017631032.1,
WP_017631279.1, WP_017785586.1, WP_017925083.1, WP_018025760.1, WP_018114351.1,
WP_018122276.1, WP_018125462.1, WP_018176611.1, WP_018285447.1, WP_018298696.1,
WP_018414917.1, WP_018676855.1, WP_018719048.1, WP_018838292.1, WP_018844146.1,
WP_018871531.1, WP_019001600.1, WP_019018098.1, WP_019022907.1, WP_019283232.1,
WP_019520402.1, WP_019543110.1, WP_019820373.1, WP_019843463.1, WP_019895601.1,
WP_019935461.1, WP_019951123.1, WP_019951124.1, WP_019985485.1, WP_020065396.1,
WP_020161984.1, WP_020328488.1, WP_020332815.1, WP_020393890.1, WP_020443857.1,
WP_020680649.1, WP_020841380.1, WP_020911193.1, WP_021017052.1, WP_021325939.1,
WP_021511407.1, WP_021515757.1, WP_021710780.1, WP_021760541.1, WP_022027306.1,
WP_022381642.1, WP_022498162.1, WP_022642201.1, WP_022654590.1, WP_022772662.1,
WP_022850860.1, WP_022940476.1, WP_023045107.1, WP_023052957.1, WP_023087477.1,
WP_023103131.1, WP_023116495.1, WP_023271487.1, WP_023320640.1, WP_023327013.1,
WP_023337013.1, WP_023404025.1, WP_023593281.1, WP_023640696.1, WP_023655988.1,
WP_023981414.1, WP_023982290.1, WP_023982478.1, WP_024033837.1, WP_024107196.1,
XP_001648478.1, XP_502895673.1, XP_003055745.1, XP_003239553.1, XP_003722415.1,
XP_004144180.1, XP_004528092.1, XP_004832109.1, XP_006459595.1, YP_001052930.1,
YP_001163237.1, YP_001176136.1, YP_001209097.1, YP_001367428.1, YP_001400516.1,
YP_001424469.2, YP_001425256.1, YP_001448331.1, YP_001555796.1, YP_001562243.1,
YP_001606219.1, YP_001651266.1, YP_001712945.1, YP_001720393.1, YP_001873018.1,
YP_001906787.1, YP_001933132.1, YP_001968013.1, YP_002155777.1, YP_002304250.1,
YP_002306147.1, YP_002310402.1, YP_002324896.1, YP_002347428.1, YP_002360076.1,
YP_002396880.1, YP_002647859.1, YP_002795072.1, YP_002892562.1, YP_002955558.1,
YP_002986364.1, YP_003003059.1, YP_003041553.1, YP_003225716.1, YP_003260998.1,

TABLE 25-continued

Type I-F cys2 polypeptide accession numbers
(the sequence identifier for each accession number, in the
order provided in Table 25, is SEQ ID NOs: 8615-9867).

YP_003334980.1, YP_003377522.1, YP_003461676.1, YP_003526746.1, YP_003548201.1,
YP_003568286.1, YP_003626195.1, YP_003690840.1, YP_003761949.1, YP_003884500.1,
YP_003896174.1, YP_004069130.1, YP_004112221.1, YP_004228872.1, YP_004314376.1,
YP_004411750.1, YP_004490627.1, YP_004512321.1, YP_004672873.1, YP_004766820.1,
YP_005019133.1, YP_005025972.1, YP_005043015.1, YP_005176268.1, YP_005199869.1,
YP_005222302.1, YP_005223367.1, YP_005229910.1, YP_005274575.1, YP_005362754.1,
YP_005432672.1, YP_005474218.1, YP_005505365.1, YP_005509300.1, YP_005522413.1,
YP_005620893.1, YP_005623563.1, YP_005639255.1, YP_005801629.1, YP_005975200.1,
YP_006119165.1, YP_006218156.1, YP_006239896.1, YP_006284729.1, YP_006286211.1,
YP_006292888.1, YP_006482608.1, YP_006518016.1, YP_006648158.1, YP_006822151.1,
YP_006869473.1, YP_007217572.1, YP_007301291.1, YP_007326545.1, YP_007342966.1,
YP_007821731.1, YP_007826785.1, YP_007935926.1, YP_008091000.1, YP_008118899.1,
YP_008267627.1, YP_008528750.1, YP_008570808.1, YP_008570809.1, YP_008590828.1,
YP_008682385.1, YP_008685344.1, YP_008981898.1, YP_047071.1, YP_051770.1, YP_071019.1,
YP_122342.1, YP_128165.1, YP_162418.2, YP_344732.1, YP_539910.1, YP_539911.1, YP_647989.1,
YP_651873.1, YP_790816.1, YP_851978.1, YP_871478.1, YP_942815.1, YP_963570.1, YP_984813.1,
and/or YP_996235.1

In some embodiments, Type I-F cas7/cys3 polypeptides include, but are not limited to, GenBank accession number as set forth in Table 26.

TABLE 26

Type I-F cas7/cys3 polypeptide accession numbers
(the sequene identifier for each accession number, in the
order provided in Table 26, is SEQ ID NOs: 9868-11057).

AAK02391.1, AAM85294.1, AAO89723.2, AAQ59426.1, AAS62488.1, AAV89308.1, ABA59203.1,
ABE06381.1, ABG13927.1, ABG18388.1, ABJ00265.1, ABJ11604.1, ABK50071.1, ABM03217.1,
ABM25015.1, ABM40736.1, ABM57216.1, ABN73324.1, ABP40263.1, ABP57350.1, ABP60086.1,
ABQ14256.1, ABS09364.1, ABS46029.1, ABS77636.2, ABS78227.1, ABU74105.1, ABX33859.1,
ABX50535.1, ABX78894.1, ABX85185.1, ABY68821.1, ACA67941.1, ACC89560.1, ACD38772.1,
ACE60870.1, ACH66461.1, ACJ19106.1, ACJ21003.1, ACJ27816.1, ACJ42247.1, ACJ57414.1,
ACK48652.1, ACO74064.1, ACQ92977.1, ACS84541.1, ACT05581.1, ACV75131.1, ACX89390.1,
ACY59061.1, ACY62908.1, ACZ78273.1, ADC72941.1, ADE14360.1, ADE65023.1, ADE89794.1,
ADG60303.1, ADH86220.1, ADJ29629.1, ADL13485.1, ADM99942.1, ADN71992.1, ADR26232.1,
ADT68978.1, ADT95522.1, ADU65664.1, ADV98277.1, ADX89041.1, ADX89500.1, ADZ92539.1,
AEC02367.1, AEC18349.1, AEF92271.1, AEF99822.1, AEH62441.1, AEL09138.1, AEL73394.1,
AEO64331.1, AEO75097.1, AET15300.1, AEX04895.1, AEX24996.1, AEX51730.1, AFF23584.1,
AFG36512.1, AFH95466.1, AFI46136.1, AFI86380.1, AFI91856.1, AFJ02200.1, AFM64905.1,
AFN56493.1, AFR04906.1, AFT71807.1, AGA34090.1, AGB12637.1, AGB80782.1, AGG09387.1,
AGG09393.1, AGG31841.1, AGP49333.1, AGQ92516.1, AGU98411.1, AGW13659.1, AGX88281.1,
AHB09919.1, AHC77003.1, AHE63725.1, AHE99152.1, AHF01505.1, AHI99023.1, BAC62732.1,
BAH15059.1, BAH77671.1, BAL82650.1, CAE14088.1, CAG69250.1, CAG76581.1, CAH17085.1,
CAH17367.1, CAH21744.1, CAL21091.1, CAM85943.1, CAO95890.1, CAP75355.1, CAQ84809.1,
CAR02245.1, CAR07058.1, CAX54610.1, CAY73259.1, CBA17529.1, CBA76127.1, CBV40990.1,
CBX29757.1, CBX29758.1, CCC73992.1, CCG18725.1, CCG19558.1, CCG88215.1, CCH40238.1,
CCJ84616.1, CCO00436.1, CCO24443.1, CCQ87262.1, CCZ55218.1, CDD80273.1, CDF05510.1,
CDG79717.1, CDH64396.1, EAQ67602.1, EAS64065.1, EAS76233.1, EAT04044.1, EAT59335.1,
EAX33533.1, EAZ52874.1, EAZ58297.1, EDK28163.1, EDM42115.1, EDM61485.1, EDM65938.1,
EDM65955.1, EDQ01681.1, EDR31163.1, EDR37799.1, EDR44804.1, EDR55774.1, EDR63809.1,
EDU58858.1, EDV62095.1, EDZ66531.1, EEC00793.1, EED26506.1, EEH84599.1, EEO29371.1,
EEO76099.1, EEO80176.1, EEO84408.1, EEO89850.1, EEP92233.1, EEQ03934.1, EEQ60552.1,
EEV21617.1, EEV21943.1, EEW05503.1, EEW96607.1, EEX04035.1, EEX50302.1, EEX68261.1,
EEY43700.1, EEY90279.1, EEZ00497.1, EFA49551.1, EFA49552.1, EFC58009.1, EFC99289.1,
EFI23594.1, EFI34393.1, EFL78323.1, EFL79686.1, EFM01119.1, EFM53865.1, EFM86279.1,
EFM88412.1, EFM90570.1, EFM92757.1, EFM95003.1, EFM97157.1, EFM99346.1, EFN01382.1,
EFN03540.1, EFO35311.1, EFO41813.1, EFO50039.1, EFO58226.1, EFP04516.1, EFQ88867.1,
EFU46688.1, EFV45901.1, EFX91404.1, EGB49274.1, EGB53898.1, EGB79045.1, EGC70202.1,
EGE11096.1, EGE12103.1, EGE12618.1, EGE14943.1, EGE19076.1, EGE19368.1, EGE21988.1,
EGE24485.1, EGE25420.1, EGE27753.1, EGF40127.1, EGH81486.1, EGJ07915.1, EGJ59630.1,
EGJ63889.1, EGM77972.1, EGP02204.1, EGP02205.1, EGP02206.1, EGP02209.1, EGP02618.1,
EGS63959.1, EGW44656.1, EGW90823.1, EGY35786.1, EGY38131.1, EGY39145.1, EGY39146.1,
EGY41120.1, EGY70945.1, EHF03401.1, EHG01974.1, EHJ94021.1, EHK62471.1, EHL67983.1,
EHM40144.1, EHM48027.1, EHN98431.1, EHO30911.1, EIA37121.1, EIC20986.1, EIC29313.1,
EIE47038.1, EIF44411.1, EIK45281.1, EIL54442.1, EIL76431.1, EIL89115.1, EIQ87530.1, EIQ88766.1,
EIQ89493.1, EIR01142.1, EIR02486.1, EIR05624.1, EIR16494.1, EIR17420.1, EIR19478.1, EIR31005.1,
EIR32504.1, EIR33321.1, EIR45350.1, EIR46431.1, EIR47970.1, EIR59144.1, EIR59980.1, EIR64113.1,
EIR73545.1, EIR75599.1, EIR76604.1, EIR87354.1, EIR89807.1, EIR91674.1, EIS03545.1, EIS03931.1,
EIS05047.1, EIS16929.1, EIS17794.1, EIS23397.1, EIS28671.1, EIS31266.1, EIS40838.1, EIS42728.1,
EIS44209.1, EIS55612.1, EIS56042.1, EIS60019.1, EIS66595.1, EIS73042.1, EIS76074.1, EIS78310.1,
EIS86652.1, EIS90396.1, EIS94484.1, EIS98160.1, EIT05327.1, EIT13605.1, EIT14715.1, EIT15446.1,

TABLE 26-continued

Type I-F cas7/cys3 polypeptide accession numbers
(the sequene identifier for each accession number, in the
order provided in Table 26, is SEQ ID NOs: 9868-11057).

EIT26175.1, EIT29051.1, EIT30489.1, EIT44651.1, EIT45184.1, EIT55053.1, EIT56867.1, EIT62390.1,
EIY36378.1, EJG24061.1, EJH60545.1, EJI84872.1, EJO38756.1, EJP50279.1, EJS85446.1,
EJS90160.1, EJS91479.1, EJS91480.1, EJS92991.1, EJZ79577.1, EJZ80877.1, EKA43934.1,
EKA54577.1, EKA74310.1, EKA81282.1, EKA84798.1, EKA91161.1, EKF84296.1, EKG52542.1,
EKG57737.1, EKG62913.1, EKG63403.1, EKG72468.1, EKG93025.1, EKK08296.1, EKK18171.1,
EKK94025.1, EKL08415.1, EKL14870.1, EKL16053.1, EKL22307.1, EKL39311.1, EKL48987.1,
EKL93519.1, EKM01141.1, EKM08463.1, EKP50107.1, EKP55006.1, EKP56619.1, EKS45297.1,
EKT62225.1, EKU52223.1, EKX95268.1, ELC02441.1, ELC12195.1, ELC21172.1, ELC30644.1,
ELC31987.1, ELD54445.1, ELD92478.1, ELE14001.1, ELE25615.1, ELE34551.1, ELE51940.1,
ELE82363.1, ELE93038.1, ELF40644.1, ELF68856.1, ELF84513.1, ELF93400.1, ELF98795.1,
ELG17254.1, ELG28218.1, ELG56202.1, ELG59755.1, ELH17523.1, ELH33235.1, ELH65837.1,
ELH83716.1, ELH95196.1, ELH95743.1, ELI27978.1, ELI75036.1, ELI90643.1, ELJ31993.1,
ELJ44083.1, ELJ56853.1, ELJ58415.1, ELJ73180.1, ELQ35557.1, ELQ65711.1, ELT18757.1,
ELT56868.1, ELU49892.1, ELX04705.1, ELY22222.1, EME59648.1, EMI19653.1, EMP51885.1,
EMT98185.1, EMT98702.1, EMU01026.1, EMU03117.1, EMU03919.1, EMU06894.1, EMU15104.1,
EMU33766.1, EMV25764.1, EMV41479.1, EMV48351.1, EMV61753.1, EMV77003.1, EMV77662.1,
EMV79456.1, EMW06847.1, EMW07146.1, EMW11060.1, EMW22774.1, EMW28014.1, EMW63401.1,
EMX55467.1, EMX95472.1, EMZ59016.1, EMZ70953.1, ENA68770.1, ENA70833.1, ENO94848.1,
ENU20825.1, ENU25386.1, ENU26368.1, ENU30660.1, ENU36863.1, ENU64163.1, ENU64517.1,
ENU68405.1, ENU79932.1, ENU84694.1, ENU84993.1, ENU90130.1, ENU94393.1, ENU94467.1,
ENV06536.1, ENV11503.1, ENV23284.1, ENV26810.1, ENV33518.1, ENV38702.1, ENV43128.1,
ENV52233.1, ENV54187.1, ENV60436.1, ENV66341.1, ENV79712.1, ENV88482.1, ENV99922.1,
ENW17836.1, ENW36549.1, ENW39482.1, ENW64165.1, ENW68333.1, ENW74529.1, ENW78804.1,
ENW99798.1, ENX46543.1, ENZ96950.1, EOD78079.1, EOQ57498.1, EOR06425.1, EOT14079.1,
EOT16831.1, EOU37595.1, EOU39901.1, EOU65600.1, EOU82025.1, EOU82328.1, EOV51402.1,
EOV89560.1, EOV96442.1, EOW37721.1, EOW66750.1, EOX15985.1, EOX25498.1, EPC00312.1,
EPC10333.1, EPD43984.1, EPE63816.1, EPE65660.1, EPE66429.1, EPE67791.1, EPE69700.1,
EPE71678.1, EPE74058.1, EPH62428.1, EPH95380.1, EPM42540.1, EPP24159.1, EPR80939.1,
EPR81195.1, EPR88383.1, EPS74966.1, EQL85637.1, EQL89639.1, EQL91069.1, EQM00497.1,
EQM01689.1, EQM08160.1, EQM16133.1, EQM46390.1, EQM86551.1, EQN06271.1, EQN09578.1,
EQN21676.1, EQN32968.1, EQN72754.1, EQN87315.1, EQO22618.1, EQO25950.1, EQO34070.1,
EQO52284.1, EQO63920.1, EQO87247.1, EQP27533.1, EQP52731.1, EQP62839.1, EQP80766.1,
EQP80767.1, EQQ42459.1, EQQ52933.1, EQR25827.1, EQR43475.1, EQR49986.1, EQR54855.1,
EQR90838.1, EQT05352.1, EQT30876.1, EQT84177.1, EQT86455.1, EQU02186.1, EQU15317.1,
EQU15700.1, EQU26656.1, EQU37329.1, EQU74185.1, EQU96775.1, EQV16500.1, EQV39102.1,
EQV73993.1, EQW35605.1, EQW74765.1, EQW95167.1, EQW95168.1, EQX30757.1, EQX30758.1,
EQY04011.1, EQY05740.1, EQY46991.1, EQY47417.1, EQZ21536.1, EQZ57877.1, EQZ59931.1,
EQZ81919.1, ERA24942.1, ERA25709.1, ERA94142.1, ERB37233.1, ERF78262.1, ERG09343.1,
ERG16855.1, ERG53585.1, ERG59563.1, ERH66545.1, ERL42548.1, ERO62444.1, ERP69293.1,
ERP72008.1, ERP72730.1, ERP73549.1, ERP82384.1, ERT12422.1, ERT61725.1, ERU80869.1,
ERU82773.1, ERU95634.1, ERV23077.1, ERV32403.1, ERV45936.1, ERV90881.1, ERV92838.1,
ERW05283.1, ERW22630.1, ERW25387.1, ERW30731.1, ERW52656.1, ERW66574.1, ERW85639.1,
ERW96790.1, ERX11462.1, ERX57183.1, ERX57290.1, ERX68375.1, ERX76657.1, ERY56083.1,
ERY93179.1, ERY99965.1, ERZ00043.1, ERZ29312.1, ERZ42445.1, ESD40181.1, ESE13075.1,
ESK35634.1, ESK57657.1, ESM77261.1, ESM81558.1, ESN04283.1, ESN26375.1, ESN28525.1,
ESN61386.1, ESP24738.1, ESP31910.1, ESP34909.1, ESQ71760.1, ESQ71808.1, EST01750.1,
ESV68076.1, ESW43323.1, ETD57409.1, ETF26483.1, ETJ46808.1, ETJ93022.1, ETQ64188.1,
ETR05217.1, ETR05670.1, ETR14605.1, ETR82058.1, ETR84941.1, ETS22725.1, ETT12869.1,
ETT14316.1, ETT20302.1, ETU83910.1, ETU88440.1, ETV19932.1, ETV43749.1, ETV55559.1,
ETX25633.1, ETX51000.1, ETX59131.1, ETX79026.1, ETY36823.1, ETY51221.1, ERY93941.1,
EUC25473.1, EUD17217.1, EUM12625.1, EVT81599.1, EVT85801.1, EVU15055.1, EWM39345.1,
EWS67917.1, GAA59874.1, GAA60409.1, GAA60410.1, GAA75157.1, GAA77963.1, GAA79128.1,
GAB76060.1, GAC09610.1, GAC15830.1, GAC19765.1, GAC34443.1, GAD77038.1, GAE10392.1,
NP_245244.1, NP_669043.1, NP_800899.1, NP_819209.2, NP_901422.1, NP_929073.1, NP_993611.1,
Q02MM1.1, WP_000151791.1, WP_000151792.1, WP_000151793.1, WP_000151794.1,
WP_000151795.1, WP_000417845.1, WP_000417846.1, WP_000417847.1, WP_000772598.1,
WP_000775488.1, WP_001029748.1, WP_001029749.1, WP_001029750.1, WP_001029751.1,
WP_001029752.1, WP_001029753.1, WP_001029754.1, WP_001029755.1, WP_001029756.1,
WP_001097003.1, WP_001097004.1, WP_001097005.1, WP_001107519.1, WP_001107520.1,
WP_001516091.1, WP_001707909.1, WP_001713253.1, WP_001714018.1, WP_001765856.1,
WP_002009837.1, WP_002126253.1, WP_002211867.1, WP_002232603.1, WP_002232605.1,
WP_002540929.1, WP_002802604.1, WP_002814020.1, WP_002923965.1, WP_003116112.1,
WP_003116909.1, WP_003124164.1, WP_003139222.1, WP_003143949.1, WP_003147063.1,
WP_003162919.1, WP_003170696.1, WP_003205164.1, WP_003219312.1, WP_003464683.1,
WP_003662184.1, WP_003664175.1, WP_003666005.1, WP_004089530.1, WP_004240703.1,
WP_004279690.1, WP_004343805.1, WP_004349920.1, WP_004389637.1, WP_004461135.1,
WP_004651373.1, WP_004652096.1, WP_004662984.1, WP_004670427.1, WP_004681362.1,
WP_004713758.1, WP_004728796.1, WP_004736107.1, WP_004752517.1, WP_004758707.1,
WP_004770612.1, WP_004798550.1, WP_004801336.1, WP_004828408.1, WP_004863333.1,
WP_004877064.1, WP_004895761.1, WP_004907044.1, WP_004918643.1, WP_004928488.1,
WP_004948469.1, WP_004963257.1, WP_004998562.1, WP_005003494.1, WP_005024344.1,
WP_005026493.1, WP_005048557.1, WP_005081863.1, WP_005163430.1, WP_005217651.1,
WP_005233404.1, WP_005370440.1, WP_005371075.1, WP_005378541.1, WP_005463133.1,
WP_005473079.1, WP_005478111.1, WP_005497848.1, WP_005499650.1, WP_005535622.1,
WP_005540021.1, WP_005562563.1, WP_005562565.1, WP_005596014.1, WP_005603465.1,
WP_005614485.1, WP_005616687.1, WP_005623509.1, WP_005721281.1, WP_005721282.1,

TABLE 26-continued

Type I-F cas7/cys3 polypeptide accession numbers
(the sequene identifier for each accession number, in the
order provided in Table 26, is SEQ ID NOs: 9868-11057).

WP_005721283.1, WP_005721285.1, WP_005725809.1, WP_005741648.1, WP_005751237.1,
WP_005753654.1, WP_005756149.1, WP_005764758.1, WP_005769532.1, WP_005807198.1,
WP_005815993.1, WP_005842410.1, WP_005879777.1, WP_005974981.1, WP_006033287.1,
WP_006033304.1, WP_006174407.1, WP_006187497.1, WP_006365991.1, WP_006773009.1,
WP_006790333.1, WP_006950320.1, WP_007069540.1, WP_007106208.1, WP_007111957.1,
WP_007117097.1, WP_007293315.1, WP_007620983.1, WP_007641670.1, WP_007749069.1,
WP_007986850.1, WP_008129242.1, WP_008133921.1, WP_008135466.1, WP_008168508.1,
WP_008169477.1, WP_008169478.1, WP_008215112.1, WP_008220723.1, WP_008247107.1,
WP_008608779.1, WP_008698007.1, WP_008723395.1, WP_008816754.1, WP_008845635.1,
WP_008869719.1, WP_008898787.1, WP_008911671.1, WP_009095260.1, WP_009151389.1,
WP_009174234.1, WP_009286532.1, WP_009368459.1, WP_009514887.1, WP_009832549.1,
WP_009875012.1, WP_009876499.1, WP_010106217.1, WP_010201100.1, WP_010279277.1,
WP_010295115.1, WP_010318157.1, WP_010364308.1, WP_010388192.1, WP_010554119.1,
WP_010559724.1, WP_010606801.1, WP_010906579.1, WP_010957412.1, WP_011095183.1,
WP_011135304.1, WP_011146072.1, WP_011192624.1, WP_011212638.1, WP_011216756.1,
WP_011240576.1, WP_011718587.1, WP_011769777.1, WP_011789482.1, WP_011803945.1,
WP_011809223.1, WP_011927919.1, WP_011996912.1, WP_011997340.1, WP_012016805.1,
WP_012089883.1, WP_012129695.1, WP_012197492.1, WP_012203145.1, WP_012220114.1,
WP_012262738.1, WP_012440592.1, WP_012533744.1, WP_012570450.1, WP_012570904.1,
WP_012588884.1, WP_012667185.1, WP_012696554.1, WP_012729576.1, WP_012764360.1,
WP_012768461.1, WP_012886075.1, WP_012917522.1, WP_012983813.1, WP_013032251.1,
WP_013107621.1, WP_013163747.1, WP_013221694.1, WP_013278930.1, WP_013319365.1,
WP_013330865.1, WP_013465400.1, WP_013505550.1, WP_013662441.1, WP_013739762.1,
WP_013747105.1, WP_013804304.1, WP_013818082.1, WP_014016719.1, WP_014228625.1,
WP_014234832.1, WP_014325846.1, WP_014390885.1, WP_014424087.1, WP_014454509.1,
WP_014500606.1, WP_014509417.1, WP_014701305.1, WP_014703620.1, WP_014848624.1,
WP_014916579.1, WP_014995868.1, WP_015259206.1, WP_015337043.1, WP_015422842.1,
WP_015551638.1, WP_015555713.1, WP_015670637.1, WP_015696922.1, WP_015731169.1,
WP_015834852.1, WP_015862796.1, WP_016158983.1, WP_016164444.1, WP_016237814.1,
WP_016242618.1, WP_016248536.1, WP_016380980.1, WP_016418864.1, WP_016451881.1,
WP_016533252.1, WP_016533500.1, WP_016534562.1, WP_016583645.1, WP_016584211.1,
WP_016620011.1, WP_016785736.1, WP_016795644.1, WP_017004727.1, WP_017019124.1,
WP_017026498.1, WP_017031014.1, WP_017045321.1, WP_017049066.1, WP_017058954.1,
WP_017064053.1, WP_017066107.1, WP_017089407.1, WP_017098523.1, WP_017101567.1,
WP_017108318.1, WP_017216064.1, WP_017253163.1, WP_017395755.1, WP_017448231.1,
WP_017631278.1, WP_017788585.1, WP_017791148.1, WP_018025759.1, WP_018122275.1,
WP_018125461.1, WP_018176612.1, WP_018298697.1, WP_018346686.1, WP_018347334.1,
WP_018414918.1, WP_018676854.1, WP_018719047.1, WP_018871530.1, WP_019001599.1,
WP_019018099.1, WP_019022906.1, WP_019251101.1, WP_019283233.1, WP_019520401.1,
WP_019543111.1, WP_019671930.1, WP_019820371.1, WP_019843464.1, WP_019895600.1,
WP_019935462.1, WP_019951125.1, WP_019959486.1, WP_020161985.1, WP_020328489.1,
WP_020332816.1, WP_020389180.1, WP_020393389.1, WP_020443858.1, WP_020527196.1,
WP_020680650.1, WP_020841381.1, WP_020911194.1, WP_021017053.1, WP_021325940.1,
WP_021461781.1, WP_021511406.1, WP_021525891.1, WP_021525892.1, WP_021531160.1,
WP_021575785.1, WP_021710781.1, WP_021760542.1, WP_022027305.1, WP_022381643.1,
WP_022498161.1, WP_022642203.1, WP_022654591.1, WP_022761971.1, WP_022775599.1,
WP_022850859.1, WP_022940477.1, WP_023000930.1, WP_023045108.1, WP_023053015.1,
WP_023116494.1, WP_023122498.1, WP_023131487.1, WP_023271488.1, WP_023320641.1,
WP_023327014.1, WP_023337014.1, WP_023593280.1, WP_023640695.1, WP_023655987.1,
WP_023982477.1, WP_024033838.1, WP_024107195.1, XP_001007303.1, XP_002402345.1,
XP_003087158.1, XP_003303032.1, XP_003494537.1, XP_003650667.1, XP_004404055.1,
XP_004528091.1, XP_005602236.1, XP_005602237.1, XP_005637873.1, XP_720614.1, XP_720742.1,
YP_001052929.1, YP_001163236.1, YP_001176137.1, YP_001209098.1, YP_001367427.1,
YP_001400517.1, YP_001424470.1, YP_001425257.2, YP_001448332.1, YP_001555795.1,
YP_001562244.1, YP_001596128.1, YP_001606218.1, YP_001651265.1, YP_001712946.1,
YP_001720394.1, YP_001873017.1, YP_001906788.1, YP_001968012.1, YP_002155776.1,
YP_002304251.1, YP_002306148.1, YP_002310403.1, YP_002320236.1, YP_002324897.1,
YP_002347427.1, YP_002360075.1, YP_002390703.1, YP_002396881.1, YP_002555750.1,
YP_002647860.1, YP_002795073.1, YP_002892563.1, YP_002955557.1, YP_002986363.1,
YP_003003060.1, YP_003041552.1, YP_003225715.1, YP_003260997.1, YP_003334979.1,
YP_003377523.1, YP_003461677.1, YP_003526747.1, YP_003568285.1, YP_003626196.1,
YP_003690839.1, YP_003761950.1, YP_003828550.1, YP_003884499.1, YP_003896175.1,
YP_004069129.1, YP_004112220.1, YP_004314375.1, YP_004411749.1, YP_004421246.1,
YP_004490626.1, YP_004512322.1, YP_004766819.1, YP_005019134.1, YP_005025971.1,
YP_005176269.1, YP_005199870.1, YP_005274574.1, YP_005362755.1, YP_005432673.1,
YP_005474219.1, YP_005505364.1, YP_005509301.1, YP_005522414.1, YP_005620892.1,
YP_005623564.1, YP_005639256.1, YP_005801630.1, YP_005975199.1, YP_006100125.1,
YP_006111504.1, YP_006119166.1, YP_006218157.1, YP_006239895.1, YP_006284728.1,
YP_006286212.1, YP_006292887.1, YP_006482607.1, YP_006518015.1, YP_006648159.1,
YP_006822150.1, YP_007217571.1, YP_007301292.1, YP_007326544.1, YP_007342967.1,
YP_007506214.1, YP_007821730.1, YP_007826784.1, YP_008163695.1, YP_008267628.1,
YP_008528749.1, YP_008570810.1, YP_008590829.1, YP_008682384.1, YP_008685343.1,
YP_008981897.1, YP_047072.1, YP_051771.1, YP_071018.1, YP_122341.1, YP_128166.1,
YP_162419.1, YP_344733.1, YP_539912.1, YP_647988.1, YP_651872.1, YP_790815.1, YP_851979.1,
YP_871477.1, YP_942816.1, YP_963569.1, YP_984812.1, and/or YP_996234.1

In some embodiments, Type I-F cas6f/cys4 polypeptides include, but are not limited to, GenBank accession number as set forth in Table 27.

TABLE 27

Type I-F cas6f/cys4 polypeptide accession numbers
(the sequene identifier for each accession number, in the
order provided in Table 27, is SEQ ID NOs: 11058-11528).

AAV89309.2, ABA59204.1, ABG13926.1, ABG18387.1, ABK50070.1, ABM03218.1, ABM25014.1,
ABM40735.1, ABM57215.1, ABP40262.1, ABP60087.1, ABP75546.1, ABQ13095.1, ABR71599.1,
ABS09363.1, ABS47360.1, ABX33860.1, ABX50534.1, ABX78249.1, ABX85582.1, ACA67942.1,
ACC89559.1, ACH66931.1, ACJ42246.1, ACJ58934.1, ACO74066.1, ACQ92978.1, ACS84540.1,
ACT05582.1, ACV75130.1, ACX89389.1, ACZ78272.1, ADC72942.1, ADE14361.1, ADE90298.1,
ADG60304.1, ADH86219.1, ADJ29630.1, ADT95521.1, ADU65663.1, ADV54188.1, ADV54624.1,
ADZ92538.1, AEC02366.1, AEF92270.1, AEF99823.1, AEL09139.1, AET15301.1, AEX51731.1,
AFF23585.1, AFG36513.1, AFH95467.1, AFI85399.1, AFI86381.1, AFI91855.1, AFJ02199.1,
AFN56492.1, AGA34089.1, AGB80783.1, AGG09388.1, AGG09394.1, AGG31840.1, AGQ92517.1,
AGW13660.1, AGX88280.1, AHB09918.1, AHC77002.1, AHE63726.1, AHE99151.1, AHF01504.1,
BAL82651.1, CAX54611.1, CAY73260.1, CBA17530.1, CCG88214.1, CCZ55217.1, CDD80274.1,
CDF05509.1, CDK64174.1, EAX33519.1, EDR31157.1, EDR35337.1, EDR37855.1, EDR44978.1,
EDR48741.1, EDR55755.1, EDR59630.1, EDR63807.1, EDU58859.1, EDV62090.1, EDZ65577.1,
EED26517.1, EEH84598.1, EEO29370.1, EEO29468.1, EEP92234.1, EEQ03935.1, EEQ19215.1,
EEV21944.1, EEW05504.1, EEW96606.1, EEX04034.1, EEX50301.1, EEX68262.1, EEY90278.1,
EFA49553.1, EFC58010.1, EFI23595.1, EFI34394.1, EFM86278.1, EFM88411.1, EFM90569.1,
EFM92756.1, EFM95002.1, EFM97156.1, EFM99345.1, EFN01381.1, EFN03539.1, EFO35488.1,
EFO42030.1, EFO49970.1, EFO58225.1, EFU46687.1, EGB79044.1, EGE11097.1, EGE12104.1,
EGE12617.1, EGE14944.1, EGE19075.1, EGE19367.1, EGE21987.1, EGE24484.1, EGE25419.1,
EGE27754.1, EGJ07914.1, EGJ59629.1, EGJ63890.1, EGM77971.1, EGS63960.1, EGY35787.1,
EGY38132.1, EGY39144.1, EGY41119.1, EGY70944.1, EHC04317.1, EHK62472.1, EHM40145.1,
EHM48026.1, EHN98432.1, EIC20987.1, EIC29314.1, EIF44412.1, EIK45280.1, EIL89116.1,
EJS92990.1, EKD42112.1, EKE17714.1, EKF84297.1, EKG52543.1, EKG57738.1, EKG62914.1,
EKG63404.1, EKG72469.1, EKG93026.1, EKT62224.1, EKX95267.1, ELT18758.1, ELY20635.1,
ELY22223.1, EMP51884.1, ENO94847.1, ENZ96949.1, EPC10332.1, EPE63815.1, EPE65659.1,
EPE67792.1, EPE71679.1, EPP24160.1, EPR80940.1, EPR81194.1, EPR88384.1, EQM86550.1,
ERG09342.1, ERG16856.1, ERG53584.1, ERG59562.1, ERH66544.1, ERP69294.1, ERP72007.1,
ERP72729.1, ERP73548.1, ERP82383.1, ESD40180.1, ESE13074.1, ESN61387.1, ESQ71759.1,
EST01749.1, ETJ46809.1, EVT85800.1, GAA75158.1, GAA77964.1, GAB76059.1, GAC09611.1,
GAC15829.1, GAC19764.1, GAC34444.1, NP_819208.1, Q02MM2.2, Q1RE32.1, WP_000083148.1,
WP_000083149.1, WP_000339854.1, WP_000340321.1, WP_000340322.1, WP_000350178.1,
WP_000350179.1, WP_000350182.1, WP_000350183.1, WP_000350184.1, WP_000378966.1,
WP_001104789.1, WP_001104791.1, WP_001110391.1, WP_001909069.1, WP_001982952.1,
WP_001986296.1, WP_002211866.1, WP_002802602.1, WP_002812325.1, WP_002923958.1,
WP_003116908.1, WP_003139220.1, WP_003143948.1, WP_003162920.1, WP_003464685.1,
WP_003662182.1, WP_003664177.1, WP_003666007.1, WP_003667345.1, WP_003670070.1,
WP_003670773.1, WP_003672250.1, WP_004089527.1, WP_004240702.1, WP_004279689.1,
WP_004343806.1, WP_004349921.1, WP_004389638.1, WP_004395176.1, WP_004681361.1,
WP_004713760.1, WP_004904259.1, WP_004918644.1, WP_004928490.1, WP_005026497.1,
WP_005186672.1, WP_005378540.1, WP_005473100.1, WP_005478386.1, WP_005497846.1,
WP_005499652.1, WP_005511272.1, WP_005540019.1, WP_005562562.1, WP_005565379.1,
WP_005596012.1, WP_005600275.1, WP_005606939.1, WP_005611343.1, WP_005614481.1,
WP_005616685.1, WP_005725810.1, WP_005728799.1, WP_005753657.1, WP_005764757.1,
WP_005769530.1, WP_005842411.1, WP_005974979.1, WP_006087140.1, WP_006174409.1,
WP_006790334.1, WP_007069539.1, WP_007106209.1, WP_007117098.1, WP_007293316.1,
WP_007620981.1, WP_007641668.1, WP_007986852.1, WP_008129244.1, WP_008133922.1,
WP_008135468.1, WP_008169475.1, WP_008215113.1, WP_008247108.1, WP_008608778.1,
WP_008845634.1, WP_008869720.1, WP_008898786.1, WP_008911670.1, WP_009095262.1,
WP_009174235.1, WP_009286533.1, WP_009288124.1, WP_009355633.1, WP_009832548.1,
WP_009838678.1, WP_009875013.1, WP_009876500.1, WP_010106216.1, WP_010279279.1,
WP_010295117.1, WP_010318156.1, WP_010364306.1, WP_010554110.1, WP_010559725.1,
WP_010588736.1, WP_010606802.1, WP_010906580.1, WP_011095184.1, WP_011146073.1,
WP_011212637.1, WP_011216757.1, WP_011221971.1, WP_011240577.1, WP_011703507.1,
WP_011718586.1, WP_011769778.1, WP_011789481.1, WP_011803944.1, WP_011809222.1,
WP_011919227.1, WP_011997341.1, WP_012016806.1, WP_012070375.1, WP_012089882.1,
WP_012197491.1, WP_012203146.1, WP_012220113.1, WP_012262737.1, WP_012440593.1,
WP_012534077.1, WP_012570451.1, WP_012601378.1, WP_012667186.1, WP_012696556.1,
WP_012729577.1, WP_012764359.1, WP_012768462.1, WP_012817197.1, WP_012886074.1,
WP_012917523.1, WP_012983814.1, WP_013032252.1, WP_013101298.1, WP_013107622.1,
WP_013163746.1, WP_013221695.1, WP_013319364.1, WP_013505549.1, WP_013622440.1,
WP_013739761.1, WP_013804303.1, WP_013818083.1, WP_014228626.1, WP_014325847.1,
WP_014390886.1, WP_014424088.1, WP_014509418.1, WP_014610405.1, WP_014701304.1,
WP_014703619.1, WP_014707760.1, WP_014848623.1, WP_014916580.1, WP_014995867.1,
WP_015259205.1, WP_015670638.1, WP_015696923.1, WP_015834851.1, WP_016504383.1,
WP_016785735.1, WP_017045322.1, WP_017066108.1, WP_017098524.1, WP_017108319.1,
WP_017216063.1, WP_017395756.1, WP_017448232.1, WP_017631031.1, WP_017791147.1,
WP_017926913.1, WP_019820369.1, WP_019843465.1, WP_020328490.1, WP_020841382.1,
WP_021017054.1, WP_021760543.1, WP_022027304.1, WP_022381644.1, WP_022498160.1,
WP_022654592.1, WP_022775596.1, WP_022940478.1, WP_022943263.1, WP_023593279.1,
WP_023640694.1, WP_023655986.1, WP_024107194.1, YP_001176138.1, YP_001183345.1,
YP_001209099.1, YP_001341534.1, YP_001367426.1, YP_001400518.1, YP_001555794.1,

TABLE 27-continued

Type I-F cas6f/cys4 polypeptide accession numbers
(the sequene identifier for each accession number, in the
order provided in Table 27, is SEQ ID NOs: 11058-11528).

YP_001562245.1, YP_001596127.1, YP_001720395.1, YP_001873016.1, YP_002155775.1,
YP_002320235.1, YP_002324898.1, YP_002647861.1, YP_002795075.1, YP_002892564.1,
YP_002986362.1, YP_003003061.1, YP_003225714.1, YP_003260996.1, YP_003334978.1,
YP_003377524.1, YP_003461678.1, YP_003526748.1, YP_003626197.1, YP_003690838.1,
YP_003761951.1, YP_004112219.1, YP_004314374.1, YP_004411748.1, YP_004490625.1,
YP_004512323.1, YP_005176270.1, YP_005199871.1, YP_005274573.1, YP_005362756.1,
YP_005432674.1, YP_005474220.1, YP_005639257.1, YP_005801631.1, YP_006009654.1,
YP_006010090.1, YP_006100126.1, YP_006218158.1, YP_006284727.1, YP_006286213.1,
YP_006292886.1, YP_006297044.1, YP_006518014.1, YP_007217570.1, YP_007342968.1,
YP_007506213.1, YP_008267629.1, YP_008590830.1, YP_008682383.1, YP_008981896.1,
YP_162420.2, YP_871476.1, YP_942817.1, YP_963568.1, YP_984811.1, and/or YP_996233.1

In some embodiments, Cas3 polypeptides include, but are not limited to, GenBank accession number as set forth in Table 28.

TABLE 28

Cas3 polypeptide accession numbers
(the sequene identifier for each accession number, in the
order provided in Table 28, is SEQ ID NOs: 11529-15493).

A82872, AAB89382.1, AAB91160.1, AAB98365.1, AAB98371.1, AAF30996.1, AAK41637.1,
AAK41673.1, AAK42189.1, AAL62539.1, AAL62627.1, AAL80764.1, AAM25779.1, AAM38679.1,
AAM72368.1, AAM73189.1, AAN50388.1, AAO35720.1, AAO36022.1, AAO58899.1, AAO66983.1,
AAR38876.1, AAS69549.1, AAS82462.1, AAS94335.1, AAU37598.1, AAU92783.1, AAV44424.1,
AAW74126.1, AAZ55629.1, AAZ72010.1, ABB14293.1, ABB24155.1, ABB31304.1, ABC18828.1,
ABC21145.1, ABC21629.1, ABC29591.1, ABC56823.1, ABC57331.1, ABD09411.1, ABD12698.1,
ABE48871.1, ABE96084.1, ABF44063.1, ABF44542.1, ABF89301.1, ABF91789.1, ABI67810.1,
ABI69806.1, ABJ76899.1, ABJ78235.1, ABK14431.1, ABK62334.1, ABL65464.1, ABL78751.1,
ABM29989.1, ABM34513.1, ABM80911.1, ABN07021.1, ABN53501.1, ABN54399.1, ABN69437.1,
ABO35078.1, ABO49083.1, ABO49537.1, ABP50708.1, ABP65963.1, ABP67974.2, ABP81368.1,
ABP86511.1, ABP95302.1, ABQ31016.1, ABQ47098.1, ABQ86071.1, ABQ90257.1, ABQ92673.1,
ABR47839.1, ABR48352.1, ABR54142.1, ABR56647.1, ABR74644.1, ABS22296.1, ABS51173.1,
ABS60790.1, ABU57118.1, ABU59352.1, ABU82314.1, ABV32773.1, ABV97856.1, ABW02349.1,
ABW28853.1, ABX07707.1, ABX27539.1, ABX32566.1, ABY33324.1, ABY36148.1, ABY93583.1,
ABY93798.1, ABZ82800.1, ABZ83124.1, ACA32869.1, ACA59801.1, ACA99760.1, ACB07189.1,
ACB33430.1, ACB39929.1, ACB40064.1, ACB59634.1, ACD60965.1, ACD66307.1, ACD96194.1,
ACE05063.1, ACF14187.1, ACF46440.1, ACG72014.1, ACH93761.1, ACH95048.1, ACI18894.1,
ACI19282.1, ACI20256.1, ACI20900.1, ACI50224.1, ACI51404.1, ACJ33147.1, ACJ76379.1,
ACK41909.1, ACK54968.1, ACL06606.1, ACL08914.1, ACL16920.1, ACL21948.1, ACL23508.1,
ACL24095.1, ACL48829.1, ACL62641.1, ACL64132.1, ACL75830.1, ACM04933.1, ACM51518.1,
ACM54572.1, ACM59283.1, ACN13666.1, ACN98177.1, ACN98263.1, ACO31905.1, ACO79326.1,
ACP34798.1, ACP37661.1, ACP37698.1, ACP45052.1, ACP49134.1, ACP54857.1, ACP54894.1,
ACQ71889.1, ACR11665.1, ACR41524.1, ACR76228.1, ACS24734.1, ACS33796.1, ACS39432.1,
ACS90541.1, ACS96757.1, ACT04375.1, ACT05791.1, ACT17308.1, ACU96431.1, ACV03335.1,
ACV25237.1, ACV25244.1, ACV35540.1, ACV36635.1, ACV38704.1, ACV48941.1, ACV50950.1,
ACV55943.1, ACV64361.1, ACV64476.1, ACV64955.1, ACV76424.1, ACX52110.1, ACX82534.1,
ACX92460.1, ACX95672.1, ACY48525.1, ACY96527.1, ACY97073.1, ACY98231.1, ACZ11932.1,
ACZ43323.1, ADB10235.1, ADB41980.1, ADB47144.1, ADB86651.1, ADC46647.1, ADC66005.1,
ADC69847.1, ADC69854.1, ADC74615.1, ADC88654.1, ADE02249.1, ADE15049.1, ADE56275.1,
ADE85052.1, ADG07363.1, ADG07374.1, ADG13847.1, ADG24312.1, ADG71322.1, ADG82739.1,
ADG83328.1, ADG88252.1, ADG91073.1, ADG94443.1, ADH59811.1, ADH61862.1, ADH65197.1,
ADH65311.1, ADH89239.1, ADH93443.1, ADI02109.1, ADI02511.1, ADI14777.1, ADI26432.1,
ADI36187.1, ADJ47561.1, ADJ54311.1, ADK80202.1, ADL06865.1, ADL41489.1, ADL43516.1,
ADL50598.1, ADL52044.1, ADL70071.1, ADL70152.1, ADM08199.1, ADM09596.1, ADM11310.1,
ADN01349.1, ADN51064.1, ADN55919.1, ADO45627.1, ADP38751.1, ADP70484.1, ADP74265.1,
ADP76108.1, ADP88371.1, ADQ02874.1, ADQ03682.1, ADQ08185.1, ADQ14921.1, ADQ41855.1,
ADQ42007.1, ADQ47252.1, ADR19820.1, ADT83449.1, ADU21654.1, ADU26222.1, ADU44690.1,
ADU51671.1, ADU75950.1, ADU97576.1, ADU98901.1, ADV45015.1, ADV46309.1, ADV65299.1,
ADV78762.1, ADW17641.1, ADW21871.1, ADX47759.1, ADX69768.1, ADX81772.1, ADX84850.1,
ADX89044.1, ADX89503.1, ADY01597.1, ADY32337.1, ADY55692.1, ADY61452.1, ADY61693.1,
ADZ26351.1, AEA46789.1, AEB06538.1, AEB07990.1, AEB12793.1, AEB34825.1, AEB44344.1,
AEB69536.1, AEB69628.1, AEB77509.1, AEB95258.1, AEC00931.1, AEC52733.1, AEE12856.1,
AEE14451.1, AEE48387.1, AEE91060.1, AEE94620.1, AEE97375.1, AEF18279.1, AEF19063.1,
AEF19552.1, AEF26533.1, AEF93426.1, AEF93615.1, AEG01409.1, AEG14217.1, AEG16477.1,
AEG34481.1, AEG34527.1, AEG46352.1, AEG46840.1, AEG61210.1, AEG68384.1, AEG94652.1,
AEH24643.1, AEH24650.1, AEH25129.1, AEH44114.1, AEH47545.1, AEH49389.1, AEH51233.1,
AEH51743.1, AEH52710.1, AEH61401.1, AEI14612.1, AEI37912.1, AEI38603.1, AEI51284.1,
AEJ20059.1, AEJ40708.1, AEJ53446.1, AEK19970.1, AEK44435.1, AEK72626.1, AEM38304.1,
AEM38377.1, AEM38562.1, AEM58839.1, AEM74972.1, AEM79946.1, AEN73078.1, AEN78296.1,
AEN97654.1, AEO02605.1, AEO46815.1, AEO47324.1, AEP01120.1, AEP13345.1, AER03344.1,
AER57691.1, AER59752.1, AER66006.1, AET32404.1, AET42231.1, AET91880.1, AEV15287.1,

TABLE 28-continued

Cas3 polypeptide accession numbers
(the sequene identifier for each accession number, in the
order provided in Table 28, is SEQ ID NOs: 11529-15493).

AEV69184.1, AEW01075.1, AEW06745.1, AEW20272.1, AEX45154.1, AEX75344.1, AEX84728.1,
AEY65498.1, AEY94191.1, AFA39172.1, AFA49665.1, AFC23727.1, AFD27466.1, AFD28167.1,
AFH39982.1, AFH42054.1, AFI31622.1, AFI85402.1, AFI86062.1, AFI87829.1, AFK07284.1,
AFK07934.1, AFK21440.1, AFK22398.1, AFK56999.1, AFK85420.1, AFK85609.1, AFL66342.1,
AFL66903.1, AFL68258.1, AFL73110.1, AFL81871.1, AFL94590.1, AFL96007.1, AFM22197.1,
AFM40488.1, AFN03429.1, AFN35324.1, AFN74053.1, AFN83063.1, AFO79272.1, AFR21613.1,
AFS77696.1, AFU15849.1, AFU57332.1, AFU72004.1, AFU72533.1, AFV12618.1, AFV22011.1,
AFV99699.1, AFY60377.1, AFY70022.1, AFY88490.1, AFY93139.1, AFY97157.1, AFZ31566.1,
AFZ36228.1, AFZ48716.1, AFZ54740.1, AFZ72876.1, AFZ74578.1, AGA24811.1, AGA56396.1,
AGA59188.1, AGA59290.1, AGB01360.1, AGB03157.1, AGB03722.1, AGB05366.1, AGB20225.1,
AGB28829.1, AGB40918.1, AGC48889.1, AGC49201.1, AGC68637.1, AGC68871.1, AGE29602.1,
AGF58565.1, AGF68345.1, AGF87287.1, AGG07000.1, AGG09390.1, AGG14996.1, AGG15486.1,
AGH38685.1, AGH40903.1, AGH74517.1, AGH79297.1, AGH93293.1, AGH93786.1, AGI10360.1,
AGI32657.1, AGI35539.1, AGI39649.1, AGI39869.1, AGJ61862.1, AGK02814.1, AGK16439.1,
AGK21126.1, AGK54740.1, AGK61245.1, AGK71297.1, AGL00361.1, AGL03423.1, AGM22631.1,
AGN16029.1, AGN26280.1, AGN82557.1, AGO11300.1, AGO59985.1, AGO61200.1, AGQ24924.1,
AGQ37973.1, AGQ40489.1, AGR15964.1, AGR27583.1, AGR75973.1, AGT86400.1, AGX42979.1,
AGX43469.1, AGX94067.1, AGY75622.1, AHB67949.1, AHB88121.1, AHC14004.1, AHC19698.1,
AHC35948.1, AHC52232.1, AHF04639.1, AHG05448.1, AHG75938.1, AHG77946.1, AHG79310.1,
AHG81514.1, AHG83785.1, AHG86048.1, AHG86669.1, AHH03843.1, AHH06893.1, AHH98593.1,
AHI12341.1, AHJ12410.1, AHJ17863.1, AHJ19775.1, AHJ21576.1, AHJ25216.1, B4JT42.1,
BAA30013.1, BAD39294.1, BAD39649.1, BAD49297.1, BAD59279.1, BAD72026.1, BAD84639.1,
BAD84710.1, BAE67553.1, BAF39967.1, BAF60097.1, BAF60175.1, BAG02901.1, BAG34482.1,
BAH74926.1, BAI69701.1, BAI80031.1, BAI81692.1, BAJ48042.1, BAJ48053.1, BAJ50842.1,
BAJ63262.1, BAJ64869.1, BAK19888.1, BAK22115.1, BAK63461.1, BAK54126.1, BAK54840.1,
BAK56461.1, BAK66413.1, BAK73770.1, BAK79790.1, BAK81137.1, BAK95333.1, BAL57693.1,
BAL59377.1, BAL61648.1, BAL99623.1, BAM47258.1, BAM55624.1, BAM59636.1, BAM70228.1,
BAN13318.1, CAB49887.1, CAB49933.1, CAC82713.1, CAE50741.1, CAG20009.1, CAG23839.1,
CAG85921.1, CAI07978.1, CAI36811.1, CAI54792.1, CAI83546.1, CAJ69338.2, CAJ69872.1,
CAJ73675.1, CAJ74859.1, CAO81147.1, CAP54009.1, CAP56153.1, CAT71365.1, CAZ87333.1,
CBA17362.1, CBA64403.1, CBA65389.1, CBA65917.1, CBE05592.1, CBE06410.1, CBE06725.1,
CBG02711.1, CBJ42356.1, CBK91605.1, CBK92834.1, CBK99507.1, CBL01823.1, CBL28678.1,
CBL34416.1, CBL44341.1, CBL92314.1, CBN58992.1, CBN86967.1, CBV16231.1, CBX22851.1,
CBY03039.1, CBY13641.1, CBY24163.1, CBY35617.1, CBY48113.1, CBY97120.1, CCA82578.1,
CCA92395.1, CCB93365.1, CCC40226.1, CCC74213.1, CCC80913.1, CCC81888.1, CCE23035.1,
CCE70385.1, CCE70431.1, CCF16786.1, CCF67639.1, CCF98722.1, CCG39874.1, CCG47211.1,
CCH29336.1, CCH39302.1, CCH56578.1, CCH91971.1, CCI01093.1, CCI24645.1, CCI36963.1,
CCI87322.1, CCJ00347.1, CCJ04669.1, CCJ32924.1, CCJ34804.1, CCJ37384.1, CCJ95684.1,
CCJ97150.1, CCK60669.1, CCK64991.1, CCK79125.1, CCK81116.1, CCK83452.1, CCK86078.1,
CCK87446.1, CCK87791.1, CCK88322.1, CCK90900.1, CCK91257.1, CCK91757.1, CCK94929.1,
CCK95460.1, CCK96293.1, CCK98528.1, CCK98869.1, CCK99453.1, CCL02781.1, CCL07489.1,
CCL08294.1, CCL08499.1, CCL10368.1, CCL11549.1, CCL12261.1, CCL14832.1, CCL15412.1,
CCL18865.1, CCL19411.1, CCL22787.1, CCL23334.1, CCL30688.1, CCL32494.1, CCL34646.1,
CCL35212.1, CCL38535.1, CCL39059.1, CCL39262.1, CCL42750.1, CCL43258.1, CCL46772.1,
CCL47271.1, CCL49882.1, CCL50401.1, CCL53862.1, CCL54351.1, CCL57969.1, CCL61501.1,
CCL65498.1, CCL66039.1, CCL69457.1, CCL69961.1, CCL73147.1, CCL73646.1, CCL76804.1,
CCL77342.1, CCL80652.1, CCL81171.1, CCL84106.1, CCL84681.1, CCL84887.1, CCL88298.1,
CCL88856.1, CCL91963.1, CCL92529.1, CCL96069.1, CCO07752.1, CCP41951.1, CCQ64199.1,
CCQ74032.1, CCQ92532.1, CCQ93021.1, CCQ94190.1, CCQ94850.1, CCU61100.1, CCU72642.1,
CCU78369.1, CCU84801.1, CCX34714.1, CCX48507.1, CCX71696.1, CCY33510.1, CCY40554.1,
CCY42904.1, CCY59069.1, CCY75833.1, CCZ06019.1, CCZ32688.1, CCZ61767.1, CCZ62158.1,
CCZ77974.1, CCZ80189.1, CCZ85780.1, CDA07279.1, CDA09427.1, CDA10107.1, CDA45399.1,
CDA52081.1, CDA64490.1, CDA72497.1, CDA89886.1, CDB08502.1, CDB14570.1, CDB26321.1,
CDB26705.1, CDB93765.1, CDB98421.1, CDC01245.1, CDC12998.1, CDC19292.1, CDC28488.1,
CDC34385.1, CDC38721.1, CDC44659.1, CDC50440.1, CDC66729.1, CDC79980.1, CDC92392.1,
CDC93210.1, CDD36453.1, CDD54038.1, CDD57366.1, CDD59787.1, CDD73516.1, CDD90196.1,
CDD98973.1, CDE06404.1, CDE35767.1, CDE46263.1, CDE52108.1, CDE80449.1, CDE83596.1,
CDE90309.1, CDE94634.1, CDF00453.1, CDF05500.1, CDF10538.1, CDF13246.1, CDG01443.1,
CDG36819.1, CDG37686.1, CDG64475.1, CDH12429.1, CDH15937.1, CDH34486.1, CDI40530.1,
CDI43447.1, CDI49495.1, CDI64713.1, CDM19083.1, CDM39372.1, CDM67380.1, EAA21639.1,
EAL07806.1, EAQ01271.1, EAQ10652.1, EAQ36305.1, EAR27413.1, EAS32118.2, EAS33820.2,
EAT98291.1, EAX48300.1, EAY05909.1, EAY25591.1, EAY30150.1, EBA01538.1, EDL53718.1,
EDM24313.1, EDN73318.1, EDN76108.1, EDN80092.1, EDN84726.1, EDO58925.1, EDP75025.1,
EDP14353.1, EDP20982.1, EDP25153.1, EDP75372.1, EDP75968.1, EDR99201.1, EDS00204.1,
EDS06801.1, EDS74682.1, EDS76093.1, EDS77863.1, EDT14747.1, EDT45689.1, EDT49006.1,
EDT87976.1, EDU19429.1, EDU38642.1, EDU50692.1, EDV94932.1, EDW71200.1, EDX73017.1,
EDY32901.1, EDY34617.1, EDY50238.1, EEA82746.1, EEB22223.1, EEB34859.1, EED10539.1,
EEF14674.1, EEF65985.1, EEG30527.1, EEG33497.1, EEG35953.1, EEG37133.1, EEG56414.1,
EEG71149.1, EEG75124.1, EEI14199.1, EEI20245.1, EEI64038.1, EEI86604.1, EEK17370.1,
EEK86602.1, EEL37865.1, EEL73902.1, EEM24968.1, EEN82622.1, EEN82842.1, EEO29471.1,
EEO43828.2, EEP20788.1, EEP61026.1, EEP68245.1, EEQ57501.1, EER08657.1, EER55916.1,
EES53465.1, EES63310.1, EES76422.2, EES90489.1, EET44429.1, EEI62040.1, EEI78542.1,
EEU01236.1, EEV20769.1, EEV89022.1, EEW19884.1, EEW20709.1, EEW64900.1, EEW67152.1,
EEW94247.2, EEX23201.1, EEX36423.1, EEX49288.1, EEX75936.1, EEY11077.1, EEY13112.1,
EEY17555.1, EEZ28139.1, EEZ61816.1, EEZ75906.1, EFA85676.1, EFA89358.1, EFB31591.1,
EFB38093.1, EFB38350.1, EFB90864.1, EFB90879.1, EFC51249.1, EFC81107.1, EFC87158.1,

TABLE 28-continued

Cas3 polypeptide accession numbers
(the sequene identifier for each accession number, in the
order provided in Table 28, is SEQ ID NOs: 11529-15493).

EFC90517.1, EFD10034.1, EFD25242.1, EFD93806.1, EFE72199.1, EFF22494.1, EFF35101.1,
EFF66132.1, EFF79647.1, EFF97458.1, EFG33109.2, EFG83860.1, EFH05802.1, EFH07555.1,
EFH07718.1, EFH10703.1, EFH15420.1, EFH16151.1, EFH17186.1, EFH21869.1, EFH93275.1,
EFH99030.1, EFI35150.1, EFI47367.1, EFI68559.1, EFK09596.1, EFK39565.1, EFK41205.1,
EFK85685.1, EFL31934.1, EFL84472.1, EFM09026.1, EFM24728.1, EFP59913.1, EFQ06778.1,
EFQ52067.1, EFR34556.1, EFR88682.1, EFS01190.1, EFS20744.1, EFS21648.1, EFS26649.1,
EFS28322.1, EFT83494.1, EFU63287.1, EFV01201.1, EFV16751.1, EFV21400.1, EFV34594.1,
EFV81297.1, EFV94303.1, EFW09840.1, EFW38350.1, EFW90578.1, EFX55033.1, EFX91371.1,
EFY07104.1, EGA93917.1, EGB16321.1, EGB18209.1, EGB62267.1, EGB94715.1, EGC00354.1,
EGC03297.1, EGC18027.1, EGC19799.1, EGC74255.1, EGC88910.1, EGD11110.1, EGD49240.1,
EGD50530.1, EGE48063.1, EGF23573.1, EGF30315.1, EGG91968.1, EGG92690.1, EGH09961.1,
EGH15666.1, EGH44318.1, EGH46858.1, EGH58454.1, EGH72941.1, EGH79509.1, EGJ10203.1,
EGL83972.1, EGL83995.1, EGM53069.1, EGN31536.1, EGN35868.1, EGN46218.1, EGN57519.1,
EGN64311.1, EGQ14151.1, EGQ77220.1, EGR34669.1, EGS63956.1, EGT75759.1, EGT79807.1,
EGV09281.1, EGV32622.1, EGV37148.1, EGV37208.1, EGV49999.1, EGV50073.1, EGW49960.1,
EGW53127.1, EGX28858.1, EGX58186.1, EGX72596.1, EGX99506.1, EGY17212.1, EGY31348.1,
EGY32749.1, EGY34065.1, EGY35530.1, EGY37213.1, EGY39664.1, EGY39881.1, EGY41441.1,
EGY42393.1, EGY45570.1, EGY46700.1, EGY53769.1, EGY61569.1, EGY70642.1, EGY70872.1,
EGY75560.1, EGY80085.1, EGZ43695.1, EGZ44573.1, EGZ49811.1, EHA63801.1, EHB48930.1,
EHB62321.1, EHB89135.1, EHC33898.1, EHC75648.1, EHD00339.1, EHE98233.1, EHF03247.1,
EHG19002.1, EHG23348.1, EHG32767.1, EHI57520.1, EHI68706.1, EHI70385.1, EHI77347.1,
EHJ01147.1, EHJ13335.1, EHJ25273.1, EHJ27822.1, EHJ35718.1, EHJ36415.1, EHJ47331.1,
EHK89929.1, EHL03894.1, EHL13043.1, EHL17679.1, EHL19479.1, EHL21081.1, EHL24440.1,
EHL64636.1, EHL70092.1, EHL79448.1, EHL85839.1, EHL92940.1, EHM10681.1, EHM13741.1,
EHM32926.1, EHM50506.1, EHM87976.1, EHO16226.1, EHO40938.1, EHO49962.1, EHO68883.1,
EHO77291.1, EHO85748.1, EHO85976.1, EHP69911.1, EHP86554.1, EHP88828.1, EHQ05140.1,
EHQ30580.1, EHQ52969.1, EHQ62727.1, EHR37292.1, EHR79727.1, EHS84825.1, EHV69086.1,
EHY79335.1, EIA21828.1, EIA26373.1, EIA26754.1, EIA28594.1, EIA30741.1, EIC02346.1, EIC03818.1,
EIC11167.1, EIC21115.1, EIC80038.1, EID14936.1, EID43006.1, EIF93150.1, EIG30378.1, EIG54633.1,
EII12409.1, EIJ71523.1, EIJ72206.1, EIM00774.1, EIM57400.1, EIM63784.1, EIM64766.1, EIM74523.1,
EIQ00065.1, EIT84250.1, EIT88138.1, EIW00129.1, EIW91734.1, EIY59735.1, EJF40839.1,
EJF52125.1, EJG07256.1, EJG08369.1, EJL46317.1, EJN45241.1, EJN52402.1, EJN54262.1,
EJO68220.1, EJO71294.1, EJO77844.1, EJP02505.1, EJP04930.1, EJP15618.1, EJP17851.1,
EJP19875.1, EJP23267.1, EJP29626.1, EJP85708.1, EJR93712.1, EJS10963.1, EJS45098.1,
EJU06234.1, EJU16838.1, EJU19961.1, EJU22340.1, EJU25588.1, EJU32127.1, EJV73278.1,
EJW09517.1, EJW17214.1, EJW82196.1, EJZ69664.1, EJZ85814.1, EKA01293.1, EKA13056.1,
EKA91355.1, EKB47818.1, EKD25942.1, EKD55710.1, EKE30556.1, EKE43332.1, EKG52539.1,
EKG57734.1, EKG62910.1, EKG63400.1, EKG72465.1, EKG93022.1, EKI36920.1, EKK94022.1,
EKL08412.1, EKL14867.1, EKL16050.1, EKL22304.1, EKL93516.1, EKM01145.1, EKM08460.1,
EKM99101.1, EKN16816.1, EKN22397.1, EKN28556.1, EKN67977.1, EKN86875.1, EKN88349.1,
EKN96987.1, EKO04942.1, EKO14466.1, EKO24574.1, EKO26697.1, EKO32500.1, EKO52371.1,
EKO52653.1, EKO59403.1, EKO61592.1, EKO69587.1, EKO70653.1, EKO77440.1, EKO79148.1,
EKO94703.1, EKO96202.1, EKP03649.1, EKP04460.1, EKP14641.1, EKP22570.1, EKP76315.1,
EKP83838.1, EKP95533.1, EKQ37062.1, EKQ39127.1, EKQ46592.1, EKQ47948.1, EKQ76725.1,
EKQ84991.1, EKQ85289.1, EKQ92341.1, EKQ99808.1, EKR06850.1, EKR08167.1, EKR15339.1,
EKR25310.1, EKR27775.1, EKR36474.1, EKR46947.1, EKR57319.1, EKR63579.1, EKR74663.1,
EKR81630.1, EKR84713.1, EKR90045.1, EKS02024.1, EKS09343.1, EKS09475.1, EKT85826.1,
EKU24261.1, EKU43640.1, EKU78427.1, EKU91951.1, EKU95518.1, EKX88305.1, EKX94127.1,
EKX95309.1, EKY02928.1, ELA07948.1, ELH35798.1, ELH49225.1, ELI28693.1, ELK21783.1,
ELK22578.1, ELQ17188.1, ELR65959.1, ELR72966.1, ELS04216.1, ELT18754.1,
ELT51926.1, ELT53860.1, ELT59291.1, ELV09153.1, ELW71756.1, ELY32095.1, ELY41479.1,
ELY64892.1, ELY69634.1, ELY72598.1, ELY84664.1, ELZ04990.1, ELZ06192.1, ELZ40748.1,
ELZ59540.1, ELZ60429.1, ELZ68875.1, ELZ71861.1, ELZ72260.1, ELZ84576.1, ELZ89349.1,
ELZ93661.1, ELZ97243.1, ELZ99742.1, EMA05599.1, EMA08152.1, EMA18800.1, EMA25144.1,
EMA34112.1, EMA56846.1, EMA69346.1, EMB14050.1, EMD31853.1, EMD37413.1, EME03974.1,
EME83389.1, EMF30787.1, EMF35383.1, EMF41746.1, EMF56342.1, EMF70591.1, EMF80240.1,
EMF90484.1, EMG01549.1, EMG09248.1, EMG31014.1, EMH94950.1, EMI10503.1, EMI28180.1,
EMI57446.1, EMI63031.1, EMI66058.1, EMI67349.1, EMI69780.1, EMI71641.1, EMJ34611.1,
EMJ36108.1, EMJ45623.1, EMJ47435.1, EMJ52875.1, EMJ54316.1, EMJ55098.1, EMJ58565.1,
EMJ63194.1, EMJ65258.1, EMJ68919.1, EMJ69812.1, EMJ72474.1, EMJ74248.1, EMJ80477.1,
EMJ80648.1, EMJ83296.1, EMJ85541.1, EMJ91110.1, EMJ92590.1, EMK02765.1, EMK06056.1,
EMK07522.1, EMK08549.1, EMK10539.1, EMK14171.1, EMK16101.1, EMK18454.1, EMK23383.1,
EMK24843.1, EMK26080.1, EMM72348.1, EMM76998.1, EMM84368.1, EMM85990.1,
EMM88565.1, EMM92118.1, EMM95757.1, EMM98808.1, EMN02654.1, EMN05708.1, EMN06831.1,
EMN08538.1, EMN23280.1, EMN26929.1, EMN27444.1, EMN30500.1, EMN35886.1, EMN37001.1,
EMN38877.1, EMN40237.1, EMN46520.1, EMN50253.1, EMN52157.1, EMN53645.1, EMN58263.1,
EMN64601.1, EMN69109.1, EMN71256.1, EMN72171.1, EMN74279.1, EMN77340.1, EMN81816.1,
EMN82468.1, EMN85327.1, EMN89990.1, EMN94815.1, EMN96888.1, EMN97741.1, EMN98295.1,
EMO07500.1, EMO08696.1, EMO14454.1, EMO14780.1, EMO16223.1, EMO21355.1, EMO23320.1,
EMO29540.1, EMO30696.1, EMO33387.1, EMO36352.1, EMO42416.1, EMO44418.1, EMO48161.1,
EMO51803.1, EMO56069.1, EMO60007.1, EMO65721.1, EMO68743.1, EMO69635.1, EMO73270.1,
EMO74239.1, EMO77649.1, EMO78641.1, EMO79140.1, EMO83150.1, EMO83521.1, EMO88906.1,
EMO89073.1, EMO94054.1, EMO95195.1, EMO96578.1, EMP00001.1, EMP03296.1, EMP04911.1,
EMP80131.1, EMR04142.1, EMR53804.1, EMS78532.1, EMS83942.1, EMS85264.1, EMT39598.1,
EMT47060.1, EMT51171.1, EMT52265.1, EMV20686.1, EMV40013.1, EMW18023.1, EMW94559.1,
EMX92278.1, EMY03896.1, EMY05816.1, EMY12534.1, EMY23097.1, EMY26723.1, EMY55509.1,

TABLE 28-continued

Cas3 polypeptide accession numbers
(the sequene identifier for each accession number, in the
order provided in Table 28, is SEQ ID NOs: 11529-15493).

EMY78151.1, EMY79390.1, EMZ33825.1, EMZ36272.1, ENA30283.1, ENA77979.1, ENA79233.1,
ENB26895.1, ENB33487.1, END57072.1, ENF74818.1, ENH55858.1, ENO18092.1, ENO64014.1,
ENO70114.1, ENO72462.1, ENO77315.1, ENO81517.1, ENO88272.1, ENO94488.1, ENV75859.1,
ENX62341.1, ENY72536.1, ENY88093.1, ENY95896.1, ENZ05665.1, ENZ10231.1, ENZ13876.1,
ENZ16946.1, ENZ26111.1, ENZ26403.1, ENZ39044.1, ENZ43233.1, ENZ45621.1, ENZ47415.1,
ENZ54160.1, ENZ65663.1, ENZ69351.1, ENZ72154.1, EOA48846.1, EOA55010.1, EOD01823.1,
EOH73740.1, EOH98200.1, EOK98747.1, EOQ36054.1, EOR26383.1, EOR71324.1, EOR85350.1,
EOS34141.1, EOS50043.1, EOS52985.1, EOS54124.1, EOS60749.1, EOS64689.1, EOS73777.1,
EOS81386.1, EOT28172.1, EOT59713.1, EOT81526.1, EOT82464.1, EOZ98894.1, EPC07706.1,
EPD26791.1, EPD37768.1, EPD73804.1, EPD77061.1, EPE60581.1, EPE61218.1, EPE82200.1,
EPE83106.1, EPG48147.1, EPG50248.1, EPG59032.1, EPG81685.1, EPI61098.1, EPI66853.1,
EPL64360.1, EPM81961.1, EPP16777.1, EPP17870.1, EPR34127.1, EPR39928.1, EPR43455.1,
EPS25302.1, EPT33668.1, EPX80546.1, EPY00200.1, EPZ01041.1, EPZ01870.1, EPZ27877.1,
EPZ29483.1, EPZ29863.1, EPZ39767.1, EQA36843.1, EQA44025.1, EQA60409.1, EQA71142.1,
EQA80741.1, EQE08411.1, EQE09392.1, EQE22719.1, EQE23424.1, EQE38501.1, EQE39192.1,
EQE41871.1, EQE43063.1, EQE47806.1, EQE53151.1, EQE68292.1, EQE68942.1, EQE74684.1,
EQE90184.1, EQE92082.1, EQF02570.1, EQF05751.1, EQF10567.1, EQF14265.1, EQF18484.1,
EQF26960.1, EQF31380.1, EQF36043.1, EQF38900.1, EQF50395.1, EQF51992.1, EQF52847.1,
EQF60174.1, EQF60779.1, EQF66130.1, EQF67397.1, EQF74261.1, EQF75116.1, EQF79634.1,
EQF80477.1, EQF94905.1, EQF98043.1, EQG00969.1, EQG02089.1, EQG09649.1, EQG18536.1,
EQG25400.1, EQG32966.1, EQG33557.1, EQG34473.1, EQG40556.1, EQG45069.1, EQG51715.1,
EQG59858.1, EQG65544.1, EQG69423.1, EQG77053.1, EQG78886.1, EQG81962.1, EQG83633.1,
EQG94071.1, EQG94500.1, EQH12985.1, EQH17954.1, EQH34295.1, EQH35108.1, EQH35210.1,
EQH37869.1, EQH51122.1, EQH59205.1, EQH63460.1, EQH66791.1, EQH67918.1, EQH70277.1,
EQH70390.1, EQH74803.1, EQH75580.1, EQH80103.1, EQH82323.1, EQH88065.1, EQH93750.1,
EQH96575.1, EQH97199.1, EQI02705.1, EQI10736.1, EQI22141.1, EQI33687.1, EQI38169.1,
EQI45906.1, EQI54641.1, EQI55928.1, EQI72787.1, EQI78469.1, EQI79463.1, EQI85815.1,
EQI90985.1, EQI99102.1, EQJ06189.1, EQJ09400.1, EQJ29787.1, EQJ34932.1, EQJ38317.1,
EQJ39103.1, EQJ49186.1, EQJ51305.1, EQJ55005.1, EQJ67541.1, EQJ77202.1, EQJ77539.1,
EQJ78490.1, EQJ94680.1, EQK00624.1, EQK02220.1, EQK05298.1, EQK11680.1, EQK17629.1,
EQK21844.1, EQK30840.1, EQK38720.1, EQK69061.1, EQK70288.1, EQK74204.1, EQK74849.1,
EQK75067.1, EQK76493.1, EQK85633.1, EQK86103.1, EQK87001.1, EQL06443.1, EQL07764.1,
EQM72183.1, EQQ19466.1, ERF59736.1, ERF73398.1, ERF77710.1, ERG84986.1, ERG92582.1,
ERH14166.1, ERH21167.1, ERH28582.1, ERH28848.1, ERI04811.1, ERI06128.1, ERI07857.1,
ERI68079.1, ERI74755.1, ERI93851.1, ERJ00270.1, ERJ18000.1, ERJ23348.1, ERJ27563.1,
ERJ28377.1, ERJ30380.1, ERJ63858.1, ERJ64712.1, ERJ67424.1, ERJ69592.1, ERJ75894.1,
ERJ81455.1, ERJ83443.1, ERJ84271.1, ERJ89571.1, ERJ91347.1, ERJ93150.1, ERK01555.1,
ERK03431.1, ERK56582.1, ERK64507.1, ERK89865.1, ERL64692.1, ERM25313.1, ERM29350.1,
ERM37468.1, ERM45585.1, ERM83477.1, ERM91448.1, ERN17773.1, ERP31667.1, ERP69290.1,
ERS40012.1, ERS57091.1, ERS64303.1, ERS74209.1, ERS80389.1, ERT07692.1, ERT32147.1,
ERT38008.1, ERT39869.1, ERT63105.1, ERV42110.1, ERV60146.1, ERY77981.1, ESH23406.1,
ESP86782.1, ESQ74771.1, EST01179.1, EST90151.1, ETA02740.1, ETA67349.1, ETA80091.1,
ETC74838.1, ETC88558.1, ETD02077.1, ETD17843.1, ETD20916.1, ETD77751.1, ETD86668.1,
ETE54109.1, ETI80953.1, ETI96854.1, ETK36602.1, ETO39378.1, ETO39674.1, ETZ17788.1,
ETZ19045.1, ETZ24058.1, EUB26789.1, EUB36157.1, EUC57952.1, EUJ23989.1, EUJ32652.1,
EUJ37074.1, EUJ38058.1, EUJ39374.1, EUJ40151.1, EUJ45450.1, EUJ57889.1, EWC94823.1,
EWM59169.1, G4RJZ3.1, GAA95795.1, GAB61209.1, GAB63519.1, GAC40773.1, GAC87195.1,
GAC90884.1, GAD05081.1, GAD07317.1, GAD27285.1, GAE14529.1, GAE18299.1, GAE82156.1,
NP_068912.1, NP_070699.1, NP_078421.1, NP_126656.1, NP_126702.1, NP_142841.1, NP_247350.1,
NP_247357.1, NP_342847.1, NP_342883.1, NP_343399.1, NP_375874.1, NP_378652.1, NP_558357.1,
NP_558445.1, NP_578369.1, NP_J88050.1, NP_624175.1, NP_644143.1, NP_662026.1, NP_662847.1,
NP_689391.1, NP_713370.1, NP_775649.1, NP_781783.1, NP_782085.1, NP_900894.1, NP_906084.1,
NP_940521.1, NP_963315.1, NP_982339.1, O94536.1, Q1CW46.1, Q57821.2, Q57828.1, Q6BV94.1,
WP_000038360.1, WP_000038361.1, WP_000038362.1, WP_000038364.1, WP_000236442.1,
WP_000343809.1, WP_000389287.1, WP_000506550.1, WP_000533899.1, WP_000601693.1,
WP_000601694.1, WP_000601695.1, WP_000601696.1, WP_000601698.1, WP_000601699.1,
WP_000601700.1, WP_000601701.1, WP_000601702.1, WP_000601703.1, WP_000601704.1,
WP_000601705.1, WP_000601706.1, WP_000601707.1, WP_000601708.1, WP_000601709.1,
WP_000601711.1, WP_000601712.1, WP_000637358.1, WP_000718775.1, WP_000827889.1,
WP_000827890.1, WP_000827892.1, WP_000827893.1, WP_000827896.1, WP_000827897.1,
WP_000827903.1, WP_000827904.1, WP_000827905.1, WP_000827907.1, WP_000827908.1,
WP_000827910.1, WP_000989806.1, WP_000989808.1, WP_001111734.1, WP_001233948.1,
WP_001394698.1, WP_001397702.1, WP_001416758.1, WP_001423115.1, WP_001537536.1,
WP_001613696.1, WP_001616387.1, WP_001636574.1, WP_001670744.1, WP_001696768.1,
WP_001718761.1, WP_001744249.1, WP_001971951.1, WP_001976831.1, WP_001982406.1,
WP_002025055.1, WP_002090052.1, WP_002097183.1, WP_002101799.1, WP_002102561.1,
WP_002106407.1, WP_002120618.1, WP_002129431.1, WP_002134050.1, WP_002138873.1,
WP_002145812.1, WP_002149052.1, WP_002180514.1, WP_002184099.1, WP_002187916.1,
WP_002189459.1, WP_002193570.1, WP_002198318.1, WP_002204285.1, WP_002296585.1,
WP_002299427.1, WP_002317880.1, WP_002323590.1, WP_002325837.1, WP_002330771.1,
WP_002338495.1, WP_002346439.1, WP_002568440.1, WP_002570354.1, WP_002571312.1,
WP_002577346.1, WP_002585642.1, WP_002589367.1, WP_002594033.1, WP_002595864.1,
WP_002606243.1, WP_002631668.1, WP_002633777.1, WP_002634037.1, WP_002656855.1,
WP_002695764.1, WP_002697310.1, WP_002702610.1, WP_002703150.1, WP_002725655.1,
WP_002734241.1, WP_002744093.1, WP_002748765.1, WP_002749879.1, WP_002760324.1,
WP_002765497.1, WP_002766210.1, WP_002769499.1, WP_002793659.1, WP_002822258.1,

TABLE 28-continued

Cas3 polypeptide accession numbers
(the sequene identifier for each accession number, in the
order provided in Table 28, is SEQ ID NOs: 11529-15493).

WP_002835740.1, WP_002849088.1, WP_002924830.1, WP_002938503.1, WP_002944230.1,
WP_002950094.1, WP_002951339.1, WP_002995136.1, WP_003001266.1, WP_003019324.1,
WP_003045456.1, WP_003116912.1, WP_003253162.1, WP_003272375.1, WP_003285127.1,
WP_003298383.1, WP_003330674.1, WP_003345771.1, WP_003352577.1, WP_003364902.1,
WP_003377379.1, WP_003388335.1, WP_003389993.1, WP_003393817.1, WP_003405054.1,
WP_003411614.1, WP_003416597.1, WP_003417576.1, WP_003422616.1, WP_003424502.1,
WP_003426159.1, WP_003430915.1, WP_003439784.1, WP_003464176.1, WP_003465424.1,
WP_003480734.1, WP_003480771.1, WP_003488962.1, WP_003500204.1, WP_003509199.1,
WP_003511802.1, WP_003513457.1, WP_003518145.1, WP_003557944.1, WP_003620497.1,
WP_003627154.1, WP_003680285.1, WP_003680674.1, WP_003685530.1, WP_003693855.1,
WP_003708649.1, WP_003714211.1, WP_003721308.1, WP_003744754.1, WP_003745656.1,
WP_003746225.1, WP_003754488.1, WP_003758684.1, WP_003762750.1, WP_003777787.1,
WP_003781704.1, WP_003790983.1, WP_003797752.1, WP_003811036.1, WP_003827015.1,
WP_003833376.1, WP_003834169.1, WP_003839261.1, WP_003871403.1, WP_003887835.1,
WP_003955762.1, WP_003990046.1, WP_004038948.1, WP_004040746.1, WP_004043129.1,
WP_004046325.1, WP_004053328.1, WP_004060809.1, WP_004062467.1, WP_004064675.1,
WP_004066422.1, WP_004068712.1, WP_004073070.1, WP_004074442.1, WP_004140340.1,
WP_004174175.1, WP_004220823.1, WP_004228693.1, WP_004260229.1, WP_004269026.1,
WP_004274589.1, WP_004278456.1, WP_004284063.1, WP_004299435.1, WP_004311070.1,
WP_004331265.1, WP_004333836.1, WP_004333879.1, WP_004373509.1, WP_004378890.1,
WP_004397036.1, WP_004399634.1, WP_004417293.1, WP_004420696.1, WP_004424736.1,
WP_004426862.1, WP_004433165.1, WP_004435928.1, WP_004446305.1, WP_004448860.1,
WP_004450054.1, WP_004453436.1, WP_004454738.1, WP_004456150.1, WP_004460803.1,
WP_004461820.1, WP_004465593.1, WP_004467844.1, WP_004469627.1, WP_004470803.1,
WP_004473238.1, WP_004475261.1, WP_004477311.1, WP_004477346.1, WP_004478346.1,
WP_004480114.1, WP_004480905.1, WP_004481897.1, WP_004483223.1, WP_004484155.1,
WP_004486391.1, WP_004486948.1, WP_004488659.1, WP_004489502.1, WP_004489563.1,
WP_004492043.1, WP_004492122.1, WP_004493161.1, WP_004494548.1, WP_004497010.1,
WP_004500122.1, WP_004501114.1, WP_004503356.1, WP_004508369.1, WP_004513240.1,
WP_004517274.1, WP_004520758.1, WP_004565442.1, WP_004603532.1, WP_004604885.1,
WP_004608922.1, WP_004609979.1, WP_004612298.1, WP_004617476.1, WP_004628994.1,
WP_004651369.1, WP_004751134.1, WP_004755739.1, WP_004756542.1, WP_004757818.1,
WP_004762441.1, WP_004762642.1, WP_004766473.1, WP_004767907.1, WP_004769089.1,
WP_004770101.1, WP_004778144.1, WP_004778274.1, WP_004778982.1, WP_004779839.1,
WP_004782375.1, WP_004783205.1, WP_004807169.1, WP_004820509.1, WP_004826232.1,
WP_004826835.1, WP_004853847.1, WP_004884713.1, WP_004889381.1, WP_004890807.1,
WP_004966756.1, WP_004971287.1, WP_004990091.1, WP_004993637.1, WP_005278168.1,
WP_005323014.1, WP_005345380.1, WP_005348716.1, WP_005351106.1, WP_005352686.1,
WP_005392862.1, WP_005487696.1, WP_005533723.1, WP_005540315.1, WP_005540831.1,
WP_005545917.1, WP_005547684.1, WP_005552076.1, WP_005553119.1, WP_005555124.1,
WP_005557278.1, WP_005562352.1, WP_005565160.1, WP_005565929.1, WP_005567425.1,
WP_005575141.1, WP_005576671.1, WP_005578469.1, WP_005578603.1, WP_005582026.1,
WP_005582665.1, WP_005583993.1, WP_005584761.1, WP_005587231.1, WP_005588971.1,
WP_005594953.1, WP_005610775.1, WP_005618939.1, WP_005623551.1, WP_005626998.1,
WP_005635200.1, WP_005641496.1, WP_005651105.1, WP_005659290.1, WP_005674862.1,
WP_005702609.1, WP_005703620.1, WP_005738157.1, WP_005759097.1, WP_005806403.1,
WP_005806453.1, WP_005817557.1, WP_005846115.1, WP_005856776.1, WP_005874865.1,
WP_005879976.1, WP_005910161.1, WP_005920822.1, WP_005927109.1, WP_005931444.1,
WP_005939911.1, WP_005942565.1, WP_005948318.1, WP_005957092.1, WP_005963237.1,
WP_005965994.1, WP_005966192.1, WP_005977423.1, WP_005986309.1, WP_005988922.1,
WP_006000240.1, WP_006003774.1, WP_006040012.1, WP_006060988.1, WP_006071458.1,
WP_006103819.1, WP_006114887.1, WP_006116158.1, WP_006165225.1, WP_006165798.1,
WP_006188476.1, WP_006194034.1, WP_006248102.1, WP_006250667.1, WP_006252733.1,
WP_006283988.1, WP_006288912.1, WP_006290255.1, WP_006291904.1, WP_006302701.1,
WP_006305876.1, WP_006320565.1, WP_006344761.1, WP_006354666.1, WP_006361705.1,
WP_006421768.1, WP_006432253.1, WP_006442421.1, WP_006475676.1, WP_006489322.1,
WP_006504184.1, WP_006508676.1, WP_006521013.1, WP_006521531.1, WP_006529642.1,
WP_006543631.1, WP_006555931.1, WP_006565553.1, WP_006569795.1, WP_006584176.1,
WP_006591777.1, WP_006599004.1, WP_006673620.1, WP_006676313.1, WP_006689762.1,
WP_006693575.1, WP_006695541.1, WP_006697087.1, WP_006736328.1, WP_006782617.1,
WP_006786408.1, WP_006788404.1, WP_006852984.1, WP_006860501.1, WP_006903554.1,
WP_006915304.1, WP_006928015.1, WP_006966952.1, WP_006986815.1, WP_007000523.1,
WP_007002118.1, WP_007039822.1, WP_007043771.1, WP_007131592.1, WP_007132951.1,
WP_007188930.1, WP_007203218.1, WP_007220334.1, WP_007222606.1, WP_007249159.1,
WP_007282373.1, WP_007285548.1, WP_007310315.1, WP_007348310.1, WP_007358163.1,
WP_007363022.1, WP_007364801.1, WP_007366427.1, WP_007427676.1, WP_007441153.1,
WP_007465277.1, WP_007473122.1, WP_007481209.1, WP_007497428.1, WP_007502660.1,
WP_007502707.1, WP_007525095.1, WP_007546053.1, WP_007575137.1, WP_007594600.1,
WP_007653600.1, WP_007708670.1, WP_007736479.1, WP_007742639.1, WP_007778800.1,
WP_007781428.1, WP_007791481.1, WP_007863421.1, WP_007982332.1, WP_008086256.1,
WP_008087910.1, WP_008090744.1, WP_008094402.1, WP_008164960.1, WP_008210195.1,
WP_008248777.1, WP_008274385.1, WP_008286675.1, WP_008286998.1, WP_008314377.1,
WP_008320683.1, WP_008324575.1, WP_008336138.1, WP_008354169.1, WP_008391432.1,
WP_008395459.1, WP_008398606.1, WP_008401180.1, WP_008410781.1, WP_008437586.1,
WP_008444866.1, WP_008462586.1, WP_008473514.1, WP_008494660.1, WP_008512434.1,
WP_008519405.1, WP_008523303.1, WP_008534584.1, WP_008538510.1, WP_008565746.1,

TABLE 28-continued

Cas3 polypeptide accession numbers
(the sequene identifier for each accession number, in the
order provided in Table 28, is SEQ ID NOs: 11529-15493).

WP_008572450.1, WP_008576910.1, WP_008592329.1, WP_008661066.1, WP_008664693.1,
WP_008675258.1, WP_008686022.1, WP_008687425.1, WP_008694963.1, WP_008709256.1,
WP_008712394.1, WP_008718030.1, WP_008768971.1, WP_008800823.1, WP_008801717.1,
WP_008847070.1, WP_008870464.1, WP_008902369.1, WP_008903299.1, WP_008906511.1,
WP_008908199.1, WP_008910043.1, WP_008932536.1, WP_008976787.1, WP_009002347.1,
WP_009035931.1, WP_009052108.1, WP_009054238.1, WP_009056605.1, WP_009056651.1,
WP_009062292.1, WP_009070156.1, WP_009078987.1, WP_009109521.1, WP_009117239.1,
WP_009117695.1, WP_009128505.1, WP_009143226.1, WP_009151518.1, WP_009164672.1,
WP_009164687.1, WP_009171794.1, WP_009180735.1, WP_009186590.1, WP_009194073.1,
WP_009200364.1, WP_009219478.1, WP_009220014.1, WP_009245305.1, WP_009247872.1,
WP_009255684.1, WP_009264823.1, WP_009274449.1, WP_009285143.1, WP_009290821.1,
WP_009299152.1, WP_009303809.1, WP_009304156.1, WP_009308516.1, WP_009311469.1,
WP_009317888.1, WP_009344901.1, WP_009361657.1, WP_009369775.1, WP_009371073.1,
WP_009427624.1, WP_009432992.1, WP_009441729.1, WP_009449141.1, WP_009495564.1,
WP_009501852.1, WP_009524580.1, WP_009528184.1, WP_009528498.1, WP_009531650.1,
WP_009533379.1, WP_009557947.1, WP_009578428.1, WP_009605938.1, WP_009643690.1,
WP_009646961.1, WP_009663617.1, WP_009667967.1, WP_009681865.1, WP_009742518.1,
WP_009743820.1, WP_009752219.1, WP_009755575.1, WP_009796703.1, WP_009804182.1,
WP_009832552.1, WP_009838675.1, WP_009856768.1, WP_009886020.1, WP_009887252.1,
WP_009891526.1, WP_009893604.1, WP_009893752.1, WP_009894922.1, WP_009897635.1,
WP_009898075.1, WP_009899276.1, WP_009903197.1, WP_009903367.1, WP_009905915.1,
WP_009925356.1, WP_009984824.1, WP_009985561.1, WP_009988399.1, WP_009991629.1,
WP_009996237.1, WP_010033566.1, WP_010064751.1, WP_010075382.1, WP_010076567.1,
WP_010109762.1, WP_010129883.1, WP_010174191.1, WP_010175117.1, WP_010197096.1,
WP_010214280.1, WP_010236953.1, WP_010255759.1, WP_010258238.1, WP_010260000.1,
WP_010289123.1, WP_010310345.1, WP_010346271.1, WP_010372421.1, WP_010381913.1,
WP_010413199.1, WP_010472238.1, WP_010479715.1, WP_010502804.1, WP_010528948.1,
WP_010543174.1, WP_010543771.1, WP_010571031.1, WP_010588738.1, WP_010600771.1,
WP_010619184.1, WP_010621280.1, WP_010626366.1, WP_010636398.1, WP_010679155.1,
WP_010680295.1, WP_010747303.1, WP_010761587.1, WP_010766148.1, WP_010794551.1,
WP_010868096.1, WP_010868140.1, WP_010869875.1, WP_010869882.1, WP_010877585.1,
WP_010879367.1, WP_010885008.1, WP_010923377.1, WP_010923405.1, WP_010923716.1,
WP_010932807.1, WP_010933627.1, WP_010935668.1, WP_010956474.1, WP_010959999.1,
WP_010960245.1, WP_010977965.1, WP_010980735.1, WP_011007011.1, WP_011007099.1,
WP_011011760.1, WP_011026652.1, WP_011099382.1, WP_011099682.1, WP_011134779.1,
WP_011153018.1, WP_011174432.1, WP_011176706.1, WP_011194444.1, WP_011194797.1,
WP_011200168.1, WP_011202915.1, WP_011210963.1, WP_011218326.1, WP_011221974.1,
WP_011222269.1, WP_011229077.1, WP_011237673.1, WP_011249405.1, WP_011249476.1,
WP_011257747.1, WP_011273277.1, WP_011309890.1, WP_011345041.1, WP_011358027.1,
WP_011388093.1, WP_011388583.1, WP_011392035.1, WP_011396660.1, WP_011406530.1,
WP_011407656.1, WP_011437724.1, WP_011460583.1, WP_011478968.1, WP_011525937.1,
WP_011529388.1, WP_011556939.1, WP_011557183.1, WP_011606664.1, WP_011639918.1,
WP_011641886.1, WP_011669569.1, WP_011671997.1, WP_011695828.1, WP_011722694.1,
WP_011743511.1, WP_011745280.1, WP_011753016.1, WP_011787402.1, WP_011797000.1,
WP_011822229.1, WP_011833222.1, WP_011838628.1, WP_011861556.1, WP_011861769.1,
WP_011868532.1, WP_011876920.1, WP_011877366.1, WP_011900615.1, WP_011914753.1,
WP_011915923.1, WP_011917896.1, WP_011942508.1, WP_011943626.1, WP_011955426.1,
WP_011956604.1, WP_011959010.1, WP_011972045.1, WP_011973779.1, WP_011994105.1,
WP_012002254.1, WP_012019694.1, WP_012021089.1, WP_012033072.1, WP_012033150.1,
WP_012062877.1, WP_012063328.1, WP_012073021.1, WP_012076828.1, WP_012094489.1,
WP_012108277.1, WP_012119548.1, WP_012121776.1, WP_012123278.1, WP_012139909.1,
WP_012164219.1, WP_012182158.1, WP_012186568.1, WP_012192596.1, WP_012209663.1,
WP_012212137.1, WP_012222313.1, WP_012226058.1, WP_012241780.1, WP_012255980.1,
WP_012258801.1, WP_012266054.1, WP_012268883.1, WP_012281431.1, WP_012281751.1,
WP_012302386.1, WP_012307383.1, WP_012309086.1, WP_012346192.1, WP_012350349.1,
WP_012350483.1, WP_012369059.1, WP_012446056.1, WP_012458647.1, WP_012459384.1,
WP_012470527.1, WP_012475527.1, WP_012500271.1, WP_012505973.1, WP_012524841.1,
WP_012538566.1, WP_012539200.1, WP_012544994.1, WP_012545630.1, WP_012547526.1,
WP_012547914.1, WP_012553115.1, WP_012574446.1, WP_012580505.1, WP_012582994.1,
WP_012585432.1, WP_012613089.1, WP_012615874.1, WP_012616459.1, WP_012618239.1,
WP_012624554.1, WP_012632151.1, WP_012641435.1, WP_012660064.1, WP_012662915.1,
WP_012673502.1, WP_012673588.1, WP_012701710.1, WP_012710929.1, WP_012710965.1,
WP_012713195.1, WP_012715850.1, WP_012717741.1, WP_012718681.1, WP_012735794.1,
WP_012743321.1, WP_012752544.1, WP_012768670.1, WP_012771277.1, WP_012796572.1,
WP_012808608.1, WP_012817716.1, WP_012823708.1, WP_012844136.1, WP_012851311.1,
WP_012851857.1, WP_012853015.1, WP_012856696.1, WP_012876354.1, WP_012902380.1,
WP_012917355.1, WP_012930468.1, WP_012938133.1, WP_012952594.1, WP_012955598.1,
WP_012963881.1, WP_012966344.1, WP_012980756.1, WP_012980763.1, WP_012984526.1,
WP_012991061.1, WP_013007279.1, WP_013008929.1, WP_013032915.1, WP_013047541.1,
WP_013067031.1, WP_013076646.1, WP_013076657.1, WP_013100592.1, WP_013101295.1,
WP_013104703.1, WP_013113745.1, WP_013120749.1, WP_013121322.1, WP_013129466.1,
WP_013131785.1, WP_013136588.1, WP_013144992.1, WP_013149497.1, WP_013150995.1,
WP_013159711.1, WP_013159789.1, WP_013166743.1, WP_013170929.1, WP_013175511.1,
WP_013175713.1, WP_013178145.1, WP_013179915.1, WP_013205427.1, WP_013227616.1,
WP_013231969.1, WP_013253666.1, WP_013260842.1, WP_013274917.1, WP_013289496.1,
WP_013291510.1, WP_013291735.1, WP_013299027.1, WP_013299107.1, WP_013299173.1,

TABLE 28-continued

Cas3 polypeptide accession numbers
(the sequene identifier for each accession number, in the
order provided in Table 28, is SEQ ID NOs: 11529-15493).

WP_013300570.1, WP_013313190.1, WP_013336789.1, WP_013399553.1, WP_013400578.1,
WP_013401698.1, WP_013404323.1, WP_013405999.1, WP_013410714.1, WP_013411097.1,
WP_013418888.1, WP_013431320.1, WP_013433570.1, WP_013433717.1, WP_013448697.1,
WP_013452029.1, WP_013466747.1, WP_013484592.1, WP_013495974.1, WP_013497831.1,
WP_013502807.1, WP_013518021.1, WP_013538361.1, WP_013548602.1, WP_013554002.1,
WP_013559650.1, WP_013561214.1, WP_013562521.1, WP_013596235.1, WP_013604759.1,
WP_013611555.1, WP_013624562.1, WP_013630169.1, WP_013647395.1, WP_013683461.1,
WP_013704838.1, WP_013705103.1, WP_013708281.1, WP_013720551.1, WP_013720640.1,
WP_013726790.1, WP_013733004.1, WP_013737756.1, WP_013749283.1, WP_013756176.1,
WP_013760345.1, WP_013762951.1, WP_013774551.1, WP_013776535.1, WP_013777983.1,
WP_013781802.1, WP_013789005.1, WP_013809679.1, WP_013809811.1, WP_013815296.1,
WP_013819638.1, WP_013821732.1, WP_013823987.1, WP_013832760.1, WP_013842962.1,
WP_013858608.1, WP_013876766.1, WP_013877551.1, WP_013877756.1, WP_013898837.1,
WP_013902813.1, WP_013905700.1, WP_013905707.1, WP_013906185.1, WP_013906861.1,
WP_013930568.1, WP_013932452.1, WP_013932951.1, WP_013934307.1, WP_013945611.1,
WP_013969349.1, WP_013987426.1, WP_013990633.1, WP_013999400.1, WP_014012310.1,
WP_014016934.1, WP_014025981.1, WP_014026054.1, WP_014026239.1, WP_014030715.1,
WP_014043410.1, WP_014066765.1, WP_014073498.1, WP_014076064.1, WP_014080660.1,
WP_014094597.1, WP_014097199.1, WP_014101083.1, WP_014125373.1, WP_014126170.1,
WP_014127143.1, WP_014147831.1, WP_014161864.1, WP_014162429.1, WP_014220987.1,
WP_014225626.1, WP_014251514.1, WP_014255746.1, WP_014288232.1, WP_014295800.1,
WP_014302523.1, WP_014323745.1, WP_014346689.1, WP_014415275.1, WP_014432862.1,
WP_014474603.1, WP_014484101.1, WP_014511104.1, WP_014511145.1, WP_014511986.1,
WP_014513746.1, WP_014514653.1, WP_014524690.1, WP_014555906.1, WP_014557203.1,
WP_014563206.1, WP_014616405.1, WP_014630466.1, WP_014686562.1, WP_014695809.1,
WP_014696638.1, WP_014702220.1, WP_014702541.1, WP_014707763.1, WP_014731183.1,
WP_014731689.1, WP_014733924.1, WP_014747988.1, WP_014757341.1, WP_014757523.1,
WP_014767243.1, WP_014767799.1, WP_014769137.1, WP_014777595.1, WP_014783120.1,
WP_014788231.1, WP_014789638.1, WP_014807422.1, WP_014826495.1, WP_014840100.1,
WP_014855489.1, WP_014956475.1, WP_014958325.1, WP_014966833.1, WP_015001116.1,
WP_015017879.1, WP_015022440.1, WP_015051480.1, WP_015072146.1, WP_015099449.1,
WP_015123921.1, WP_015155037.1, WP_015159303.1, WP_015164988.1, WP_015189436.1,
WP_015193896.1, WP_015220463.1, WP_015224029.1, WP_015233838.1, WP_015243996.1,
WP_015253163.1, WP_015255923.1, WP_015256022.1, WP_015283989.1, WP_015284324.1,
WP_015286120.1, WP_015286684.1, WP_015290768.1, WP_015293951.1, WP_015312650.1,
WP_015326643.1, WP_015329041.1, WP_015353142.1, WP_015353454.1, WP_015359321.1,
WP_015359551.1, WP_015370998.1, WP_015394874.1, WP_015407304.1, WP_015419282.1,
WP_015419759.1, WP_015425005.1, WP_015432823.1, WP_015439068.1, WP_015450163.1,
WP_015462030.1, WP_015487360.1, WP_015537471.1, WP_015556825.1, WP_015565149.1,
WP_015567040.1, WP_015580742.1, WP_015590843.1, WP_015594792.1, WP_015605258.1,
WP_015691376.1, WP_015717148.1, WP_015724182.1, WP_015738987.1, WP_015759048.1,
WP_015759160.1, WP_015759625.1, WP_015760876.1, WP_015763783.1, WP_015766731.1,
WP_015767810.1, WP_015769052.1, WP_015785746.1, WP_015791970.1, WP_015791977.1,
WP_015817777.1, WP_015836560.1, WP_015847311.1, WP_015849758.1, WP_015858908.1,
WP_015860136.1, WP_015864168.1, WP_015881448.1, WP_015895954.1, WP_015906762.1,
WP_015924972.1, WP_015934178.1, WP_015944883.1, WP_015949643.1, WP_016148217.1,
WP_016175473.1, WP_016188721.1, WP_016207023.1, WP_016217544.1, WP_016264725.1,
WP_016280410.1, WP_016299058.1, WP_016314141.1, WP_016314948.1, WP_016319071.1,
WP_016339464.1, WP_016357732.1, WP_016361153.1, WP_016442351.1, WP_016453852.1,
WP_016460509.1, WP_016478059.1, WP_016487078.1, WP_016510117.1, WP_016510766.1,
WP_016519079.1, WP_016519968.1, WP_016560536.1, WP_016564035.1, WP_016568441.1,
WP_016647301.1, WP_016668942.1, WP_016687507.1, WP_016696748.1, WP_016731280.1,
WP_016731501.1, WP_016731712.1, WP_016732168.1, WP_016732176.1, WP_016732427.1,
WP_016737727.1, WP_016750258.1, WP_016751556.1, WP_016751644.1, WP_016752742.1,
WP_016753856.1, WP_016756796.1, WP_016758536.1, WP_016838858.1, WP_016851257.1,
WP_016915812.1, WP_016922099.1, WP_016994002.1, WP_017116854.1, WP_017119022.1,
WP_017135671.1, WP_017172610.1, WP_017215443.1, WP_017303317.1, WP_017306224.1,
WP_017318860.1, WP_017320064.1, WP_017364196.1, WP_017407429.1, WP_017427970.1,
WP_017429509.1, WP_017448228.1, WP_017463411.1, WP_017470764.1, WP_017539384.1,
WP_017540929.1, WP_017552094.1, WP_017552735.1, WP_017558277.1, WP_017559346.1,
WP_017572806.1, WP_017587082.1, WP_017602138.1, WP_017615956.1, WP_017619212.1,
WP_017622955.1, WP_017637954.1, WP_017690353.1, WP_017717455.1, WP_017740138.1,
WP_017748679.1, WP_017751166.1, WP_017754499.1, WP_017778774.1, WP_017826608.1,
WP_017838894.1, WP_017839476.1, WP_017841804.1, WP_017851557.1, WP_017854157.1,
WP_017854286.1, WP_017857943.1, WP_017860276.1, WP_017861029.1, WP_017863290.1,
WP_017869337.1, WP_017870393.1, WP_017873804.1, WP_017890208.1, WP_017907374.1,
WP_017938168.1, WP_017948473.1, WP_017950340.1, WP_017973756.1, WP_017980956.1,
WP_018033621.1, WP_018034885.1, WP_018060812.1, WP_018086140.1, WP_018106361.1,
WP_018119873.1, WP_018130450.1, WP_018153316.1, WP_018154664.1, WP_018186243.1,
WP_018192946.1, WP_018193691.1, WP_018206664.1, WP_018215904.1, WP_018220085.1,
WP_018223837.1, WP_018230088.1, WP_018252767.1, WP_018255307.1, WP_018258158.1,
WP_018289398.1, WP_018346676.1, WP_018358703.1, WP_018360773.1, WP_018367987.1,
WP_018383064.1, WP_018402825.1, WP_018409882.1, WP_018449896.1, WP_018466793.1,
WP_018466925.1, WP_018490087.1, WP_018493896.1, WP_018501141.1, WP_018508656.1,
WP_018540248.1, WP_018556241.1, WP_018559300.1, WP_018571692.1, WP_018574520.1,
WP_018575259.1, WP_018590885.1, WP_018596860.1, WP_018621542.1, WP_018649506.1,

TABLE 28-continued

Cas3 polypeptide accession numbers
(the sequene identifier for each accession number, in the
order provided in Table 28, is SEQ ID NOs: 11529-15493).

WP_018652887.1, WP_018710328.1, WP_018713225.1, WP_018719629.1, WP_018724540.1,
WP_018732470.1, WP_018734992.1, WP_018737826.1, WP_018740929.1, WP_018758583.1,
WP_018790942.1, WP_018799110.1, WP_018815209.1, WP_018821755.1, WP_018829239.1,
WP_018862901.1, WP_018887429.1, WP_018887587.1, WP_018908951.1, WP_018916771.1,
WP_018920531.1, WP_018963744.1, WP_018964769.1, WP_018969391.1, WP_018979029.1,
WP_018988391.1, WP_018990863.1, WP_018999161.1, WP_019000931.1, WP_019007706.1,
WP_019033984.1, WP_019064969.1, WP_019108546.1, WP_019153453.1, WP_019165691.1,
WP_019184218.1, WP_019273183.1, WP_019338273.1, WP_019358609.1, WP_019397356.1,
WP_019403922.1, WP_019415299.1, WP_019419611.1, WP_019426617.1, WP_019462123.1,
WP_019463219.1, WP_019497303.1, WP_019500469.1, WP_019532635.1, WP_019538393.1,
WP_019540684.1, WP_019543035.1, WP_019551463.1, WP_019555031.1, WP_019586913.1,
WP_019595929.1, WP_019610388.1, WP_019636670.1, WP_019659222.1, WP_019680702.1,
WP_019703285.1, WP_019726858.1, WP_019776147.1, WP_019807552.1, WP_019855133.1,
WP_019910873.1, WP_019912989.1, WP_019950949.1, WP_019960729.1, WP_019968532.1,
WP_019977116.1, WP_019989964.1, WP_019991492.1, WP_020005377.1, WP_020039660.1,
WP_020074382.1, WP_020074665.1, WP_020087242.1, WP_020220936.1, WP_020250593.1,
WP_020253683.1, WP_020265457.1, WP_020305675.1, WP_020305858.1, WP_020310784.1,
WP_020312615.1, WP_020314570.1, WP_020314718.1, WP_020326061.1, WP_020340121.1,
WP_020373620.1, WP_020373820.1, WP_020380337.1, WP_020383873.1, WP_020410295.1,
WP_020448805.1, WP_020493800.1, WP_020506072.1, WP_020530991.1, WP_020537508.1,
WP_020560769.1, WP_020587139.1, WP_020599886.1, WP_020602099.1, WP_020608603.1,
WP_020612862.1, WP_020651075.1, WP_020678825.1, WP_020750859.1, WP_020762501.1,
WP_020765669.1, WP_020765987.1, WP_020774517.1, WP_020779218.1, WP_020779678.1,
WP_020780952.1, WP_020781866.1, WP_020783925.1, WP_020784106.1, WP_020784342.1,
WP_020784475.1, WP_020864067.1, WP_020877258.1, WP_020880186.1, WP_020886855.1,
WP_020985351.1, WP_020993579.1, WP_021022952.1, WP_021052092.1, WP_021085882.1,
WP_021088056.1, WP_021089598.1, WP_021093589.1, WP_021093748.1, WP_021133737.1,
WP_021210211.1, WP_021279370.1, WP_021311726.1, WP_021329089.1, WP_021329905.1,
WP_021331295.1, WP_021359473.1, WP_021359715.1, WP_021360801.1, WP_021361002.1,
WP_021362774.1, WP_021362907.1, WP_021362978.1, WP_021363718.1, WP_021363850.1,
WP_021363926.1, WP_021364750.1, WP_021365607.1, WP_021365749.1, WP_021367003.1,
WP_021367925.1, WP_021369762.1, WP_021371378.1, WP_021371446.1, WP_021372124.1,
WP_021372533.1, WP_021373543.1, WP_021373587.1, WP_021376023.1, WP_021376270.1,
WP_021378270.1, WP_021380017.1, WP_021380654.1, WP_021385911.1, WP_021385995.1,
WP_021388087.1, WP_021390231.1, WP_021394445.1, WP_021394986.1, WP_021397103.1,
WP_021398090.1, WP_021398788.1, WP_021401430.1, WP_021401940.1, WP_021402633.1,
WP_021406024.1, WP_021408552.1, WP_021408663.1, WP_021411254.1, WP_021412323.1,
WP_021414455.1, WP_021415812.1, WP_021416873.1, WP_021417289.1, WP_021419388.1,
WP_021421656.1, WP_021422491.1, WP_021422633.1, WP_021422666.1, WP_021422973.1,
WP_021422994.1, WP_021423805.1, WP_021424005.1, WP_021424306.1, WP_021424823.1,
WP_021425615.1, WP_021426566.1, WP_021426790.1, WP_021427109.1, WP_021462178.1,
WP_021604024.1, WP_021610629.1, WP_021615272.1, WP_021615580.1, WP_021623242.1,
WP_021625637.1, WP_021637099.1, WP_021640897.1, WP_021654353.1, WP_021659783.1,
WP_021662697.1, WP_021663530.1, WP_021665805.1, WP_021666375.1, WP_021673650.1,
WP_021676128.1, WP_021677807.1, WP_021679319.1, WP_021685843.1, WP_021687361.1,
WP_021751292.1, WP_021761190.1, WP_021816692.1, WP_021823925.1, WP_021825208.1,
WP_021836920.1, WP_021856107.1, WP_021869885.1, WP_021875389.1, WP_021932608.1,
WP_021958974.1, WP_021988549.1, WP_022009882.1, WP_022033205.1, WP_022033510.1,
WP_022046300.1, WP_022048651.1, WP_022051789.1, WP_022051847.1, WP_022069845.1,
WP_022070969.1, WP_022071459.1, WP_022103208.1, WP_022108012.1, WP_022119726.1,
WP_022127775.1, WP_022143367.1, WP_022161369.1, WP_022169014.1, WP_022176830.1,
WP_022177040.1, WP_022228625.1, WP_022228951.1, WP_022232568.1, WP_022240071.1,
WP_022248003.1, WP_022257409.1, WP_022264212.1, WP_022271469.1, WP_022272153.1,
WP_022282399.1, WP_022286809.1, WP_022298984.1, WP_022302638.1, WP_022343366.1,
WP_022356881.1, WP_022361840.1, WP_022363354.1, WP_022377859.1, WP_022400167.1,
WP_022402823.1, WP_022410980.1, WP_022424424.1, WP_022431366.1, WP_022444764.1,
WP_022445689.1, WP_022475431.1, WP_022477155.1, WP_022484701.1, WP_022486952.1,
WP_022494224.1, WP_022498152.1, WP_022502228.1, WP_022507269.1, WP_022530081.1,
WP_022588386.1, WP_022636790.1, WP_022654262.1, WP_022656789.1, WP_022659414.1,
WP_022660216.1, WP_022681043.1, WP_022742456.1, WP_022745994.1, WP_022746617.1,
WP_022748670.1, WP_022786162.1, WP_022799399.1, WP_022803626.1, WP_022803642.1,
WP_022805381.1, WP_022816096.1, WP_022819292.1, WP_022835069.1, WP_022835510.1,
WP_022838084.1, WP_022846699.1, WP_022854085.1, WP_022855921.1, WP_022856085.1,
WP_022856207.1, WP_022861871.1, WP_022926574.1, WP_022937467.1, WP_022947926.1,
WP_022949623.1, WP_023018586.1, WP_023023280.1, WP_023039492.1, WP_023039732.1,
WP_023042241.1, WP_023059996.1, WP_023062929.1, WP_023066170.1, WP_023103416.1,
WP_023104938.1, WP_023233924.1, WP_023389230.1, WP_023396043.1, WP_023438292.1,
WP_023450090.1, WP_023485929.1, WP_023606049.1, WP_023796429.1, WP_023844485.1,
WP_023903632.1, WP_023911235.1, WP_023921142.1, WP_023922811.1, WP_023937046.1,
WP_023945257.1, WP_023988271.1, WP_023991511.1, WP_024025745.1, WP_024075605.1,
WP_024084607.1, WP_024105345.1, WP_024107004.1, WP_024124530.1, WP_024174209.1,
WP_024176794.1, WP_024194483.1, WP_024262709.1, XP_001318132.1, XP_001436424.1,
XP_001606022.2, XP_001938105.1, XP_001945184.2, XP_001994196.1, XP_002059142.1,
XP_002365536.1, XP_002776841.1, XP_003005711.1, XP_003072670.1, XP_003426140.1,
XP_003522431.1, XP_003526886.1, XP_004039973.1, XP_006449459.1, XP_006814937.1,
XP_006815053.1, XP_006817051.1, XP_006856306.1, XP_457875.1, XP_730074.1, YP_000912.1,

TABLE 28-continued

Cas3 polypeptide accession numbers
(the sequene identifier for each accession number, in the
order provided in Table 28, is SEQ ID NOs: 11529-15493).

YP_001030288.1, YP_001038694.1, YP_001039592.1, YP_001040345.1, YP_001088965.2,
YP_001089496.1, YP_001097293.1, YP_001111908.1, YP_001112362.1, YP_001153360.1,
YP_001174210.1, YP_001179154.1, YP_001181165.2, YP_001189243.1, YP_001191226.1,
YP_001212466.1, YP_001212544.1, YP_001234935.1, YP_001244674.1, YP_001275021.1,
YP_001276207.1, YP_001278623.1, YP_001319498.1, YP_001320011.1, YP_001322754.1,
YP_001325259.1, YP_001344579.1, YP_001375291.1, YP_001405995.1, YP_001410447.1,
YP_001431136.1, YP_001433370.1, YP_001435721.1, YP_001466976.1, YP_001469837.1,
YP_001518170.1, YP_001536847.1, YP_001541339.1, YP_001547835.1, YP_001568889.1,
YP_001577840.1, YP_001600362.1, YP_001602455.1, YP_001619825.1, YP_001633713.1,
YP_001636537.1, YP_001658093.1, YP_001663919.1, YP_001664134.1, YP_001678811.1,
YP_001679135.1, YP_001717433.1, YP_001735016.1, YP_001736872.1, YP_001741353.1,
YP_001752667.1, YP_001790195.1, YP_001794375.1, YP_001794510.1, YP_001812651.1,
YP_001915497.1, YP_001930079.1, YP_001930861.1, YP_001952714.1, YP_001960544.1,
YP_001974440.1, YP_001996634.1, YP_002016087.1, YP_002133143.1, YP_002222467.1,
YP_002223269.1, YP_002248912.1, YP_002249826.1, YP_002249951.1, YP_002250045.1,
YP_002274839.1, YP_002276019.1, YP_002315132.1, YP_002335720.1, YP_002352523.1,
YP_002355864.1, YP_002434074.1, YP_002436382.1, YP_002460384.1, YP_002461944.1,
YP_002462531.1, YP_002466643.1, YP_002479507.1, YP_002491198.1, YP_002495133.1,
YP_002505810.1, YP_002521277.1, YP_002567843.1, YP_002570898.1, YP_002572056.1,
YP_002601830.1, YP_002728806.1, YP_002728847.1, YP_002753899.1, YP_002800301.1,
YP_002828959.1, YP_002828996.1, YP_002831443.1, YP_002836974.1, YP_002841056.1,
YP_002842902.1, YP_002842939.1, YP_002887334.1, YP_002914192.1, YP_002938362.1,
YP_002950000.1, YP_002952812.1, YP_002959660.1, YP_002962709.1, YP_002994890.1,
YP_003003270.1, YP_003006844.1, YP_003014461.1, YP_003021066.1, YP_003074490.1,
YP_003128737.1, YP_003128744.1, YP_003133258.1, YP_003135792.1, YP_003163695.1,
YP_003167469.1, YP_003168564.1, YP_003178648.1, YP_003179541.1, YP_003182332.1,
YP_003192984.1, YP_003193099.1, YP_003193578.1, YP_003215317.1, YP_003215784.1,
YP_003215962.1, YP_003218826.1, YP_003219291.1, YP_003219469.1, YP_003227008.1,
YP_003238960.1, YP_003255753.1, YP_003262719.1, YP_003290913.1, YP_003298565.1,
YP_003299111.1, YP_003300269.1, YP_003303967.1, YP_003324145.1, YP_003361059.1,
YP_003377356.1, YP_003390779.1, YP_003398459.1, YP_003419021.1, YP_003423539.1,
YP_003432902.1, YP_003436280.1, YP_003458583.1, YP_003458590.1, YP_003463071.1,
YP_003472781.1, YP_003495787.1, YP_003497448.1, YP_003527436.1, YP_003533667.1,
YP_003552999.1, YP_003577459.1, YP_003590507.1, YP_003590518.1, YP_003616811.1,
YP_003618264.1, YP_003623186.1, YP_003633521.1, YP_003640640.1, YP_003641229.1,
YP_003650025.1, YP_003652145.1, YP_003656950.1, YP_003671009.1, YP_003675822.1,
YP_003677873.1, YP_003686705.1, YP_003686819.1, YP_003693858.1, YP_003698062.1,
YP_003702674.1, YP_003702876.1, YP_003705320.1, YP_003707160.1, YP_003744986.1,
YP_003767963.1, YP_003773133.1, YP_003802796.1, YP_003810000.1, YP_003824488.1,
YP_003839475.1, YP_003841502.1, YP_003842362.1, YP_003843808.1, YP_003853155.1,
YP_003853236.1, YP_003853340.1, YP_003854738.1, YP_003873622.1, YP_003902115.1,
YP_003905210.1, YP_003985774.1, YP_003988876.1, YP_003990719.1, YP_003993554.1,
YP_003995275.1, YP_004001414.1, YP_004001482.1, YP_004011583.1, YP_004025071.1,
YP_004027468.1, YP_004027620.1, YP_004048353.1, YP_004051983.1, YP_004070672.1,
YP_004090953.1, YP_004102398.1, YP_004104288.1, YP_004109423.1, YP_004125789.1,
YP_004152217.1, YP_004162601.1, YP_004168058.1, YP_004173862.1, YP_004175469.1,
YP_004176781.1, YP_004185145.1, YP_004194932.1, YP_004202420.1, YP_004236326.1,
YP_004245099.1, YP_004252517.1, YP_004265693.1, YP_004271474.1, YP_004271715.1,
YP_004294513.1, YP_004341504.1, YP_004368903.1, YP_004369171.1, YP_004372353.1,
YP_004385354.1, YP_004385446.1, YP_004397285.1, YP_004440944.1, YP_004409742.1,
YP_004414390.1, YP_004424737.1, YP_004437582.1, YP_004442024.1, YP_004445260.1,
YP_004456924.1, YP_004458918.1, YP_004460367.1, YP_004464197.1, YP_004471951.1,
YP_004496338.1, YP_004496527.1, YP_004509027.1, YP_004513908.1, YP_004516018.1,
YP_004518278.1, YP_004534213.1, YP_004546496.1, YP_004568096.1, YP_004587626.1,
YP_004589470.1, YP_004603180.1, YP_004616620.1, YP_004620601.1, YP_004623915.1,
YP_004623922.1, YP_004624401.1, YP_004625078.1, YP_004658416.1, YP_004660329.1,
YP_004660839.1, YP_004662202.1, YP_004673776.1, YP_004698567.1, YP_004720451.1,
YP_004727889.1, YP_004742713.1, YP_004762303.1, YP_004767040.1, YP_004771203.1,
YP_004780556.1, YP_004780629.1, YP_004780814.1, YP_004785823.1, YP_004799949.1,
YP_004821230.1, YP_004824915.1, YP_004832232.1, YP_004834870.1, YP_004839586.1,
YP_004857063.1, YP_004859900.1, YP_004863862.1, YP_004887497.1, YP_004891993.1,
YP_004892966.1, YP_004916629.1, YP_004931732.1, YP_004932103.1, YP_004934107.1,
YP_004957573.1, YP_005010478.1, YP_005015167.1, YP_005042767.1, YP_005071108.1,
YP_005084656.1, YP_005096026.1, YP_005126356.1, YP_005136892.1, YP_005147303.1,
YP_005169124.1, YP_005258417.1, YP_005259779.1, YP_005321311.1, YP_005441521.1,
YP_005511920.1, YP_005533892.1, YP_005554087.1, YP_005583248.1, YP_005641608.1,
YP_005641654.1, YP_005644061.1, YP_005644986.1, YP_005648064.1, YP_005653361.1,
YP_005668366.1, YP_005689401.1, YP_005704009.1, YP_005839933.1, YP_005841506.1,
YP_005849755.1, YP_005964505.1, YP_005989327.1, YP_006028920.1, YP_006046612.1,
YP_006047121.1, YP_006059768.1, YP_006068309.1, YP_006115.1, YP_006196970.1,
YP_006199527.1, YP_006199998.1, YP_006200194.1, YP_006250064.1, YP_006262541.1,
YP_006271827.1, YP_006272774.1, YP_006285894.1, YP_006287661.1, YP_006297047.1,
YP_006346527.1, YP_006347177.1, YP_006351427.1, YP_006354473.1, YP_006373981.1,
YP_006391019.1, YP_006391208.1, YP_006401917.1, YP_006402478.1, YP_006403833.1,
YP_006413235.1, YP_006418886.1, YP_006424384.1, YP_006425801.1, YP_006444522.1,
YP_006465820.1, YP_006491721.1, YP_006501931.1, YP_006527066.1, YP_006552217.1,

TABLE 28-continued

Cas3 polypeptide accession numbers
(the sequene identifier for each accession number, in the
order provided in Table 28, is SEQ ID NOs: 11529-15493).

YP_006655417.1, YP_006680971.1, YP_006692471.1, YP_006720032.1, YP_006759829.1,
YP_006761820.1, YP_006787543.1, YP_006831248.1, YP_006845020.1, YP_006860989.1,
YP_006865570.1, YP_006887325.1, YP_006921117.1, YP_006930948.1, YP_006982631.1,
YP_007036209.1, YP_007060920.1, YP_007092359.1, YP_007096666.1, YP_007102450.1,
YP_007128726.1, YP_007133194.1, YP_007162784.1, YP_007166365.1, YP_007177325.1,
YP_007179027.1, YP_007200506.1, YP_007211394.1, YP_007214186.1, YP_007214288.1,
YP_007247532.1, YP_007247867.1, YP_007249664.1, YP_007250229.1, YP_007265296.1,
YP_007269509.1, YP_007296335.1, YP_007299922.1, YP_007315011.1, YP_007318532.1,
YP_007364573.1, YP_007364885.1, YP_007373247.1, YP_007373481.1, YP_007393663.1,
YP_007457819.1, YP_007484342.1, YP_007500039.1, YP_007500529.1, YP_007548476.1,
YP_007555209.1, YP_007593343.1, YP_007629877.1, YP_007638256.1, YP_007647093.1,
YP_007647586.1, YP_007652558.1, YP_007666165.1, YP_007669047.1, YP_007679667.1,
YP_007679887.1, YP_007682879.1, YP_007688876.1, YP_007773719.1, YP_007800216.1,
YP_007827924.1, YP_007837791.1, YP_007839945.1, YP_007841644.1, YP_007864862.1,
YP_007872240.1, YP_007884170.1, YP_007894111.1, YP_007899160.1, YP_007907238.1,
YP_007923449.1, YP_007944037.1, YP_007947099.1, YP_008018527.1, YP_008071635.1,
YP_008074473.1, YP_008095151.1, YP_008140886.1, YP_008142101.1, YP_008219478.1,
YP_008221977.1, YP_008233404.1, YP_008282084.1, YP_008299750.1, YP_008339180.1,
YP_008428006.1, YP_008462068.1, YP_008618774.1, YP_008675016.1, YP_008675506.1,
YP_008698878.1, YP_008773532.1, YP_008797472.1, YP_008874109.1, YP_008899634.1,
YP_008911631.1, YP_008915221.1, YP_008932958.1, YP_009169.1, YP_074138.1,
YP_074493.1, YP_088183.1, YP_099831.1, YP_113419.1, YP_120643.1, YP_129811.1, YP_133639.1,
YP_134130.1, YP_145469.1, YP_158879.1, YP_182863.1, YP_182934.1, YP_199511.1, YP_250429.1,
YP_289652.1, YP_306590.1, YP_308462.1, YP_375198.1, YP_395104.1, YP_425432.1, YP_425916.1,
YP_429371.1, YP_434016.1, YP_447466.1, YP_447974.1, YP_449827.1, YP_479140.1, YP_482427.1,
YP_518999.1, YP_544712.1, YP_594137.1, YP_603711.1, YP_635133.1, YP_635377.1, YP_715739.1,
YP_745202.1, YP_753181.1, YP_755177.1, YP_797168.1, YP_801657.1, YP_843071.1, YP_878706.1,
YP_910049.1, YP_911888.1, YP_920754.1, YP_961177.1, and/or YP_972287.1

Thus, in some embodiments, a recombinant nucleic acid molecule of this invention comprising a nucleotide sequence encoding a subset of CRISPR-Cas polypeptides, or functional fragments thereof, from a type I CRISPR-Cas system can comprise, consist essentially of, or consist of a nucleotide sequence encoding three or more polypeptides having the GenBank accession numbers set forth above, or any other type I CRISPR-Cas polypeptide.

In another aspect, the present invention provides a recombinant CRISPR array comprising, consisting essentially of, or consisting of two or more repeat nucleotide sequences, or portion thereof, and one or more spacer nucleotide sequence(s), wherein each spacer nucleotide sequence in said CRISPR array is linked at its 5' end and at its 3' end to a repeat nucleotide sequence. Accordingly, the repeat nucleotide sequences and spacer nucleotide sequences of the CRISPR array alternate with each other, e.g., 5' to 3', repeat, spacer, repeat, and the like.

A recombinant CRISPR array of the invention can be of any length and comprise any number of spacer nucleotide sequences alternating with repeat nucleotide sequences, as described above, necessary to achieve the desired level of repression of expression (e.g., repression of transcription) of one or more target genes. In some embodiments, a CRISPR array can comprise, consist essentially of, or consist of 1 to about 100 spacer nucleotide sequences, each linked on its 5' end and its 3' end to a repeat nucleotide sequence. Thus, in some embodiments, a recombinant CRISPR array of the invention can comprise, consist essentially of, or consist of 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, or more, spacer nucleotide sequences.

A repeat nucleotide sequence of a CRISPR array of the invention can comprise, consist essentially of, or consist of a nucleotide sequence of any known repeat nucleotide sequence of a type-I CRISPR cas system. As described herein, a repeat nucleotide sequence can also be of a synthetic design comprising the secondary structure of a native repeat from a type-I CRISPR cas system (e.g., an internal hairpin). In some embodiments, a repeat nucleotide sequence of the recombinant CRISPR array of the invention can comprise, consist essentially of, or consist of a nucleotide sequence of SEQ ID NOs:59-249.

In some embodiments, the at least one spacer nucleotide sequence can be linked at its 3' end to a repeat sequence and linked at its 5' end to about 1 to about 8, about 1 to about 10, about 1 to about 15 nucleotides from the 3' end of a repeat nucleotide sequence (e.g., a portion of a repeat nucleotide sequence). In other embodiments, the at least one spacer nucleotide sequence can be linked at its 5' end to about 2 to about 6, or about 2 to about 4 nucleotides from the 3' end of a repeat nucleotide sequence.

In representative embodiments, the recombinant CRISPER array comprises two or more (e.g., 2, 3, 4, 5, 6, 7, 8, 9, 10, or more, as described herein) spacer nucleotide sequences, each spacer nucleotide sequence flanked on its 3' and its 5' end by a repeat nucleotide sequence, and the at least two of the two or more spacer nucleotide sequences of said recombinant CRISPR array can each comprise a nucleotide sequence that is complementary to a different target nucleotide sequence from a single target gene (e.g., a different region of the same target gene). By targeting at least two different regions of a single target gene, a CRISPR array can be used to modify repression (e.g., increase or decrease the level of repression) of the expression of said target gene. More specifically, a CRISPR array having multiple spacer nucleotide sequences each of which are complementary to a different non-overlapping target nucleotide sequence from a single gene, can provide stronger/ increased repression of expression of that target gene as compared with a CRISPR array having comparatively fewer spacer nucleotide sequences each of which are complementary to different target nucleotide sequences from a single target gene. The level of transcription repression can be further modified by designing a CRISPR array having spacer nucleotide sequences that are complementary to overlapping target nucleotide sequences within the same target gene. Overlapping spacer nucleotide sequences that are complementary to overlapping target nucleotide sequences within the same target gene can result in reduced repression of expression of that target gene as compared to a CRISPR array in which the spacer nucleotide sequences are complementary to different target nucleotide sequences within the same target gene but which said target nucleotide sequences do not overlap. That is, such overlapping spacer sequences have a reduced effect on repression of expression than spacer sequences that do not overlap. Without wishing to be bound to any particular theory it is believed that the overlapping sequences compete with one another, thereby reducing the level of repression as compared with non-overlapping sequences In addition to targeting different locations/regions on a single gene to modulate the repression of that gene, the length of the spacer or its complementarity to the target nucleotide sequence can be altered to modulate repression. Thus, for example, shorter spacers or a spacer with less complementarity to a target nucleotide sequence will typically result in reduced repression as compared a longer spacer and/or a spacer with greater complementarity to a target nucleotide sequence, respectively.

Accordingly, in some embodiments, repression by a spacer can be increased by adding one or more nucleotides to the length of said spacer, said spacer resulting in increased repression when used with the recombinant nucleic acids of the invention as compared with the same spacer but without the additional nucleotides. In some embodiments, the length of the spacer can be increased by one to about 100 nucleotides, and/or any range or value therein (e.g., 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 35, 40, 45, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, or more). In representative embodiments, the length of the spacer can be increased by about 1 to about 40, about 5 to about 30, 10 to about 30, about 20 to about 30 nucleotides. In other embodiments, the length of the spacer can be increased by about 6 nucleotides, about 8 nucleotides, about 10 nucleotides, about 12 nucleotides, about 18 nucleotides, about 24 nucleotides, and the like.

In further embodiments, repression by a spacer can be decreased by reducing the length of said spacer by one or more nucleotides, said spacer resulting in decreased repression when used with the recombinant nucleic acids of the invention as compared with the same spacer but without a reduced number of nucleotides. Accordingly, in some embodiments, repression by a spacer can be decreased by decreasing the length of the spacer by 1 to about 100 nucleotides, and any range or value therein. In representative embodiments, the length of the spacer can be decreased by about 1 to about 40, about 5 to about 30, 10 to about 30, about 20 to about 30 nucleotides. In other embodiments, the length of the spacer can be decreased by about 6 nucleotides, about 8 nucleotides, about 10 nucleotides, about 12 nucleotides, about 18 nucleotides, about 24 nucleotides, and the like.

In further aspects, a spacer sequence of a CRISPR array of the invention can be complementary to a target nucleotide sequence that is from a coding strand or a plus (top) strand and/or from a non-coding strand or a minus (bottom) strand of a double stranded target gene. As demonstrated herein, designing a recombinant CRISPR array to include spacers targeting a coding/plus strand rather than a non-coding/minus strand, and vice versa, provides further modulation of repression with targeting of coding/plus strands providing increased or greater repression as compared to targeting of non-coding/minus strands of the same target gene.

These variations of a spacer nucleotide sequence of a CRISPR array construct as described herein and other variations are possible and can be used to repress or modify repression of expression of a target gene. Any combination of the types of spacers described herein as well as other types of spacers can be used alone or in any combination for repressing expression or modulating the repression of expression of a target gene.

Thus, as is clear, the above described and other variations in CRISPR array design can be used to achieve a desired level of repression of expression of a target gene.

In other embodiments, a recombinant CRISPR array can be designed to comprise, consist essentially of, consist of at least two spacer nucleotide sequences each of which comprise a nucleotide sequence that is complementary to a different target nucleotide sequence from a different target gene, thereby achieving repression of expression of different target genes using a single CRISPR array. Alternatively, different genes can be targeted for repression of expression using two or more recombinant CRISPR arrays.

As would be readily understood, various recombinant CRISPR array designs can be constructed and introduced into a cell or an organism in single or in multiple recombinant CRISPR array constructs for use in repressing and/or modulating the expression of one or more target genes in said cell or organism. Thus, for example, various combinations of different types of spacer nucleotide sequences, as described herein, can be introduced on a single recombinant CRISPR array such that expression of one or more target genes can be repressed and/or modulated. Alternatively, in other embodiments, various spacer nucleotide sequences can be introduced on two or more recombinant CRISPR arrays for repressing or modulating expression of one or more target genes.

In some embodiments, a spacer nucleotide sequence of the recombinant CRISPR array of the invention can be fully identical to or substantially identical to a target nucleotide sequence, or complement thereof, from a target gene. In particular embodiments, the one or more spacer nucleotide sequence(s) can have at least about 50% identity to a target nucleotide sequence, or complement thereof. In other embodiments, the one or more spacer nucleotide sequence(s) can have at least about 70% identity to a target nucleotide sequence, or complement thereof. In further embodiments, the one or more spacer nucleotide sequence(s) can have at least about 80% identity to a target nucleotide sequence, or complement thereof. In still further embodiments, the one or more spacer nucleotide sequence(s) can have at least about 85%, 90%, 95%, 96%, 97%, 98%, 99% or 100% identity to a target nucleotide sequence, or complement thereof.

In other aspects of the invention, the target nucleotide sequence and/or the target gene is from a genome, a plasmid, or a plastid of a target organism.

In some embodiments, a target organism can be a eukaryote, a prokaryote or a virus. In other embodiments, a prokaryote includes, but is not limited to, a bacterium or an archaeon. In still other embodiments, a eukaryote includes, but is not limited to, an animal, a mammal, an insect, a plant, a fungus, an insect, a bird, a fish, an amphibian, a reptile, or a cnidarian. In additional embodiments, a mammal can include, but is not limited to, a rodent, a horse, a dog a cat, a human, a non-human primate (e.g., monkeys, baboons, and chimpanzees), a goat, a pig, a cow (e.g., cattle), a sheep, laboratory animals (e.g., rats, mice, gerbils, hamsters, and the like) and the like. Non-limiting examples of birds useful with this invention include chickens, ducks, turkeys, geese, quails and birds kept as pets (e.g., parakeets, parrots, macaws, and the like). Additional embodiments can include, for example, mammalian and insect cell lines. Non-limiting examples of mammalian and insect cell lines include HEK293 cells, HeLa cells, CHO cells, MEF cells, 3T3 cells, Hi-5 cells, and Sf21 cells.

Suitable target organism can include both males and females and subjects of all ages including embryonic (e.g., in utero or in ovo), infant, juvenile, adolescent, adult and geriatric subjects. In embodiments of the invention, the target organism is not a human embryonic subject.

Thus, for example, any bacterium, archaeon, plant, or fungus can be employed in practicing the present invention. In representative embodiments, non-limiting examples of bacteria useful with this invention include *Escherichia* spp., *Salmonella* spp., *Bacillus* spp., *Corynebacterium Clostridium* spp., *Clostridium* spp., *Pseudomonas* spp., *Clostridium* spp., *Lactococcus* spp. *Acinetobacter* spp., *Mycobacterium* spp., *Myxococcus* spp., *Staphylococcus* spp., *Streptococcus* spp., or cyanobacteria. In further embodiments, non-limiting examples of bacteria useful with this invention include *Escherichia coli, Salmonella enterica, Bacillus subtilis, Clostridium acetobutylicum, Clostridium ljungdahlii, Clostridium difficile, Acinetobacter baumannii, Mycobacterium tuberculosis, Myxococcus xanthus, Staphylococcus aureus, Streptococcus pyogenes*, or cyanobacteria. Further non-limiting examples of bacteria useful with this invention include lactic acid bacteria including but not limited to *Lactobacillus* spp. and *Bifidobacterium* spp.; electrofuel bacterial strains including but not limited to *Geobacter* spp., *Clostridium* spp., or *Ralstonia eutropha*; or bacteria pathogenic on, for example, plants and mammals. In particular embodiments, the bacterium can be *Escherichia coli*.

Non-limiting examples of such archaea include *Pyrococcus furiosus, Thermus aquaticus, Sulfolobus sulfataricus*, or haloarchaea including but not limited to *Haladaptatus* (e.g., *Haladaptatus paucihalophilus*), *Halalkalicoccus* (e.g., *Halalkalicoccus tibetensis*), *Halobaculum* (e.g., *Halobaculum gomorrense*), *Halobellus* (e.g., *Halobellus clavatus*), *Halomicrobium* (e.g., *Halomicrobium mukohataei*), *Natrialba* (e.g., *Natrialba asiatica*), *Natrinema* (e.g., *Natrinema pellirubrum*), *Natronorubrum* (e.g., *Natronorubrum bangense*), *Salarchaeum* (e.g., *Salarchaeum japonicum*)

In some embodiments of this invention, a plant and/or plant cell useful with this invention can include, but not is not limited to, *Camelina, Glycine, Sorghum, Brassica, Allium, Armoracia, Poa, Agrostis, Lolium, Festuca, Calamogrostis, Deschampsia, Spinacia, Beta, Pisum, Chenopodium, Helianthus, Pastinaca, Daucus, Retroselium, Populus, Prunus, Castanea, Eucalyptus, Acer, Quercus, Salix, Juglans, Picea, Pinus, Abies, Lemna, Wolffia, Spirodela, Oryza, Zea* or *Gossypium*. In other embodiments, the plant and/or plant cell can include, but is not limited to, *Camelina alyssum* (Mill.) Thell., *Camelina microcarpa* Andrz. ex DC., *Camelina rumelica* Velen., *Camelina sativa* (L.) Crantz, *Sorghum bicolor* (e.g., *Sorghum bicolor* L. Moench), *Gossypium hirsutum, Glycine max, Zea mays, Brassica oleracea, Brassica rapa, Brassica napus, Raphanus sativus, Armoracia rusticana, Allium sative, Allium cepa, Populus grandidentata, Populus tremula, Populus tremuloides, Prunus serotina, Prunus pensylvanica, Castanea dentate, Populus balsamifer, Populus deltoids, Acer Saccharum, Acer nigrum, Acer negundo, Acer rubrum, Acer saccharinum, Acer pseudoplatanus* or *Oryza sativa*. In additional embodiments, a plant and/or plant cell can be, but is not limited to, wheat, barley, oats, turfgrass (bluegrass, bentgrass, ryegrass, fescue), feather reed grass, tufted hair grass, spinach, beets, chard, quinoa, sugar beets, lettuce, sunflower (*Helianthus annuus*), peas (*Pisum sativum*), parsnips (*Pastinaca sativa*), carrots (*Daucus carota*), parsley (*Petroselinum crispum*), duckweed, pine, spruce, fir, *eucalyptus*, oak, walnut, or willow. In particular embodiments, the plant and/or plant cell can be *Arabidopsis thaliana*. In some representative embodiments, the plant and/or plant cell can be *camelina*, wheat, rice, corn, rape, canola, soybean, sorghum, tomato, bamboo, or cotton.

In further embodiments, a plant and/or plant cell can be an algae or algae cell including, but not limited to, a Bacillariophyceae (diatoms), Haptophyceae, Phaeophyceae (brown algae), Rhodophyceae (red algae) or Glaucophyceae (red algae). In still other embodiments, non-limiting examples of an algae or algae cell can be *Achnanthidium, Actinella, Nitzschia, Nupela, Geissleria, Gomphonema, Planothidlum, Halamphora, Psammothidium, Navicula, Eunotia, Stauroneis, Chlamydomonas, Dunaliella, Nannochloris, Nannochloropsis, Scenedesmus, Chlorella, Cyclotella, Amphora, Thalassiosira, Phaeodadylum, Chrysochromulina, Prymnesium, Thalassiosira, Phaeodactylum, Glaucocysts, Cyanophora, Galdieria*, or *Porphyridium*.

Non-limiting examples of fungi useful with this invention include *Candida* spp., *Fusarium* spp., *Aspergillus* spp., *Cryptococcus* spp., *Coccidioides* spp., *Tinea* spp., *Sporothrix* spp., *Blastomyces* spp., *Histoplasma* spp., *Pneumocystis* spp, *Saccharomyces* spp., *Saccharomycodes* spp., *Kluyveromyces* spp., *Pichia* spp., *Candida* spp., *Zygosaccharomyces* spp. or *Hanseniaspora* spp. In representative embodiments, the fungus can include, but is not limited to, *Saccharomyces cerevisiae, S. uvarum (carlsbergensis), S. diastaticus, Saccharomycodes ludwigii, Kluyveromyces marxianus, Pichia pastoris, Candida stellata, C. pulcherrima, Zygosaccharomyces fermentati, Hanseniaspora uvarum, Aspergillus fumigatus, Aspergillus flavus, Aspergillus niger, Aspergillus terreus, Aspergillus nidulans, Candida albicans, Coccidioides immitis, Cryptococcus neoformans, Fusarium solani, Fusarium culmorum, Tinea unguium, Tinea corporis, Tinea cruris, Sporothrix schenckii, Blastomyces dermatitidis, Histoplasma capsulatum, Pneumocystis carinii*, or *Histoplasma duboisii*.

The target gene can be any gene of interest for which there is a desire to repress expression or modulate the repression of expression. Thus, in some embodiments, non-limiting examples of a target gene can include a gene encoding a transcriptional regulator, a translational regulator, a polymerase gene, a metabolic enzyme, a transporter, an RNase, a protease, a DNA replication enzyme, a DNA modifying or degrading enzyme, a regulatory RNA, a transfer RNA, or a ribosomal RNA. A target gene can also be a gene that, for example, is involved in cell-division, cell structure, metabolism, motility, pathogenicity or virulence. In other embodiments, a target gene useful with this invention can also include a hypothetical gene whose function is not yet characterized (see, e.g., Kolker et al. *Nucleic Acids Research* 32(8): 2353-2363 (2004)).

In representative embodiments, a target nucleotide sequence can comprise, consist essentially of or consist of all or a part of a nucleotide sequence encoding a promoter, or a complement thereof, of a target gene. The present inventors have discovered that spacer nucleotide sequences that are complementary to a promoter, or a part thereof, of a target gene achieve substantial gene repression when used as disclosed herein. In particular, it was discovered that substantial gene repression can be achieved with such spacers, regardless of which strand was targeted.

In further aspects, recombinant nucleic acid molecules, recombinant CRISPR arrays, and/or the nucleotide sequences of this invention can be introduced into a cell of a host organism. Any cell/host organism for which this invention is useful with can be used. Exemplary host organisms include, but are not limited to, a plant, bacterium, archaeon, fungus, animal, mammal, insect, bird, fish, amphibian, cnidarian, human, or non-human primate. In further embodiments, a cell useful with this invention can be, but is not limited to a stem cell, somatic cell, germ cell, plant cell, animal cell, bacterial cell, archaeon cell, fungal cell, mammalian cell, insect cell, bird cell, fish cell, amphibian cell, cnidarian cell, human cell, or non-human primate cell. Thus, in some embodiments, a recombinant nucleic acid molecule, recombinant CRISPR array, or a nucleotide sequence of this invention can be introduced into a cell of an organism for which repression of expression or modulation of repression of expression is desirable for target genes in said cell/organism Accordingly, further provided are methods for using the recombinant nucleic acid molecules and CRISPR arrays of this disclosure. Thus, in some embodiments, a method for a repressing the expression (reducing transcription) of a target gene is provided, the method comprising: introducing of an organism (e.g., into a cell) a recombinant nucleic acid molecule of the invention and at least one recombinant CRISPR array of the invention, thereby repressing the expression (reducing the transcription) of said target gene. Varying levels of repression can be achieved according to the methods of this invention. Thus, the extent of repression (e.g., silencing) for any given target gene will depend on the design of the spacers that are targeting the gene of interest (e.g., target gene) including, but not limited to, the number of spacers used to target the gene of interest (multiplexing), the location of the target nucleotide sequence on the target gene to which the spacer has complementarity (including the number of overlapping versus non-overlapping target nucleotide sequences), the length of the spacers and/or the complementarity of each spacer to the target nucleotide sequence of the target gene.

In other embodiments, a method for a repressing the expression (reducing transcription) of a target gene is provided, the method comprising: introducing of an organism (e.g., into a cell of said organism) a recombinant nucleic acid molecule of the invention and at least one recombinant CRISPR array of the invention, wherein the at least one recombinant CRISPR array introduced into the organism comprises at least two spacer nucleotide sequences each comprising a nucleotide sequence that is complementary to a different target nucleotide sequence from a single target gene, thereby modulating the repression of said target gene relative to a recombinant CRISPR array having no spacers directed to said target gene or a CRISPR array that has more or fewer of such spacer nucleotide sequences each comprising a nucleotide sequence that is complementary to a different target nucleotide sequence from a single target gene.

In other embodiments, a CRISPR array having fewer spacer nucleotide sequences that are complementary to a different target nucleotide sequence derived from a single target gene when introduced into an organism or cell can result in reduced or decreased repression as compared to a CRISPR array having more spacer nucleotide sequences that are complementary to a different target nucleotide sequence derived from the same target gene.

In further embodiments, a spacer nucleotide sequence that is less complementary to a target nucleotide sequence derived from a single target gene when introduced into an organism or cell can result in reduced or decreased repression as compared to a spacer nucleotide sequence that has a greater degree of complementarity to the same target nucleotide sequence derived from the same target gene. In still further embodiments, a longer spacer nucleotide sequence complementary to a target nucleotide sequence derived from a single target gene when introduced into an organism or cell can result in increased repression as compared to a shorter spacer nucleotide sequence that is complementary to the same target nucleotide sequence derived from the same target gene.

As the skilled artisan would readily understand, the various spacer nucleotide sequence and CRISPR array designs can be used, alone or in combination with each other and in single or multiple CRISPR arrays, to provide significant flexibility in the amount or level of repression achieved in a single or in multiple target genes. Thus, for example, the total number of spacers, as well as the length of each spacer, location in the target gene, and/or the degree of complementarity can be used, alone or in combination, along with any other spacer/CRISPR array designs to provide a desired level of repression of a target gene.

In still other embodiments, a method for repressing the expression (reducing transcription) of at least two genes in an organism is provided, the method comprising: introducing into an organism a recombinant nucleic acid molecule of the invention and at least one recombinant CRISPR array of the invention, wherein the at least one recombinant CRISPR array comprises at least two spacer nucleotide sequences each comprising a nucleotide sequence that is complementary to a different target nucleotide sequence from a different target gene, thereby repressing the expression of at least two genes in said organism. As would be readily understood by the skilled artisan, any combination of spacer and CRISPR array design described herein and variations thereof can be used to repress the expression and/or modulate the repression of expression of said two genes.

In some embodiments, to design a spacer nucleotide sequence for targeting a genomic sequence, one first identifies a region of the gene of interest (e.g., the target nucleotide sequence) that is adjacent to a set of nucleotide sequences called a protospacer adjacent motif (PAM). This motif is thus found in the target gene next to the region to which a spacer sequence binds as a result of being complementary to that region and identifies the point at which base pairing with the spacer nucleotide sequence begins. For type I systems, the PAM is located immediately 5' to the sequence that matches the spacer, and thus is 3' to the sequence that base pairs with the spacer nucleotide sequence. Non-limiting examples of PAMs include CCA, CCT, CCG, CCT, CCA, TTC, AAG, AGG, ATG, GAG, and/or CC.

In some embodiments, the polypeptides encoded by a recombinant nucleic acid molecule as disclosed herein can be introduced as protein complex. Accordingly, in some embodiments, a protein complex can comprise, consist essentially of, or consist of any subset of a group of polypeptides from a type-I Cascade. In other embodiments, a protein complex can comprise, consist essentially of, or consist of (a) a Cas6b polypeptide, a Cas8b (Csh1) polypeptide, a Cas7 (Csh2) polypeptide and a Cas5d polypeptide (Type I-B); (b) a Cas5 polypeptide, a Cas8c (Csd1) polypeptide, and a Cas7 (Csd2) polypeptide (Type I-C); (c) a Cse1 (CasA) polypeptide, a Cse2 (CasB) polypeptide, a Cas7 (CasC) polypeptide, a Cas5 (CasD) polypeptide and a Cas6e (CasE) polypeptide (Type I-E); (d) a Cys1 polypeptide, a Cys2 polypeptide, a Cas7 (Cys3) polypeptide and a Cas6f polypeptide (Type I-F); (e) a Cas7 (Csa2) polypeptide, a Cas8a1 (Csx13) polypeptide or a Cas8a2 (Csx9) polypeptide, a Cas5 polypeptide, a Csa5 polypeptide, a Cas6a polypeptide, a Cas3' polypeptide, and a Cas3" polypeptide having no nuclease activity (Type I-A); or (f) a Cas10d (Csc3) polypeptide, a Csc2 polypeptide, a Csc1 polypeptide, and a Cas6d polypeptide (Type I-D). Thus, in some embodiments, a protein complex and a CRISPR array are introduced into a cell free system, a cell and/or an organism. In some embodiments, said protein complex and CRISPR array are introduced separately or together as a ribonucleoprotein.

Thus, in further embodiments, a ribonucleoprotein complex comprising, consisting essentially of, or consisting of the protein complex and a CRISPR array of the invention can be introduced into a cell free system, a cell and/or an organism. In some embodiments, the protein complex/ribonucleoprotein complex can be delivered to transiently repress genes, thereby providing further advantageous methods for achieving desired levels of target gene repression.

Accordingly, in still further embodiments, the polypeptide encoded by a recombinant nucleic acid molecule can be delivered as a protein complex, DNA, RNA (e.g., mRNA) or a ribonucleoprotein complex. In some embodiments, the CRISPR array can be delivered as a DNA or an RNA.

In additional aspects, the present invention provides a method of repressing the expression of a bacterium or archaeon target gene, comprising: disrupting an endogenous cas3 nucleotide sequence in a bacterium or archaeon, wherein the disrupted endogenous cas3 nucleotide sequence is not present, or is present but not expressed and/or is expressed but non-functional; and introducing into said bacterium or archaeon at least one recombinant CRISPR array of the invention or an expression cassette or vector comprising at least one recombinant CRISPR array of the invention, thereby repressing the expression of said bacterium or target gene.

In still further aspects, the present invention provides a method of modulating the repression of expression of a bacterium or archaeon target gene, comprising: disrupting an endogenous cas3 nucleotide sequence in a bacterium or archaeon, wherein the disrupted endogenous cas3 nucleotide sequence is not present, or is present but not expressed and/or is expressed but non-functional; and introducing into said bacterium or archaeon at least one recombinant CRISPR array of the invention or an expression cassette or vector comprising at least one recombinant CRISPR array of the invention, wherein the at least one recombinant CRISPR array comprises at least two spacer nucleotide sequences each comprising a nucleotide sequence that is complementary to a different target nucleotide sequence from a single target gene, thereby modulating the repression of said bacterium or archaeon target gene relative to a the same target gene in a bacterium or archaeon that comprises a CRISPR array having no spacers directed to said target gene or a CRISPR array having more or fewer of such spacer nucleotide sequences each comprising a nucleotide sequence that is complementary to a different target nucleotide sequence from a single target gene.

In additional embodiments, the present invention provides a method of repressing the expression of at least two genes of a bacterium or archaeon target gene, comprising: disrupting an endogenous cas3 nucleotide sequence in a bacterium or archaeon, wherein the disrupted endogenous cas3 nucleotide sequence is not present, or is present but not expressed and/or is expressed but non-functional; and introducing into said bacterium or archaeon at least one recombinant CRISPR array of the invention or an expression cassette or vector comprising at least one recombinant CRISPR array of the invention, wherein the at least one recombinant CRISPR array comprises at least two spacer nucleotide sequences each comprising a nucleotide sequence that is complementary to a different target nucleotide sequence from a different target gene, thereby repressing the expression of at least two target genes of said bacterium or archaeon.

In some embodiments, the at least one recombinant CRISPR array of the invention or an expression cassette or vector comprising at least one recombinant CRISPR array of the invention can be introduced into said bacterium or archaeon at the same time as the disrupting of said endogenous cas3 nucleotide sequence. In other embodiments, the at least one recombinant CRISPR array of the invention or an expression cassette or vector comprising at least one recombinant CRISPR array of the invention can be introduced into said bacterium or archaeon after the endogenous cas3 nucleotide sequence is disrupted. In some embodiments, said bacterium or archaeon comprises an endogenous Cascade. In further embodiments, at least one heterologous promoter is introduced into the bacterium or archaeon and operably linked to said endogenous Cascade. In representative embodiments, said heterologous promoter(s) is introduced at the same time as the disrupting of the endogenous cas3 via, for example, homologous recombination.

As used herein, "disrupt", "disrupted," or "disrupting" and/or other grammatical variations, means that the cas3 nucleotide sequence is mutated or otherwise altered such that either the nucleotide sequence encoding the Cas3 protein is absent, or the nucleotide sequence encoding the Cas3 protein is present, but the Cas3 protein is not produced or is produced and is non-functional.

Disruption of the cas3 nucleotide sequence can be accomplished by any method known to those of ordinary skill in the art for altering or mutating a nucleotide sequence. Such methods include, but are not limited to, generating point mutations (e.g., missense, or nonsense, or insertions or deletions of single base pairs that result in frame shifts), insertions, deletions, and/or truncations.

In some embodiments, disruption results in the removal or deletion of the entire cas3 nucleotide sequence, or a portion thereof (e.g., 1% to 99%, or any value or range therein). In representative embodiments, the entire nucleotide sequence encoding the cas3 gene is deleted by, for example, homologous recombination. In particular embodiments, the disruptions can result in premature translational termination, premature transcriptional termination, disruption endonuclease catalytic sites, or mutations that destabilize or prevent proper folding of the protein, wherein no cas3 polypeptide is produced or a non-functional cas3 polypeptide is produced. Methods for mutating or otherwise altering an endogenous gene are well known in the art and can be readily used with the methods of this invention to produce a bacterium or archaeon having no endogenous cas3 polypeptide or a non-functional cas3 polypeptide.

"A non-functional Cas3 polypeptide" as used herein is a Cas3 polypeptide having little or no nuclease activity. Having "little or no nuclease activity" means that the disrupted cas3 polypeptide exhibits about 10% or less activity (e.g., about 10%, 9%, 8%, 7%, 6%, 5%, 4%, 3%, 2%, 1%, or 0%, or any value or range therein) as compared to the wild-type/non-disrupted Cas3 polypeptide. Further, as used herein, a non-functional Cas3 polypeptide has little or no nuclease activity over a wide range of temperatures including from about 10° C. to about 125° C., or any value or range therein. Therefore, a non-functional Cas3 polypeptide as defined herein is a Cas3 polypeptide having little to no activity at a temperature of about 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, and/or 125° C. Accordingly, as one example, a disrupted Cas3 polypeptide of the invention includes a cas3 polypeptide that is active at 30° C. but inactive at 42° C.

A further aspect of the invention relates to kits for use in the methods of the invention. The kit can comprise the recombinant nucleic acid constructs, CRISPR arrays, nucleotide sequences and/or vectors/expression cassettes of the invention in a form suitable for introduction into a cell and/or administration to a subject. The kit can further comprise other therapeutic agents, carriers, buffers, containers, devices for administration, and the like. The kit can further comprise labels and/or instructions for repression of expression a target gene and/or modulation of repression of expression of a target gene. Such labeling and/or instructions can include, for example, information concerning the amount, frequency and method of introduction and/or administration of the recombinant nucleic acid constructs, CRISPR arrays, nucleotide sequences and/or vectors/expression cassettes.

Accordingly, in one aspect, a kit for repressing the expression of at least one target nucleotide sequence is provided, said kit comprising, consisting essentially of, consisting of a recombinant nucleic acid molecule of the invention, a recombinant CRISPR array of the invention and/or an expression cassette or vector comprising said recombinant nucleic acid molecule of the invention and/or a recombinant CRISPR array of the invention.

In some embodiments, a kit is provided for modulating the repression of at least one target gene, the kit comprising, consisting essentially of, consisting of a recombinant nucleic acid molecule of the invention, a recombinant CRISPR array of the invention and/or an expression cassette or vector comprising said recombinant nucleic acid molecule of the invention and/or a recombinant CRISPR array of the invention, wherein the recombinant CRISPR array comprises, consists essentially of, consists of at least two spacer nucleotide sequences each comprising a nucleotide sequence that is complementary to a different target nucleotide sequence from a single target gene.

In additional embodiments, a kit is provided for modulating the repression of at least two target genes, the kit comprising, consisting essentially of, consisting of a recombinant nucleic acid molecule of the invention, a recombinant CRISPR array of the invention and/or an expression cassette or vector comprising said recombinant nucleic acid molecule of the invention and/or a recombinant CRISPR array of the invention, wherein the recombinant CRISPR array comprises, consists essentially of, consists of at least two spacer nucleotide sequences each comprising a nucleotide sequence that is complementary to a different target nucleotide sequence from a different target gene.

In some embodiments, the recombinant nucleic acid molecule and the recombinant CRISPR array of said kits are comprised on a single vector or expression cassette or on separate vectors or expression cassettes. In further embodiments, the kits comprise instructions for use.

The invention will now be described with reference to the following examples. It should be appreciated that these examples are not intended to limit the scope of the claims to the invention, but are rather intended to be exemplary of certain embodiments. Any variations in the exemplified methods that occur to the skilled artisan are intended to fall within the scope of the invention.

EXAMPLES

Example 1. Methods

Using homologous recombination and P1 transduction, the cas3 gene knocked out of the genome of *E. coli* BW25113 as well as the genome of *E. coli* MG1655 and a constitutive promoter placed upstream of the casABCDE operon. This ensured that the Cas3 protein would be completely absent while the Cascade complex (comprised of the five Cas proteins CasA, CasB, CasC, CasD, and CasE) would be constitutively expressed.

Spacers were designed to target a fluorescent reporter plasmid, pUA66lacZ. This plasmid expresses the fluorescent GFP protein under the control of the lacZ promoter. Spacers were designed by locating the PAM (protospacer-adjacent motif) sequence—either AGG or AAG—and selecting the adjacent 30 nucleotides on the 3' end. Spacers were selected to cover different locations of interest, including the promoter, untranslated region, and coding region. Both the coding and non-coding strands of DNA were targeted.

Each spacer was cloned into the expression vector pCRISPR. This vector contains a minimal CRISPR array: a promoter, a single repeat, and a terminator. The vector allows for sequential introduction of spacers so that multiple spacers can be expressed from a single CRISPR array. With a working spacer, Cascade (e.g., the recombinant nucleic acid molecule) was directed to bind to the DNA of pUA66lacZ and reduce the expression level of GFP, thus reducing fluorescence. The plasmids pUA66lacZ and pCRISPR were co-transformed into BW25113Δcas3. Cells harboring a pCRISPR plasmid with the indicated spacer were grown in M9 minimal medium supplemented with 0.4% glycerol and 0.2% casamino acids, back-diluted into the same medium, and grown for 6 hours to mid-log phase. Fluorescence was then measured on an Accuri C6 flow cytometer.

Using flow cytometry, the levels of transcriptional repression were quantified by measuring a reduction in fluorescence. In the absence of any repression, pUA66lacZ yields strong fluorescence.

Spacers were further designed to target the promoters of three endogenous operons responsible for the catabolism of L-arabinose (araBAD), D-xylose (xylAB), and lactose (lacZYA). The transduced MG1655 cells harboring the pCRISPR or the spacer-encoding plasmids were grown for 24 hours in M9 medium supplemented with glycerol, back-diluted to $ABS_{600}$ of 0.001 in M9 medium supplemented with the indicated carbon source, and cultured at 37° C. for 22 hours. The final $ABS_{600}$ value of each culture was then measured using a Nanodrop 2000c spectrophotometer.

Example 2. Data

Shown in FIG. 1 is the region of interest in the plasmid pUA66lacZ that encodes fluorescent GFP polypeptide under control of the lacZ promoter. The long green arrow indicates the coding region of gfp. The thin black arrow indicates the start of transcription with the −35 and −10 elements of the promoter outlined in black. Each spacer on the top matches the top strand or the coding strand (and therefore, binds the bottom strand or non-coding strand). Similarly each spacer on the bottom matches the bottom strand or the non-coding strand (and therefore, binds the top strand). The established PAM AAG or AGG is located at the 5' end of each protospacer.

Figure 2:
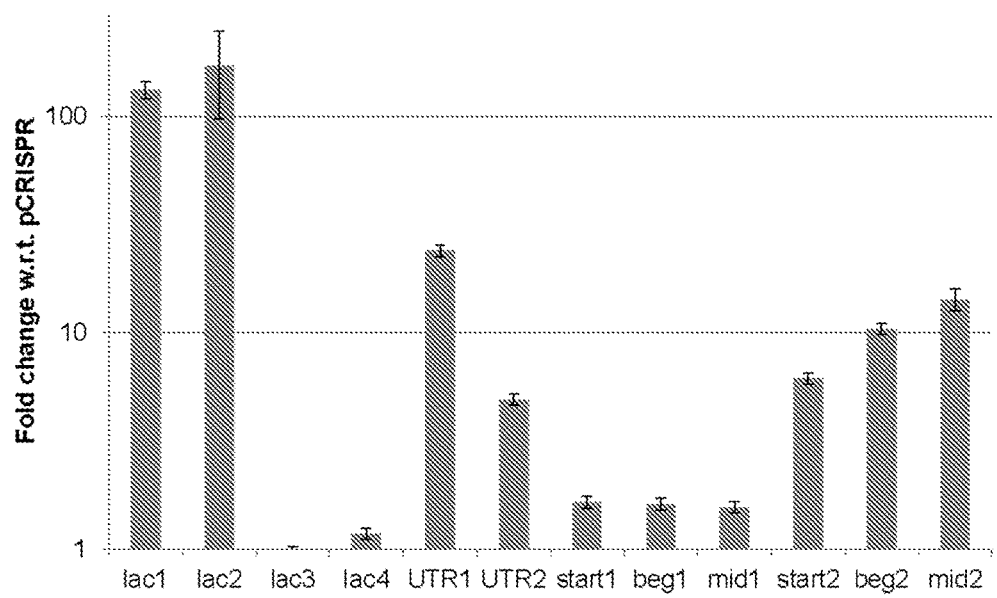
FIG. 2 provides a graph showing transcriptional repression of fluorescent GFP protein in *Escherichia coli* K-12 substrain MG1655 harboring the plasmid pUA66lacZ using methods of the invention as described herein. Cells harboring a pCRISPR plasmid with the indicated spacer were grown in M9 minimal medium supplemented with 0.4% glycerol and 0.2% casamino acids, back-diluted into the same medium, and grown for 6 hours to mid-log phase. Fluorescence was then measured on an Accuri C6 flow cytometer. Fold Change w.r.t. pCRISPR means fold change with respect to pCRISPR. pCRISPR is the same plasmid but does not encode spacers targeting the GFP gene.

FIG. 2 provides a graph showing transcriptional repression of fluorescent GFP protein in transduced MG1655 cells harboring the plasmid pUA66lacZ. Fold Change w.r.t. pCRISPR means fold change with respect to pCRISPR lacking any spacers. The flow cytometry experiments were conducted in triplicate. To compute fold-repression, the median fluorescence for each spacer was averaged and background autofluorescence was removed. Next, the fluorescence was compared against the original pCRISPR that does not any encode any spacers. For example, the pCRISPR control recorded 7332 AU and lac1 recorded 56 AU; this corresponds to a 131-fold change.

Figure 3:
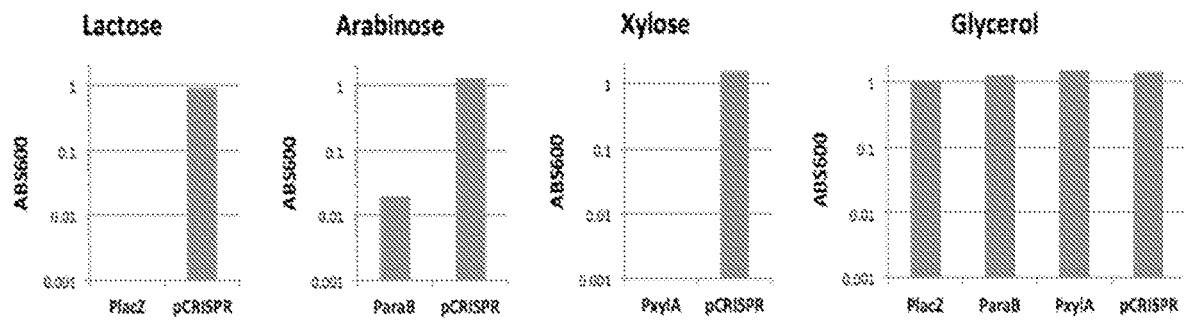
FIG. 3 provides a bar chart of the optical densities ($ABS_{600}$) of cultures of transduced MG1655 cells harboring plasmids with spacers targeting different endogenous sugar-utilization operons, and shows the resulting impact on the growth of the culture on the indicated sugar. Cells were transformed with the pCRISPR plasmid (pCRISPR) or the same plasmid harboring a spacer against the promoter of utilization genes of the associated sugar (ParaB, the araB promoter for L-arabinose; PlacZ, the lacZ promoter for lactose; and PxylA, the xylA promoter for D-xylose). Cells were grown for 24 hours in M9 medium supplemented with glycerol, back-diluted to $ABS_{600}$ of 0.001 in M9 medium supplemented with the indicated carbon source, and cultured for 22 hours. The bar graphs report the final $ABS_{600}$ value as measured using a Nanodrop 2000c spectrophotometer.

FIG. 3 provides a bar chart of the optical densities of cultures of transduced MG1655 cells harboring plasmids with spacers targeting different endogenous sugar-utilization operons, and the resulting impact on the growth of the culture on the indicated sugar. Glycerol was used as a negative control whose catabolism should not be impacted by any of the spacers. A single experiment was conducted for the growth assays, which report the measured $ABS_{600}$ value.

Example 3. Results and Conclusions

The data confirm that this invention works as expected; in the absence of Cas3, Cascade binds to DNA and elicits variable levels of transcriptional repression. In addition to the conceptual proof-of-principle, we also found that (1) targeting the promoter in the −35/−10 region (lac1/lac2) elicits the strongest repression and (2) within the transcribed region, spacers that bind the coding DNA strand show stronger silencing than spacers that bind the non-coding DNA strand. It was further found that targeting endogenous sugar utilization genes leads to negligible growth on the associated sugar. These data demonstrate that the invention can also repress the expression of endogenous genes, leading to expected phenotypes.

Example 4. Modulating Repression Via Spacer Length

Figure 12A:
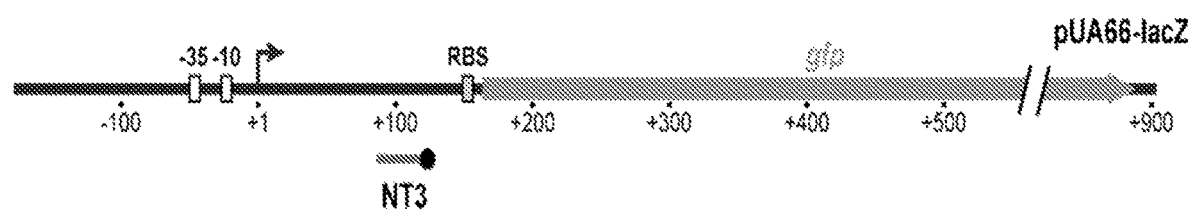
FIGS. 12A-12B shows the affect on repression of changing the length of the spacer in the recombinant constructs of the invention.
Figure 12B:
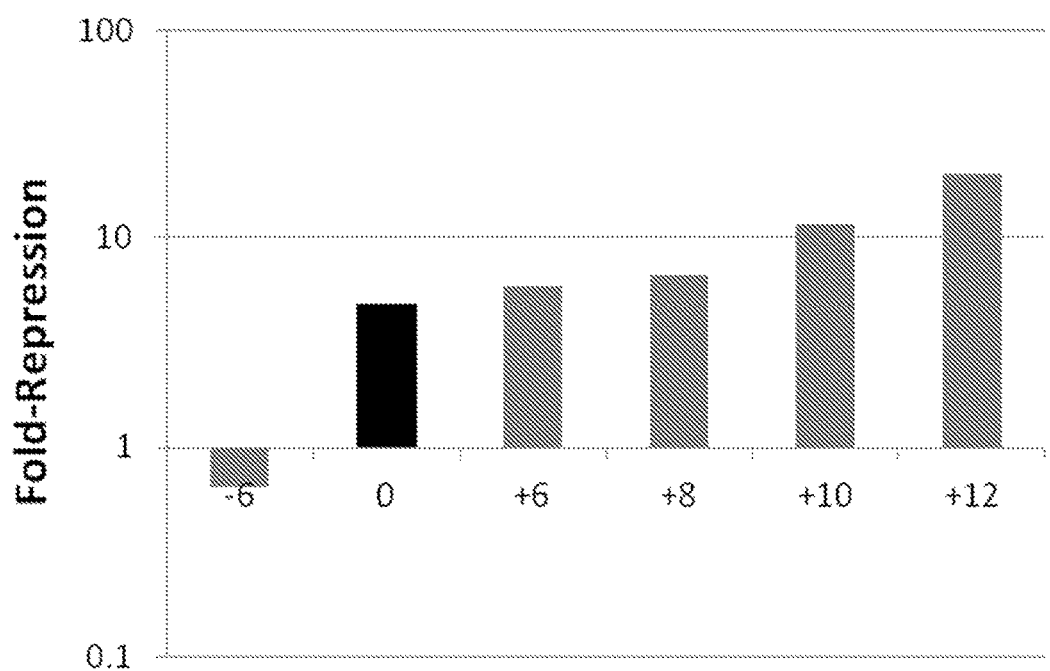

The length of an E. coli spacer was varied and the impact of the changes in length on the degree of repression was measured. The original spacer had a length of 32 nucleotides. In this study, the spacer length was increased by 6, 8, 10 or 12 nucleotides or decreased by 6 nucleotides. The construct is shown in FIG. 12A. The results are shown in FIG. 12B, wherein increased length resulted in increased repression while decreased length abolished repression.

Example 5. Modulated Gene Silencing by Altering Spacer Length and Degree of Complementarity Using the two reported spacers targeting the promoter of pUA66lacZ, we will vary the length of the spacer between 15 nts and 40 nts. We also will vary the degree of complementarity for these spacers between 50% and 100% across the entire 32-nt spacer as well as within the first 8 nts (starting at the 5' end). Each spacer will be flanked on both sides by the same repeat sequence (GAGTTCCCCGCGCCAGCGGGGATAAACCG, SEQ ID NO:250) within the pCRISPR plasmid. It will be demonstrated that reducing the length and extent of complementarity reduces the extent of GFP expression.

Example 6. Gene Silencing Through Heterologous Expression

The casABCDE operon from E. coli MG1655 will be expressed off of the pCDF-1b plasmid in an E. coli BL21 (DE3) strain in which the entire native CRISPR-Cas system will be deleted by homologous recombination. The strain will also harbor the pUA66lacZ plasmid and the pCRISPR plasmid either with no spacer or a lacZ-targeting spacer. We then will measure GFP expression in each strain, where we expect that the strain expressing the casABCDE operon and the lacZ-targeting spacer will show reduced expression in comparison to a strain not expressing the operon or the lacZ-targeting spacer. This will demonstrate gene silencing through heterologous expression of the genes from a Type I-E system.

Example 7. Multiplexed Targeting of the Same or Different Genes

Two to four spacers already shown to reduce expression from pUA66lacZ will be combined into a single array (e.g. repeat-spacer1-repeat-spacer2-repeat-spacer3-repeat for three spacers) in the pCRISPR plasmid. Additionally, we will integrate and test a spacer with a target overlapping one of the other spacers. We then will measure GFP expression for each strain. We expect GFP expression to decrease with the addition of a non-overlapping spacer, and to increase with the addition of an overlapping spacer. In addition, we will combine the three spacers targeting the sugar utilization operons (araBAD, lacZYA, xylAB) into a single array in the pCRISPR plasmid. The transduced E. coli MG1655 strains harboring this plasmid or the original pCRISPR plasmid will be grown in M9 minimal medium on each associated sugar (L-arabinose, lactose, D-xylose) or on glucose. Our expectation is that the pCRISPR plasmid with the three spacers will reduce growth on L-arabinose, lactose, and D-xylose but not on glucose. Silencing will be confirmed by qRT-PCR. These experiments will demonstrate the use of multiple spacers in a single array for modulated silencing or the silencing of multiple genes.

Example 8. Catalytically Dead Cas3

Point mutations in the cas3 gene of E. coli MG1655 will be introduced that inactivate the Cas3 catalytic activity. These point mutations, D75A and D229A, are located in the active sites of Cas3. The resulting gene will be encoded on the pCDF-1b plasmid. An E. coli BL21(DE3) strain with the native CRISPR-Cas system deleted and harboring this plasmid along with pUA66lacZ and a pCRISPR plasmid encoding one of the validated lacZ-targeting spacers. We then will measure GFP expression by flow cytometry analysis for this strain along with a strain with the original pCDF1-b plasmid. Our expectation is that the strains with an inactive Cas3 or no Cas3 will yield similar levels of GFP.

Example 9. Spacer Location within CRISPR Array

To test whether the location of a spacer within the array affects its repression efficacy, we will encode 4-spacer arrays with three non-targeting spacers and one validated lacZ-targeting spacer within the pCRISPR plasmid. Each array will contain the lacZ-targeting spacer in a different location within the array. The transduced E. coli MG1655 strain harboring pUA66lacZ and each pCRISPR plasmid will be tested by quantifying GFP expression by flow cytometry. By comparing levels of repression, we can compare which locations within the CRISPR array elicit the strongest repression or whether the location is irrelevant.

Example 10. Other Type I Systems

The present approach using the Type I-E CRISPR-Cas system in E. coli will be generalized to other Type I systems. The reasoning is that cas3 is the signature gene associated with all Type I systems (I-A, I-B, I-C, I-D, I-E, I-F) with the conserved function of cleaving and degrading DNA bound by Cascade. To further explore the propensity of other Type I systems to achieve transcriptional repression, we will investigate the Type I-C system in *Streptococcus pyogenes*, the Type I-F system in *Pectobacterium atrosepticum*, the Type I-B system in *Aeropyrum pernix*, and the Type I-D system in *Methanospirillum hungatei*. We will encode the genes that comprise Cascade from each system as operons in the pCDF-1b and pRSF-1b expression vectors. E. coli BL21(DE3) cells will then be transformed with plasmids encoding each system and the original pCRISPR plasmid or a pCRISPR plasmid encoding a spacer flanked by repeats from the native system. The spacer will be designed to target the xylA promoter using a PAM derived from the native system. We then will evaluate growth and xylAB expression (by qRT-PCR). We expect cells encoding each system and targeting the xylA promoter will grow poorly on xylose and showed reduced xylAB expression.

Example 11. Archaea

Transcriptional silencing with Type I systems in archaea will also be investigated using *Pyrococcus furiosus* COM1. First, we will delete the native cas3 gene (PFC_04820) associated with the Type I-B system by homologous recombination of the $P_{gdh}$-pyrF gene and selection on defined medium with uracil followed by removal of the pyrF gene by growth on 5'FOA. The cas3' (PFC_02330) and the cas3" (PFC_02335) genes associated with the Type I-A system will also be deleted using the same approach. We will then encode a 30-nt spacer flanked on both sides by the native repeat sequence (GTTACAATAAGACTAAAATAGAATT-GAAAG, SEQ ID NO:251) targeting the promoter of the gdh gene (PFC_00670) or the 2-hydroacid dehydrogenase gene (PFC_00915). Spacers with a protospacer with a 5' CCN PAM will be tested. Each construct will be driven by the S-layer protein (slp) promoter and integrated with pyrF into the genome. We will then measure mRNA levels of each target gene by qRT-PCR for the targeting spacer and a non-targeting spacer. We expected to substantially reduce mRNA levels for either gene in the COM1 strain lacking cas3 as well as the strain lacking cas3, cas3', and cas3".

Example 12. Eukaryotic Organisms

Transcriptional silencing in eukaryotic organisms will be investigated using Baker's yeast and Hela cells as exemplary hosts. A synthetic CRISPR array and the Cascade genes from the Type I-E system in E. coli (casA, casB, casC, casD, casE) will be encoded in standard expression vectors for each host, where each gene will be individually expressed from a separate promoter and terminator (e.g. CMV promoter and SV40 polyA tail for each gene). We also will encode multiple genes in two transcripts using intervening IRES sequences and self-cleaving peptide sequences to simplify the expression constructs. The constructs will be transformed into cell lines stably expressing GFP. The array will encode one, two, or three 32-nt spacers designed to target the heterologous GFP promoter as well as the coding region. Flow cytometry analysis will be used to measure the extent of repression. It is expected that GFP fluorescence will decrease in cell lines expressing the CRISPR array and Cascade genes.

Example 13

Strains and Plasmid Construction.

Table 1, below, provides the list of the E. coli strains used.

TABLE 1

| E. coli strains | | | |
|---|---|---|---|
| Strains | Genotype | Source | Stock # |
| BW25113 | *Escherichia coli* K12 F− DE(araD-araB)567 lacZ4787(del)(::rrnB-3) λ− rph-1 DE(rhaD-rhaB)568 hsdR514 | CGSC[a] #7636 | pCB294 |
| BW25113 Δcas3::cat | BW25113 [Δcas3 $P_{cse1}$::[cat $P_{J23119}$] | This study | pCB385 |
| BW25113 Δcas3 | BW25113 [Δcas3 $P_{cse1}$::[$P_{J23119}$] | This study | pCB400 |
| BW25113 ΔCRISPR-Cas | BW25113 [Δcas3-cse1-cse2-cas7-cas5-cas6e-CRISPR1]::cat | This study | pCB401 |
| NM500 cas3+ | NM500 [ΔP$_{cse1}$]::[cat P$_{J23119}$] | This study | pCB402 |
| MG1655 | *Escherichia coli* K12 F− λ− ilvG− rfb-50 rph-1 | Storz lab (NIH) | pCB1 |
| MG1655 Δcas3::cat | MG1655 [Δcas3 $P_{cse1}$::[cat $P_{J23119}$] | This study | pCB386 |

[a]CGSC: Coli Genetic Stock Center (cgsc.biology.yale.edu).

To generate BW25113 Δcas3::cat and MG1655 Δcas3::cat, the cat resistance cassette was PCR-amplified from the pKD3 plasmid (Datsenko et al. (2000) *Proc. Natl. Acad. Sci. U.S.A.*, 97, 6640-6645) using oligonucleotides that append the synthetic constitutive promoter J23119 (BBa_J23119 in the registry for standard biological parts, partsregistry.org) (J23119-pKD3.for, J23119-pKD3.rev). Following a second PCR amplification to introduce homology arms (HR-cas3.for, HR-cas3.rev), the resulting PCR product was recombineered into NM500 by mini-λ-mediated recombination (Court et al. (2003) *Gene*, 315, 63-69). The insertion replaced the native cas3 gene and the native promoter for the Cascade operon with the cat cassette and the J23119 promoter. Successful recombination was verified by sequencing. P1 transduction was then used to transfer the cat cassette and the synthetic promoter into BW25113 and MG1655. Successful transduction was verified by PCR. To generate BW25113 Δcas3, the cat cassette from BW25113 Δcas3::cat was excised using the pCP20 plasmid as described previously (Cherepanov, et al. (1995) *Gene*, 158, 9-14). To generate NM500 cas3+, the cat resistance cassette was PCR-amplified from the pKD3 plasmid using oligonucleotides that append the constitutive promoter J23119 (J23119-pKD3.for, HR-casA.rev). Following a second PCR amplification to introduce homology arms (HR-cas3.for, HR-casA.rev), the resulting PCR product was recombined into NM500. This NM500 cas3+ strain replaces the native promoter for the Cascade operon with a constitutive promoter while retaining the native cas3 gene. To generate BW25113 ΔCRISPR-Cas::cat, the cat resistance cassette was PCR-amplified from the pKD3 plasmid (HR-CRISPR-.for, HR-cas3.rev), and recombineered into NM500, followed by P1 transduction into BW25113. This BW25113 ΔCRISPR-Cas eliminates the entire CRISPR locus as well as cas3, the Cascade operon, and the CRISPR1 locus.

See Table 2, below, for a list of all plasmids used in this work.

TABLE 2

Plasmids

| Plasmid | Description | Resistance marker | Source | Stock # |
|---|---|---|---|---|
| pUA66-lacZ | lacZ promoter upstream of GFP | Kanamycin | OpenBiosystems | pCB338 |
| pUA66-araB | araB promoter upstream of GFP | Kanamycin | OpenBiosystems | pCB208 |
| pUA66-xylA | xylA promoter upstream of GFP | Kanamycin | Ref. (3) | pCB289 |
| pUA66-rhaB | rhaB promoter upstream of GFP | Kanamycin | Ref. (3) | pCB292 |
| pBAD18 | L-arabinose-inducible plasmid with araC regulator | Ampicillin | Ref. (3) | pCB284 |
| pcrRNA.ind | pBAD18 with single repeat | Ampicillin | This study | pCB359 |
| pcrRNA.ind-T1 | pcrRNA.ind with spacer T1 | Ampicillin | This study | pCB360 |
| pcrRNA.ind-T2 | pcrRNA.ind with spacer T2 | Ampicillin | This study | pCB361 |
| pcrRNA.ind-T3 | pcrRNA.ind with spacer T3 | Ampicillin | This study | pCB362 |
| pcrRNA.ind-T4 | pcrRNA.ind with spacer T4 | Ampicillin | This study | pCB363 |
| pcrRNA.ind-T5 | pcrRNA.ind with spacer T5 | Ampicillin | This study | pCB364 |
| pcrRNA.ind-T6 | pcrRNA.ind with spacer T6 | Ampicillin | This study | pCB365 |
| pcrRNa.ind-NT1 | pcrRNA.ind with spacer NT1 | Ampicillin | This study | pCB366 |
| pcrRNA.ind-NT2 | pcrRNA.ind with spacer NT2 | Ampicillin | This study | pCB367 |
| pcrRNA.ind-NT3 | pcrRNA.ind with spacer NT3 | Ampicillin | This study | pCB368 |
| pcrRNA.ind-NT4 | pcrRNA.ind with spacer NT4 | Ampicillin | This study | pCB369 |
| pcrRNA.ind-NT5 | pcrRNA.ind with spacer NT5 | Ampicillin | This study | pCB370 |
| pcrRNA.ind-NT6 | pcrRNA.ind with spacer NT6 | Ampicillin | This study | pCB371 |
| pcrRNA.ind-LM | pcrRNA.ind with spacers T2-mviM | Ampicillin | This study | pCB372 |
| pcrRNA.ind-LMM | pcrRNA.ind with spacers T2-mviM-mviM | Ampicillin | This study | pCB373 |
| pcrRNA.ind-LMMM | pcrRNA.ind with spacers T2-mviM-mviM-mviM | Ampicillin | This study | pCB374 |
| pcrRNA.ind-MLMM | pcrRNA.ind with spacers mviM-T2-mviM-mviM | Ampicillin | This study | pCB375 |
| pcrRNA.ind-MMLM | pcrRNA.ind with spacers mviM-mviM-T2-mviM | Ampicillin | This study | pCB376 |
| pcrRNA.ind-MMML | pcrRNA.ind with spacers mviM-mviM-mviM-T2 | Ampicillin | This study | pCB377 |
| pcrRNA.ind-MMMM | pcrRNA.ind with spacers mviM-mviM-mviM-mviM | Ampicillin | This study | pCB378 |
| pcrRNA.con | pcrRNA.con with synthetic constitutive promoter | Ampicillin | This study | pCB379 |
| pcrRNA.con-lacZ | pcrRNA.con with spacer T2 | Ampicillin | This study | pCB380 |
| pcrRNA.con-araB | pcrRNA.con with spacer araB | Ampicillin | This study | pCB381 |
| pcrRNA.con-xylA | pcrRNA.con with spacer xylA | Ampicillin | This study | pCB382 |
| pcrRNA.con-rhaB | pcrRNA.con with spacer rhaB | Ampicillin | This study | pCB383 |
| pcrRNA.con-araB/rhaB/xylA/T2 | pcrRNA.con with spacers araB-rhaB-xylA-T2 | Ampicillin | This study | pCB384 |

The GFP reporter plasmids were based on the pUA66 plasmid (low-copy sc101 origin-of-replication) (Zaslaver at al. (2006) *Nat. Methods*, 3, 623-628) and reported in previous work (Afroz et al. (in press) Bacterial sugar utilization gives rise to distinct single-cell behaviors. *Mol. Microbiol.*). To construct the arabinose-inducible pcrRNA.ind plasmid (medium-copy pBR322 origin-of-replication), oligonucleotides were designed to encode a single repeat and a synthetic rho-independent terminator (BBa_B1006 in the registry for standard biological parts) (pcrRNA.ind.for, pcrRNA.ind.rev). These oligonucleotides were annealed, 5' phosphorylated using polynucleotide kinase (PNK), and ligated into the pBAD18 plasmid digested with KpnI-HF and HindIII-HF. To construct the constitutively expressed pcrRNA.con plasmid, oligonucleotides encoding the synthetic constitutive promoter J23119 (pcrRNA.con.for, pcrRNcon.rev) were annealed, 5' phosphorylated with polynucleotide kinase (PNK), and ligated into the pcrRNA.ind plasmid digested with NsiI and NheI. The insertion replaced the araC gene and P$_{araB}$a promoter with the synthetic constitutive promoter. To insert new repeat-spacer pairs into pcrRNA.con or pcrRNA.ind, oligonucleotides encoding the palindromic repeat and crRNA spacers were annealed, 5' phosphorylated with PNK, and ligated into either plasmid digested with KpnI and XhoI. See FIG. 6 for an illustration of the cloning scheme.

All plasmid cloning was verified by sequencing. See Table 3, below, for a list of oligonucleotides used in this work. The oligonucleotides were chemically synthesized by IDT. All enzymes were purchased from NEB.

TABLE 3

| Oligonucleotides | |
|---|---|
| Name | Sequence |
| J23119-pKD3.for | GCTAGCATTATACCTAGGACTGAGCTAGCTGTCAATCCATATGAA<br>TATCCTCCTTAG<br>SEQ ID NO: 252 |
| J23119-pKD3.rev | TGTAGGCTGGAGCTGCTT<br>SEQ ID NO: 253 |
| HR-cas3.for | TACAATTAACCTATACATATATTAAGATGTGTTGAATTGTGCTAG<br>CATTATACCTAGGAC<br>SEQ ID NO: 254 |
| HR-cas3.rev | TGATATCATCGATAATACTAAAAAAACAGGGAGGCTATTATGTAG<br>GCTGGAGCTGCTT<br>SEQ ID NO: 255 |
| HR-CRISPR.rev | ACCGCAGAGGCGGGGGAACTCCAAGTGATATCCATCATTCCATAT<br>GAATATCCTCCTTAG<br>SEQ ID NO: 256 |
| perRNA.ind.for | CCACCTCGAGTTCCCCGCGCCAGCGGGGATAAACCGAAAAAAAA<br>ACCCCGCCCCTGACAGGGCGGGGTTTTTTTA<br>SEQ ID NO: 257 |
| perRNA.ind.rev | AAGCTTAAAAAAAACCCCGCCCTGTCAGGGGCGGGGTTTTTTTT<br>CGGTTTATCCCCGCTGGCGCGGGGAACTCGAGGTGGTACC<br>SEQ ID NO: 258 |
| perRNA.con.for | TTTGACAGCTAGCTCAGTCCTAGGTATAATGCTAGCG<br>SEQ ID NO: 259 |
| perRNA.con.rev | CTAGCGCTAGCATTATACCTAGGACTGAGCTAGCTGTCAAATGCA<br>SEQ ID NO: 260 |
| T2.for | CACCTCGAGTTCCCCGCGCCAGCGGGGATAAACCGCTTTACACTT<br>TATGCTTCCGGCTCGTATGT<br>SEQ ID NO: 261 |
| T2.rev | TCGAACATACGAGCCGGAAGCATAAAGTGTAAAGCGGTTTATCC<br>CCGCTGGCGCGGGGAACTCGAGGTGGTAC<br>SEQ ID NO: 262 |
| NT2.for | CACCTCGAGTTCCCCGCGCCAGCGGGGATAAACCGCATAAAGTGT<br>AAAGCCTGGGGTGCCTAATG<br>SEQ ID NO: 263 |
| NT2.rev | TCGACATTAGGCACCCCAGGCTTTACACTTTATGCGGTTTATCCCC<br>GCTGGCGCGGGGAACTCGAGGTGGTAC<br>SEQ ID NO: 264 |
| T3.for | CACCTCGAGTTCCCCGCGCCAGCGGGGATAAACCGAAACAGCTA<br>TGACCATGATTACGGATTCAC<br>SEQ ID NO: 265 |
| T3.rev | TCGAGTGAATCCGTAATCATGGTCATAGCTGTTTCGGTTTATCCCC<br>GCTGGCGCGGGGAACTCGAGGTGGTAC<br>SEQ ID NO: 266 |
| NT3.for | CACCTCGAGTTCCCCGCGCCAGCGGGGATAAACCGGCGATTAAGT<br>TGGGTAACGCCAGGGTTTTC<br>SEQ ID NO: 267 |
| NT3.rev | TCGAGAAAACCCTGGCGTTACCCAACTTAATCGCCGGTTTATCCC<br>CGCTGGCGCGGGGAACTCGAGGTGGTAC<br>SEQ ID NO: 268 |

TABLE 3-continued

Oligonucleotides

| Name | Sequence |
|---|---|
| T1.for | CACCTCGAGTTCCCCGCGCCAGCGGGGATAAACCGCCCTTTCGTC<br>TTCACACTCGAGCACGACAG<br>SEQ ID NO: 269 |
| T1.rev | TCGACTGTCGTGCTCGAGTGTGAAGACGAAAGGGCGGTTTATCCC<br>CGCTGGCGCGGGGAACTCGAGGTGGTAC<br>SEQ ID NO: 270 |
| T4.for | CACCTCGAGTTCCCCGCGCCAGCGGGGATAAACCGAGATATACA<br>TATGAGTAAAGGAGAAGAACT<br>SEQ ID NO: 271 |
| T4.rev | TCGAAGTTCTTCTCCTTTACTCATATGTATATCTCGGTTTATCCCC<br>GCTGGCGCGGGGAACTCGAGGTGGTAC<br>SEQ ID NO: 272 |
| T5.for | CACCTCGAGTTCCCCGCGCCAGCGGGGATAAACCGTGATGCAAC<br>ATACGGAAAACTTACCCTTAA<br>SEQ ID NO: 273 |
| T5.rev | TCGATTAAGGGTAAGTTTTCCGTATGTTGCATCACGGTTTATCCCC<br>GCTGGCGCGGGGAACTCGAGGTGGTAC<br>SEQ ID NO: 274 |
| T6.for | CACCTCGAGTTCCCCGCGCCAGCGGGGATAAACCGTGATACCCTT<br>GTTAATAGAATCGAGTTAAA<br>SEQ ID NO: 275 |
| T6.rev | TCGATTTAACTCGATTCTATTAACAAGGGTATCACGGTTTATCCCC<br>GCTGGCGCGGGGAACTCGAGGTGGTAC<br>SEQ ID NO: 276 |
| NT1.for | CACCTCGAGTTCCCCGCGCCAGCGGGGATAAACCGACGAAAGGG<br>CCTCGTGATACGCCTATTTTT<br>SEQ ID NO: 277 |
| NT1.rev | TCGAAAAAATAGGCGTATCACGAGGCCCTTTCGTCGGTTTATCCC<br>CGCTGGCGCGGGGAACTCGAGGTGGTAC<br>SEQ ID NO: 278 |
| NT4.for | CACCTCGAGTTCCCCGCGCCAGCGGGGATAAACCGTTCTTCTCCT<br>TTACTCATATGTATATCTCC<br>SEQ ID NO: 279 |
| NT4.rev | TCGAGGAGATATACATATGAGTAAAGGAGAAGAACGGTTTATCC<br>CCGCTGGCGCGGGGAACTCGAGGTGGTAC<br>SEQ ID NO: 280 |
| NT5.for | CACCTCGAGTTCCCCGCGCCAGCGGGGATAAACCGGTAAGTTTTC<br>CGTATGTTGCATCACCTTCA<br>SEQ ID NO: 281 |
| NT5.rev | TCGATGAAGGTGATGCAACATACGGAAAACTTACCGGTTTATCCC<br>CGCTGGCGCGGGGAACTCGAGGTGGTAC<br>SEQ ID NO: 282 |
| NT6.for | CACCTCGAGTTCCCCGCGCCAGCGGGGATAAACCGGTATCACCTT<br>CAAACTTGACTTCAGCACGT<br>SEQ ID NO: 283 |
| NT6.rev | TCGAACGTGCTGAAGTCAAGTTTGAAGGTGATACCGGTTTATCCC<br>CGCTGGCGCGGGGAACTCGAGGTGGTAC<br>SEQ ID NO: 284 |
| araB.for | CACCTCGAGTTCCCCGCGCCAGCGGGGATAAACCGATTAGCGGA<br>TCCTACCTGACGCTTTTTATC<br>SEQ ID NO: 285 |
| araB.rev | TCGAGATAAAAAGCGTCAGGTAGGATCCGCTAATCGGTTTATCCC<br>CGCTGGCGCGGGGAACTCGAGGTGGTAC<br>SEQ ID NO: 286 |
| xylA.for | CACCTCGAGTTCCCCGCGCCAGCGGGGATAAACCGGAGTGCCCA<br>ATATTACGACATCATCCATCA<br>SEQ ID NO: 287 |

TABLE 3-continued

Oligonucleotides

| Name | Sequence |
|---|---|
| xylArev | TCGATGATGGATGATGTCGTAATATTGGGCACTCCGGTTTATCCC CGCTGGCGCGGGGAACTCGAGGTGGTAC SEQ ID NO: 288 |
| rhaB.for | CACCTCGAGTTCCCCGCGCCAGCGGGGATAAACCGGTCGCGAATT CAGGCGCTTTTTAGACTGGT SEQ ID NO: 289 |
| rhaB.rev | TCGAACCAGTCTAAAAAGCGCCTGAATTCGCGACCGGTTTATCCC CGCTGGCGCGGGGAACTCGAGGTGGTAC SEQ ID NO: 290 |
| mviM.for | CACCTCGAGTTCCCCGCGCCAGCGGGGATAAACCGAGCGCGGGC AGGGTATTCTCATCAAACCCA SEQ ID NO: 291 |
| mviM.rev | TCGATGGGTTTGATGAGAATACCCTGCCCGCGCTCGGTTTATCCC CGCTGGCGCGGGGAACTCGAGGTGGTAC SEQ ID NO: 292 |
| lacZ-qPCR.fwd | CGGCGTATCGCCAAAATCAC SEQ ID NO: 293 |
| lacZ-qPCR.rev | ATGGGTAACAGTCTTGGCGG SEQ ID NO: 294 |
| araB-qPCR.fwd | TACCAGTGCGTTAGGCTGTG SEQ ID NO: 295 |
| araB-qPCR.rev | CTGGACCCGATCCTCAATCG SEQ ID NO: 296 |
| xylA-qPCR.fwd | CGCCCCACAGGACATAGTTT SEQ ID NO: 297 |
| xylA-qPCR.rev | GGAACGGCCAACTGCTTTAC SEQ ID NO: 298 |
| rhaB-qPCR.fwd | TCACTTTCCGGGATCGGTTG SEQ ID NO: 299 |
| rhaB-qPCR.rev | TTCAGCGAGTGCTTCAGGAG SEQ ID NO: 300 |

Growth Conditions

All strains were cultured in 14 ml round-bottom polypropylene tubes at 37° C. and 250 RPM in up to 5 ml of LB medium (10 g/L tryptone, 5 g/L yeast extract, 10 g/L NaCl) or M9 minimal medium (1×M9 salts, 2 mM $MgSO_4$, 0.1 mM $CaCl_2$, 10 µg/ml thiamine) containing some combination of 0.4% glycerol, 0.2% indicated sugar, and 0.2% casamino acids. All strains were plated on LB agar (LB medium with 1.2% agar) in 100×15 mm polystyrene petri dishes. To maintain any plasmids, cells were cultured in liquid medium or on agar plates containing appropriate antibiotics at the following concentration: 50 µg/ml of ampicillin, 34 µg/ml of chloramphenicol, 50 µg/ml of kanamycin.

Spacer Design

See Table 4, below, for a list of protospacers targeted in this work.

TABLE 4

Protospacers

| Spacer name | Target strand[a] | Distance from TSS[b] | Protospacer sequence[c] |
|---|---|---|---|
| T1 | T | −141 | AGGCCCTTTCGTCTTCACaCTCGAGCACGACAG SEQ ID NO: 301 |
| T2/lacZ | T | −37 | AGGCTTTACACTTTATGCTTCCGGCTCGTATGT SEQ ID NO: 302 |
| T3 | T | +27 | AGGAAACAGCTATGACCATGATTACGGATTCAC SEQ ID NO: 303 |
| T4 | T | +149 | ACGAGATATACATATGAGTAAAGGAGAAGAACT SEQ ID NO: 304 |

TABLE 4-continued

Protospacers

| Spacer name | Target strand[a] | Distance from TSS[b] | Protospacer sequence[c] |
|---|---|---|---|
| T5 | T | +263 | AGGTGATGCAACATACGGAAAACTTACCCTTAA SEQ ID NO: 305 |
| T6 | T | +506 | AGGTGATACCCTTGTTAATAGAATCGAGTTAAA SEQ ID NO: 306 |
| NT1 | N | −129 | AAGACGAAAGGGCCTCGTGATACGCCTATTTTT SEQ ID NO: 307 |
| NT2 | N | −20 | AAGCATAAAGTGTAAAGCCTGGGGTGCCTAATG SEQ ID NO: 308 |
| NT3 | N | +119 | AAGGCGATTAAGTTGGGTAACGCCAGGGTTTTC SEQ ID NO: 309 |
| NT4 | N | +180 | AAGTTCTTCTCCTTTACTCATATGTATATCTCC SEQ ID NO: 310 |
| NT5 | N | +290 | AGGGTAAGTTTTCCGTATGTTGCATCACCTTCA SEQ ID NO: 311 |
| NT6 | N | +515 | AGGGTATCACCTTCAAACTTGACTTCAGCACGT SEQ ID NO: 312 |
| araB | T | −53 | AAGATTAGCGGATCCTACCTGACGCTTTTTATC SEQ ID NO: 313 |
| xylA | T | −19 | AGGGAGTGCCCAATATTACGACATCATCCATCA SEQ ID NO: 314 |
| rhaB | T | −33 | AAGGTCGCGAATTCAGGCGCTTTTTAGACTGGT SEQ ID NO: 315 |
| mviM[d] | N/A | N/A | AAGAGCGCGGGCAGGGTATTCTCATCAAACCCA SEQ ID NO: 316 |

[a]Characteristics of the target strand, which is complementary to the spacer: T, template strand of gene; N, non-template strand of the gene.
[b]Distance from the transcriptional start site (TSS) to the closest end of the PAM. Negative and positive values are upstream and downstream of the TSS, respectively.
[c]PAMs are in bold red lettering (first three nucleotides of each sequence). CRISPR spacers were designed to match the protospacer sequence.
[d]Targets a protospacer in Salmonella typhimurium LT2 and has been shown to be non-targeting in E. coli(4).

Protospacers were selected by identifying a PAM (CTT, CCT, CAT, CTC located at the 3' end of the target sequence) for the Type I-E system in E. coli (Westra et al. (2012) Mol. Cell, 46, 595-605). Note that only CTT and CCT were used in this work based on our previous experience with these PAM sequences (Gomaa et al. (2014) mBio, 5, e00928-00913). The 32 nucleotides immediately downstream of the PAM were then used as the spacer. The cloning scheme required changing the final two nucleotides of the spacer to TC (FIG. 6), which is not expected to impact crRNA activity (Semenova et al. (2011) Proc. Natl. Acad. Sci. U.S.A., 108, 10098-10103).

Transformation Assays

The transformation assay was conducted similar to previous work (Gomaa et al. (2014) mBio, 5, e00928-00913). Briefly, E. coli BW25113 Δcas3::cat or NM500 cas3* cells were cultured overnight in LB medium. Cultures were back-diluted 1:25 into 25 ml of LB medium in 125 ml Erlenmeyer flasks and grown to an $ABS_{600}$ of 0.6-0.8, which was quantified using a Nanodrop 2000c spectrophotometer (Thermo Scientific). The cells were then washed in ice-cold 10% glycerol and concentrated by a factor of 100. A total of 50 μl of the concentrated cells were transformed with 50 ng of plasmid DNA using a MicroPulser electroporator (Bio-Rad). Transformed cells were recovered in 500 μl SOC medium for 1 hr at 37° C. After the recovery period, the cells were diluted by factors of $10^4$-$10^6$ and 250 μl of the dilution were plated on LB agar with appropriate antibiotics and inducers.

Flow Cytometry Analysis

Cells grown overnight in M9 minimal medium containing 0.2% casamino acids and 0.4% glycerol were back-diluted to an $ABS_{600}$ of 0.01 into M9 minimal medium with the specified combination of 0.1 mM IPTG and 0.2% of the indicated inducing sugar. Upon reaching an $ABS_{600}$ of about 0.2 after about 3-4 hours of growth, the cultures were diluted 1:100 in 1×PBS and run on an Accuri C6 Flow Cytometer (Becton Dickinson) equipped with CFlow plate sampler, a 488 nm laser, and a 530±15 nm bandpass filter. Events reflecting cells were gated based on forward scatter (FSC-H) and side scatter (SSC-H) with respective lower cutoffs of 11,500 and 600 to reduce the measurement of particulates. The gate was set using E. coli cells stained with the DRAQ5 dye (Thermo Scientific). The fluorescence of the gated cells was then measured in FL1-H. At least 30,000 events were analyzed for each sample.

For the reversibility experiments, cells were grown overnight in M9 minimal medium containing 0.2% casamino acids, 0.4% glycerol, and 0.1 mM IPTG, with or without 0.2% L-arabinose. Overnight cultures were pelleted and resuspended twice in M9 minimal media with 0.2% casamino acids, 0.4% glycerol, and 0.1 mM IPTG to remove residual L-arabinose. The washed cultures were then back-diluted to an $ABS_{600}$ of ~0.001 in 30 ml of the same medium without or with 0.2% L-arabinose, respectively. Every hour, 800 µl of culture was withdrawn for flow cytometry analysis and measurement of the $ABS_{600}$.

Doubling-Time Measurements

Cells were grown overnight in M9 minimal medium with 0.4% glycerol. The overnight cultures were pelleted and resuspended twice in M9 minimal medium with no carbon source. The washed cultures were then back-diluted to an $ABS_{600}$ of ~0.001 into 25 ml of M9 minimal medium containing 0.2% of the indicated sugar in 125 ml Erlenmeyer flasks. Every 30 minutes, 800 µl of culture was withdrawn for measurement of the $ABS_{600}$.

Quantitative Real-Time PCR

Cells were grown overnight in M9 minimal medium containing 0.2% casamino acids and 0.4% glycerol. Overnight cultures were back-diluted 1:250 in M9 minimal medium containing 0.2% casamino acids, 0.4% glycerol, and 0.2% of the indicated sugar. Once cultures reached an $ABS_{600}$ of about 0.4, total RNA was isolated as reported previously (Stead, et al. (2012) *Nucleic Acids Res.*, 40, e156) followed by treatment with DNase I. cDNAs were generated from 2 µg of the resulting RNA using random primers and SuperScript III reverse-transcriptase (Invitrogen) followed by treatment with RNase H. Quantitative PCR was conducted on cDNA samples using the gene specific primers (X-qPCR.fwd/rev, where X is the target gene) provided in Table 3 and SYBR Green (Bio-Rad). cDNAs were run on a Mastercycler ep realplex² real-time PCR system (Eppendorf) according to the manufacturer's instructions. For the PCR runs, each cDNA was heated to 95° C. for 2 minutes followed by 50 cycles of a 15-second denaturing step at 95° C., a 15-second annealing step at 55° C., and a 30-second extension step at 72° C. At the end of the run a melt curve was generated to ensure the absence of non-specific products. Relative quantitation of gene expression was calculated using the $2^{\Delta Ct}$ method.

Growth Assays

Cells were inoculated into M9 minimal medium containing 0.4% glycerol and grown overnight. After 24 hours, cells were pelleted and resuspended in 2 ml of M9 minimal medium with no carbon source two times to remove glycerol as a possible source of growth. The washed cultures were then back-diluted to an $ABS_{600}$ of 0.001 into 2 ml of M9 minimal medium containing 0.2% of the indicated sugar(s). Finally, the cultures were grown for 24 hours until the $ABS_{600}$ was measured.

Example 14. Results

Targeted Gene Repression Following Deletion of Cas3

Figure 4A:
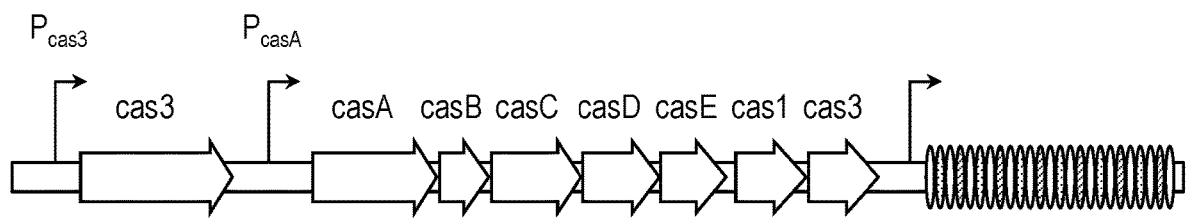
FIGS. 4A-4B show the Type I-E CRISPR-Cas system in E. coli K-12.
Figure 4B:
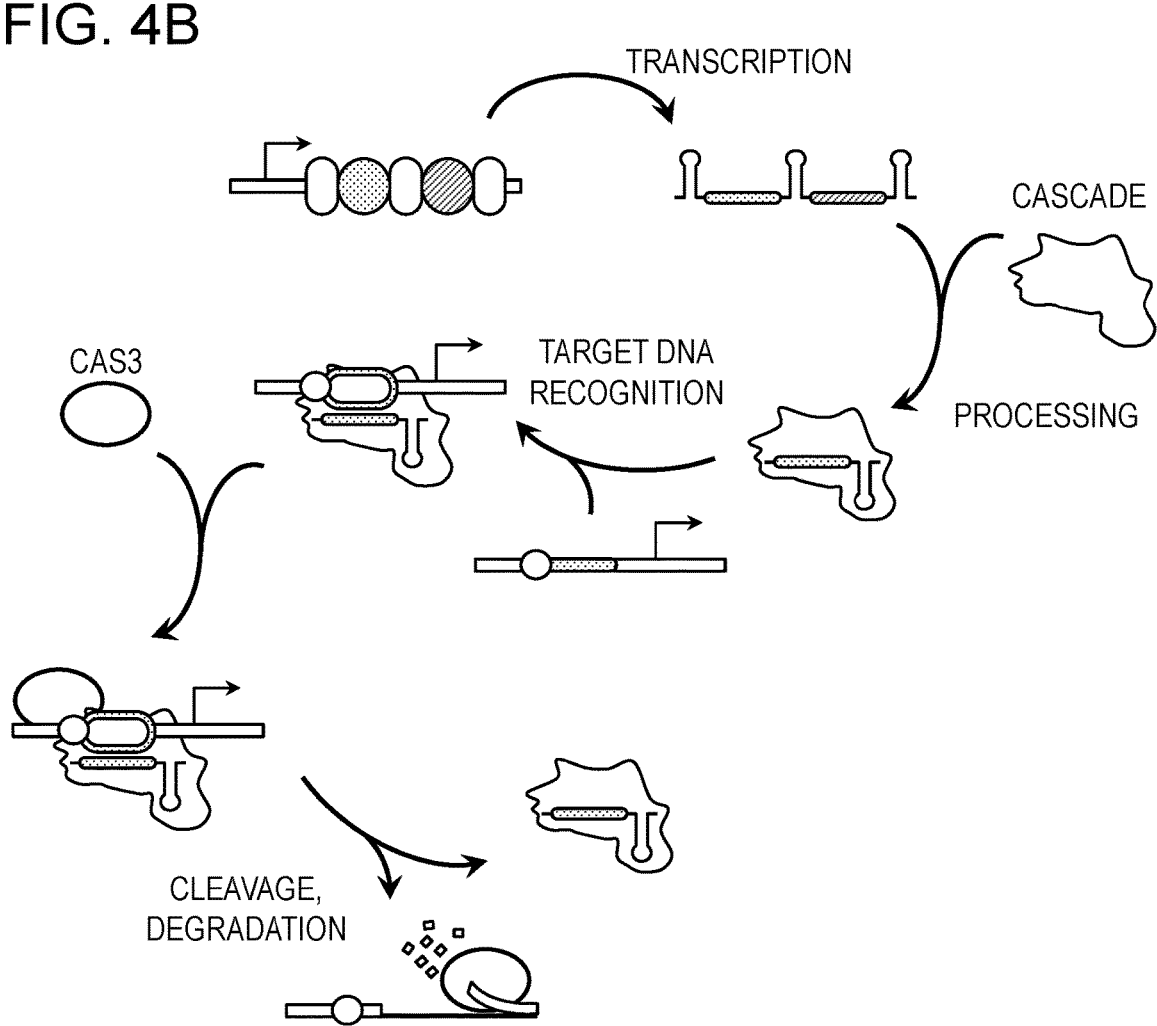
Figure 5A:
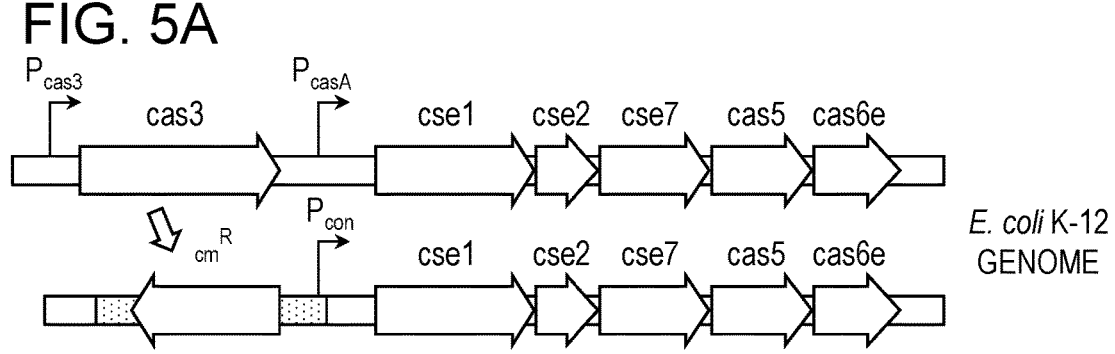
FIGS. 5A-5B show repurposing of the Type I-E CRISPR-Cas system in E. coli K-12 for programmable gene repression.
Figure 5B:
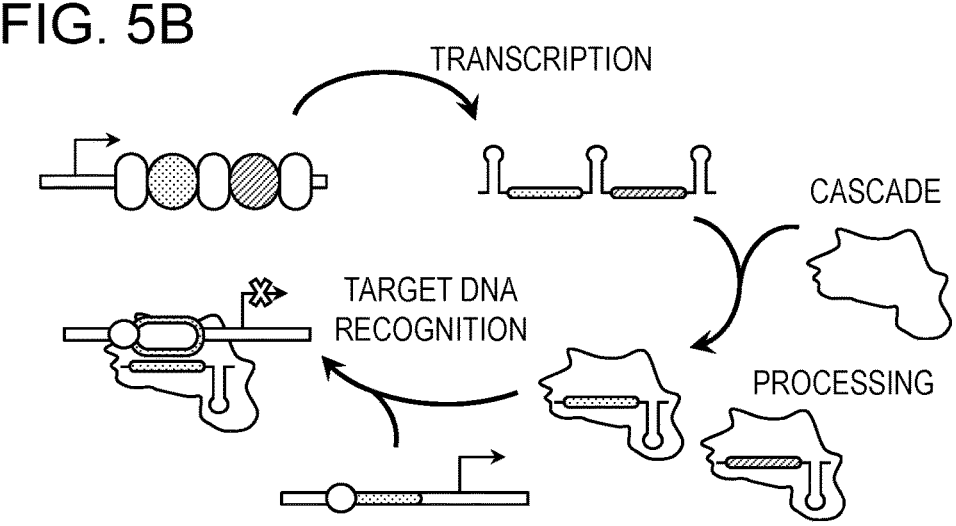
Figure 6:
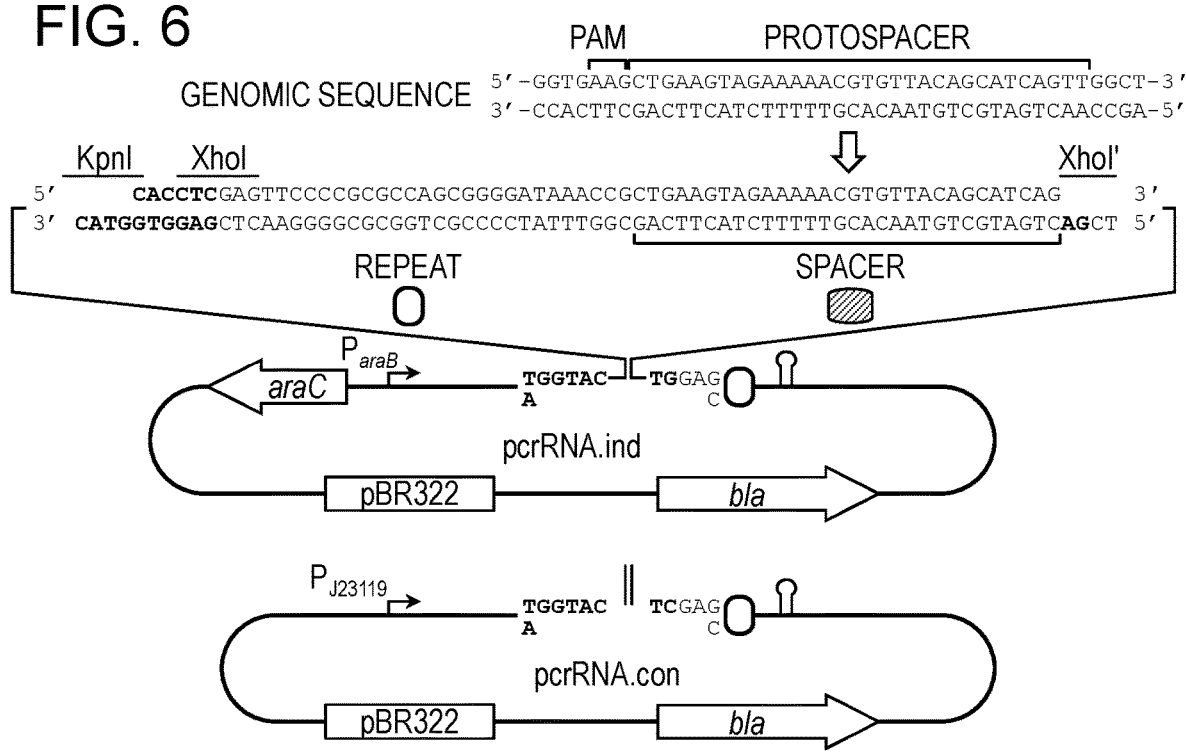
FIG. 6 provides a cloning scheme for the synthetic Type I-E CRISPR arrays. Following identification of a PAM in the target sequence (upper dsDNA, SEQ ID NO:321 (top strand), SEQ ID NO:322 (bottom strand)), the downstream 32 base pairs serve as the protospacer. All but the last two base pairs are copied into two annealed oligonucleotides that, when annealed, form a repeat-spacer pair. The spacer-repeat pair contains the overhangs for a cleaved KpnI restriction site (left) and cleaved XhoI restriction site (right) along with an internal XhoI restriction site. As long as the $30^{th}$ base in the protospacer is not a C, ligation of the annealed oligonucleotides (lower dsDNA, SEQ ID NO:323 (top strand), SEQ ID NO:324 (bottom strand)) into either plasmid digested with KpnI/XhoI disrupts the original XhoI restriction site. Consequently, additional repeat-spacer pairs can be sequentially inserted into the KpnI/XhoI restriction sites.
Figure 7A:
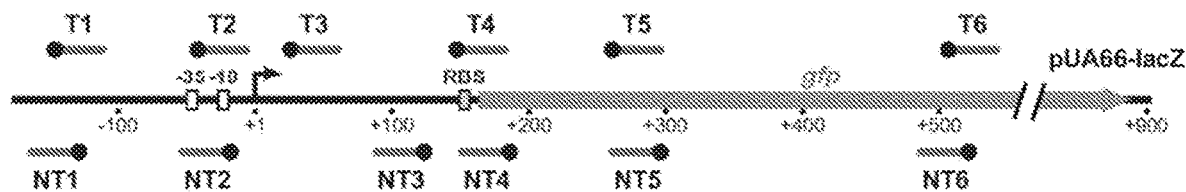
FIGS. 7A-7C show RNA-mediated transcriptional repression with the repurposed Type I-E CRISPR-Cas system in E. coli K-12.

To explore the capacity of Type I systems for gene regulation, we employed the Type I-E CRISPR-Cas system in *Escherichia coli* K-12 (FIG. 4). Because the casABCDE operon encoding Cascade (cse1-cse2-cas7-cas5-cas6e) is strongly repressed under normal growth conditions (Pul, et al. (2010) *Mol. Microbiol.*, 75, 1495-1512; Westra, et al. (2010) *Mol. Microbiol.*, 77, 1380-1393), we replaced cas3 and the native cse1 promoter with a constitutive promoter in one round of homologous recombination (FIG. 5). The resulting strain (BW25113 Δcas3::cat) was transformed with a medium-copy plasmid encoding L-arabinose-inducible single-spacer arrays (FIG. 6) and a low-copy reporter plasmid encoding the green fluorescent protein (gfp) gene downstream of the lacZ promoter (pUA66-lacZ, Table 5). The spacers were designed to target ten locations in the promoter and gfp coding region as well as two locations far upstream of the promoter (FIG. 7A, Table 4). Using flow cytometry analysis, the fluorescence of individual cells was then measured following induction of GFP and crRNA expression.

TABLE 5

Promoter sequences

| Promoter | Sequence[a] |
|---|---|
| lacZ | CTTTCGTCTTCACACTCGAGCACGACAGGTTTCCCGACTGGAAAGCGGGCAGTGAGCGC |
|  | AACGCAATTAATGTGAGTTAGCTCACTCATTAGGCACCCCAGGCTTTACACTTTATGCTTCC |
|  | GGCTCGTATGTTGTGTGG<u>A</u>ATTGTGAGCGGATAACAATTTCACACAGGAAACAGCTATGAC |
|  | CATGATTACGGATTCACTGGCCGTCGTTTTACAACGTCGTGACTGGGAAAACCCTGGCGTT |
|  | ACCCAACTTAATCGCCTTGCAGCACAGGATCCTCTAGATTTAAGAA SEQ ID NO: 317 |
| araB | CCTGTCTCTTGATCAGATCTGGCCTCAATCGGCGTTAAACCCGCCACCAGATGGGCGTTA |
|  | AACGAGTATCCCGGCAGCAGGGGATCATTTTGCGCTTCAGCCATACTTTTCATACTCCCACC |
|  | ATTCAGAGAAGAAACCAATTGTCCATATTGCATCAGACATTGCCGTCACTGCGTCTTTTACT |
|  | GGCTCTTCTCGCTAACCCAACCGGTAACCCCGCTTATTAAAAGCATTCTGTAACAAAGCGG |
|  | GACCAAAGCCATGACAAAAACGCGTAACAAAAGTGTCTATAATCACGGCAGAAAAGTCCA |
|  | CATTGATTATTTGCACGGCGTCACACTTTGCTATGCCATAGCATTTTTATCCATAAGATTAG |
|  | CGGATCCTACCTGACGCTTTTTATCGCAACTCTCTACTGTTTCTCCAT<u>A</u>CCCGTTTTTTGGA |
|  | TGGAGTGAAACGATGGCGATTGCAATTGGCCTCGATTTTGGCAGTGATTCTGTGCGAGCTT |
|  | TGGCGGTGGACTGCGCTACCGGTGAAGCTCGAGGGGATCCTCTAGA SEQ ID NO: 318 |

TABLE 5-continued

Promoter sequences

| Promoter | Sequence[a] |
|---|---|
| xylA | CGAGGCCCTTTCGTCTTCACGGTGTAGGGCCTTCTGTAGTTAGAGGACAGTTTTAATAAG |
| | TAACAATCACCGCGATAAACGTAACCAATTTTTAGCAACTAAACAGGGGAAAACAATTAC |
| | AGATTTTTATCTTTCGATTACGATTTTTGGTTTATTTCTTGATTTATGACCGAGATCTTACTT |
| | TTGTTGCGCAATTGTACTTATTGCATTTTTCTCTTCGAGGAATTACCCAGTTTCATCATTCCA |
| | TTTTATTTTGCGAGCGAGCGCACACTTGTGAATTATCTCAATAGCAGTGTGAAATAACATA |
| | ATTGAGCAACTGAAAGGGAGTGCCCAATATTACGACATCATCCATCACCCGCGGCATTACC |
| | TGATTATGGAGTTCAATATGCAAGCCTATTTTGACCAGCTCGATCGCGTTCGTTATGAAGGC |
| | TCAAAATCCTCAAACCCGTTAGCATTCCGTCACTACAATCCCGACGAACTGGTGTTGGGTA |
| | AGCGTATGTAATCTAGATTTAAGAAGGAGAT SEQ ID NO: 319 |
| rhaB | CCTGTCTCTTGATCAGATCTGTTCTATCGCCACGGACGCGTTACCAGACGGAAAAAAATC |
| | CACACTATGTAATACGGTCATACTGGCCTCCTGATGTCGTCAACACGGCGAAATAGTAATC |
| | ACGAGGTCAGGTTCTTACCTTAAATTTTCGACGGAAAACCACGTAAAAAACGTCGATTTTT |
| | CAAGATACAGCGTGAATTTTCAGGAAATGCGGTGAGCATCACATCACCACAATTCAGCAAA |
| | TTGTGAACATCATCACGTTCATCTTTCCCTGGTTGCCAATGGCCCATTTTCCTGTCAGTAAC |
| | GAGAAGGTCGCGAATTCAGGCGCTTTTTAGACTGGTCGTAATGAAATTCAGCAGGATCACA |
| | TTATGACCTTTCGCAATTGTGTCGCCGTCGATCTCGGCGCATCCAGTGGGCGCGTGATGCTG |
| | GCGCGTTACGAGCGTGAATGGGATCCTCTAGATTTAAGAA SEQ ID NO: 320 |

[a]Sequences in bold are from pUA66, indicating where each promoter was inserted into the plasmid. The underlined and bolded base is the previously mapped transcriptional start site.

Figure 7B:
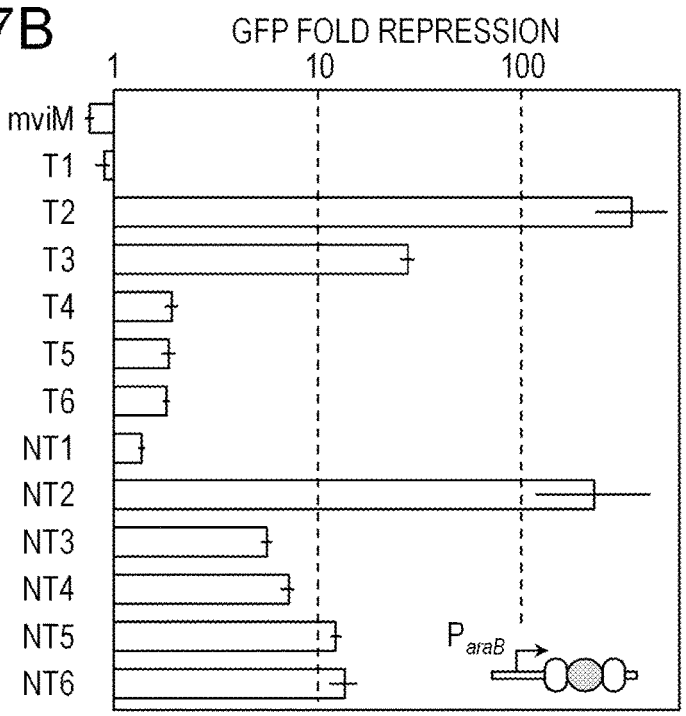
Figure 7C:
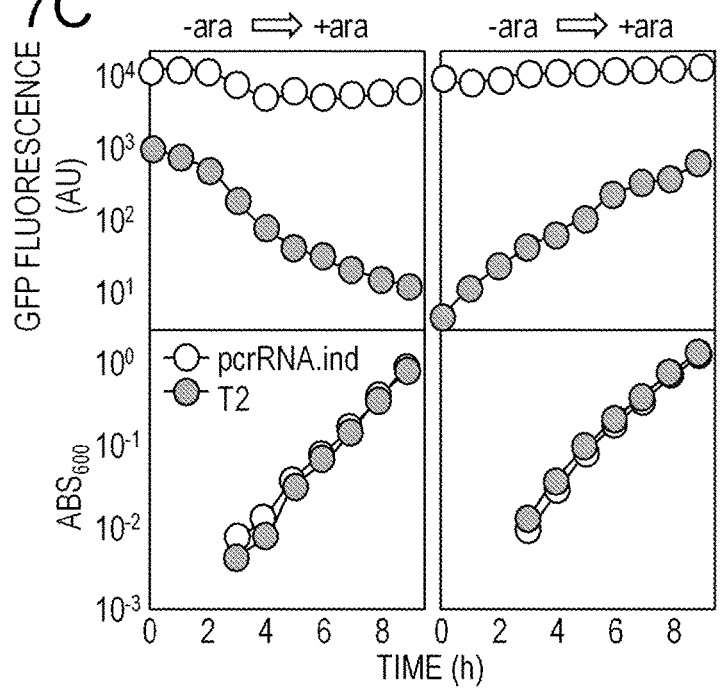

In comparison to the spacer-free plasmid (pCRISPR.ind, FIG. 6), we observed ranging extents of repression that depended on which region of pUA66-lacZ was targeted (FIG. 7B). Targeting either strand of the promoter region strongly reduced GFP fluorescence (~200-fold). Targeting the transcribed region moderately reduced GFP fluorescence, but only when targeting anywhere along the non-template strand or in the vicinity of the RNA polymerase footprint on the template strand (Kovacic, R. T. (1987) *J. Biol. Chem.*, 262, 13654-13661). Interestingly, the strand bias observed when targeting the template versus non-template strand mirrors that observed for dCas9 in bacteria (Qi et al. (2013) *Cell*, 152, 1173-1183; Bikard et al. (2013) *Nucleic Acids Res.*, 41, 7429-37). As expected, targeting upstream of the promoter region negligibly reduced fluorescence. In all cases, the extent of gene silencing was uniform across the entire bacterial population. Importantly, GFP levels were similar for the no-spacer plasmid and a plasmid encoding a spacer targeting the mviM gene in *Salmonella enterica* (FIG. 7B), ruling out potential differences due to the assembly of Cascade. We also found that GFP silencing was reversible based on the change in fluorescence following addition or removal of L-arabinose (FIG. 7C). The associated dynamics can be attributed to the stability of GFP similar to previous work (Bikard et al. (2013) *F1000prime Rep.*, 5, 47).

Figure 8A:
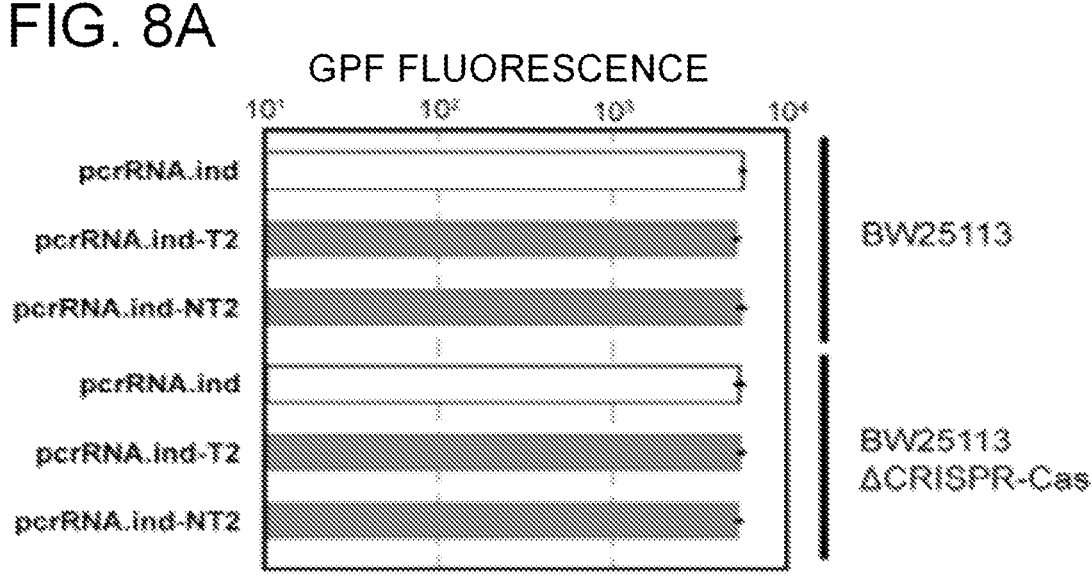
FIGS. 8A-8C show GFP expression and DNA transformation in variants of the parent strain BW25113 and NM500.
Figure 8B:
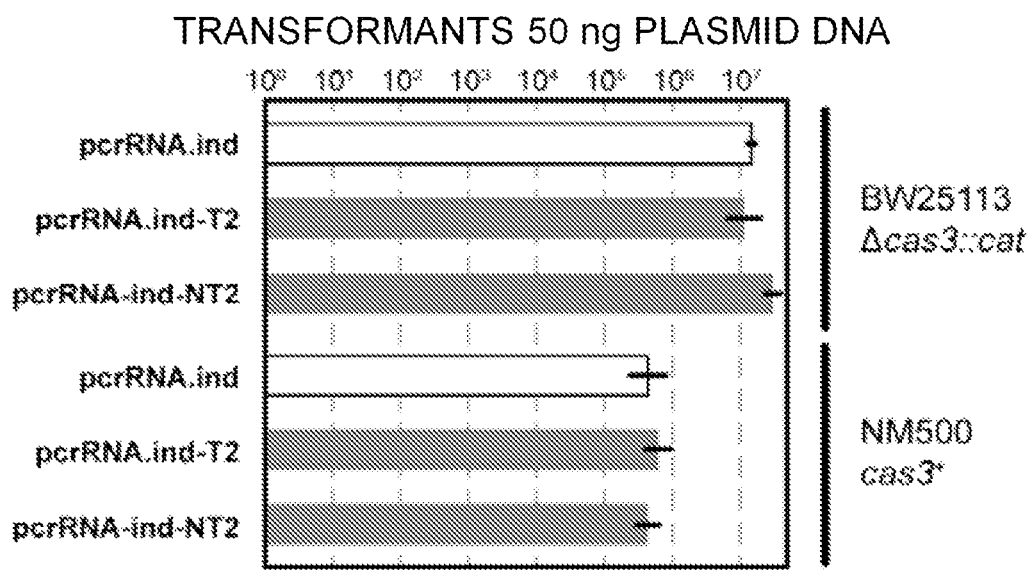
Figure 8C:
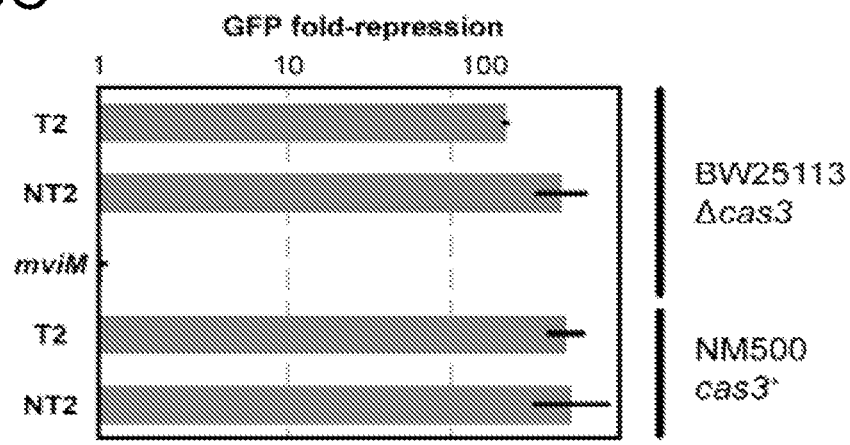

We next performed a series of control experiments to assess the impact of deleting cas3 and constitutively expressing Cascade operon. We first measured GFP fluorescence in the original wild type strain in which the Cascade operon was tightly repressed and cas3 was still present (BW25113) and in a strain in which cas3 and the Cascade operon were both deleted (BW25113 ΔCRISPR-Cas::cat). The fluorescence levels were similar regardless of whether a targeting spacer was used (FIG. 8A), indicating that Cascade must be present and Cas3 must be absent for gene silencing. Next, to assess the impact on DNA integrity, we measured the transformation efficiencies for targeting and non-targeting plasmids in strains with Cascade constitutively expressed and cas3 present (NM500 cas3$^+$) or absent (BW25113 Δcas3::cat). Surprisingly, we observed similar transformation efficiencies for the targeting and non-targeting plasmids even when cas3 was present (FIG. 8B), suggesting that Cas3 is poorly expressed or inactive in this strain. As further support, the strain with cas3 present could still strongly silence GFP (FIG. 8C). Finally, to gauge the impact of the resistance cassette, we excised the cassette used to delete cas3 to produce BW25113 Δcas3-cat strain and measured gene silencing. The resulting strain (BW25113 Δcas3) and the original strain (BW25113 Δcas3:: cat) exhibited similar silencing efficiencies (Supplementary Figure S4C), indicating a negligible impact of the resistance cassette.

Impact of Array Length and Spacer Position

Figure 9:
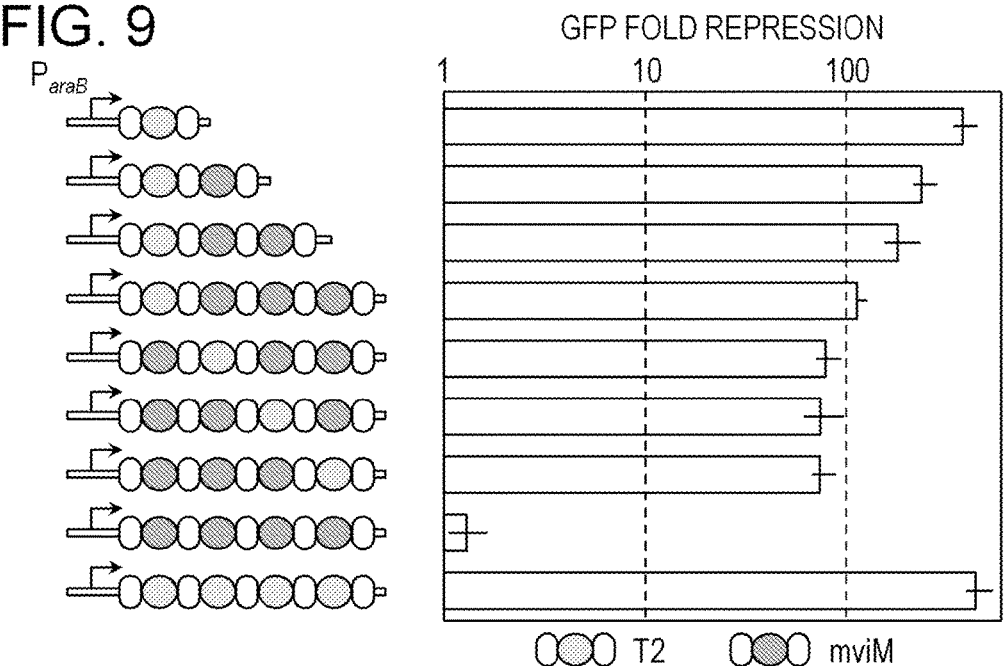
FIG. 9 shows the impact of array length and spacer location on silencing efficiency. BW25113 Δcas3::cat cells harboring pUA66-lacZ and the indicated inducible CRISPR array plasmid were subjected to flow cytometry analysis following induction with IPTG and L-arabinose. Repression is calculated as the ratio of the autofluorescence-subtracted fluorescence for the inducible no-spacer plasmid (pcrRNA.ind) and each multi-spacer plasmid. Repeats, white ovals; T2 spacers, dotted circles; non-targeting spacers matching the Salmonella enterica mviM gene, hashmark circles. Values represent geometric mean and S.E.M. from independent experiments staring with three separate colonies.

One beneficial feature of Cascade is that it can process multiple crRNAs from a single spacer array. However, little is known about how the composition of natural or synthetic multi-spacer arrays quantitatively impacts individual targets. To evaluate the impact of array length, we generated arrays with one promoter-targeting spacer (T2) followed by zero to three non-targeting spacers (mviM) (FIG. 9). Flow cytometry analysis revealed a gradual decrease in silencing efficiency with each additional spacer. We speculate that this decrease may be due to non-targeting spacers diluting available Cascade complexes for targeting crRNAs, as observed with other RNA-based systems (Hussein, R. and Lim, H. N. (2011) *Proc. Natl. Acad. Sci. U.S.A.,* 108, 1110-1115). In support of this assertion, the single-spacer array and an array of four targeting spacers exhibited statistically indistinguishable extents of silencing (two-tailed t-test, t(4)=1.05, p=0.35) (FIG. 9). To evaluate the impact of spacer position, we generated arrays with different permutations of one targeting and three non-targeting spacers (FIG. 9). With the exception of a targeting spacer in the first position of the four-spacer array, the extent of gfp silencing was similar regardless of spacer position (one-way ANOVA, F(2,6) =0.15, p=0.86). These results suggest that longer arrays can reduce the potency of individual spacers, whereas the exact location of a spacer within an array has a lesser contribution to the potency of silencing.

Multiplexed Repression of Endogenous Genes

As a complement to targeting heterologous genes such as gfp, we explored the ability of spacers to regulate endogenous targets. We focused on operons involved in the catabolism of the sugars L-arabinose (araBAD), L-rhamnose (rhaBAD), D-xylose (xylAB), and D-lactose (lacZYA) (FIG. 10, panel A) because these operons are well characterized and are required for growth on their cognate sugar (Gross, J. and Englesberg, E. (1959) *Virology,* 9, 314-331; Power, J. (1967) *Genetics,* 55, 557-568; Lawlis, et al. (1984) *Appl. Environ. Microbiol.,* 47, 15-21; Beckwith, J. R. (1967) *Science,* 156, 597-604). Because the araBAD, rhaBAD, and lacZYA operons are disrupted in BW25113, we imported the cas3 deletion and synthetic promoter into another strain of *E. coli* K-12 (MG1655 Δcas3::cat). We also placed each single-spacer array under the control of the strong constitutive promoter to circumvent the need for L-arabinose as an inducer (FIG. 6).

Figure 10:
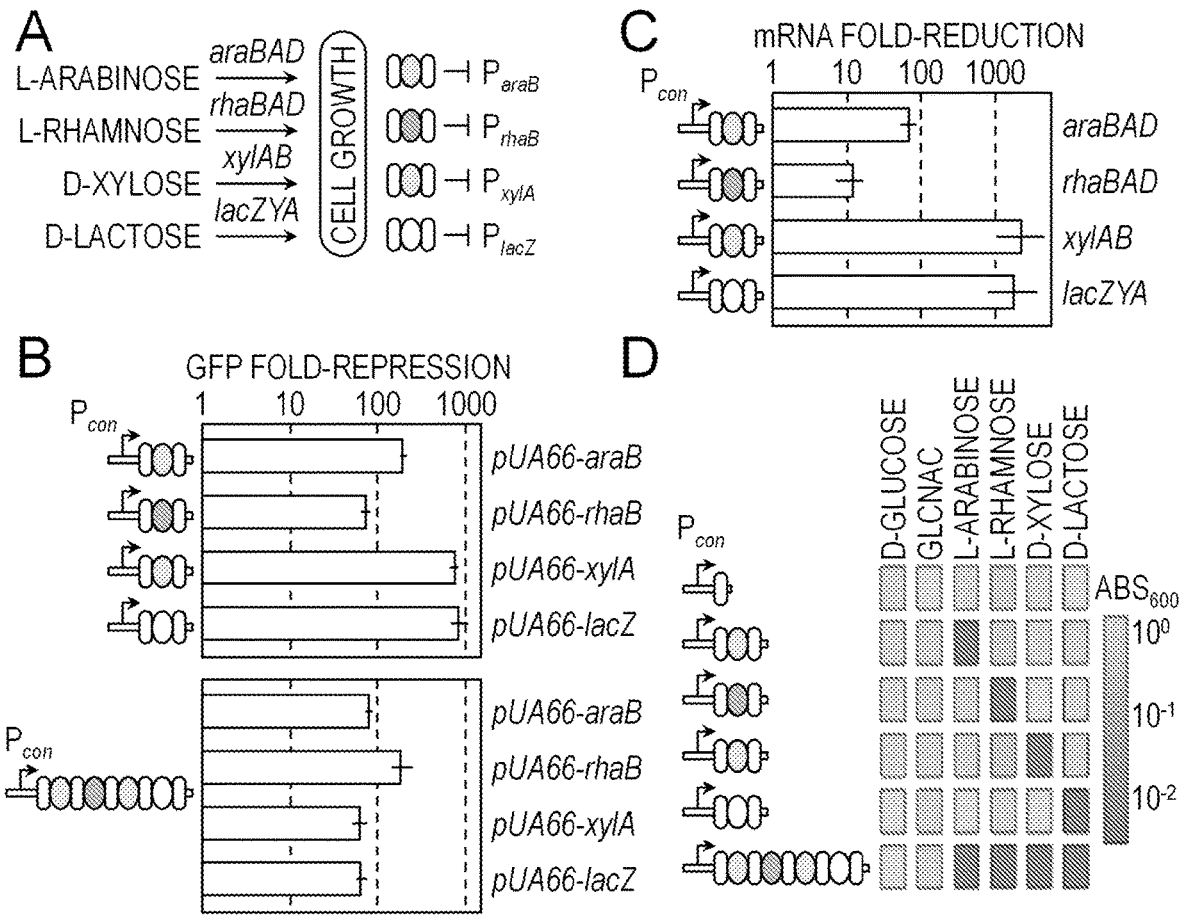
FIG. 10, panels A-D show targeted repression of endogenous genes and pathways.

To assess silencing of promoter activity, we cloned the promoter of each operon upstream of gfp in the pUA66 plasmid (Table 5, below). The resulting plasmids were placed in MG1655 Δcas3 cells harboring the corresponding single-spacer plasmid (top) or multi-spacer plasmid (bottom) and then tested for the ability to repress their respective target promoter by flow cytometry analysis following promoter induction with the cognate sugar (FIG. 10, panel B). In comparison to the spacer-free plasmid (pCRISPRcon, FIG. 6), each targeting plasmid greatly reduced fluorescence (about 80-fold to about 900-fold). As expected, combining the spacers into one array strongly reduced fluorescence for all four promoters when tested individually (FIG. 10, panel B), although the degree of silencing was generally less than that observed for the individual spacers (FIG. 9).

To evaluate silencing of the endogenous genes, we measured mRNA levels of each operon for cells with each single-spacer plasmid. In comparison to the no-spacer plasmid, the single-spacer plasmids greatly reduced mRNA levels (about 11-fold to about 2,200-fold) of the target operons (FIG. 10, panel C), paralleling that observed for the GFP reporters (FIG. 10, panel B). This wide range in repression matches the variability in gene silencing observed with dCas9 (Qi et al. (2013) *Cell,* 152, 1173-1183; Bikard et al. (2013) *Nucleic Acids Res.,* 41, 7429-37)

Figure 11A:
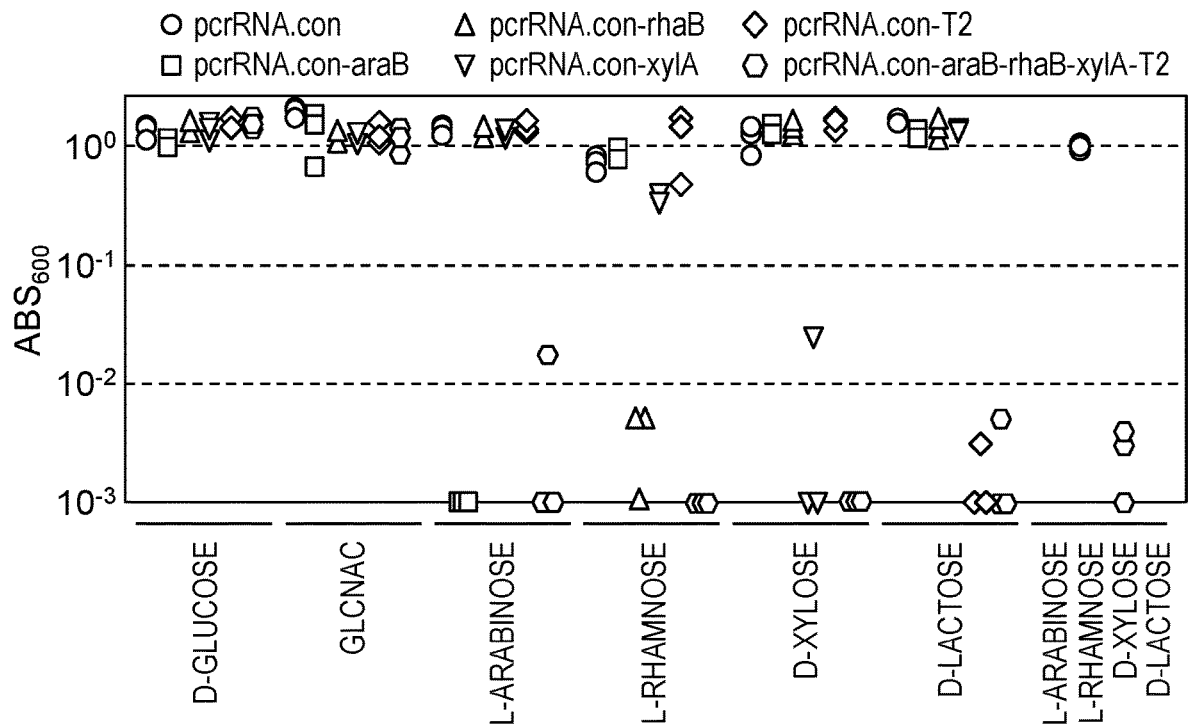
FIGS. 11A-11B show extended information for the growth assays.
Figure 11B:
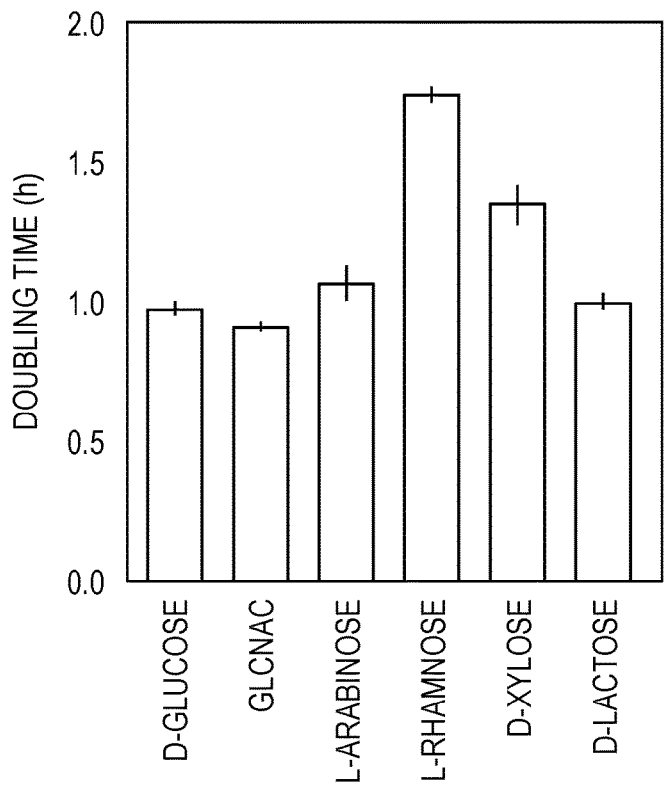

Finally, we explored whether targeting endogenous genes could generate defined phenotypes. Because each operon is required for the catabolism of its cognate sugar, we measured growth on each sugar as well as on two non-targeted sugars D-glucose and N-acetyl-D-glucosamine (GlcNAc). We cultured MG1655 Δcas3::cat expressing a single-spacer or four-spacer array with the different sugars as sole carbon sources and measured the turbidity of the culture after 24 hours of growth (FIG. 10, panel D; FIG. 11A). We found that targeting each operon limited growth on the cognate sugar, whether using a single-spacer array or the four-spacer array. The four-spacer array silenced all target operons in individual cells, as this array limited growth in medium containing all four targeted sugars (FIG. 11A). Growth was unhampered for all non-targeted sugars, supporting the specificity of targeting. The final turbidity was generally lower for all cultures grown in L-rhamnose (FIG. 10, panel D, FIG. 11A), which we attribute to L-rhamnose being a poor carbon source (FIG. 11B). We thus conclude that the Type I-E system deprived of Cas3 in *E. coli* can be programmed to silence multiple endogenous genes and generate complex phenotypes.

Example 15. Discussion

As shown herein, the Type I-E CRISPR-Cas system in *E. coli* can be repurposed for programmable gene repression through the deletion of cas3 and constitutive expression of the Cascade operon. Structural and phylogenetic data suggest that this same phenomenon would apply readily to Type I-B, I-C, and I-F systems based on the stability of Cascade in the absence of Cas3 and the ability of this complex to process transcribed CRISPR arrays (Makarova et al. (2011) 9, 467-477; Nam et al. (2012) *Struct. Lond. Engl.* 1993, 20, 1574-1584; Brendel et al. (2014) *J. Biol. Chem.,* 289, 7164-7177; Wiedenheft et al. (2011) *Proc. Natl. Acad. Sci. U.S.A.,* 108, 10092-10097). Type I-A and I-B systems appear to be exceptions, as two distinct Cas3 proteins (Cas3' and Cas3") are required for stabilization of the Type I-A Cascade and the uncharacterized Type I-B Cascade is most closely related to Type I-A systems (Sorek et al. (2013) *Annu. Rev. Biochem.,* 82, 237-266; Plagens et al. (2014) *Nucleic Acids Res.,* 42, 5125-5138). However, these cas3 genes could be catalytically inactivated (Hochstrasser et al. (2014) *Proc. Natl. Acad. Sci. U.S.A.,* 111, 6618-6623) as performed with Cas9 (Jinek et al. (2012) *Science,* 337, 816-821), albeit with point mutations that are harder to introduce using rudimentary genetic tools.

With this demonstration, another question is whether Type I systems or Type II systems should be employed for transcriptional regulation. Type II systems in the form of dCas9 are highly attractive because they offer a compact heterologous system that can be imported into diverse organisms. However, exploiting endogenous Type I systems does offer some potential advantages. For instance, once cas3 is deleted, only the CRISPR array totaling at most a few hundred bases must be introduced. Another potential advantage is that the native Type I system would be well suited for thermophilic and hyperthermophilic microorganisms that thrive in environmental conditions that would prevent proper folding of common Cas9 proteins. Type I systems also offer PAMs that are distinct from those associated with known Type II systems, including a different orientation and a bias toward T/C-rich sequences (Sorek et al. (2013) *Annu. Rev. Biochem.,* 82, 237-266; Westra et al. (2012) *Mol. Cell,* 46, 595-605; Esvelt et al. (2013) *Nat. Methods,* 10, 1116-21). Finally, Type I systems are naturally found in diverse industrially and medically relevant strains, including *Escherichia coli, Streptococcus thermophilus, Clostridium autoethanogenum,* and *Acinetobacter baumannii* (Grissa et al. (2007) *BMC Bioinformatics,* 8, 172). A possible drawback to this strategy is that the strains may lose immunity against some invading pathogens. Overexpression of Cascade in the absence of Cas3 may also inadvertently impact the transcriptional landscape, although this remains to be explored even for dCas9.

One interesting parallel observed for transcriptional regulation with Type I and Type II systems is the strand bias when targeting transcribed regions (FIG. 7B) (Qi et al. (2013) Cell, 152, 1173-1183; Bikard et al. (2013) Nucleic Acids Res., 41, 7429-37). Previous work with dCas9 demonstrated that targeting the non-template strand but not the template strand strongly interfered with RNA polymerase extension. We observed the same trend with the Type I-E Cascade (FIG. 7B) despite structural differences and opposing PAM locations in comparison to dCas9 (Jore et al. (2011) Nat. Struct. Mol. Biol., 18, 529-536; Westra et al. (2012) Mol. Cell, 46, 595-605; Jiang et al. (2013) Nat. Biotechnol., 31, 233-239; Nishimasu et al. (2014) Cell, 156, 935-949).

In summary, the present invention offers novel strategies for exploiting Type I CRISPR-Cas system for transcriptional regulation. Moreover, our findings provide a framework to identify natural Type I systems that naturally regulate gene expression, potentially expanding the list of known systems that coordinate cellular processes (Sampson et al. (2014) Proc. Natl. Acad. Sci. U.S.A., 111, 11163-8; Sampson et al. (2013) Nature, 497, 254-257).

Example 16. Spacer Length

Figure 13:
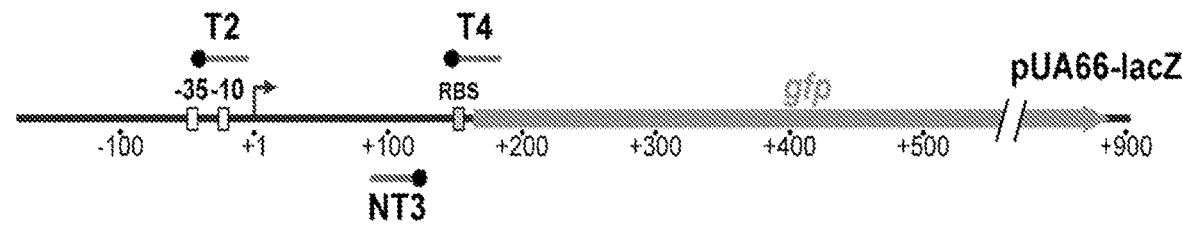
FIG. 13 shows a schematic of different locations targeted for the spacer length variants. T2 targets the template strand in the promoter region, T4 targets the template strand in the coding region, an NT3 targets the non-template strand in the untranslated region.
Figure 14:
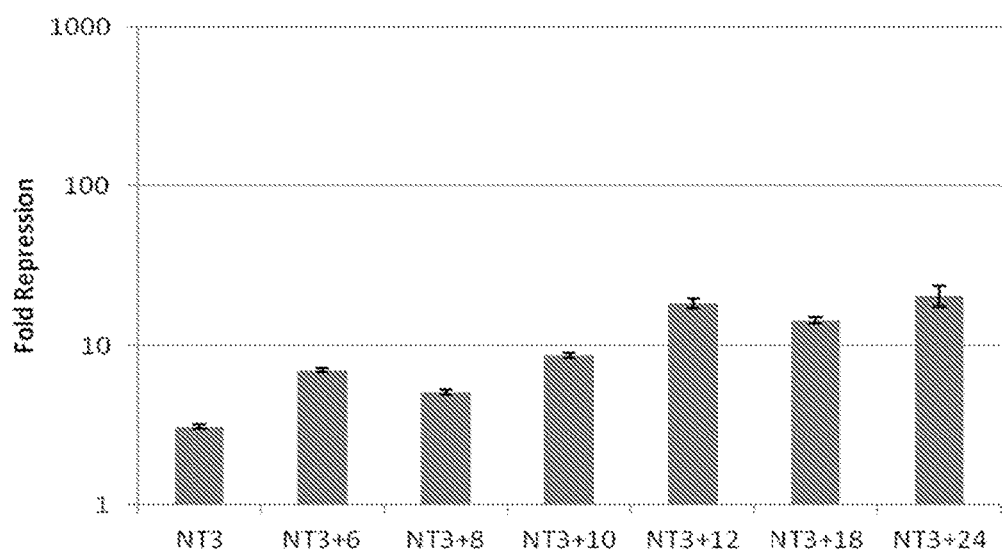
FIG. 14 shows average fold-repression of NT3 increasing spacer length variants. The designated length is in addition to the standard 30 nucleotides. For instance, NT3+12 encodes a spacer of 42 nucleotides.
Figure 15:
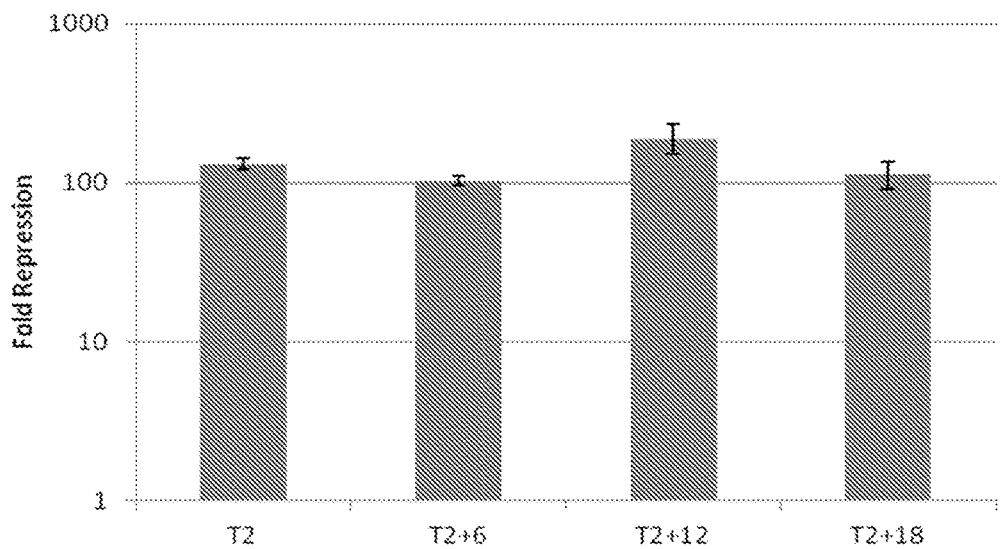
FIG. 15 shows average fold-repression of T2 spacer length variants. See FIG. 14 for more information about the spacer length.
Figure 16:
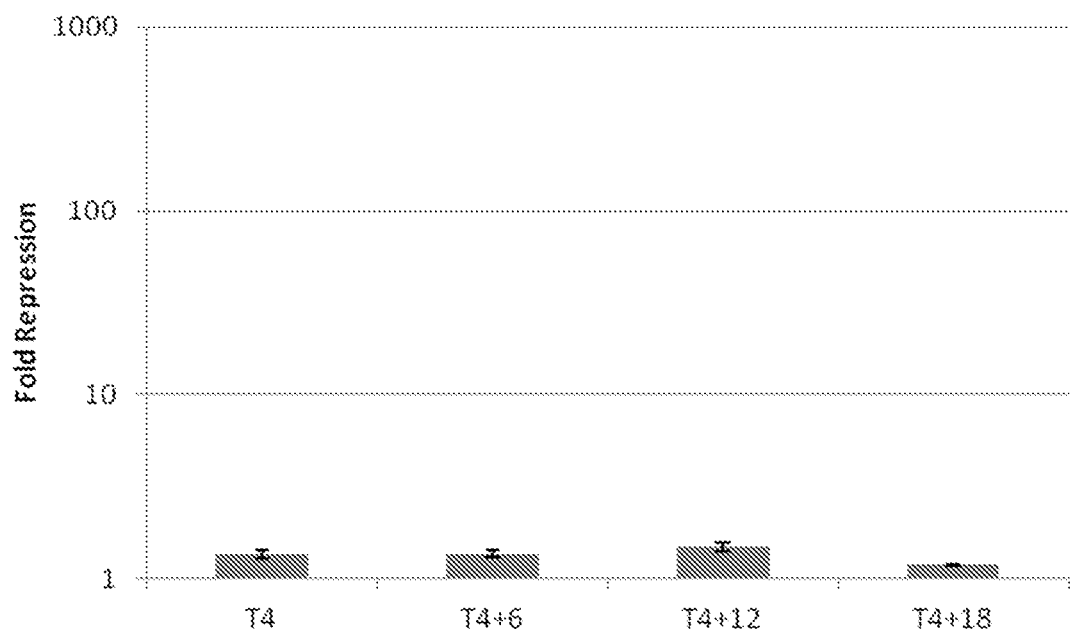
FIG. 16 shows average fold-repression of T4 spacer length variants. See FIG. 14 for more information about the spacer length.

The effect of spacer length and other characteristics of the Type 1 CRISPR-Cas system was studied. The spacer was extended from its 3' end, which preserves the location of the PAM. FIG. 13 shows a schematic of different locations that were targeted. FIG. 14 goes up to a +24 nucleotide to NT3 spacer and shows that increasing spacer length improves silencing efficiency, though the trend is non-monotonic. FIG. 15 shows that increasing spacer length does not appear to improve silencing efficiency with the T2 spacer as the "normal" spacer length has already reduced fluorescence to near-background levels, leaving little room for possible silencing improvement. FIG. 16 shows that increasing spacer length does not appear to improve silencing efficiency with the T4 spacer.

Figure 17:
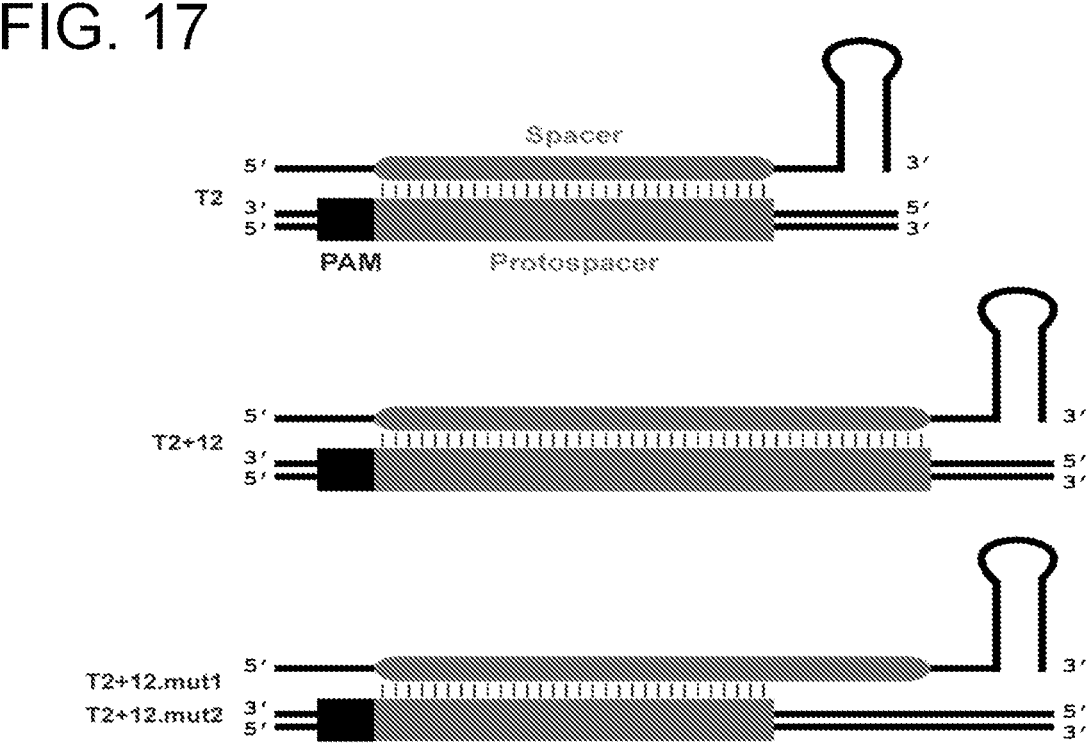
FIG. 17 shows a schematic of disrupting base-pairing interactions between the longer spacer and the target. The bottom image depicts the T2+12 mutants where the extra 12 nucleotides distal to the 5' handle of the crRNA were designed not to base-pair to the target. Base-pairing is maintained between the first 30 nucleotides of the spacer to the target.
Figure 18:
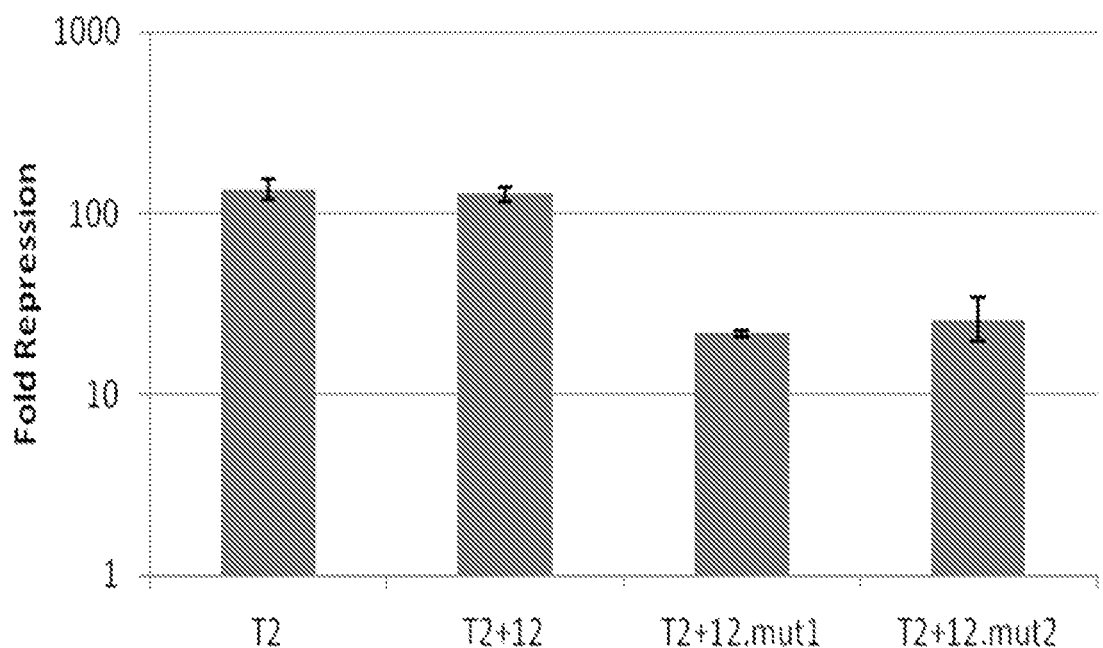
FIG. 18 shows average fold-repression of the T2 mutant spacers.
Figure 19:
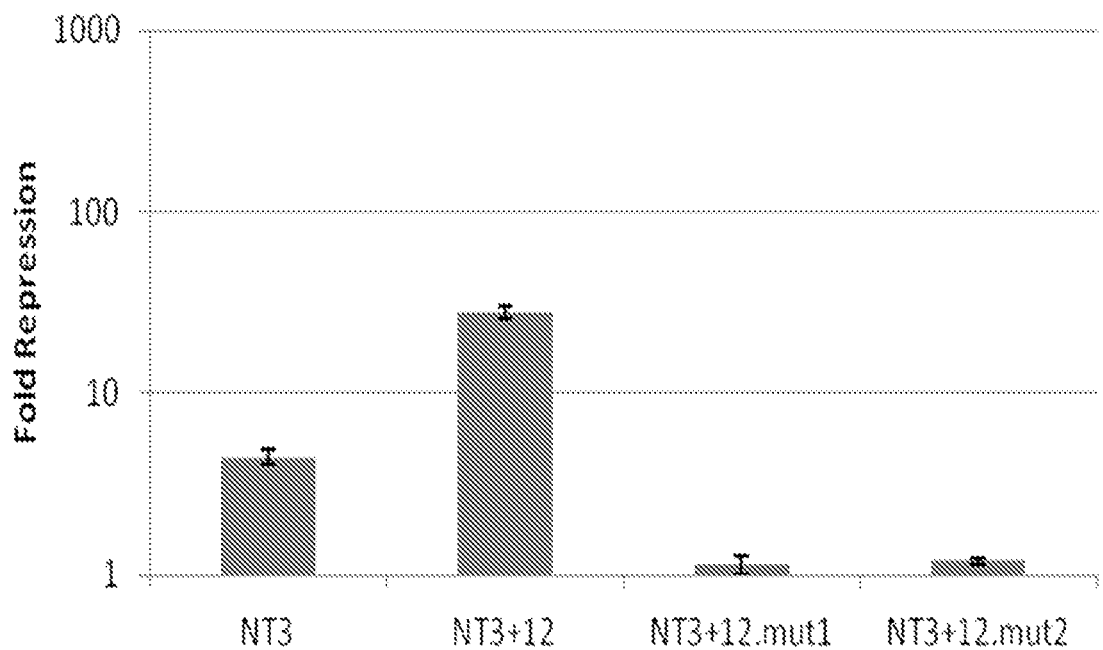
FIG. 19 shows average fold-repression of NT3 mutant spacers.

FIGS. 17, 18, and 19 show how the amount of complementarity affects the effect of silencing with the longer spacers. FIG. 17 shows a schematic of disrupting base-pairing interactions between the longer spacer and the target. FIGS. 18 and 19 show the disruption of base-pairing with the extra nucleotides reduced the silencing efficiency by about 10-fold. Overall, the data show that the silencing efficiency can be altered by varying the length of the spacer and extended base pairing must be maintained to preserve silencing activity.

Example 17. Targeted Gene Repression with Cascade from the Bacillus halodurans Type I-C Crispr-Cas System The three genes associated with the I-C Cascade complex (cas5c, cas8c, and cas7) were expressed from a constitutive plasmid in Escherichia coli. The E. coli cells also harbored a plasmid encoding the green fluorescent protein (gfp) gene controlled by the lac promoter and another plasmid encoding the B. halodurans repeat (spacer −) or a repeat-spacer-repeat (spacer+). The integrated spacer was designed to target a sequence within the lac promoter with a flanking CTC or TTC PAM. Both PAM's were predicted for Type I-C systems. Cells harboring the three plasmids were grown overnight in LB with appropriate antibiotics, back-diluted into the same medium, and cultured until reaching mid-log phase. The cultures were then analyzed by flow cytometry analysis. The reported values are the mean fluorescence of the unimodal histogram minus the fluorescence of GFP-negative cells.

Figure 20A:
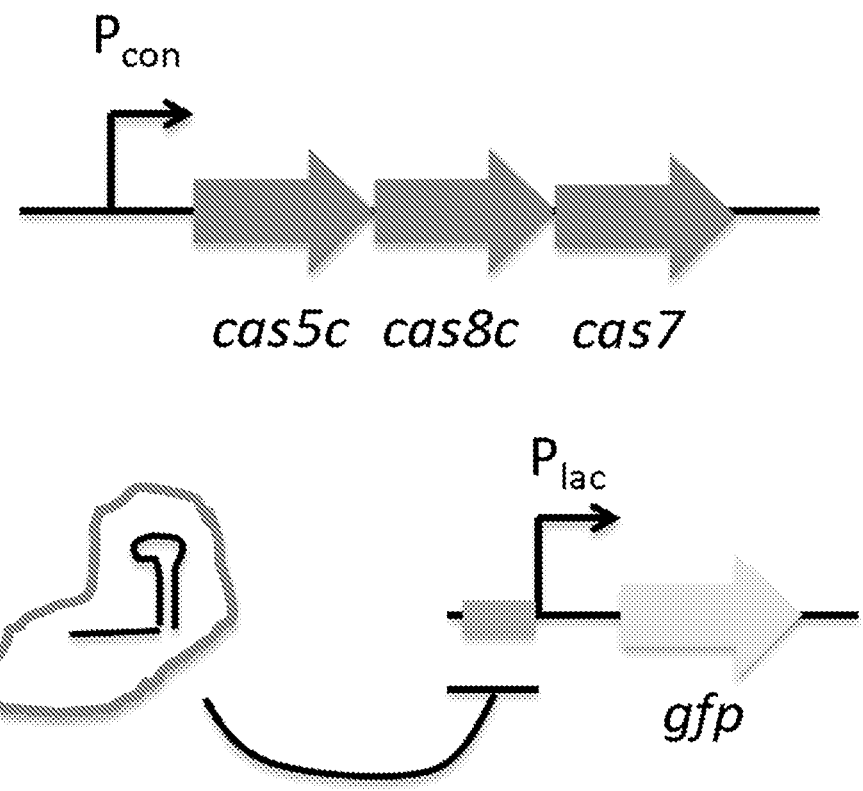
FIGS. 20A-20B shows targeted gene repression with Cascade from the *Bacillus halodurans* Type I-C CRISPR-Cas system.
Figure 20B:
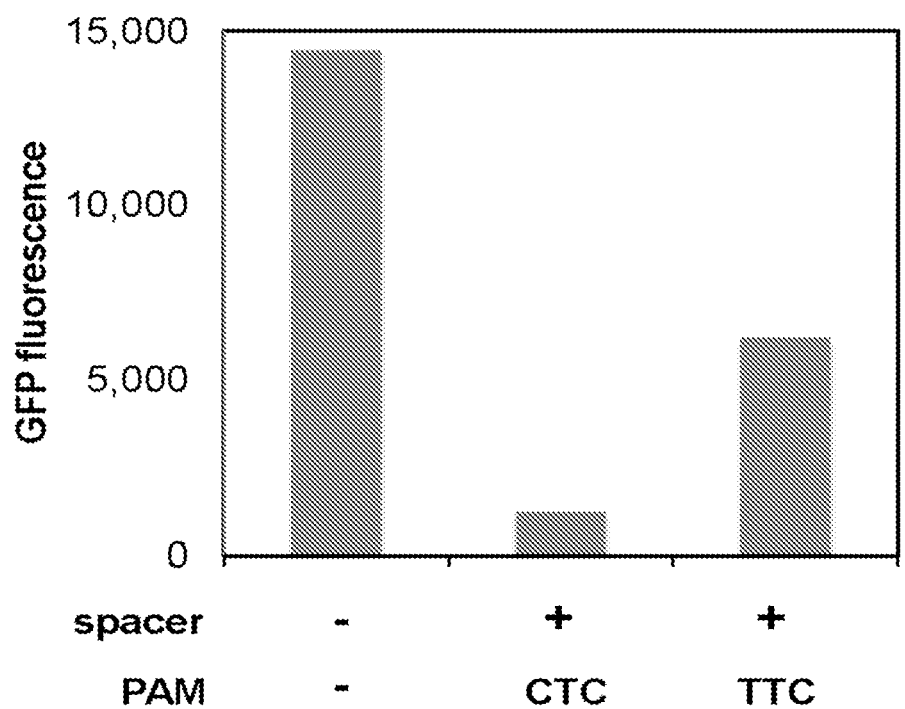

FIG. 20A shows B. halodurans Type I-C Cascade operon under the control of a constitutive promoter. As depicted below, the CRISPR RNA guides Cascade to bind the lac promoter controlling GFP expression; FIG. 20B shows analysis of cultures by flow cytometry analysis. The data demonstrate repression by the I-C Cascade from B. halodurans, where the extent of repression varied between the two different PAM's. These data demonstrate our ability to enact targeted gene silencing using heterologously expressed Cascade and the applicability of our general approach beyond the Type I-E system.

The foregoing is illustrative of the invention, and is not to be construed as limiting thereof. The invention is defined by the following claims, with equivalents of the claims to be included therein.

SEQUENCE LISTING (15493 sequences)

SEQ ID NO: 1 - protein, 346 aa, Aeropyrum pernix K1
AYVRVAGRVRVNVAVLTGHGTAGNYSMHARARVYCCGDSSKVYEVPVLTGNSLKHWHAYYAAQVYQALGGSMLNELCKRGIGLRGYNVDTNLEGERRLATRESEAIKDFCNDLHGFLIAERGRQLKRDSLARFSFAIPVLNNEVLENIEKFSVTHNRVDPLQRRRAGEESNSQETGATEMMVFKQEYSSGLYGISASFDLEYLCRPLYESEEGGSACDEEERMRRARASLLALAYLLGGAASKQARALPIAMVEELVVAVCNKPVPNAVHGSYENYVEKTASLLKSVTESLGDGASCILHCYPEGICGGYGSDKLKIKEYRDLGTLLKEAADHASELVGGYGGKEA

SEQ ID NO: 2 - protein, 320 aa, Sulfolobus solfataricus P2
IGGSGRFLVNLESLNGVESIGNLTKHRTAPVVLKTSTGYLVRYVPVISGEALAHAYQASLVDIAKKEGLPVGNLSSQYEFIKFSTDEALKIEGIKEPKDYNDARRFEVEVMLKDVIADVGGFMYAGSAPVRRTSRIKLGYMIPALRGDEIPAQLEAQFHVRFSNKPVKGSQAIFNVEVSSALYTFSFELDEDLIAVPSTVGEKVKGEEELERQKARRVDSAIKALYSLLAGNFGGKRSRFLPSMKLMSLVVVKTDFPFIPEPGHDDSYIKTTVMRLEKAKSVLNGNVAKVYVINNEGIEVGEGATVLSSVEDLVAKLKEK

SEQ ID NO: 3 - protein, 328 aa, Thermoproteus tenax Kra 1
RVAPPYVRAAGRFEAQLSVLTGAGNMGNYNMHAVAKVIHGGKAYEVPVLTGNALKHWHSVYLAEVYQDLGGTQLNEFCKKGVGLRGKNMSGEDASSEAEAIKDLCNDLHGFLLPDKQIKRDSLVRVSFAVPVLEEKNLEAASKFAVVHNRVDPFKRTQQVKSKEEQEGTEMMVFKQEYSSAVYGFAAAMDLGLSGVPLYQEGESGVDDRERALRIKSALVALLRLFNGVGSKQARALPIARLRELVIAISDSPIPNLVHGAYPDYVARSAELLTAYLKAVGKKGVVLCYGVDCPQSNNVLECKKADTLDDLFQEALRRALPGGQPARR

SEQ ID NO: 4 - protein, 130 aa, Aeropyrum pernix K1
ERVDGQRDPVEDLARAARIVILAEEAYDITDTLASRPSSYEEQLALLARLAVKVYKDLESFYNKGEGERVEEALKRLKYMAANLEKLFRYLRCVEAEGGEKLLNREVRRLAALSLAPDYHALSVREILWG

SEQ ID NO: 5 - protein, 373 aa, Aeropyrum pernix K1
VCILYTPGHNLYTDTLILYGIARLLAWSGKVSGEVERVGERYVVKVDADNCHPVSQLPESIRLALRLLQEEQQQVFLGDEGTFYSDLYRLARGSKVGESILNNLRIRVAAKILSNDANILEKYVSPGHKKLQGEFRGRKKGLVTLVLPLGPLYGKFYTWSLKPRRLTEKPYVVCPYCYFLSVLGFHYGSYTYQKDGESKVVTLSPHHASLEDVLALSQSFEAASIWMPAILRYRNSLTGPGLSLYVLSLGETLLSSSSHFEVLYGEFSVDNNTFRVVDVGRLPGVLLTSIAIIKYHMASWPRLIDFIARRDPGLLHRIALTLSFEVGNEYALYGILREILSLLNDDKSQEARYLAKQLDRLAEGLAMVWESGG

SEQ ID NO: 6 - protein, 360 aa, Thermoproteus tenax Kra 1
TQCPQEMITPGHGIIADALIMHGLIKILHIEGKMEGWAERRGERFVVCAERPDLNWIDQWEPMELLEIAAEFKAKGKDRASEEEEQRPYFGLVHDLSRSTVDPGNFSSWISDVREALYALKADFDLSEEHKEKRGEGRARSKKRGYYTLYLPLSGVYGKYVVENYGIRQSQYAVCATCFALSTLGYIYGTVKARVERRSSSGGGHDVFNLTFIPRERTSLRSLMALQRMAGLVEMRPGDLNELGAVVYMLSVGETIYAVREGVDILVWVTQRAGNFQRTVGVNIFRGDRLLEAIAEIKYRAPSWPKIARQLGSSLNVLGEYLAFGGDVYHVIRSVMADLGRKGGKLAGLEGLAEALKKIG

SEQ ID NO: 7 - protein, 281 aa, Aeropyrum pernix K1
RPGDWVVVAELATPAFSVKNPESYQVASPLPLPLPSTLLGGLMRGASLLGSCTGGIASQSCIKKTGRIVKAAAPLSKPGQILGVEWEVVLRRLRKVLEPDSEEGSTRENRGNRVLDELSRISDALLRGYITPYNPVYAVFVARGRDNANRIEKALWYIDRLGDSESLVSARPVGRCQLAEFRSKSVNTPVALDSAVGGSFTVVYAPARAGRTGRTRRSEAIAIAMPVKKEAVERGYVLVYSEIEVEGSVYGCSVEGIDGRINVAVHESFHEVSGYGIWMPA

SEQ ID NO: 8 - protein, 239 aa, Sulfolobus solfataricus P2
IYSKVFLKLHWGFSVVKPSAAKAKSGFYLPPPTTLIGALSYGKFRGIDNTNLGKIYGSPAYNFRNVMATARLESEGAYTEDIVRNVISYFQRKDRRDNPRYIYGVIPTGKVYMPNGTLVVVYVTDSMSKEELEKLSWSITRIGGKECLVSVENVEIGEAKKVSGRMKTRYYFRDTVKVVGKKEFLEYVTFWEENGYIWGKEGGPIRYILPVATYPLASKEVEVEAKEAYEVGGEYVVFS

SEQ ID NO: 9 - protein, 225 aa, Thermoproteus tenax Kra 1
HYYLIEARAPLYSVKVVDVYQVASAYPLPTPHAVVGALGAAMAHAGMCRGLQCMKEAEGLVVAARPAAVGELAKFPAVLWRTRGVLEDKSLPAGLEDYAGARDAMVREYVYAHAVKILLVTRKRVPQHVIRLMARLGDSESYVSVVDVLEGKPRECGGLVNVAVRAAKARRGSYTLYRALDERGNRELFAYPVVEEGGVYRRGGVEVGSKVLCLGEAVFPEGDGW

SEQ ID NO: 10 - protein, 242 aa, Aeropyrum pernix K1
VIGLYKVSLILESTRPLPLLSWSGVVAARIVKECIGGREGLVSVEPLQKEGQPLNASPSKPSTIEEPNILLGATLNTTGFYRLRSSLPGCLDRWGFRVISFEVERWVPRLPRRVTTSRDAIEFTVEYWPTIYMFRSRPILYPSPQRLVYSVFSALARHTGLSLKGYANTLASNVELLGWNGRVGLYSIGRDRKVRAFYGRATYAATARYVELLQLVMEAAQVLHVGKSRGIGFGAVKTGSIM

SEQ ID NO: 11 - protein, 288 aa, Sulfolobus solfataricus P2
PLIFKIGYNVIPLQDVILPTPSSKVLKYLIQSGKLIPSLKDLITSRDKYKPIFISHLGFNQRRIFQTNGNLKTITKGSRLSSIIAFSTQANVLSEVADEGIFETVYGKFHIMIESIEIVEVEKLKEEVEKHMNDNIRVRFVSPTLLSSKVLLPPSLSERYKKIHAGYSTLPSVGLIVAYAYNVYCNLIGKKEVEVRAFKFGILSNALSRIIGYDLHPVTVAIGEDSKGNLRKARGVMGWIEFDIPDERLKRRALNYLLTSSYLGIGRSRGIGFGEIRLEFRKIEEKEG

SEQ ID NO: 12 - protein, 569 aa, Aeropyrum pernix K1
EYGCQPNVLKKTILKMVKRRIHVEGAKKAVNEALLNSQAKAAEEICRIAYESPGGVVFLGAPTGAGKTEVFMAPLLASFASKRPIAARGFLVEPMHSLIKAMVDRLKTSIETLGVSEDHGETVQPTFLYTAPITVTTPDTYFYGFAASRVYRILTHEGVETGRFSMPVGLQATSYTVFDEAHLVQDEVFLSPRLLSLVVAALARAGGLIVVSSATLPSYYKTVIREKLGDWRVEEVELDHTVLSPKIDVEVKNNSLEPDDVDCNVKGLVLVNTVSKSIRVYKSLKTRCSNSKVLLLHSLFKRRDKNSKIELLQKLLKEQDNGVIAVATQVLEVGVDLDFEALYTETAPIDSVIQRLGRIGRRRGRGYAIIYNAETHHPYPEKLYLKSKEIMDQLAGTYTPSIRTSSDLVNTVYERDVVDSLARLGDKLMLRALAYLESLAPLSYPPNDDLYFRPSAFIDIAILPCDIVGDGREWEPEWEEHLVRLSIPLSANERTSGWDRLTRLLSKAKEVYEVRSGPGGRRLIRASQRPKPGSTLVVCLENPEYVYNDEEGLLVSPLVGGRPRVGGKS

SEQ ID NO: 13 - protein, 514 aa, Sulfolobus solfataricus P2
KLRLRKHMRLVENMLSLADFYNDFITRHGFEERKGIEETLLNLENGHSVILKAPTGYGKTTLTMILANAVSSDIDLGSRVIHVLPYRAIVQDLYLKLKNYADRGVIYTKNIGAQDMDYQDSPFFMKKVNVTTLDTFILNLFKLPTVDFKLIFKNYGSHYEFPRALIYSSIVIFDEFHLLGEDGKSLGAGLAALEVLRDAGVPIVVTSATIDKGLERVLMNKLGKNVKVVNADDFKIDRKIYVNVLENDEISITEEKVKEGKRVLLVYNTRMGAIEAYKKLKGRGLSPILIHSKFSKKDRIDKVNKINEAKLVVSTQVIEAGIDTSFDVLITEASPSHNLIQRAGRVARYGKGGRGKLEGEVYIFPFSGKVYDEREVKETVERVRELKTIDENLLIERDYTEVIDSILAKDLSVIDNSVFVDSKKVKSIYEKICSITRNASIILGFPPNSNDVNDAIPLTEEEAIKIIESKGSSAFVGNGNVKLYNKKCLQLEMLKNDILGVRIQDYNSEIGGVY

SEQ ID NO: 14 - protein, 566 aa, Thermoproteus tenax Kra 1
MVGRRLDTLVRELSLAWCRSKGEPSCAVREDLLAEQAKAAEVIERSDGVILLKAPTGFGKTEIWTAPFFAQWLRGEWFAPRMYVVEPMHALLRQMKRRMEVYAQAVQGLGLPRLNVAEDHGEVAKPLFLYGGHIVLTTVDSLAYGYLARRVQRWREEGVERGRYSMPAGLLASAYIVLDEAHLIQDEAYLGPRVLGKIVCDLASAGAKVVISTATVPETFLKHIPCLGGRLTLGSGTVRRNVKVERRKGVLKAEEIECGKPTIVIVNTIERARRIYKQVRCGKKAVVHSLMRREDKERQLSKVLADGKVAEDAVLIGTQALEVGLDFSNLRALYTETAPVDALIQRIGRVGRDGDKAEAYIYEAEGDAPYPQTLMRATREALEKELLGGAALTSWEDAQRAVDKVYNEKAVEELMTRGLAWYGQALGYLQELSLFSYPPRGEVRIRPSNYITLVIADVKQDGDKGRYITEDDVERGAMKMSYTSRDDPRINALLQKVSTAYTVRGVATAKDETRYYLSELRRSWDGVEVVVVDRRDVEELYDEAGLDVAQLSGGGQKRKGRGRRRR

SEQ ID NO: 15 - protein, 281 aa, Aeropyrum pernix K1
SRVACAYIIRKATGEHECCETLEEHVQRSLEVWLGRLKKCYSSAVNRIIYSQGSQTLASVLGDPVAVAIVLHDIGKAVPAYQKKRIMRGRVQYRHELVSGALSLLAIEKAADMAGIGRNDRGLYVFEVPLAVMMHHESISMGVLAGELGERFVTLSVASLMLEDYYDGELWGLERLARTVKNMGAVGDAVVDVLKILSGSPPSRKEVLIALGRLKAYSLSGDTLSRLSARARVAGILHPLVVADSIAANEGRKRCNGDGGTWIVKRALGRDSQEPAEPCLS

SEQ ID NO: 16 - protein, 238 aa, Sulfolobus solfataricus P2
IKPCAYEKQGLIDHAIGSYRVLDGKISESYYKIISRRLERYGIVLDLNGVKEMVKDVVVLHDMGKAGEYYQNQFDDNCNPLKSNFSFIYHELGSALFFYYDYEPIDVEKAEEVKSLLTLAVLNHLNAIRVISDYLVNKFPDNFDERMIKLNKYGSIMLQNLRGVISKSLKVRDYTFDDYHDMLYAFSKKSDKYLKLYNLFLAPIMLGDNLDSSLVRNNGSKTGFVRILEGELNGGSTL

SEQ ID NO: 17 - protein, 226 aa, Thermoproteus tenax Kra 1
MSCCAYFRGRDCLQTYEDHITQALEACERLRPYYGRWMEKAFGTADAAALAVEFHDLGKLAKAYIAGNRARYRHEVLGAYFALKTLQTEARYYVAAAVALHHEPMILAAYAGELGERAIHVSTLRAMLKDSDLSLGCTPNYSYRPEVAAALREWASRPPTADDVADAFQELAVYLSGGAPEEARVKRLRVAGLLHVLTVCDNWGARGRPGEGTFISRYMTVSELGL

SEQ ID NO: 18 - protein, 272 aa, Haloferax volcanii DS2 [sequence omitted]

SEQ ID NO: 19 - protein, 300 aa, Thermotoga neapolitana
MPKNLKTQDIIKEGRVEKVRREGPSLSYVQLITVFLVDKNDKIITKRGCGMRIKINFQTTKARIPLNYNYFLSSFIYKRLAAQNENFARFLHESGYGKRFKFFTFSQLFFENSKVDGDKIVIFPGRGWWHISSPVVDFVRYMFSSLSEDPVIRVGKTEFFVQSITVEESLPALSEYNFVMISPLVVSVPEEKNGKLVHRYLHPCEEEFYEAFKKNLYKKYRIFYGKDPEGDVEIIPDWNYIKSRERITKRIKLKDVFVRAVVFPFRMRGDRKLVEIGYETGFGEKNSMGFGMVALKENKP

SEQ ID NO: 20 - protein, 244 aa, Thermotoga neapolitana
MNMRIFVKIQPESGSEGKFPADYRRIFMSLLKQVYKRTPFEEIVNSHDRIPKPYVFSVGFNKIKDISGDSIIFESPIFFNFSSSIPQMVGYLYNYIVSQDSIMNGLKVAGVDLPVPKIITSKTVTFKIMGSAVLTRAEKDRYYVLPEDNDFEEALNHSIQVRLNLSRELFETFGVRIPNFKPVKVVNKNLRKVPAKHYGGYIEAFSGTITLDGDPDVLSFLHENGLGVRTGQGFGMLKVVREWH

SEQ ID NO: 21 - protein, 717 aa, Haloferax volcanii DS2
MTGPDIDDFENALNAFWHGRPPASLEDVMALYGVLAVAESGGELYGTDSKLEPFVDDGRLVTIDIDLTGETPNVSDPKVDTLRVEDVSKLRYAHKSSGRGAKYSLTQIGSKNGNDAEGVASTILGRVRSWTTQDSVRSVTGEDGHPDGWIVEELAAVFEKGSDTLEALEEAIKALLPPDESLPTVITVRLRLDAGRLSHGEESGPRWFWPAELDVLEEAMKRYATANAADKNVESGDGISEGESVGLVTDRVERVVGTPDNPIGVFSVKHPDAQPGLRQDQSWRNYPVGADTAMLFSKGQDLVETCVLRRGGVETYALPYFAGELTPLKAQSLYGAIQSLDRESDYDDSGGSPLARVTYELRESDDETLQELAKTELRFYTITLPIGDDKNVIAEEPAAPVYWVSELADALAQTVHGPTLNPERGGFAPYDNWSLLELATEDFEESRKFGFYRIVGHQFTDSAFAYRGDDEDDDFRRVVDHRLIAGVPLDASMLFDEYLRRYHDESEGGDLPPHQIVAQQLVHLETLSRAGLLNGLDVPIEPPTMTTETETETDFDTTSLPAIREHRLESFLDRPLFEAPARRAAALAGVLVGQVSWHQESERNVGRPLDAQTKGDQLTKNSLENALTSALEKAKVYALDSEYRSDRDMLFPETVDRLLETTEDMPSAWPIEKRELQFCYVLGHAHGRRSMPVAFDLHEKEDEDDQDTEEPAESTTN

SEQ ID NO: 22 - protein, 455 aa, Thermotoga neapolitana
MALVIYPQGWLHNANVYGFLKVINEKSRERKISFELSDILKDDGTIVLEDKMLDELYLIDNFDNLSLPRLFVFILEETARIEGDIRKAYNYFKGNVGYYENYVAQVKEKQFMENLSKIVHYIFRKPSLEGTDRCFFCGNSLKTDEDRSILQRKQFSRILFKDFSSSEGKFPNSFWNMSNEFYLCDVCSQMALFRHFVFPKSGESIFVNVPSFKAIWYLNEAIKAYRDLSLELSVSRAISEVHLKLQRLLGIWERQNVEVIYYNSKSYRIYYMPQRVINLLLNTRISSILNSLNSIKIFEAVIYQERLNEILECEYLLLKYLFDVSSSGRSHLAENVKQYVGDVKRNAGYYMNTLPDLFQEVRSVMGVKQMVPVWRMRELGKEASQLFERTRYRLLELIRLAKKDEVYHLILKTYMANNKPFPEDLNRVFSAKDEDFKNLMFAYVSGMISGGEENE

SEQ ID NO: 23 - protein, 340 aa, Haloferax volcanii DS2
MTTLNRSELLFVYDAQDCNPNGNPIGDNRPRRDPDTGQGIITDVRLKRYLRDQLQDDGFDIYVKKTEGRSHTRTKLIKDVLGGVDDADDLEDLGDVAEAFLDAATDVRYFGSTLSFEASDKDEDEAFRDALNSSLPNNYQGPVQFLPSKSLNEVEENEEYDSLTSVISTGEGNRQGGFDLDDKRIKYGIFPFWGLVDNNGAESTNLSQADVERLDTLCWRALKNQTTSRSKLGQEPRLYVRVEYEEGNYHVGGLQNLLELGDDSSESLRSVKDVVVDVTELVETLERVADRIDTLHVVGDGRLELDIGDETIRADEFWSHLSEAGHDVHEIDVLNERDLA

SEQ ID NO: 24 - protein, 337 aa, Thermotoga neapolitana
SNPKAITATIVFESSAVNRDENIANNIQSLKKLRREDGVYTFFSRASMRHHVFNALVRKHGWKPARVAKDGDVIQFDVLEESILTSEELDFFGYMRTFESASLSRKAPVGMTKAVSLEKWEGDMAFYANHDLVQRAREIGESADPNPFSKEEHLSLYKYSVVVDLENIGKEKVIINEKQCEKLNRLFGIDLKELKEKESIANDKGTISLESVGEKSYRILVTLNDPEKQKRLKQFFDIIINGFEIHSSTESWCVSPVFIVIATTRLPVTLFNPYIKLDDGKIDVDLVAKIAEENTNVIDYRIWGVPFILKGEVDKLCKGPKDLNDWVTGVIGGKENS

SEQ ID NO: 25 - protein, 264 aa, Haloferax volcanii DS2
SPHIDANGVPIDCLSFTVRSTWGHFKRVGRSVTKQTYRIPPRTTVAGMLAAIVGADRDSYYDVFGADNSAIAITPLSDLRTVNIPTTGLGTDPKQDVTETAGSWRTYKLTYQNTTGDRQLHSYEVLADPAYRIDVALENEEFYDSLREHLVNGTSIYPPSLGKSEYLAVIEDVEVDREPEVQDIDETLDIDSVVPISLSEAVPQGKVTYGVERSPAVMVRESGGRRTTRFDDYVYAQQASNPVRIGEQTDVAPVQVGDRTVVFR

SEQ ID NO: 26 - protein, 260 aa, Thermotoga neapolitana
MKLLRIEIKASTGHFAIPFLIFERKTFPIPMYSTMIGFVCNILADEAKISRFLSSNFSMAVVGDHDGVVEEYTWFRNLSKESHTKKFICSFNREANNEIEHPGGQSPVKIQTLINPKINLFLKAEEWILEMVKESFENPQCISRPHLGRSEDVVDDIKVELIDCEKKQVFDTNGYTWMPSPEFVDDVSDSYEELYKRISGSVYRVSSVYIIQNNRRIFEFVHAKLHRGAIPMVGFKVPEVLSWNGTPIFLARIRFPDKGG

SEQ ID NO: 27 - protein, 226 aa, Desulfovibrio vulgaris DP4
THGAVKTYGIRLRVWGDYACFTRPEMKVERVSYDVMTPSAARGILEAIHWKPAIRWIVDRIHVLRPIVFDNVRRNEVSSKIPKPNPATAMRDRKPLYFLVDDGSNRQQRAATLLRNVDYVIEAHFELTDKAGAEDNAGKHLDIFRRRARAGQSFQQPCLGCREFPASFELLEGDVPLSCYAGEKRDLGYMLLDIDFERDMTPLFFKAVMEDGVITPPSRTSPEVRA

SEQ ID NO: 28 - protein, 241 aa, Streptococcus pyogenes MGAS5005
YRSRDFYVRVSGQRALFTNPATKGGSERSSYSVPTRQALNGIVDAIYYKPTFTNIVTEVKVINQIQTELQGVRALLHDYSADLSYVSYLSDVVYLIKFHFVWNEDRKDLNSDRLPAKHEAIMERSIRKGGRRDVFLGTRECLGLVDDISQEEYETTVSYYNGVNIDLGIMFHSFAYPKDKKTPLKSYFTKTVMKNGVITFKAQSECDIVNTLSSYAFKAPEEIKSVNDECMEYDAMEKGEN

SEQ ID NO: 29 - protein, 598 aa, Desulfovibrio vulgaris DP4
ILQALHGYYQRMSADPDAGMPPYGTSMENISFALVLDAKGTLRGIEDLREQDGKKLRPRKMAVPAAVTRTSGVKANFCWDKTAYVLGNDANGAAKNAERFAAFRELLTAVCADVDDEGFRAVTRFLDTWDPEQAAQVVAALHDWDDIVPANLVFRLEGTKGFIHDRPAIQKAWSAFCANSDNSPKGRCLITGERDVAQALVHTPIKGVAGGQTSGGYIVSFNAPAFVSYHKDKADVGEVAAFAYTTALNTLLARGSRQRVPIADATVVFWAERSSPAEDIFAGMFDPPSTTAKPESSNGTQPEDSEEGSQPDTTRDDPHAAARMHDLLVAIRSGKRATDIMPDMDESVRFHVLGLSPNAARLSVRFWEVDTVGHMLDKVGRHYRELEIVRQYDNEPEFPPLWLLLRQTAALNKTENISPVLAGGLFRAMLTGGPYPQSLLPAVLGRIRAEHTVTYYRAALIKAYLIRNRKLEVPVSLDPARTDRPYLLGRLFAVLEKAQEDAVPGANATIKDRYLASASANPGQVFHMLLKNASNHTAKLRKDPERKGSAIHYEIMMQEIIDNISDFPVTMSSDEQGLFMIGYYHQRKALFTKKNKEN

SEQ ID NO: 30 - protein, 630 aa, Streptococcus pyogenes MGAS5005
DFFTSLLKTYEKAELADLVDHQKRNNEPVLLPIYHTSLKSNGKNIISVKLDKDGQFHKAEFMADKQMIIFPVTADSVARSGSHPAPHPLVDKFAYYSAEMGQIQYDSFHKQLNNWIDYCEEGDVKKFLTFVQQFILKPEFLTLILDSLIGPDYQHNQLKVTFCDATGKEKLIDLSACFLEFSIDQFQGFKNESVSTFKALHQSYISFVEANRENLGICNISGREEQLTDKHRGLMGNAKIISVSNKREAYKGRFREREDVFSVGYETSEKIHLMLKYLLENKNTSTWLGSSQYLINWFSDDLTNDSRLDIVSPIFDDGLEEEDDDDTPPVITLATEDNKRIGKSFIKGQKLFANDATYYVAILNKTSNGRIALKYFRQLQASQLLTNLNKWQETYSWESRSKFGKSRLRTPTFHDILNVSYGVDRDRFLELDNDNFKSDQIQKLVASLIDGKPMPQSIVKKLGNNVKERHRYRKHWYQVEQVCLAILHKQNGEEFSPMLDHTNQNRSYLFGRLLAIFELIETLRYGLDGNNNDRITNAERYWTAYTGQPTKLMMLLENKIKPYEEPLKLNRRGSWMKLEKEKEEILELLNPLLETETMEKPLDYRFIFGYYAEKNYYYTKQNTEVTESEE

SEQ ID NO: 31 - protein, 289 aa, Desulfovibrio vulgaris DP4
TAIANRYEFVLLFDVENGNPNGDPDAGNMPRIDPETGHGLVTDVCLKRKIRNHVALTKEGAERFNIYIQEKAILNETHERAYTACKLKPEPKKLPKKVEDAKSVTDWMCTNFYDIRTFGAVMTTEVNCGQVRGPVQMAFARSVEPVVPQEVSITRMAVTTKAEAEKQQGDNRTMGRKHIVPYGLYVAHGFISAPLAEKTGFSDEDLTLFWDALVNMFEHDRSAARGLMSSRKLIVFKHQNKLGNAPAHKLFDLVKVSRAEGSSGPARSFADYAVTVGQAPEGVEVKEML

SEQ ID NO: 32 - protein, 281 aa, Streptococcus pyogenes MGAS5005
LEHKIDFMVTLEVKEANANGDPLNGNMPRTDAKGYGVMSDVSIKRKIRNRLQDMGKSIFVQANERIEDDFRSLEKRFSQHFTAKTPDKEIEEKANALWFDVRAFGQVFTYLKKSIGVRGPVSISMAKSLEPIVISSLQITRSTNGMEAKNNSGRSSDTMGTKHFVDYGVYVLKGSINAYFAEKTGFSQEDAEAIKEVLVSLFENDASSARPEGSMRVCEVFWFTHSSKLGNVSSARVFDLLEYHQSIEEKSTYDAYQIHLNQEKLAKYEAKGLTLEILEGL

SEQ ID NO: 33 - protein, 1079 aa, Methanospirillum hungatei JF-1
RTKKITSVFTHDMLFGEGHDDHGNMQEDYDLLLHEYFQTIDHPLRTSKYAYMPAKSVEFGKTDQPMINHVRNGIQALIELNKTLLQSGSAHYLPVSKLREVIALFSIHDLHKTIGKDWRDQFDLNEDEVMSFAHAIQADIFAPALTPNDFLSVAVATHPTQGFHGDLSHTFITYKNWVLLADIFASLEMPVVTEGMKKHIAFIDAKKTFFYHTFSESIGLLSNVVHAAVLEWAKQYALFPLLFFEKGVIYLGDKNSRFEFTQASQIEEIYQELKKKIQSSHESLSRPEKLQKYIQVQGSKGLFSVEESFFFYSGIHTVIKAFLAAAVMTSEKDNSGNFEIDTSTPSLTLNKSDLEMQYPPAEVIDVPAHFIKSISVDGNVIPVSDVRIICHGEERKAKKYTLVPDSVFVGEEEIFGLITITGIGLMPSMVGYRSHILSDFGVDTGWDESIIPLARAVSGIRKDVITELIKAGSLPTDDPLLEACRMFQTNDDLTQKMVTYASENRGQDHHSVGGFWNYSYAIARDILDREVNGIAFSQIASIQEKISYLNTLVDEYLSTISSENLEKFESAILYPYKEKLLVWLCENLSINGSMLYGSFENKTNKFKAYCDGTGICRLTNDTPYDKERKTTSKDVSMLKYTFSNRVPIGSSEPSLYVSVPVQIELGLRSIGHGIRKGSDKIYFRLIPDYHFSHTTASIFSQFANYFDGDSGTRVLDLAREFLREDVPSEDSIIELLIAETGRKNICQYAGLGFFYQNSTFDFVFNKKRNGDGEYWFFGSYLALILAYVTGCRVVAGENPICMTSGDEFSEFVLLEAPHVAVKRIFSDRIRLSDLKKTLMTASLIISMGYEIRMDDAAFVRFLQTFRNHPFPGSTLLKQIRRVYEQDKKKGGMGGFVNSARGWRKVDGEIIRSEYPGFIFQAVKLDTFGENPMAVASIHELARLGLSVAIPRNYDPHKVEKLFRESVKAILGKRGSQYPREDYVDAVSGRLLKMIKRAGDDQFSRTPGLYDFSLIVSFAEYFVDHIFYQVASGDPGKLKRAANDLADGFYSATLQLREEYFESRKEAFESEQDLSSEQEN

SEQ ID NO: 34 - protein, 1022 aa, Natronomonas pharaonis DSM 2160
TENDGKQTKLGEIESETDDVAEEEPAEGVGSFSPAFLANPEEEFETDPNSETVDAKLDNVLGEYISEVDPRLIEAGWAFLPNKSVEYGKVDQSMLNHTRNLVYFLHQLARQIENTDLPSITPKKLRHLVALAVAHDYHKLREEDENPNERFDIKIKELEPFIEEIGLDEFSSTPDDPESELSIRTFRSCAVDHHDTENANSTRVTTTWREYRPLIRLADSMASSATPEAATNNRVQDRFREAFPSGNFELAYHQTDHVSGVFTNLLNKVVSEYLQEEYDYQLLTMYQDGCVYLTPAELDQPETDEDIVAAITSRLGDSIGDSHPSYNDIDQLRSNFSIVGAQGLYSLNEPDFFYAGSGKMLQAVVRKGVTDGDADASATDAATESMELLEAELGTKFEKTEQQYGLGRFVNTIKSWFVDPLLPSDRTANDLIRATVTAFGLSDELAEDLVALSEETTSALTSGGKWEYSYAIAQGLLDRHGTGPVIPTVEDEIVMTLSDGFAALVEDDSDWQTRIQNAHAGDMATEVQAFIGETLRIGGGNLILTSATVDTYDEYVKSSRGKTCTLCSRGVAVGGNLGPMKSKQSLTTLQGGFSNREMVGGMKRDKLLLCSICRIEFSLRETAASRRDGGRLFFHLVPDYFYTPYSWRLYSRLVNRFTGENRVRLGRLAERVFDIDSLEEFTGVMDELTQPEGNGRTMIESLSQEFDRNRQFGAQTVGYFKNPDNDTEFQFFGAFLALTVSAYTGMRVYLSSSPVPEMRSRDFPEFAKIGSGFTQVTSFYGETVSLTSLQSELQSAAAVVKLGYAIQGNDRNDSLFAKYLRTTRNELLPGSYLLKRAVQTSDEGPYIPALMRYAVALDQRNAIRQSNSQMTDTPHNRISTLAELAYDAIRPASGHGRKPHRVERVFRESVKAVSKTGQQLDQEDYKMCVSGRLQKMIDRQAGDAVYPVSAEESDAGTPLQERIEEYAAYFVDEILYGIANGRPSQLKRLENNLADGFFGATLRAEAEYYDQKGEEKQKANEA

SEQ ID NO: 35 - protein, 334 aa, Methanospirillum hungatei JF-1
ADKVIQSFYASIKPYTLEKPERKPKQNYVSILILRELQSAARFTTDGTEANSSIIRIGDEEVTVGKLFGRKQVASDRRIAKALQRDLIAEKMNSFYKKGGWSGCSMEVTKMCQKCPECALFGSAASEGDMSVTSRVMYDEAYTIRGINSVVEEYFQNAPGDDYAKKATSGIREPDFFKEGTLFPCVVTLRDVTCEEVLFFLNITDRNTRYGATGTRFGKTRNHILGVFASNREGPSSLEISRGVALRLAGGDEVRLPDSESLKRVLELDSLPLHDVKKNALEVYQHLLKTHRISGIDLGESEVTALLDAMKDDAVIKEILITQIEKISDFLADQ

SEQ ID NO: 36 - protein, 328 aa, Natronomonas pharaonis DSM 2160
IPDNITNALADGTVPIDGMTNTPGTNYTTLLVLRELDSHAIFTTNGQDADITSLSVVGDSGSIEYSPGLMFMRKQTGSDRRAGKAIQRELLEYDRSDSMDVNDMNPQSVESALYGSAASGDDDVDIGVTSRVMYDTAFTVRDASACIDEKFQNAPGEGYAKGSTANIREPDFFEPGTLFPCTITLRDATPAEVAFVTAITSRNKRYGAATTRLGRVNNRILGLYTGSEEGPSNRELTAETIVSFASESNRTLGDVVQAPALNADQAAAYVREAYDTACTETVAQTPVDDEVLDELLALTDDDDLRAVLEAQQPHSRSFIDDAIAADES

SEQ ID NO: 37 - protein, 243 aa, Methanospirillum hungatei JF-1
NNQSSVRAFEGVLEMMSELFFASLEPGNNYTTRPLILNTALYYALGYCSGRYVNVPVKKGSAKQNPTYVEDTASFYSKLYVSPAKPVKSIRFASEITNARSDEYIQYNTYEKQMNSPTGKYGVRKQILPGGKFVFFVLSFDGNEPDLPVYIRLGKKRSKASVTWSECPVTRKKGSFILNHPVLVDDLTQIPSRDISFKRMQPFDVIERGSFEGEYIQIQRGGKEKKEDVVFPASIRFLQRIRS

SEQ ID NO: 38 - protein, 246 aa, Natronomonas pharaonis DSM 2160
EVLEATLTTHGKVGFASREVGRMADTDPYILNTALHYALGLAGGNYVDVTHQPTYIEDTADIVDEVYVTPATPVAVESESIRTEYLTTNRNARADTYATPNYPAEDDPTGKASQNLPTFERERALAPGNHFRFYVFPYGRTAKSAKETLPSYIRLGKKRGKGRVRYRIVEAERKSGTFSLGHPLSIYDHDAQPLGGVVMRQMQPTPLWFEGKFEADHYAIESPTESADRVYYPAGAKFLATKRGDV

SEQ ID NO: 39 - protein, 284 aa, Methanospirillum hungatei JF-1
HLIHLTVSPKTSFDIPLSDGYQLYSALLSFINEKNPSTSLKIHNSPLPSLSTTGLMGKFEKSFHKGHKRILEGEVYHWRIGVTDPEDEDLFTHIITPFLLDRKELSLHEGELCICSVETQYQSFQDIIQKVKECQRPAVKMDFITPTCIQYRNSRVTEMFPNRIAVFFSILSKYNQVCPEELRLSLNRDDFGRYLLESPHPQTYRTHSVLTNTIYDTKKQHHRPIFKQGFTGTCHYSFTSDAPAAIRNASLILAYFAEYCGVGSSVSRGCGQVIVSVVEESYEN

SEQ ID NO: 40 - protein, 289 aa, Natronomonas pharaonis DSM 2160
ASAGEKGTVVPQVRQVTVSLTPRTRFPVPKSDGYSVYSALLSVLSDVSEEIGSSVHDSPLGSLHNSGLLGPRGSSDRPHHKLLLPDETYELSLGIVHPEDGEVFQALVNALVLQNETVELSHGELEVREFESSNATHEELLAEASQYDDPTVEMTFQTATCIEEADGVTTMFPTRGAVFNSLLGKWNRSVPEELELDLTREEVDASVIEKPNDRSYQTHSVLVNRVKNDNGENRNIFRQGFTGECAYAFKGASESVENAVTALALFGEYSGVGSAVARGCGQVSTEVKD

SEQ ID NO: 41 - protein, 501 aa, Escherichia coli str. K-12 substr. MG1655
NLLIDNWIPVRPRNGGKVQIINLQSLYCSRDQWRLSLPRDDMELAALALLVCIGQIIAPAKDDVEFRHRIMNPLTEDEFQQLIAPWIDMFYLNHAEHPFMQTKGVKANDVTPMEKLLAGVSGATNCAFVNQPGQGEALCGGCTAIALFNQANQAPGFGGGFKSGLRGGTPVTTFVRGIDLRSTVLLNVLTLPRLQKQFPNESHTENQPTWIKPIKSNESIPASSIGFVRGLFWQPAHIELCDPIGIGKCSCCGQESNLRYTGFLKEKFTFTVNGLWPHPHSPCLVTVKKGEVEEKFLAFTTSAPSWTQISRVVVDKIIQNENGNRVAAVVNQFRNIAPQSPLELIMGGYRNNQASILERRHDVLMFNQGWQQYGNVINEIVTVGLGYKTALRKALYTFAEGFKNKDFKGAGVSVHETAERHFYRQSELLIPDVLANVNFSQADEVIADLRDKLHQLCEMLFNQSVAPYAHHPKLISTLALARATLYKHLRELKPQGGPSNG

SEQ ID NO: 42 - protein, 501 aa, Thermus thermophilus HB8
GSLEKFNLIDEPWIPVLKGGRVVEVGIGEALLRAHEFARIETPSPLEEAVLHRLLLAVLHRALSGPRCPEDVLDWWRKGGFPQDPIRDYLNRFRDRFFLFHPEAPFLQVADLPEENPLPWSKLLPELASGNNPTLFDHTTEENLPKATYAQAARALLVHQAFAPGGLLRRYGVGSAKDAPVARPALFLPTGQNLLETLLLNLVPYTPEDDAPIWEVPPLRLGDLEGARTKWPLTGRTRVYTWPARGVRLLDEGDGVRFMGYGPGVEPLEATHRDPMVAQRLDAKGNLLVLRLSEERSFWRDFSAMLPRQGGKVAATLEHAENLQGELEDEGLEGRITLRVLGQVSDQAKVLDIRREVYPLPSGLLTPKAEENLEKALKMAEELGQGLKHLAQEVAKAVVGERDRGHGRSPYLEELTKLANSLPLERLYWHALDGAFPRFFARVEEEASLDLWREALRGAALEAWKATRRFLGTGARHLKALAQGEQEFGRLLGELGEEVRT

SEQ ID NO: 43 - protein, 159 aa, Escherichia coli str. K-12 substr. MG1655
ADEIDAMALYRAWQQLDNGSCAQIRRVSEPDELRDIPAFYRLVQPFGWENPRHQQALLRMVFCLSAGKNVIRHQDKKSEQTTGISLGRALANSGRINERRIFQLIRADRTADMVQLRRLLTHAEPVLDWPLMARMLTWWGKRERQQLLEDFVLTTNKNA

SEQ ID NO: 44 - protein, 168 aa, Thermus thermophilus HB8
SPGERFLDWLKRLQGQKAWTAARAAFRRSLAFPPGAYPRAMPYVEPFLAKGDWRQEEREAHYLVAALYALKDGDHQVGRTLARALWEKAQGSASVEKRFLALLEADRDQIAFRLRQAVALVEGGIDFARLLDDLLRWFSPERHVQARWAREYYGAGASEEEKKKEVEA

SEQ ID NO: 45 - protein, 362 aa, Escherichia coli str. K-12 substr. MG1655
SNFINIHVLISHSPSCLNRDDMNMQKDAIFGGKRRVRISSQSLKRAMRKSGYYAQNIGESSLRTIHLAQLRDVLRQKLGERFDQKIIDKTLALLSGKSVDEAEKISADAVTPWVVGEIAWFCEQVAKAEADNLDDKKLLKVLKEDIAAIRVNLQQGVDIALSGRMATSGMMTELGKVDGAMSIAHAITTHQVDSDIDWFTAVDDLQEQGSAHLGTQEFSSGVFYRYANINLAQLQENLGGASREQALEIATHVVHMLATEVPGAKQRTYAAFNPADMVMVNFSDMPLSMANAFEKAVKAKDGFLQPSIQAFNQYWDRVANGYGLNGAAAQFSLSDVDPITAQVKQMPTLEQLKSWVRNNGEA

SEQ ID NO: 46 - protein, 370 aa, Thermus thermophilus HB8
KLLEVHILQTVAPSNLNRDDTGSPKDALFGGFRRARISSQAQKRAVRVAFRDWPLLSEEERAVRTKRLVEELLRRLAGVEEELARRAIENALNALGFGVKEGRTEYLLFLGNRELDALAQGIRENLEALSGEVKGKKKAEVPPELKKALERVLDGGKAVDLALFGRMLADRPELGVDAAAQVAHALSTHKVDREFDFYTAVDDLNPKEDTGAGMMGDVEFYSATLYRYAVVDLDKLVENLQGDKELALKGVLAFLEAFALTLPSGKQNSFAAHNPPLFVAFRAGEGMPRNLATAFEAPLRPKEEVPLSRLSAEALLKEWAKFDRVYGPLEPEWKGALDLTGAEGDGVPRLENLKALKEKAAEAVKALLGV

SEQ ID NO: 47 - protein, 223 aa, Escherichia coli str. K-12 substr. MG1655
RSYLILRLAGPMQAWGQPTFEGTRPTGRFPTRSGLLGLLGACLGIQRDDTSSLQALSESVQFAVRCDELILDDRRVSVTGLRDYHTVLGAREDYRGLKSHETIQTWREYLCDASFTVALWLTPHATMVISELEKAVLKPRYTPYLGRRSCPLTHPLFLGTCQASDPQKALLNYEPVGGDIYSEESVTGHHLKFTARDEPMITLPRQFASREWYVIKGGMDVSQ

SEQ ID NO: 48 - protein, 247 aa, Thermus thermophilus HB8
PTLLIRLQGPLQSWGTRSRFDHRDTWPYPTKSGVVGLLAAALGRDRREDVSDLAALRMGVRVDRKGVLKVDYQTAQFVYRTEGYVAVSTPKEREWLSRYTKTPIRVDERNATVTSKRYFLSDAAFLVGLEGERALLEALHRALKNPRFPLYLGRKSYVPSPPPYLPDGLVEAPLAEALEGYPYLLGGKPPEDLLLALEAEEGRLVYDQPAGPFSERRFAARFVREEVLPKERVPEGPPAWEVARVAH

SEQ ID NO: 49 - protein, 198 aa, Escherichia coli str. K-12 substr. MG1655
YLSKVIIARAWSRDLYQLHQGLWHLFPNRPDAARDFLFHVEKRNTPEGCHVLLQSAQMPVSTAVATVIKTKQVEFQLQVGVPLYFRLRANPIKTILDNQKRLDSKGNIKRCRVPLIKEAEQIAWLQRKLGNAARVEDVHPISERPQYFSGDGKSGKIQTVCFEGVLTINDAPALIDLVQQGIGPAKSMGCGLLSLAPL

SEQ ID NO: 50 - protein, 210 aa, Thermus thermophilus HB8
WLTKLVLNPASRAARRDLANPYEMHRTLSKAVSRALEEGRERLLWRLEPARGLEPPVVLVQTLTEPDWSVLDEGYAQVFPPKPFHPALKPGQRLRFRLRANPAKRLAATGKRVALKTPAEKVAWLERRLEEGGFRLLEGERGPWVQILQDTFLEVRRKKDGEEAGKLLQVQAVLFEGRLEVVDPERALATLRRGVGPGKALGLGLLSVAP

SEQ ID NO: 51 - protein, 448 aa, Yersinia pestis CO92
MSDEGLAAFIVSYIKSREQPKLEAFDKEAEKRLAGLTQAEDIALAQQEIAQQRQELIARYEVRNWLTDAANRAGQIKLATHAPKYTHSDSKSSGILNIELQSKKKDYFSSVDLAEQASDVIGNAAVFDLVKLLQSECEGGSLIKCLEQGDNSVLKLFSNDDELVEEWTTKFKSILNNEKFTSHKLAKQFYFPVGPDQYHLLSPLFSSSLAQAMHQRIIEARFSDQSKEAKAAHKAGRWHPTVRVLYLDTAVQHIGGTKPQNISYLNSVRGGKVWLLPCGAPSWKNIQKPPIKYRSIFHDRSEFTVLARNNLWQMQLYLLGVKPLSNTMDIRAARLACCDEIIDILFNYVAEIQNLDGTNGWSDAEDCKLKRSEQLWLDPTRAMDDPVFKLEREKEDWKQEVSQDFGYWLNRWLQHDELVFGYVEQREWSSLFKQRLREFEQGSLETSS

SEQ ID NO: 52 - protein, 433 aa, Pseudomonas aeruginosa UCBPP-PA14
TSPLPTPTWQELRQFIESFIQERLQGKLDKLQPDEDDKRQTLLATHRREAWLADAARRVGQLQLVTHTLKPIHPDARGSNLHSLPQAPGQPGLAGSHELGDRLVSDVVGNAAALDVFKFLSLQYQGKNLLNWLTEDSAEALQALSDNAEQAREWRQAFIGITTVKGAPASHSLAKQLYFPLPGSGYHLLAPLFPTSLVHHVHALLREARFGDAAKAAREARSRQESWPHGFSEYPNLAIQKFGGTKPQNISQLNNERRGENWLLPSLPPNWQRQNVNAPMRHSSVFEHDFGRTPEVSRLTRTLQRFLAKTVHNNLAIRQRRAQLVAQICDEALQYAARLRELEPGWSATPGCQLHDAEQLWLDPLRAQTDETFLQRRLRGDWPAEVGNRFANWLNRAVSSDSQILGSPEAAQWSQELSKELTMFKEILEDERD

SEQ ID NO: 53 - protein, 316 aa, Yersinia pestis CO92
MSSLIVLHQVRVENANAIAGLTYGFPAITHFLGYSHALSRKLQSSHGLTLRGCAVICHYQQVHAYLSGWDYVFSLTRNPLTKEAKTAAFNEEGRMHMTVSLVIECDGTIANGDDGANALEKHLASLCLTQRLAGGTITNIRRVKVINYPETEVATRRLLCRLLPGFALLDRSELLAEHLNRLRQTNPQAEMLDAWLDFSALKIQAIPPQSDTPVESGAPAPWGYVGKPAAGYLVPIVTGYRAISPLYAPGEVDKTRDPHTPFRFVESLYGIGEWRGLHRITDLRQLLWGYHQEGDNYLCRCALPASVDTYLLNDEE

SEQ ID NO: 54 - protein, 326 aa, Pseudomonas aeruginosa UCBPP-PA14
SVTDPEALLLLPRLSIQNANAISSPLTWGFPSPGAFTGFVHALQRRVGISLDIELDGVGIVCHRFEAQISQPAGKRTKVFNLTRNPLNRDGSTAAIVEEGRAHLEVSLLLGVHGDGLDDHPAQEIARQVQEQAGAMRLAGGSILPWCNERFPAPNAELLMLGGSDEQRRKNQRRLTRRLLPGFALVSREALLQQHLETLRTTLPEATTLDALLDLCRINFEPPATSSEEEASPPDAAWQVRDKPGWLVPIPAGYNALSPLYLPGEVRNARDRETPLRFVENLFGLGEWLSPHRVAALSDLLWYHHAEPDKGLYRWSTPRFVEHAIA

SEQ ID NO: 55 - protein, 334 aa, Yersinia pestis CO92
MAKATIKTASVLAFERKLSNSDAMMYAGNWGQTDNWQPIIIKEKAVRGTISNRLKNALASDPAKLDAEIQKANLQRVDVAALPFDTDTLKMSFTLRVLGNLATPSVCNDQEYQAELASVINGYISEQSFSVLAARYAENLANGRFLWRNRVGAEDIKVCITSQTKSYQFDSNEFSLRQFSQPSKELTALAQEIEQGLAGNGFAFFTVDAFVRLGNGQEVFPSQELVLDSNSKKSKVLYQIDGIAALHSQKVGNALRTIDDWYPDATELALGPIAVEPYGSVTSRGKAYRQPKQKMDFYTLLDNWVTKGTVPAVEQQHYVMATLIRGGVFGEKGE

SEQ ID NO: 56 - protein, 341 aa, Pseudomonas aeruginosa UCBPP-PA14
SKPILSTASVLAFERKLDPSDALMSAGAWAQRDASQEWPAVTVREKSVRGTISNRLKTKDRDPAKLDASIQSPNLQTVDVANLPSDADTLKVRFTLRVLGGAGTPSACNDAAYRDKLLQTVATYVNDQGFAELARRYAHNLANARFLWRNRVGAEAVEVRINHIRQGEVARAWRFDALAIGLRDFKADAELDALAELIASGLSGSGHVLLEVVAFARIGDGQEVFPSQELILDKGDKKGQKSKTLYSVRDAAAIHSQKIGNALRTIDTWYPDEDGLGPIAVEPYGSVTSQGKAYRQPKQKLDFYTLLDNWVLRDEAPAVEQQHYVIANLIRGGVFGEAEEK

SEQ ID NO: 57 - protein, 183 aa, Yersinia pestis CO92
DHYLDIRVLPDPEFSAQTLLEALFAKLHRALVATIPGRVGVSFPTAGKTLGSQLRLHGSRGDLLELQSAGWLKGLQDYCECSEILPVPADVKHRTIRRVQVKSSAQRLRRRSVSKGWLTEEQARLRIPDSHDKRCDLPFLRLKSRSSEQYFLLFIEQGTLQASATTGEFSAYGLSVNATIPWF

SEQ ID NO: 58 - protein, 166 aa, Pseudomonas aeruginosa UCBPP-PA14
SVLFGKLHQALVAQGGDRIGVSFPDLDESRSRLGERLRIHASADDLRALLARPWLEGLRDHLQFGEPAVVPHPTPYRQVSRVQAKSNPERLRRRLMRRHDLSEEEARKRIPDTVARALDLPFVTLRSQSTGQHFRLFIRHGPLQVTAEEGGFTCYGLSKGGFVPWF

SEQ ID NO: 59 - DNA, 25 bp, Aeropyrum pernix K1
gcatatccctaaagggaatagaaag

SEQ ID NO: 60 - DNA, 24 bp, Sulfolobus solfataricus P2
ctttcaattctatagtagattagc

SEQ ID NO: 61 - DNA, 24 bp, Thermoproteus tenax Kra 1
ctttcaatcctctttttgagattc

SEQ ID NO: 62 - DNA, 31 bp, Haloferax volcanii DS2
ggtttcagacgaacccttgtgggtttgaagc

SEQ ID NO: 63 - DNA, 30 bp, Thermotoga neapolitana DSM 4359
gtttcaatacttccttagaggtatggaaac

SEQ ID NO: 64 - DNA, 32 bp, Desulfovibrio vulgaris DP4
gtttcaatccacgcccccgcacggggggcgac

SEQ ID NO: 65 - DNA, 32 bp, Streptococcus pyogenes MGAS5005
atttcaatccactcacccatgaagggtgagac

SEQ ID NO: 66 - DNA, 37 bp, Methanospirillum hungatei JF-1
gtttcaatccctatcgggttttcttttccattgtgac

SEQ ID NO: 67 - DNA, 37 bp, Natronomonas pharaonis DSM 2160
gtcgagacggactgaaaacccagaacgggattgaaac

SEQ ID NO: 68 - DNA, 28 bp, Escherichia coli str. K-12 substr. MG1655
ggtttatccccgctggcgcggggaacac

SEQ ID NO: 69 - DNA, 27 bp, Escherichia coli
gttccccgcgccagcggggataaaccg

SEQ ID NO: 70 - DNA, 29 bp, Thermus thermophilus HB8
gtagtccccacgcgtgtggggatggaccg

SEQ ID NO: 71 - DNA, 28 bp, Yersinia pestis CO92
tttctaagctgcctgtgcggcagtgaac

SEQ ID NO: 72 - DNA, 28 bp, Pseudomonas aeruginosa UCBPP-PA14
gttcactgccgtataggcagctaagaaa

SEQ ID NO: 73 - DNA, 25 bp, Aeropyrum pernix K1
gcatatccctaaagggaatagaaag

SEQ ID NO: 74 - DNA, 24 bp, Sulfolobus solfataricus P2
ctttcaattctatagtagattagc

SEQ ID NO: 75 - DNA, 24 bp, Thermoproteus tenax Kra 1
ctttcaatcctctttttgagattc

SEQ ID NO: 76 - DNA, 30 bp, Acetobacterium woodii DSM 1030
atttacattccaatatggatctactcaaat

SEQ ID NO: 77 - DNA, 29 bp, Caldicellulosiruptor hydrothermalis 108
gtttacatccctaatagttcagataaaac

SEQ ID NO: 78 - DNA, 37 bp, Chloroflexus aggregans DSM 9485
gtttcagtgctctaccgtgagccgaaagtattgaaag

SEQ ID NO: 79 - DNA, 30 bp, Clostridium acidurici 9a
gcattaatagaactaaagtagaatgtaaat

SEQ ID NO: 80 - DNA, 37 bp, Halobacteroides halobius DSM 5150
gttacaaaccttactccgttaagtaggagactgaaag

SEQ ID NO: 81 - DNA, 29 bp, Sulfurihydrogenibium sp. YO3AOP1
ctttataacccacacggttcagatgtaac

SEQ ID NO: 82 - DNA, 36 bp, Synechococcus sp. PCC 6312
gtgctcaacgccttacggcatctaaggtagaggaac

SEQ ID NO: 83 - DNA, 29 bp, Thermoanaerobacter mathranii subsp. mathranii str. A3
atttacatccctcatagttcagataaaac

SEQ ID NO: 84 - DNA, 24 bp, Sulfolobus islandicus M.16.4
gataatctactatagaattgaaag

SEQ ID NO: 85 - DNA, 25 bp, Staphylothermus marinus F1
ctttcaattctttctatgttgttac

SEQ ID NO: 86 - DNA, 30 bp, Pyrococcus yayanosii CH1
gttccaataagactcaaagagaattgaaag

SEQ ID NO: 87 - DNA, 25 bp, Pyrobaculum oguniense TE7
gtttcaactatcttttgattttgac

SEQ ID NO: 88 - DNA, 24 bp, Metallosphaera sedula DSM 5348
ctttcaactctataggagattaac

SEQ ID NO: 89 - DNA, 26 bp, Candidatus Korarchaeum cryptofilum OPF8
tctttcaatcctcttttcatcgagac

SEQ ID NO: 90 - DNA, 30 bp, Thermotoga thermarum DSM 5069
gtttgaaccctacctataaggaatggaaac

SEQ ID NO: 91 - DNA, 30 bp, Thermodesulfovibrio yellowstonii DSM 11347
gttttgagcctacctatgaggaattgaaac

SEQ ID NO: 92 - DNA, 30 bp, Thermococcus litoralis DSM 5473
ctttcaattcttctaaagtcttattggaac

SEQ ID NO: 93 - DNA, 31 bp, Haloferax volcanii DS2; identical to SEQ ID NO: 62

SEQ ID NO: 94 - DNA, 30 bp, Thermotoga neapolitana DSM 4359; identical to SEQ ID NO: 63

SEQ ID NO: 95 - DNA, 30 bp, Ammonifex degensii KC4
gtttgtagcctacctatgagggattgaaac

SEQ ID NO: 96 - DNA, 30 bp, Anaerobaculum mobile DSM 13181
gtttccatccctcataggaagttcaaaaac

SEQ ID NO: 97 - DNA, 30 bp, Carboxydothermus hydrogenoformans Z-2901
gtttcaatcccagaatggttcgattaaaac

SEQ ID NO: 98 - DNA, 30 bp, Deferribacter desulfuricans SSM1
gtttcaattcctcataggcactctaaaaac

SEQ ID NO: 99 - DNA, 37 bp, Desulfobacterium autotrophicum HRM2
cctggaatgcctgatccacgacaacaaggattgaaac

SEQ ID NO: 100 - DNA, 29 bp, Dictyoglomus thermophilum H-6-12
gtttaaatcccacatagttcagatcaaac

SEQ ID NO: 101 - DNA, 30 bp, Ferroplasma acidarmanus fer1
gtgtttagtctatctataagggtttgaaat

SEQ ID NO: 102 - DNA, 30 bp, Fervidobacterium nodosum Rt17-B1
gcttttagcatacctattagggattgaaac

SEQ ID NO: 103 - DNA, 30 bp, Fusobacterium nucleatum subsp. animalis 4_8
atgaactgtaaacttgaaaagttttgaaat

SEQ ID NO: 104 - DNA, 30 bp, Haloarcula hispanica N601
gtttcagacgaaccctcgtggggttgaagc

SEQ ID NO: 105 - DNA, 30 bp, Halorhabdus tiamatea SARL4B
gtttcagacggaccctcgtggggttgaagc

SEQ ID NO: 106 - DNA, 30 bp, Hydrogenobacter thermophilus TK-6
gtttcaatcccttataggcacctaataaac

SEQ ID NO: 107 - DNA, 30 bp, Mahella australiensis 50-1 BON
gtttcaattcctcataggtaggctaaaaac

SEQ ID NO: 108 - DNA, 31 bp, Nitratifractor salsuginis DSM 16511
atcatgaagcagtccctatgggatttgaaat

SEQ ID NO: 109 - DNA, 30 bp, Odoribacter splanchnicus DSM 20712
gtttcaattctaccttagttcaattaaaag

SEQ ID NO: 110 - DNA, 29 bp, Persephonella marina EX-H1
ctttctatcccacttagttcaaagaaaac

SEQ ID NO: 111 - DNA, 30 bp, Petrotoga mobilis SJ95
ctttttatcctacctatgaggaatggaaac

SEQ ID NO: 112 - DNA, 30 bp, Natronobacterium gregoryi SP2; identical to SEQ ID NO: 104

SEQ ID NO: 113 - DNA, 32 bp, Natrinema sp. J7-2
gtttcagaaggacccttgtagggttgaagcga

SEQ ID NO: 114 - DNA, 24 bp, Methanosarcina mazei Tuc01
gtttcaatccttgttttaatggat

SEQ ID NO: 115 - DNA, 37 bp, Methanosaeta thermophila PT
gtcgaagagcgagttccaggaaaacaaggattgaaac

SEQ ID NO: 116 - DNA, 37 bp, Methanoregula formicicum SMSP
gtttcaatccttgttctcgtggatgtttcgctcgaag

SEQ ID NO: 117 - DNA, 37 bp, Methanococcus voltae A3
gtttcaatccttgttttaatggattatgcattgtgac

SEQ ID NO: 118 - DNA, 30 bp, Halorhabdus utahensis DSM 12940
gcttcaaccccacgagggtccgtctgaaac

SEQ ID NO: 119 - DNA, 30 bp, Halomicrobium mukohataei DSM 12286
gtttcagacggacccttgtgggattgaagc

SEQ ID NO: 120 - DNA, 30 bp, Haloferax volcanii DS2
gtttcagacgaacccttgtgggattgaagc

SEQ ID NO: 121 - DNA, 30 bp, Aciduliprofundum sp. MAR08-339
ctttcaatcccaacatggtctgattctaac

SEQ ID NO: 122 - DNA, 37 bp, Zunongwangia profunda SM-A87
cttccagaccattccatcaaacaactaggattgaaac

SEQ ID NO: 123 - DNA, 30 bp, Thermovirga lienii DSM 17291
gttttagaccttcctataagggatggaaac

SEQ ID NO: 124 - DNA, 30 bp, Thermosipho africanus TCF52B
gtttcaatccctaataggtatgctaaaaac

SEQ ID NO: 125 - DNA, 30 bp, Thermosediminibacter oceani DSM 16646
gttactagcttacctatgaggggttgaaac

SEQ ID NO: 126 - DNA, 30 bp, Thermodesulfobium narugense DSM 14796
gtttttacgatacctatgaggaattgaaac

SEQ ID NO: 127 - DNA, 32 bp, Desulfovibrio vulgaris DP4; identical to SEQ ID NO: 64

SEQ ID NO: 128 - DNA, 32 bp, Streptococcus pyogenes MGAS5005; identical to SEQ ID NO: 65

SEQ ID NO: 129 - DNA, 31 bp, Acidaminococcus fermentans DSM 20731
gtcgcccccgcaagggggcgtggattgaaat

SEQ ID NO: 130 - DNA, 32 bp, Acidobacterium capsulatum
gtttcaatccacgcgcccgcgaggggcgcgac

SEQ ID NO: 131 - DNA, 32 bp, Acidovorax avenae subsp. avenae
gtcgcgccccgcgtgggcgcgtgggttgaaac

SEQ ID NO: 132 - DNA, 32 bp, Aggregatibacter actinomycetemcomitans D7S-1
gcagccatcttcgcatggctctgttttgaaat

SEQ ID NO: 133 - DNA, 32 bp, Alkaliphilus metalliredigens QYMF
gtcgctccctatatggggggcgtggattgaaa

SEQ ID NO: 134 - DNA, 32 bp, Azotobacter vinelandii CA
gtttcaatccacacgcccgcatggggcgtgac

SEQ ID NO: 135 - DNA, 32 bp, Bacteroides helcogenes P 36-108
gtttcaatccacacacccgtatagggtgtgac

SEQ ID NO: 136 - DNA, 32 bp, Bibersteinia trehalosi USDA-ARS-USMARC-192
ccagctacgtacgcgtagctgtgagttgaaac

SEQ ID NO: 137 - DNA, 32 bp, Cellvibrio japonicus Ueda107
gtttcaatccacgcgctcgcgaagagcgcgac

SEQ ID NO: 138 - DNA, 37 bp, Chamaesiphon minutus PCC 6605
gttccaatcctcgatcaacccgaaagccgatcgctac

SEQ ID NO: 139 - DNA, 32 bp, Dehalococcoides mccartyi DCMB5
gtcgctccccgtgcgggagcgtgaattgaaac

SEQ ID NO: 140 - DNA, 32 bp, Desulfobulbus propionicus DSM 2032
gtcgccccccacgcgggggcgtggattgaaac

SEQ ID NO: 141 - DNA, 32 bp, Desulfocapsa sulfexigens DSM 10523
gtttcaatccacgcccccgcatggagggcgac

SEQ ID NO: 142 - DNA, 32 bp, Desulfomonile tiedjei DSM 6799
gtcgcccctcacgcaggggcgtggattgaaac

SEQ ID NO: 143 - DNA, 32 bp, Desulfosporosinus acidiphilus SJ4
gtcgctccctacgtgggagcgtggattgaaat

SEQ ID NO: 144 - DNA, 32 bp, Desulfotomaculum carboxydivorans CO-1-SRB
gtcgcgccccacacgggcgcgtggattgaaac

SEQ ID NO: 145 - DNA, 33 bp, Eggerthella lenta DSM 2243
atttcaacccgcactccccatgcggggagtgac

SEQ ID NO: 146 - DNA, 33 bp, Ethanoligenens harbinense YUAN-3
atttcaatccacgctctccgtgtggagagcgac

SEQ ID NO: 147 - DNA, 32 bp, Exiguobacterium sibiricum 255-15
gtcgcactcctcgtgagtgcgtggattgaaat

SEQ ID NO: 148 - DNA, 33 bp, Faecalibacterium prausnitzii L2-6
gtcgccctcctcgcggagggcgtggatagaaat

SEQ ID NO: 149 - DNA, 32 bp, Filifactor alocis
gtcgcgtcccacaggggcgcgtggattgaaat

SEQ ID NO: 150 - DNA, 37 bp, Halothiobacillus neapolitanus c2
gtttcaatccgcgcccggcggttaggccgggcgattc

SEQ ID NO: 151 - DNA, 32 bp, Hyphomicrobium nitrativorans NL23
gtttctatccacgcctccgcgcgggaggcgac

SEQ ID NO: 152 - DNA, 32 bp, Ketogulonicigenium vulgare Y25
gtcgctccccccacgggagcgtggatagaaac

SEQ ID NO: 153 - DNA, 37 bp, Leptothrix cholodnii SP-6
gtttcaatccacgcccgccagtttcccggcgagcgac

SEQ ID NO: 154 - DNA, 33 bp, Magnetococcus sp. MC-1
gtcgccccctcccacgggggcgtggattgaaac

SEQ ID NO: 155 - DNA, 37 bp, Myxococcus fulvus HW-1
gtcgctccccgtgaacgcggggagcgtgggttgaaac

SEQ ID NO: 156 - DNA, 32 bp, Nitrosomonas sp. AL212
gtttcaatccacgcgcccacgcggggcgcgac

SEQ ID NO: 157 - DNA, 32 bp, Pelodictyon phaeoclathratiforme BU-1
gtcgcgccccctgcgggcgcgtggattgaaac

SEQ ID NO: 158 - DNA, 31 bp, Planctomyces brasiliensis DSM 5305
gtttcaatccgcgcccctgtggaggggcgat

SEQ ID NO: 159 - DNA, 33 bp, Porphyromonas asaccharolytica DSM 20707
gtcgcaccccgcacggggtgcgtgaattgaaac

SEQ ID NO: 160 - DNA, 32 bp, Prevotella dentalis DSM 3688
gtcgcgtctcacgtaggcgcgtggattgaaac

SEQ ID NO: 161 - DNA, 32 bp, Prosthecochloris vibrioformis DSM 265
gtcgcgcccttcacgggcgcgtggattgaaac

SEQ ID NO: 162 - DNA, 31 bp, Pseudoxanthomonas spadix BD-a59
gtcgcgctctcacgagcgcgtggattgaaac

SEQ ID NO: 163 - DNA, 32 bp, Rhodobacter sphaeroides KD131
gtcgcccctcacgcgggggcgtggatcgaaac

SEQ ID NO: 164 - DNA, 32 bp, Rhodopseudomonas palustris DX-1
gtcgctccccgcgcgggagcgtggatcgaaac

SEQ ID NO: 165 - DNA, 33 bp, Roseburia hominis A2-183
atttcaatccacgctcccctcacagggagcgac

SEQ ID NO: 166 - DNA, 32 bp, Sphingobium sp. SYK-6
gtcgctccccgtgcgggggcgtggatcgaaac

SEQ ID NO: 167 - DNA, 32 bp, Teredinibacter turnerae T7901
gtttcaatccacgcgctcgcgaggagcgcgaa

SEQ ID NO: 168 - DNA, 31 bp, Xanthomonas oryzae pv. oryzae PXO99A
gtcgcgtcctcacgggcgcgtggattgaaac

SEQ ID NO: 169 - DNA, 32 bp, Uncultured Termite group 1 bacterium phylotype Rs-D17
gtcgcgccccgtgtgggcgcgtgaattgaaat

SEQ ID NO: 170 - DNA, 32 bp, Treponema brennaborense DSM 12168
gtttcaatccacgctcccgtgaagggagcgac

SEQ ID NO: 171 - DNA, 37 bp, Thermus thermophilus SG0.5JP17-16
gtttcaatcctcaccggccctttcgggccggtgcaac

SEQ ID NO: 172 - DNA, 37 bp, Methanospirillum hungatei JF-1; identical to SEQ ID NO: 66

SEQ ID NO: 173 - DNA, 37 bp, Natronomonas pharaonis DSM 2160; identical to SEQ ID NO: 67

SEQ ID NO: 174 - DNA, 38 bp, Acetohalobium arabaticum DSM 5501
ctttaaagaactataatttcgtttaaggaattgaaacg

SEQ ID NO: 175 - DNA, 37 bp, Anabaena cylindrica PCC 7122
gtttcaatccctaatagggagtaatagaaattgcaat

SEQ ID NO: 176 - DNA, 37 bp, Calothrix sp. PCC 6303
gttcctataaactaaaatccctatcagggattgaaac

SEQ ID NO: 177 - DNA, 37 bp, Cyanothece sp. PCC 7425
gtttccaagcctgaatcccggtctacgggactgaaac

SEQ ID NO: 178 - DNA, 37 bp, Gloeocapsa sp. PCC 7428
atttcaattaacataaatccttatcagggattgaaac

SEQ ID NO: 179 - DNA, 31 bp, Methanotorris igneus Kol 5
gtttccatccccctatgggtctgattttaat

SEQ ID NO: 180 - DNA, 30 bp, Methanothermococcus okinawensis IH1
atttccatccatcaatggtctgattttaac

SEQ ID NO: 181 - DNA, 30 bp, Methanocaldococcus vulcanius M7
attaaaatcagcacggatcgtgatggaaac

SEQ ID NO: 182 - DNA, 37 bp, Haloquadratum walsbyi C23
gttgcaacgaagagaaaacccgctaagggattgaaac

SEQ ID NO: 183 - DNA, 37 bp, Halophilic archaeon DL31
gtttcaatcccgttctgggttttctgggtgtcgcgac

SEQ ID NO: 184 - DNA, 28 bp, Escherichia coli str. K-12 substr. MG1655
ggtttatccccgctggcgcggggaacac

SEQ ID NO: 185 - DNA, 27 bp, Escherichia coli
gttccccgcgccagcggggataaaccg

SEQ ID NO: 186 - DNA, 29 bp, Thermus thermophilus HB8
gtagtccccacgcgtgtggggatggaccg

SEQ ID NO: 187 - DNA, 29 bp, Acetobacter pasteurianus IFO 3283-01
gtgttccccgcacacgcggggatgaaccg

SEQ ID NO: 188 - DNA, 28 bp, Acidimicrobium ferrooxidans DSM 10331
ggatcacccccgcctgcgcggggagcac

SEQ ID NO: 189 - DNA, 28 bp, Alkalilimnicola ehrlichei MLHE-1
ggtctatccccgcaggcgcgggggagcc

SEQ ID NO: 190 - DNA, 29 bp, Allochromatium vinosum DSM 180
cggttcatccccgcgagcgcggggaacgg

SEQ ID NO: 191 - DNA, 29 bp, Alteromonas macleodii
gtgttccccgtgcccacggggatgaacca

SEQ ID NO: 192 - DNA, 29 bp, Amycolatopsis mediterranei RB
gtcgtccccgcgcacgcggggccggtccg

SEQ ID NO: 193 - DNA, 29 bp, Anaeromyxobacter dehalogenans 2CP-1
ggcttccccgcgtgcgcggggatcgaccc

SEQ ID NO: 194 - DNA, 29 bp, Anaeromyxobacter sp. K
ggcttccccgcgtgcgcggggattgtaga

SEQ ID NO: 195 - DNA, 29 bp, Arcanobacterium haemolyticum DSM 20595
ctcttccccgcacacgcgggggtatttcc

SEQ ID NO: 196 - DNA, 29 bp, Bifidobacterium animalis subsp. animalis
cggatcatccccgcctgtgcggggcaaac

SEQ ID NO: 197 - DNA, 27 bp, Burkholderia sp. YI23
gtctatctccgcacacgcggaggaacc

SEQ ID NO: 198 - DNA, 29 bp, Candidatus Accumulibacter phosphatis clade IIA str. UW-1
gtttcccccgcgtcagcggggataggccc

SEQ ID NO: 199 - DNA, 26 bp, Catenulispora acidiphila DSM 44928
gggaccagccccgcacgcgcggggag

SEQ ID NO: 200 - DNA, 28 bp, Cellulomonas fimi ATCC 484
gtcgtctccccgcgtgcggggatgagcc

SEQ ID NO: 201 - DNA, 29 bp, Chromohalobacter salexigens DSM 3043
ccgttccccgcaggcgcggggatcaaccg

SEQ ID NO: 202 - DNA, 28 bp, Coriobacterium glomerans PW2
gtgctccccgcgcatgcggggatgatcc

SEQ ID NO: 203 - DNA, 29 bp, Cycloclasticus zancles 7-ME
cggttcatccccacgcttgtggggaacac

SEQ ID NO: 204 - DNA, 29 bp, Desulfatibacillum alkenivorans AK-01
gtcttccccacgcccgtgggggtgtttct

SEQ ID NO: 205 - DNA, 29 bp, Erwinia amylovora
cggtttatccccgcatacgcggggaacac

SEQ ID NO: 206 - DNA, 28 bp, Gardnerella vaginalis 409-05
gtctttcccgcatacgcgggggtgatcc

SEQ ID NO: 207 - DNA, 29 bp, Geobacter lovleyi SZ
cggttcatccccgcgggtgcggggaacgg

SEQ ID NO: 208 - DNA, 28 bp, Klebsiella pneumoniae NTUH-K2044
gaaacacccccacgtgcgtggggaagac

SEQ ID NO: 209 - DNA, 28 bp, Lactobacillus fermentum F-6
ggatcacccccatatacatggggagcac

SEQ ID NO: 210 - DNA, 29 bp, Marinomonas sp. MWYL1
cggtttatccccgtgtgctcggggaacgc

SEQ ID NO: 211 - DNA, 29 bp, Pelobacter propionicus DSM 2379
cggttcatccccgcgcatgcggggaacac

SEQ ID NO: 212 - DNA, 29 bp, Polymorphum gilvum SL003B-26A1
gtctcccccgcctacgcggggatgaaccc

SEQ ID NO: 213 - DNA, 29 bp, Propionibacterium acidipropionici
gtcgtccccgcgcaggcgggggtaatccg

SEQ ID NO: 214 - DNA, 29 bp, Pseudomonas aeruginosa RP73
gtgttccccacgggtgtggggatgaaccg

SEQ ID NO: 215 - DNA, 29 bp, Ralstonia solanacearum CFBP2957
gtgttccccgcgcctgcggggatgaaccg

SEQ ID NO: 216 - DNA, 29 bp, Rhodospirillum photometricum DSM 122
cggttcatccccgcgcaggcggggaacac

SEQ ID NO: 217 - DNA, 29 bp, Rubrivivax gelatinosus IL144
cggttcatccccacccgcgtggggaacgc

SEQ ID NO: 218 - DNA, 29 bp, Salmonella bongori N268-08
cggtttatccccgctggcgcggggaacac

SEQ ID NO: 219 - DNA, 29 bp, Sphaerobacter thermophilus DSM 20745
cggttcacccccacgcgtgtggggacaac

SEQ ID NO: 220 - DNA, 29 bp, Thauera sp. MZ1T
ggttcccccgcgtccgcggggataggccc

SEQ ID NO: 221 - DNA, 27 bp, Methanospirillum hungatei JF-1
gttcatccccatacacacggggaactc

SEQ ID NO: 222 - DNA, 28 bp, Methanosalsum zhilinae DSM 4017
ggttcatccccacgtgtgtggggaactc

SEQ ID NO: 223 - DNA, 29 bp, Methanococcoides burtonii DSM 6242
gagttccccatgcatgtggggataaaccg

SEQ ID NO: 224 - DNA, 29 bp, Truepera radiovictrix DSM 17093
cggttcatccccacgtgtgtggggaatag

SEQ ID NO: 225 - DNA, 29 bp, Thiocystis violascens DSM 198
gtgttccccgcgctcgcggggatgaaccg

SEQ ID NO: 226 - DNA, 29 bp, Thermomonospora curvata DSM 43183
cggaccacccccgcctgcgcggggagcac

SEQ ID NO: 227 - DNA, 29 bp, Thermobispora bispora DSM 43833
gggatcatccccgcgtgcgcggggagcac

SEQ ID NO: 228 - DNA, 29 bp, Thermobifida fusca YX
cggtccatccccacgtgcgtggggctcac

SEQ ID NO: 229 - DNA, 28 bp, Yersinia pestis CO92
tttctaagctgcctgtgcggcagtgaac

SEQ ID NO: 230 - DNA, 28 bp, Pseudomonas aeruginosa UCBPP-PA14
gttcactgccgtataggcagctaagaaa

SEQ ID NO: 231 - DNA, 28 bp, Acidovorax sp. JS42
tttctgagctgcctatgcggcagtgaac

SEQ ID NO: 232 - DNA, 28 bp, Alcanivorax dieselolei B5
tttcttagctgcctgcgcggcagcgaac

SEQ ID NO: 233 - DNA, 28 bp, Delftia acidovorans SPH-1
gttcgctgccgcgtaggcagctcagaaa

SEQ ID NO: 234 - DNA, 28 bp, Desulfurispirillum indicum S5
tttctgagctgcctatgcggcagtgaac

SEQ ID NO: 235 - DNA, 28 bp, Desulfurivibrio alkaliphilus AHT2
tttctgagctgcctgtgcggcagtgaac

SEQ ID NO: 236 - DNA, 28 bp, Halomonas elongata DSM 2581
gttcgctgccgcccaggcagctcagaaa

SEQ ID NO: 237 - DNA, 28 bp, Methylophaga sp. JAM1
tttctaagctgcctgttcggcagtgaac

SEQ ID NO: 238 - DNA, 28 bp, Moraxella catarrhalis RH4
tttctaagcgacctgtgcggtcgtgaag

SEQ ID NO: 239 - DNA, 29 bp, Nitrosococcus watsoni C-113
ggttcaccgccgcacaggcggtttagaaa

SEQ ID NO: 240 - DNA, 28 bp, Pasteurella multocida 36950
gttcaccatcgtgtagatggcttagaaa

SEQ ID NO: 241 - DNA, 28 bp, Providencia stuartii MRSN 2154
gttcactgccgcataggcagcttagaaa

SEQ ID NO: 242 - DNA, 28 bp, Rahnella aquatilis
gttcactgccgtacaggcagcttagaaa

SEQ ID NO: 243 - DNA, 28 bp, Selenomonas ruminantium subsp. lactilytica TAM6421
gtgttccgccgtataggcggcttagaaa

SEQ ID NO: 244 - DNA, 28 bp, Spirochaeta africana DSM 8902
gttacctgccgcataggcagcttagaaa

SEQ ID NO: 245 - DNA, 28 bp, Yersinia pseudotuberculosis YPIII
gttcactgccgcacaggcagcttagaaa

SEQ ID NO: 246 - DNA, 28 bp, Vibrio parahaemolyticus BB22OP
gtgaactgccgaataggtagctgataat

SEQ ID NO: 247 - DNA, 28 bp, Verminephrobacter eiseniae EF01-2
tttctgagctgcctatccggcagtgaac

SEQ ID NO: 248 - DNA, 28 bp, Tolumonas auensis DSM 9187
cttcactgccgcacaggcagcttagaaa

SEQ ID NO: 249 - DNA, 28 bp, Thioalkalivibrio sp. K90mix
gttagctgccgcacaggcagctcagaaa

SEQ ID NO: 250 - DNA, 29 bp, Escherichia coli
gagttccccgcgccagcggggataaaccg

SEQ ID NO: 251 - DNA, 30 bp, Pyrococcus furiosus
gttacaataagactaaaatagaattgaaag

SEQ ID NO: 252 - DNA, 57 bp, Artificial
  synthetic oligonucleotide
gctagcattatacctaggactgagctagctgtcaatccatatgaatatcctccttag

SEQ ID NO: 253 - DNA, 18 bp, Artificial
  synthetic oligonucleotide
tgtaggctggagctgctt

SEQ ID NO: 254 - DNA, 60 bp, Artificial
  synthetic oligonucleotide
tacaattaacctatacatatattaagatgtgttgaattgtgctagcattatacctaggac

SEQ ID NO: 255 - DNA, 58 bp, Artificial
  synthetic oligonucleotide
tgatatcatcgataatactaaaaaaacagggaggctattatgtaggctggagctgctt

SEQ ID NO: 256 - DNA, 60 bp, Artificial
  synthetic oligonucleotide
accgcagaggcgggggaactccaagtgatatccatcattccatatgaatatcctccttag

SEQ ID NO: 257 - DNA, 76 bp, Artificial
  synthetic oligonucleotide
ccacctcgagttccccgcgccagcggggataaaccgaaaaaaaaaccccgcccctgacagggcggggtttttttta

SEQ ID NO: 258 - DNA, 85 bp, Artificial
  synthetic oligonucleotide
aagcttaaaaaaaaccccgccctgtcaggggcggggtttttttttcggtttatccccgctggcgcggggaactcgaggtggtacc

SEQ ID NO: 259 - DNA, 37 bp, Artificial
  synthetic oligonucleotide
tttgacagctagctcagtcctaggtataatgctagcg

SEQ ID NO: 260 - DNA, 45 bp, Artificial
  synthetic oligonucleotide
ctagcgctagcattatacctaggactgagctagctgtcaaatgca

SEQ ID NO: 261 - DNA, 65 bp, Artificial
  synthetic oligonucleotide
cacctcgagttccccgcgccagcggggataaaccgctttacactttatgcttccggctcgtatgt

SEQ ID NO: 262 - DNA, 73 bp, Artificial
  synthetic oligonucleotide
tcgaacatacgagccggaagcataaagtgtaaagcggtttatccccgctggcgcggggaactcgaggtggtac

SEQ ID NO: 263 - DNA, 65 bp, Artificial
  synthetic oligonucleotide
cacctcgagttccccgcgccagcggggataaaccgcataaagtgtaaagcctggggtgcctaatg

SEQ ID NO: 264 - DNA, 73 bp, Artificial
  synthetic oligonucleotide
tcgacattaggcaccccaggctttacactttatgcggtttatccccgctggcgcggggaactcgaggtggtac

SEQ ID NO: 265 - DNA, 65 bp, Artificial
  synthetic oligonucleotide
cacctcgagttccccgcgccagcggggataaaccgaaacagctatgaccatgattacggattcac

SEQ ID NO: 266 - DNA, 73 bp, Artificial
  synthetic oligonucleotide
tcgagtgaatccgtaatcatggtcatagctgtttcggtttatccccgctggcgcggggaactcgaggtggtac

SEQ ID NO: 267 - DNA, 65 bp, Artificial
  synthetic oligonucleotide
cacctcgagttccccgcgccagcggggataaaccggcgattaagttgggtaacgccagggttttc

SEQ ID NO: 268 - DNA, 73 bp, Artificial
  synthetic oligonucleotide
tcgagaaaaccctggcgttacccaacttaatcgccggtttatccccgctggcgcggggaactcgaggtggtac

SEQ ID NO: 269 - DNA, 65 bp, Artificial
  synthetic oligonucleotide
cacctcgagttccccgcgccagcggggataaaccgccctttcgtcttcacactcgagcacgacag

SEQ ID NO: 270 - DNA, 73 bp, Artificial
  synthetic oligonucleotide
tcgactgtcgtgctcgagtgtgaagacgaaagggcggtttatccccgctggcgcggggaactcgaggtggtac

SEQ ID NO: 271 - DNA, 65 bp, Artificial
  synthetic oligonucleotide
cacctcgagttccccgcgccagcggggataaaccgagatatacatatgagtaaaggagaagaact

SEQ ID NO: 272 - DNA, 73 bp, Artificial
  synthetic oligonucleotide
tcgaagttcttctcctttactcatatgtatatctcggtttatccccgctggcgcggggaactcgaggtggtac

SEQ ID NO: 273 - DNA, 65 bp, Artificial
  synthetic oligonucleotide
cacctcgagttccccgcgccagcggggataaaccgtgatgcaacatacggaaaacttacccttaa

SEQ ID NO: 274 - DNA, 73 bp, Artificial
  synthetic oligonucleotide
tcgattaagggtaagttttccgtatgttgcatcacggtttatccccgctggcgcggggaactcgaggtggtac

SEQ ID NO: 275 - DNA, 65 bp, Artificial
  synthetic oligonucleotide
cacctcgagttccccgcgccagcggggataaaccgtgatacccttgttaatagaatcgagttaaa

SEQ ID NO: 276 - DNA, 73 bp, Artificial
  synthetic oligonucleotide
tcgatttaactcgattctattaacaagggtatcacggtttatccccgctggcgcggggaactcgaggtggtac

SEQ ID NO: 277 - DNA, 65 bp, Artificial
  synthetic oligonucleotide
cacctcgagttccccgcgccagcggggataaaccgacgaaagggcctcgtgatacgcctattttt

SEQ ID NO: 278 - DNA, 73 bp, Artificial
  synthetic oligonucleotide
tcgaaaaaataggcgtatcacgaggccctttcgtcggtttatccccgctggcgcggggaactcgaggtggtac

SEQ ID NO: 279 - DNA, 65 bp, Artificial
  synthetic oligonucleotide
cacctcgagttccccgcgccagcggggataaaccgttcttctcctttactcatatgtatatctcc

SEQ ID NO: 280 - DNA, 73 bp, Artificial
  synthetic oligonucleotide
tcgaggagatatacatatgagtaaaggagaagaacggtttatccccgctggcgcggggaactcgaggtggtac

SEQ ID NO: 281 - DNA, 65 bp, Artificial
  synthetic oligonucleotide
cacctcgagttccccgcgccagcggggataaaccggtaagttttccgtatgttgcatcaccttca

SEQ ID NO: 282 - DNA, 73 bp, Artificial
  synthetic oligonucleotide
tcgatgaaggtgatgcaacatacggaaaacttaccggtttatccccgctggcgcggggaactcgaggtggtac

SEQ ID NO: 283 - DNA, 65 bp, Artificial
  synthetic oligonucleotide
cacctcgagttccccgcgccagcggggataaaccggtatcaccttcaaacttgacttcagcacgt

SEQ ID NO: 284 - DNA, 73 bp, Artificial
  synthetic oligonucleotide
tcgaacgtgctgaagtcaagtttgaaggtgataccggtttatccccgctggcgcggggaactcgaggtggtac

SEQ ID NO: 285 - DNA, 65 bp, Artificial
  synthetic oligonucleotide
cacctcgagttccccgcgccagcggggataaaccgattagcggatcctacctgacgctttttatc

SEQ ID NO: 286 - DNA, 73 bp, Artificial
  synthetic oligonucleotide
tcgagataaaaagcgtcaggtaggatccgctaatcggtttatccccgctggcgcggggaactcgaggtggtac

SEQ ID NO: 287 - DNA, 65 bp, Artificial
  synthetic oligonucleotide
cacctcgagttccccgcgccagcggggataaaccggagtgcccaatattacgacatcatccatca

SEQ ID NO: 288 - DNA, 73 bp, Artificial
  synthetic oligonucleotide
tcgatgatggatgatgtcgtaatattgggcactccggtttatccccgctggcgcggggaactcgaggtggtac

SEQ ID NO: 289 - DNA, 65 bp, Artificial
  synthetic oligonucleotide
cacctcgagttccccgcgccagcggggataaaccggtcgcgaattcaggcgctttttagactggt

SEQ ID NO: 290 - DNA, 73 bp, Artificial
  synthetic oligonucleotide
tcgaaccagtctaaaaagcgcctgaattcgcgaccggtttatccccgctggcgcggggaactcgaggtggtac

SEQ ID NO: 291 - DNA, 65 bp, Artificial
  synthetic oligonucleotide
cacctcgagttccccgcgccagcggggataaaccgagcgcgggcagggtattctcatcaaaccca

SEQ ID NO: 292 - DNA, 73 bp, Artificial
  synthetic oligonucleotide
tcgatgggtttgatgagaataccctgcccgcgctcggtttatccccgctggcgcggggaactcgaggtggtac

SEQ ID NO: 293 - DNA, 20 bp, Artificial
  synthetic oligonucleotide
cggcgtatcgccaaaatcac

SEQ ID NO: 294 - DNA, 20 bp, Artificial
  synthetic oligonucleotide
atgggtaacagtcttggcgg

SEQ ID NO: 295 - DNA, 20 bp, Artificial
  synthetic oligonucleotide
taccagtgcgttaggctgtg

SEQ ID NO: 296 - DNA, 20 bp, Artificial
  synthetic oligonucleotide
ctggacccgatcctcaatcg

SEQ ID NO: 297 - DNA, 20 bp, Artificial
  synthetic oligonucleotide
cgccccacaggacatagttt

SEQ ID NO: 298 - DNA, 20 bp, Artificial
  synthetic oligonucleotide
ggaacggccaactgctttac

SEQ ID NO: 299 - DNA, 20 bp, Artificial
  synthetic oligonucleotide
tcactttccgggatcggttg

SEQ ID NO: 300 - DNA, 20 bp, Artificial
  synthetic oligonucleotide
ttcagcgagtgcttcaggag

SEQ ID NO: 301 - DNA, 33 bp, Artificial
  Protospacer targeting sequence
aggccctttcgtcttcacactcgagcacgacag

SEQ ID NO: 302 - DNA, 33 bp, Artificial
  Protospacer targeting sequence
aggctttacactttatgcttccggctcgtatgt

SEQ ID NO: 303 - DNA, 33 bp, Artificial
  Protospacer targeting sequence
aggaaacagctatgaccatgattacggattcac

SEQ ID NO: 304 - DNA, 33 bp, Artificial
  Protospacer targeting sequence
aggagatatacatatgagtaaaggagaagaact

SEQ ID NO: 305 - DNA, 33 bp, Artificial
  Protospacer targeting sequence
aggtgatgcaacatacggaaaacttacccttaa

SEQ ID NO: 306 - DNA, 33 bp, Artificial
  Protospacer targeting sequence
aggtgatacccttgttaatagaatcgagttaaa

SEQ ID NO: 307 - DNA, 33 bp, Artificial
  Protospacer targeting sequence
aagacgaaagggcctcgtgatacgcctattttt

SEQ ID NO: 308 - DNA, 33 bp, Artificial
  Protospacer targeting sequence
aagcataaagtgtaaagcctggggtgcctaatg

SEQ ID NO: 309 - DNA, 33 bp, Artificial
  Protospacer targeting sequence
aaggcgattaagttgggtaacgccagggttttc

SEQ ID NO: 310 - DNA, 33 bp, Artificial
  Protospacer targeting sequence
aagttcttctcctttactcatatgtatatctcc

SEQ ID NO: 311 - DNA, 33 bp, Artificial
  Protospacer targeting sequence
agggtaagttttccgtatgttgcatcaccttca

SEQ ID NO: 312 - DNA, 33 bp, Artificial
  Protospacer targeting sequence
agggtatcaccttcaaacttgacttcagcacgt

SEQ ID NO: 313 - DNA, 33 bp, Artificial
  Protospacer targeting sequence
aagattagcggatcctacctgacgctttttatc

SEQ ID NO: 314 - DNA, 33 bp, Artificial
  Protospacer targeting sequence
agggagtgcccaatattacgacatcatccatca

SEQ ID NO: 315 - DNA, 33 bp, Artificial
  Protospacer targeting sequence
aaggtcgcgaattcaggcgctttttagactggt

SEQ ID NO: 316 - DNA, 33 bp, Artificial
  Protospacer targeting sequence
aagagcgcgggcagggtattctcatcaaaccca

SEQ ID NO: 317 - DNA, 289 bp, Artificial
  pUA66 promoter sequence
ctttcgtcttcacactcgagcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacggattcactggccgtcgttttacaacgtcgtgactgggaaaaccctggcgttacccaacttaatcgccttgcagcacaggatcctctagatttaagaa

SEQ ID NO: 318 - DNA, 537 bp, Artificial
  pUA66 promoter sequence
cctgtctcttgatcagatctggcctcaatcggcgttaaacccgccaccagatgggcgttaaacgagtatcccggcagcaggggatcattttgcgcttcagccatacttttcatactcccaccattcagagaagaaaccaattgtccatattgcatcagacattgccgtcactgcgtcttttactggctcttctcgctaacccaaccggtaaccccgcttattaaaagcattctgtaacaaagcgggaccaaagccatgacaaaaacgcgtaacaaaagtgtctataatcacggcagaaaagtccacattgattatttgcacggcgtcacactttgctatgccatagcatttttatccataagattagcggatcctacctgacgctttttatcgcaactctctactgtttctccatacccgtttttttggatggagtgaaacgatggcgattgcaattggcctcgattttggcagtgattctgtgcgagctttggcggtggactgcgctaccggtgaagctcgaggggatcctctaga

SEQ ID NO: 319 - DNA, 522 bp, Artificial
  pUA66 promoter sequence
cgaggccctttcgtcttcacggtgtagggccttctgtagttagaggacagttttaataagtaacaatcaccgcgataaacgtaaccaatttttagcaactaaacaggggaaaacaattacagatttttatctttcgattacgatttttggtttatttcttgatttatgaccgagatcttacttttgttgcgcaattgtacttattgcatttttctcttcgaggaattacccagtttcatcattccattttattttgcgagcgagcgcacacttgtgaattatctcaatagcagtgtgaaataacataattgagcaactgaaagggagtgcccaatattacgacatcatccatcacccgcggcattacctgattatggagttcaatatgcaagcctattttgaccagctcgatcgcgttcgttatgaaggctcaaaatcctcaaacccgttagcattccgtcactacaatcccgacgaactggtgttgggtaagcgtatgtaatctagatttaagaaggagat

SEQ ID NO: 320 - DNA, 468 bp, Artificial
  pUA66 promoter sequence
cctgtctcttgatcagatctgttctatcgccacggacgcgttaccagacggaaaaaaatccacactatgtaatacggtcatactggcctcctgatgtcgtcaacacggcgaaatagtaatcacgaggtcaggttcttaccttaaattttcgacggaaaaccacgtaaaaaacgtcgatttttcaagatacagcgtgaattttcaggaaatgcggtgagcatcacatcaccacaattcagcaaattgtgaacatcatcacgttcatctttccctggttgccaatggcccattttcctgtcagtaacgagaaggtcgcgaattcaggcgctttttagactggtcgtaatgaaattcagcaggatcacattatgacctttcgcaattgtgtcgccgtcgatctcggcgcatccagtgggcgcgtgatgctggcgcgttacgagcgtgaatgggatcctctagatttaagaa

SEQ ID NO: 321 - DNA, 43 bp, Artificial
  target genomic sequence
ggtgaagctgaagtagaaaaacgtgttacagcatcagttggct

SEQ ID NO: 322 - DNA, 44 bp, Artificial
  target genomic sequence
ccacttcgacttcatctttttgcacaatgtcgtagtcaaaccga

SEQ ID NO: 323 - DNA, 65 bp, Artificial
  sequence for cloning example
cacctcgagttccccgcgccagcggggataaaccgctgaagtagaaaaacgtgttacagcatcag

SEQ ID NO: 324 - DNA, 73 bp, Artificial
  sequence for cloning example
catggtggagctcaaggggcgcggtcgcccctatttggcgacttcatctttttgcacaatgtcgtagtcagct

SEQ ID NO: 325 - protein, 288 aa, Haloquadratum walsbyi
METQSESTSRLRRIELTLRVDERFDVPQSDGYSVYSALLALLQSADDEVSQRVHDSEIGSLHTSGLRGPFGDGERSYHKQILPNKEYTLSLGVTDPNDEAIFEALVSGLVFADEPLELTHGQLQVESFESENTFHETLLTETNKLDDPTIEMTFQTATCIEEAGSVTTMFPTRGAVFGSLLGKWNNTAPDELALDVGRDTLIESVIEKPHARSYDTHSVLVNRVDDPDGGTQPLFRQGFSGTCAYAFKNASESVMNAVTALALFAEYSGVGSAVARGCGQVSTDVNKQ

SEQ ID NO: 326 - protein, 254 aa, Methanocaldococcus jannaschii
MRESMRIELELQTDNFTVIPYNHQYYLASAIYNKIHSANPAYAKRLHNYQKFKFFTFSLLQIRKRVIRKEGIETIDGKAYLYISSPNNEFIENFVAGLLEDGKLRVGNVEFFVRKAKILPIPKKFNILKTISPIYLKTMIETEDGLKTYDLLPNNSKFYENLKNNLKKKYEAFYNEKCDMNFEFEVLKFRPKRMRIKNDIYCRCSEMVFKVWGDYDLIKFGYECGFGEKNSMGFGMVVNVEDKNQKNKKLKTKI

SEQ ID NO: 327 - protein, 287 aa, Saccharolobus solfataricus
MPLIFKIGYNVIPLQDVILPTPSSKVLKYLIQSGKLLPSLNNLITSRDKYKPIFISHLGLNQRRIFQTNGNLKTISRGSKLSSTIAFSTQVNVLPELDEGVFETIYGKFHITIESVEIVEVEKLKEEVEKHMNDNIRVRFISPTLLSSKVLLPPSLSERYKRVNAGYSTLPSVGLIVAYAYNVYCNLIGKKEVEVRAFKFGVISNALSRIIGYDLHPVTIVIGEDSKGNLRKARGVMGWIEFDIPDEKLKRRALRYLLASSYLGIGRSRGIGFGEIKLEFIKREENH

SEQ ID NO: 328 - protein, 288 aa, Haloquadratum walsbyi; identical to SEQ ID NO: 325

SEQ ID NO: 329 - protein, 570 aa, Aeropyrum pernix
MEYGCQPNVLKKTILKMVKRRIHVEGAKKAVNEALLNSQAKAAEEICRIAYESPGGVVFLGAPTGAGKTEVFMAPLLASFASKRPIAARGFLVEPMHSLIKAMVDRLKTSIETLGVSEDHGETVQPTFLYTAPITVTTPDTYFYGFAASRVYRILTHEGVETGRFSMPVGLQATSYTVFDEAHLVQDEVFLSPRLLSLVVAALARAGGLIVVSSATLPSYYKTVIREKLGDWRVEEVELDHTVLSPKIDVEVKNNSLEPDDVDCNVKGLVLVNTVSKSIRVYKSLKTRCSNSKVLLLHSLFKRRDKNSKIELLQKLLKEQDNGVIAVATQVLEVGVDLDFEALYTETAPIDSVIQRLGRIGRRRGRGYAIIYNAETHHPYPEKLYLKSKEIMDQLAGTYTPSIRTSSDLVNTVYERDVVDSLARLGDKLMLRALAYLESLAPLSYPPNDDLYFRPSAFIDIAILPCDIVGDGREWEPEWEEHLVRLSIPLSANERTSGWDRLTRLLSKAKEVYEVRSGPGGRRLIRASQRPKPGSTLVVCLENPEYVYNDEEGLLVSPLVGGRPRVGGKS

SEQ ID NO: 330 - protein, 515 aa, Sulfolobus solfataricus
MKLRLRKHMRLVENMLSLADFYNDFITRHGFEERKGIEETLLNLENGHSVILKAPTGYGKTTLTMILANAVSSDIDLGSRVIHVLPYRAIVQDLYLKLKNYADRGVIYTKNIGAQDMDYQDSPFFMKKVNVTTLDTFILNLFKLPTVDFKLIFKNYGSHYEFPRALIYSSIVIFDEFHLLGEDGKSLGAGLAALEVLRDAGVPIVVTSATIDKGLERVLMNKLGKNVKVVNADDFKIDRKIYVNVLENDEISITEEKVKEGKRVLLVYNTRMGAIEAYKKLKGRGLSPILIHSKFSKKDRIDKVNKINEAKLVVSTQVIEAGIDTSFDVLITEASPSHNLIQRAGRVARYGKGGRGKLEGEVYIFPFSGKVYDEREVKETVERVRELKTIDENLLIERDYTEVIDSILAKDLSVIDNSVFVDSKKVKSIYEKICSITRNASIILGFPPNSNDVNDAIPLTEEEAIKIIESKGSSAFVGNGNVKLYNKKCLQLEMLKNDILGVRIQDYNSEIGGVY

SEQ ID NO: 331 - protein, 566 aa, Thermoproteus tenax; identical to SEQ ID NO: 14

SEQ ID NO: 332 - protein, 282 aa, Aeropyrum pernix
MSRVACAYIIRKATGEHECCETLEEHVQRSLEVWLGRLKKCYSSAVNRIIYSQGSQTLASVLGDPVAVAIVLHDIGKAVPAYQKKRIMRGRVQYRHELVSGALSLLAIEKAADMAGIGRNDRGLYVFEVPLAVMMHHESISMGVLAGELGERFVTLSVASLMLEDYYDGELWGLERLARTVKNMGAVGDAVVDVLKILSGSPPSRKEVLIALGRLKAYSLSGDTLSRLSARARVAGILHPLVVADSIAANEGRKRCNGDGGTWIVKRALGRDSQEPAEPCLS

SEQ ID NO: 333 - protein, 239 aa, Sulfolobus solfataricus
MIKPCAYEKQGLIDHAIGSYRVLDGKISESYYKIISRRLERYGIVLDLNGVKEMVKDVVVLHDMGKAGEYYQNQFDDNCNPLKSNFSFIYHELGSALFFYYDYEPIDVEKAEEVKSLLTLAVLNHLNAIRVISDYLVNKFPDNFDERMIKLNKYGSIMLQNLRGVISKSLKVRDYTFDDYHDMLYAFSKKSDKYLKLYNLFLAPIMLGDNLDSSLVRNNGSKTGFVRILEGELNGGSTL

SEQ ID NO: 334 - protein, 226 aa, Thermoproteus tenax; identical to SEQ ID NO: 17

SEQ ID NO: 335 - protein, 241 aa, Pyrococcus furiosus
MRIEIKLLPLQDNPVIPFNYNYELYSQIVEKAGAIEPRIVKLLESPHGYWTFSRIIIRKREIIPEKGIKILSDDISLYISSSNKEIIKGIVEGIEKSPEFKIGDVGFLVADIKALKSKEIKNVNIFSTLSPIVVRTVKFEGDKLKHWDLYPHDELFLDRLRKVMLLRYHEVMGDLPEDKDFRIELIKFKPTRLIVKDSYIRGSLMVFRYYGSKEIAKFGYENGFGEKTNLGFGMVKIIEEQ

SEQ ID NO: 336 - protein, 289 aa, Saccharolobus solfataricus
MPLIFKIGYNVIPLQDVILPTPSSKVLKYLIQSGKLIPSLKDLITSRDKYKPIFISHLGFNQRRIFQTNGNLKTITKGSRLSSIIAFSTQANVLSEVADEGIFETVYGKFHIMIESIEIVEVEKLKEEVEKHMNDNIRVRFVSPTLLSSKVLLPPSLSERYKKIHAGYSTLPSVGLIVAYAYNVYCNLIGKKEVEVRAFKFGILSNALSRIIGYDLHPVTVAIGEDSKGNLRKARGVMGWIEFDIPDERLKRRALNYLLTSSYLGIGRSRGIGFGEIRLEFRKIEEKEG

SEQ ID NO: 337 - protein, 241 aa, Methanocaldococcus jannaschii
MRLKLSLTPKQDFSFDKINKHTIQGFIYSLLKDTEFGEMHNQPRFKFWCFSDIFPPNDFVKGEDKYLLISSPREEFINVLYERLDNLEEVNLNNFKFEVSELKKFDLKVKNKFITGSPIVLYKDKDRGEYIKFYDDDFDLMFFVQRLQDNAVKKYKAFYNEEPVLNGFIFDRISPRVRNGRVDVYVRIAKKGREFLVVGTTWKLLEKIKIRKEERKFYKFIMDCGLGEKNSLGFGFINPIK

SEQ ID NO: 338 - protein, 272 aa, Haloferax volcanii [sequence omitted]

SEQ ID NO: 339 - protein, 300 aa, Thermotoga neapolitana; identical to SEQ ID NO: 19

SEQ ID NO: 340 - protein, 244 aa, Thermotoga neapolitana; identical to SEQ ID NO: 20

SEQ ID NO: 341 - protein, 517 aa, Fusobacterium nucleatum
MKYDIDKNEYSFDTAISASDWKYSAAITGLIYYFKELEKKYEIKKITIDEITDSYLLYNKEDINEENYLDFIEKFYSKYSEDTLAHKKLENQLKHTKEFTSEIIKSIKENMSANTVLKKVFSKTKFDGTNKDEVLKLLDENRHSIIKETFRNKKDLYDNYCQTSRLLEKGDNSPCRLKGYYFDPNRKSKATGYNFVSSSVDYFDDEIFDFIPFAFTGSSFETIFLNDNLDLEILENMNYKLREYFSEEKENETERLKSLKQEKAIKEKKNEETEGNQNSVPLKKLFLNILQKKVDYIKYGMEIIYKNRDKEYFETWYLRNESIKVLKEIEDFSKLDIRIKITDKYYFNLLDEVFSAVLNLSLLTNSILYLLKDRESFIKIDTTRENLSKLFKYNYAINELIKVNQIIRNGGKEMDENLKKSIKACSIAVVKKFIKENSLNKLASYRQKLLSSVVAKNHKRILDVLTQLSVYSGVYFSFAFDYIENQTQNEDIIHYFILELDQSRLESKKNKENEDKE

SEQ ID NO: 342 - protein, 456 aa, Methanosarcina barkeri
MSQSFLYTFTGNPFVDSGIWAICEWSGRKKPEDIKIEDVKKIAHDVIPIYLSLKWSKSLYSVFPNNAVTNPSVKNKDKKLLESLEKLIGQVESLEKSEKSGNCISCGKYNVEQTRTKTEIPLIGSGTLINFFPYGQKGADYCPACTLAVQFSPLVFYACGKLLLIHSNSNKVMHYWVEKAVKDIRRQILANSYSGCFDEGYKNPVNALFHIIEDIIIQYDEDWVEENPSINMYHFTNFNQGPDLDIYRVPTPVFRFLACVKDPEWFTEWKKIVRRGYFNWNKIKEGDDYKNRGNSVYINLLKGRSIVKYFIDNKNRQVYGDWELLEFYLKEVRNMGSKRLDTLKRVGDSISEYIKDTQNIKRLNQLEMARNFASFRNQLRIIEKDRINRSVQDPLFTLEEFMDDLFPEGNLGWRETQDLLLFRIYENLHNWLVEHDTLKSKLISSDEEEMGLLEEE

SEQ ID NO: 343 - protein, 447 aa, Clostridium perfringens
MEEKVFDCTLESGDWRESATIVGLIKYFDFLYQNGVADKSELYEFEDDYLRYNSNYISEENYLLFVEKYFKDAMHHKVVENILLKDELSEDEISIINDKLKANQAMKSIFGKIKYTGENKEEILDLIEKNRLKLIKETYRRGKSLYSNFANENLLFSDNNKVCRLVNYCADMGKKGKSLGYYWDNNTFEFKDEKIFDFIPFAFSKSYDAFFINNNVSIKELKKSNSFIENSENTRTTLFGNMKESAEYIGFDVEVILKSRDKNYYETVYVREKAINIFKQSDDFDYKGIKFWYRDDEKNSKYMEPEVVNRILNGIRMDSIIELLFKSKNNHSYNIKTLIAINNLIYEGGSEMTEKMKSAYASAKEVRDKLKNQENKINSYKQKLISAVTFKDKDRFCEILLQLSSFSGVVFDFAYDLFEDFENNKNLAYTFINALNKEGNKENGGDK

SEQ ID NO: 344 - protein, 546 aa, Caldicellulosiruptor saccharolyticus
MKERVYLGDWAYNAGIIGFIEIMLDGEDIDSQNIITIGPNYIEFERESLQGFSDKFFKKAYQRYPRTDEIMNEGKDLLAQLNNQSDIDEQQRERVRKFKDRINGFAKLNRVAKEYGCSLEKKFNKNEAVDYVNTIIKILEDRKQEFMENDVKVYLNNVSSVYGEASFLNRQITENLKEKFYNDFEKPIIEKANEEDKKYPCIFCGERKAKKGAMFNTGIVNFLGANKDNKNFFWNFKPQLPICEICELMYFCIFAALTEFRVGQTKRFYFVDKSTSVLELYQANKLFMEIMSKEENLLKDKGILNFINDYLLVKLREESKFALTNILFVEIDLSSVAPKVYGFNISKQKAEFVTSNYEFFENVVGTKITVKDNTLYPFHELLQRFLNNTLSFQFVSFLESQFISSKKVNSKIKTNLSPYRLQMFNIITYKFLKSIKRGEMLMDEKSLWRMYFFGQELKKTFLKSGAENKITSLAYRLISALRIGDINTFMNLVIRTYMNYNMEVPALFVSCINDKDNFCALGYSFVNGLLGSERDERLENEEDEEK

SEQ ID NO: 345 - protein, 497 aa, Roseiflexus sp.
MITYTGHPFVDTGFAVITAFVRKRRFADLADDDFQQIADYIEANYVRQPLRSFLTVAFTSNAWFAQSAFNPDRPDLSPEKQTEAREKRQYWADRHLRQWQQSAAALETCLFTGLPAAGLELSQKLQPGRVGRAQMPLLQGDDAINFFINGDPGLPMAAEAILALQAMPLGCAKVGGGLLAVHCDDEALTIAFATRFLQRNLNDVAKAQAAGEKKLPGSPRSLKTLLVETLTEILIRQIQEEERRARRPAITAYYFNNGQSPFLEIYHLPLQITGFLLAVHTPAYRAIWNELVQRGWQRAGISGKQGKAVDPVEPHFNYLYEDLFTLPAQAARFVRTYFLRIPDLRRSADDPRREYSPRREADLVSWPLVELFAQEVLLMTDDRVTKLKELGDKLADYTRYQGGKRFFRQFFVEQRSDNFLSLLNKANIDYTRYKRGQETLFDLDSFLTIFMEGDEVLRKDWRLMRDLVLIRMVEQLRDWIAGNPDAIPAEEEVAANE

SEQ ID NO: 346 - protein, 554 aa, Alkaliphilus metalliredigens
MAQRIRLEMNDWLYNAGLVGLYNILVHSGEKVKMNEQGIEMDQSQLENFEERYFTYFIEKYEVYLSWYKIISYKDVLTYHQKQNFNSFGEEELDSLNQYIKDVKHYLSSNSYKAAYELIGSQVTLLELAKKLQTIKLKKKETIGEKLIEIKETVNKLNEIIGHCMEEDYKKYLAGKNVIYTIIKNGWNGVSILNPQTKEKDIYMDYKNYFVKPVEDYMGDDKSTKKYNCFTCDREMKDLKNDLSFLNQVGFDVSRKASHTWDFVNDIAICPICKLVFSCVPAGMTYVYSKGIYINDNNSFQRAVNVNQRIKSEILKEHEDNRLLTYRALVKSIQEQIHEKIKYELADIQVIRYEEEKYRFNILTRQMIKIIQQSKHSLGYIHNSGFKEVNTYFNIYELVIERVLNNQNLFTLIHKLLSYKLSSPKNCRFTTSQVISVLEINFRFLEGMGYMQNADQDMIKKANVSGYYLREQYKVKGAKDKLNGVSYRLLNALKTNKKDMFMDTLLNCYLYAQKTVPSIFLDALEDEEKYKTIGYAFVAGLIEGKDHQNKEGDQ

SEQ ID NO: 347 - protein, 582 aa, Bacillus cytotoxicus
MIFVTEEIPLAAEEWTITQGLVGYYRILKHAGIKVKTTDEGILFNPEHLRNFEHYYFDYFLDRFSVAKRDEQNIRRTFLKFRAESESKGSKEAKRRMQAAKKSLDETIKKTAIEKVEKKFEDSSHKKRLVEYATLIRNQKTYNPEMDKWIEEYIQALSEPNINEKLTLNYFKATVLGTYFGQVSFLNVSHTSKDIEEQKEIFRKDYIESLLADLELQQMIARAEDSDEIMKYLEISTHEMAKKLKTKFKKMTIQQIKDYVSNEINCCSFFDSQWAFEQYSELHFSPLSMSASKALNFYWNANGTLTIPVSKLAKLILFCAPAGASIIGGKSLFVQREGRFEQVIYANETYEIGRSKDKAFDEIIFDLIAEQKTKAQHTGDSYLILEYSSEYNAKKTDLQYLHLTPGLCSFFKEKNCTKWFSRLNYVLRNQIVHAFLRYQDSKHIIHNALRKKLQEQKLANEIVYACLLRCYYLFFVKGEGKMNTDLKTSKNRIWSAFYEGVAIKNIVEEGKIRSVAYRLLNAIRSNDKKMFLDTVMRLYMSVEKPFPRVFMNILDESNIDFASIGDSFIAGLISKEEEKINE

SEQ ID NO: 348 - protein, 501 aa, Roseiflexus castenholzii
MPNPIAYTGHPFIDVGFATMCALTCKRRFADLTADDFQKVVDYIETNYVRQPLRSFLTVAFTSNAWFAQSAFNPDRFDDPNKKNEAQQKRTYWADRHLRQWAQAAESLETCLFTGLPAAALELSGKLQPGRVGRAQMPLLQGDDSINFFTNGDPGLPMAPEAILALQAMPLGCAKVGGGLLAVHCDDEALTIEFAGQFLQRNLADVTKAQAAGEEKLPGSPRSLKTLLIETLNAIQTRQAQEEWRRQHRPAITAYYFNNSQSPSLEIYYLPLQITGFLSAVHTPTYRALWNELVARSWQRPAAAGKRGKATEPTEPRFNYLFEDLFTLPAQAARFVRTYFLRIPDLRRPADDPRRAYSPRREVDLVSWTLVELFVQEVMLMTDDRVAKLKELGDKLADYTRAQGGKRFFRQFFTVQRTDHFLSLLNKTNIDYTRYKGGAETLFDLDSFLTLFMEGEEVLRSDWRLIRDLVLIRMVEQLRDWIANNADAVPSEEEVTIAEPA

SEQ ID NO: 349 - protein, 492 aa, Herpetosiphon aurantiacus
MLKETGHPLVDVGFATIAAHVNKTNIKAVTAADLEKVAAYLEAEFVVNPLRSFLTVAFTSNAWFIQDAYNPDKPQLTDEQRTTRRATRKKLADAHLRQWQQPSTSEQRCVFTDEPAVGEVLSNTLTVGRAARAQIPLLQGDATINFFPNGNAGLPVSGIALLALQAFPLGSAKAGNGILVVHSANPRLTLNFAKTFYQRNKSKIERARIAGDDRVPGEVRSPKTLLIETLFEITAERENYDDDQITSIVAYNLNNGKTPSLAIYELPHEIILFMLEAKGHFPKQWNQLVHGAWEQASAASKKSNQHFEPRRNYFYEDMFDLPNNAKRFVRTYFLKMPYLGTLDDDNQSRYYLHDYYHLIDFPIVELFLRRIFLMDDLRIARIKHFGDKLANYVRAENGKRFFRAFASEYKYQDFRQRLIKASEDYVRSSQEPLFTIDEYVDVFERQYSDQAPDWRLSRDLVLIRMIEQLKDWLSRNPDAMPERPEPKQEQSN

SEQ ID NO: 350 - protein, 500 aa, Chloroflexus aurantiacus
MNQIRYTGHPFVDVGFATMTAFVGKQRVADLNAGDFQRIADYIEANYVRQPLQRFLTVALTTNAWFVQPAFNPDRPGLSPDQQANARQKRDYWAKRHLRQWAEAARALETCLFTGLPAAAFELSGKLQPGRVGRAQMPLLQGDDSINFFVNGDPGLPMAPEAILALQAMPLGCARVGNNLLAVHCDDERLTIAFANRFLQRNLSDVAKAQAAGEEKLPGSPRSLRTLLIETLADIMRQQLEGAQRTTITAYHFSNFGQSPFLELYHLPLQITGFLLAVYTPTYRNLWNELVARSWQRVTPTGKRGKAAEPAEPRVNYLYEDLFTLPAQAAQFVRTYFLRIPDVNRSTNRSTDDPRRDYSLRRDIDLVSWPLVELFVQEVMLMTDDRVAIVKELGDKLADYTRKQGGKRFFRQFFTVQRSDHFLSLLNRTNIDYTRYTQGRETLFTLDSFLTVFMEGEEVLRSDWRLMRDLVLIRMVEQLRDWIAGNPDAVPDDAEVAVSE

SEQ ID NO: 351 - protein, 539 aa, Sulfurihydrogenibium sp.
MELFNRKDSHVSPLTSHVSRIYLGDWLYNAGIVGFLRINNHLWDVKDKKLISKDENLLKIGDNYIEIDRKIFDGFTDRFFDYAFNLYGRYDRKLKRFRELLENLNDGTFKDVYKDFKEEVNGFTLLKNKLGDIKAKNSQELKHLIEKAIRILEQDKEEFVESDVQIFLRSFNGQKSFLNKTITKDRKKKFYEDFEEPLKTDNNQKDKKFTCVICGERPAKKDTNYDTGFSPIFGLNKDAVNFAWNFNTKLPSCDICEIVYFCYFAGLTELNGKYYFVNLDDSVESLMLANNLFKEEIEKSPENPFVDFFTEYLLRIKKSQAKYTLSNINFLETELKETLPKVFSFNIDYKTAEFIEENHENLKLLSKSFFILPDKNKTRVYILTEFLNLILKKDLNYGLLYKIFKSATQDKAYVSNYNLQRLIIMYLLYKQKVGGKEMGLEEKSLWAMYMQGKNLLERLKDGDAENKIQSIAYKLLNALKIGDVNQFMDVMMRVHMAYDLEVPSLLIKALQDKDNFYLLGYSFLNGLLGKENKLQEENQ

SEQ ID NO: 352 - protein, 462 aa, Chlorobium limicola
MSSLFQYTGNPFVDAGISALTNWCDKKTPQELTEADIKKALPEIANLFSQGAWVKTFYTTFSNGVMVQPSNKGKEREKWLEFIGDLVKELQPLADHGSCVACGCRNAIKIKKEKRGLLRSEVPMASGSLNYYSFASTGADYCGTCAIAIQVSPLVLYRSGGKMILVHSSSEKAMCSWAKMAINEVRSQISLRNYTGCFTENFTNPQNALFRIAKILIQDKDDWKSDPITIRIYYFTNYGQGAELKYYDLPNRVFHFLNEVHHSEELKDWDKIIGSTYFFKKNNSKIYLNTDDKSEEEYKNNNNVIYEGLLKDEWIVKYFYNFLQRKAYAKWELVQLYLKEVRQMDKQRTEVIKRVADEISLVIQRDESHNPKRLWQLERANSYGTFRNVLRLIIKDRIKNGAERPLFSIEDYTERLFPDGALCWRETQDLILFRLYEMLHGWLKERDIVIDEVEENSTTEIE

SEQ ID NO: 353 - protein, 558 aa, Dictyoglomus thermophilum
MERVYLSDWLFNAGIIGFLSILFEGKEDLKEGENTFSNGKNIYIGKNYIEFEREVLEGFSDKYFNSAYERYRRTDRFIDYCREILEDIKKETLYKDIEKSYEELKNRIDNFSKLKDFLKKDFQLPPLNEVKRNPELFREYILKVLEVAEKNKQILIENDVKIYLGKIYGQKSFLNRTITSNYKNKFKEDFEDKIINDTKKIKRSILCINCGERYAKKDTSFDTGISPFTGVNTDALNFFWNFNAKLPLCEICELIYFCTFRGFTESVLENKYFFVNSDTSVIDLYKKNLLLQEKLKKNLTENIFVEFFSELLLREEYEKSTHRLQGIAFIEIDLTNKDVLPKVFSFNISRAKAEFLKEHAEKNFKNLINIRYSIKRYSIKDSIKEIIKNVTLEFLEKILSNTLSYGYLSFLEYLLLESIKGNKDVKTYYSPIHLNILNIIIEDYIQKFKKYERGEKMSSKNEEQLWFMFKKGEEIANKLISENSENKIPSLTYKLLSCLRTEDVHSFMNIILRLYMTYSLEVPSLLVKALNEKDLFLAYGYSFVNGLLSKYTSQNNEN

SEQ ID NO: 354 - protein, 554 aa, Thermodesulfovibrio yellowstonii
MVNDSIKLYPSTVKHKIYMRDWYFNAGIVGFLNIITDGKELDSIPYLTIGENYIEFSDEIFEGFEEKFSKYAFLKFFNVNAYLQRLQKAQKDLTEKKTKIKPEQIRKKLEEIEKPPYKDFLKLLNIPVWEYKSAEDFIDNLEKAQSKLKNLSKNQIFEILNKTPEGKESIQIFINQKLKGVCSHENVSEYVSRIKAMKYSKKLKNNELCPSCQEKKAEYEFNNAVSNIIGFNKDNSNWIWGFKVSKLQICPLCAIIYSCAFASFAYVLKIAEGEYLNYFYFPNENTNLKTLYEIVKTFNLLIDNIEENSNLLYVMIKQIVDYITKKQINRISENINFIEIADNPILAGQGTKGYNIYNYNISPDIAMFLDLQFKNESVPKGYYVLNKNYCSIEEELLKLAISYQIDYSTLYRYFAYYLDTDNYSTKYNLNKVMNFVIKYIQWVRGESMEKSQKIINKGYLSGLSLRNELIKKGKENQINGLVYGFLNDLKIGDREKFLDKYLRIVMSHNQPNRFGKDEMLDDDYFLQFGYSFVSGLISKSGIENNTGTNDIEEE

SEQ ID NO: 355 - protein, 562 aa, Listeria monocytogenes
MQTEIELRADDWLINAGLVGFLNIVGKENVRINGQSIYFKADLLVGFEDKYFNFFIQEYKETLAWFKIVSYKDTMERFRAEDFASFDEKALNDLNKYMKDVVKFYLKKSNYIKVFSLIDAKANVTKWLENLNAINLTKKQQWEDVKVDIVEKVKRNYIQLDFIIDFCLGEKGLKYLGAKNLIYSVINKGWTGTSFLYTKTKFADPYLDYKTSFLDPVLDYVDSDLSKAKYNCFNCNLPIKNLKTGLSFMNDIGFDIEKKTSHVWDFNNDVATCPICRLIYSCVPAGFTYVYGEGMFVNDSYGVEELHRVNERMRNSILRFNQDGINSTNTYRALVESITMEHENNRRYELADIQLVRYENEHYRFNLLSKKMLHIVNDSKGILKSLIRCGYKEGNLNVNLYKEVIQHLMNNENLFTLIHKLIYYKQTSVNGLYYNMGHVSGILDINTKFLKEMEVMTNISQNQLWFVQNCGKEFKEGYVKKKSENKISGITYKLLNSLKVNDKDGFMDTLLNSYSYLSMPIPDVFIKMFSNNEAFKSVGYAFMLGVGGEKTKKENGGNTDEK

SEQ ID NO: 356 - protein, 500 aa, Chloroflexus aggregans
MVNSIGITYTGHPFIDVGFATLAAFANRRHLADLTTNDLAEMANYIEANYVRQPLRSFLTVAFTSNAWFAQSAFNPDRFDDPDKKIEAQQKRKYWADRHLRQWAQAAAALETCLFTGLPAAALELSGKLQPGRVGRAQMPLLQGDDSINFFTNGDPGLPMAPEAILALQAMPLGCAKVGGGLLAVHSDDEQLTIDFAKRFLERNLSDVAKAQAAGEEKLSGSPRSLKTLLIETLAEIIRRQMQEEVRRERRPTVTAYYFNNGQSPSLDIYHLPLQITGFLLAVHTPAYRAIWNELVQRSWQRLETPTKRRKVAEPTEPRFNYLYEDLFTLPAQAARFVRTYFLRIPNRSTATDDPRREYSTRREVDLVSWPLVELFVQEVMLMTDDRVAKLKELGDKLADYTRYQGGKRFFRQFFTVQRSDHFLTLLNKTNIDYTRYKRGTETLFDLDSFLTLFMEGEEVLRNDWRLMRDLVLIRMVEQLRDWIANNADAIPSEEEVVEA

SEQ ID NO: 357 - protein, 500 aa, Chloroflexus aurantiacus; identical to SEQ ID NO: 350

SEQ ID NO: 358 - protein, 546 aa, Caldicellulosiruptor bescii
MKERVYLGDWAYNAGIIGFIEIMLDGEDIDSQNIITIGLNYIEFERESLRGFSDKFFKKAYQRYPRTDEIINEGKDLLEQLNNRSDIDEQQRERIRKFKDRVNGFAKLSRLAKEYGCSLNKKFNKNEAVDFVNTIIKILEDRKQEFMENDVKVYLNSVSSVYGEASFLNRQITENLKEKFYNDFEKPIIEKANEEDKKYPCIFCGERKAKKGAMFNTGIVNFLGANKDNKNFFWNFKPQLPICEICELMYFCIFAALTEFRVGQTKRFYFVDKSTSVLELYQANKLFMEIMSKEENLLKDKGILNFINDYLLLKLREESKFALTNVLFVEIDLSSVAPKVYGFNISKQKAEFVTSNYEFFENVVGTKITVKDNTLYPFHELLQRFLNNTLSFQFVSFLESQFISSKKVNSKIKTNLSPYRLQMFNIITYKFLKSIKRGEMLMDEKSLWRMYFFGQELKKTFLKSGAENKITSLAYRLISALRIGDINTFMNLVIRTYMNYNMEVPALFVSCINDKDNFCALGYSFVNGLLGSERDERLENEEDEEK

SEQ ID NO: 359 - protein, 573 aa, Sulfurihydrogenibium azorense
MERVYLGDWLYNAGILGFLNINSHLWELNTIGDKQELKSKDESLLKFGENYIEFDIQIFDGFSERFFNYAFNQYGRYENEKKNFKEYIQDLESLKNNKILDYLNKKYFSNKKENAEILEEIPIIIFNKFEKILEGFKLLKDKLGSIPSKNEIKKDVNLLMNILKKAIEIMEKDKQEFWESDVRIYLRNIYGQKSFLNKSVNTNRFEKFYKDFEELLKEKKVKKDKKFLCISCMERKAKKDTIFDTGISKFYGLNPDVINFSWNFNPKIPLCEICEIIYFSYFAGLTLIQKDGKRAFYFVNSDTSIIDLVSNNRLLNGVLKPDLTENILLNFFTQLVLESSYQKAYFTVQNISVLELDLNNEIMPKVYSFNLSRKKAEFLKESKTKENLKQLSKDYYKINRKKGELKIYILPEVISLILENKLYFNYLNKILRMFIAYQNGSERYETNISPYKIQILNLVVSEFIKNIGGKTMSVSEKEIWVIYQEGKKLANILSEKKAENKIKSIAYKLLNSLRIGNSQQFMDILLRVYMAYGEVIPSSFIKTLQNKEDFYSIGYSFLNGLLSKQNKEVESDE

SEQ ID NO: 360 - protein, 567 aa, Persephonella marina
MERVYLGDWLCNAGIIGFLKINHHLWKIEREKLISQDESLLKFGDNYLEFDRKIFEGFSERFFDYAFHQYGRYENLLNLFKEYIEDLQNLDDEENFEKLAKKYFKNKDIKIENLPTLLPVEIFDRFKRILQGFTLLKKKLNKIPSKNDIKKDKNLLIDVLNEAISIMESEREEFWESDVQIYLRNIYGQKSFLNLSVNKDRFEKFYKDFEKPLIESSVKRDKTYKCINCIDRQAKKDTIFDTGISKFYGLNPDSVNFVWNFKPKLPLCEICEIIYFSYFAGLIPVNKNGKTVFYYVNSDTSLESLLKENLLLERKLTKEISENPFIEFFTELVLMSEEERARYTLQNTVIIELDLNNETMPKIYSFNISREKAEFLVNNKENFQKLSKVFYKIKNDSFSVLPEVIEKTLNNSLNFKYLNRLIKLHLKNANDSSYYATNITSYQLQLLNLLTKEFLQKVILGGTDMGIDENNLWSIYYQGIDLAKKLRESNAENKIQSIAYKLLNALRIGDTNQFMDVLIRTYMAYGEEIPSTFVKAISDKNTFYPLGYSFLNGLLGKEKPKEVSNNE

SEQ ID NO: 361 - protein, 601 aa, Geobacillus sp.
MKVQLRMGEWMITMGLVGLYRVFEYGLKNEIIDQQYRRSISIRPWGLELDVDVLSQLPKAYFLYLMDEYSVAKRDSEKLQLYMKQAEKEAQFSYALSAIKKTITDTGKKVLKYFSHPPLANALEALKQVKKPENFELLATCAHTFETALYEPKINEKLTLNYFKAAILKAFFGQVSFLNVSKNSLDLQGHIQEFQKDYIAPAQYDLQFEHILADAKSSEEIIAFLDKHKDYQPFKVLKRAWKNKTLEDIQDYVKNTITKCLLLHDRLAFYNFEEMVFAPIGVAKNNAFNFNWNLEDHQPKPISSLAKLVLFFAPAGAAIYLKKEGVNEQGEYRTYAGFVQSDAAFSEILQKNNHFKQLKQQKEPFDRIVSKLVQGITKEAEYVADHLFFLEFSSDYDSKKTHLHYYHLPMYLAYYFKNCKGKLDYIQPYEYREHFVQYVLRGEDPAIVIYSYLRYCIEKGNSHIGPYITVRERNRILQLKKGVKDMSSTDKRVYAVFRSGQEIRKALEQAAASKTSEQYSASSNKKVNAIAYRLLNAAKAGNQKSFMDTLFRLHMSAEKPISPIFLNALHERDLDFATVANAFIAGLLSSGLQEEQEDVVS

SEQ ID NO: 362 - protein, 589 aa, Leptotrichia bucallis
MSDEKIELKLKDWLFNAGLLGFINILGEEARNNGELEIDDKNRLIRFSPKVLENFEYKYFDFFIKRYGKTLTYGKILEFEKYIDEFEENGEKIRSINELKMINDKITFFKAKIKSASYKKAYDFIEKDGTNKILGLEKELKKIKEPKENIDEISKDDVKNNIKIMKEIIDFFKKKITDKNGNVKNYLAAKNIAYVIINNAWSSVSFLNRANAAKDIYEEHKSYFVEPALEYVNADKSKFKYKCVLSNMLMKDYKNTLGFLNDTGFDVNRKPSHVWNFVNDIAVTPLVTLVYSCVPAGFIYGADKGIFVNANHNIDQLCKINNGIAYNILEDESEEKNINLYKNLLKEIKKEKDNTKYELSDIQIVKFEEGHYKFTLLSRNILKLLSENKEKLDALLDKWYLIDRRYFYLYDTTITELLNNQNLFSLINKLCYYKISKTKLSCKLKNIEDLLKINLDYIRRLKKMDKQEIIEKKENKKTSEELTEKDIFYIRRDAMIFREEYIRKSGNDKKIGSLLYRLQNALRINNVDMFMDALISAHAYAGKNISSLFAKALLNDENFQTLGHGFLLGLLGEDKSKNENKTDKKEGNE

SEQ ID NO: 363 - protein, 563 aa, Desulfofarcimen acetoxidans
MKSDKIRLTLGDWQWNASVIGFINIVGEENVCHIEADTVEFWPEALDGFENKYFAYFINTYEKTLSWYKIVNFQDRLNTYEENNFEEFDLKALEFLNVYIKDVKRYIKSNSYKAAYELIDSEVELLSFEKQLITIKEPKNQQRFDVDKSEIVNEVKRRFLLLQQIINYCASSEGRRYIGAKNAIYNIINNAWNGVSFLNSQTKEKNIYSDYKSYFVDTATGYLQSEKGKYKYNCFVCDAPIKDMSNDLSFLNATGFDVARKSSHVWNFQNDITICPLCKLIYSCLPAGIIYTYNRGIYINQTIKLKDAVRINNKIKSRILRSQDGSMRPIYHALVSVLHEQENDSAKYELADVQVVRYENESYRFNILAKPMLQIIVNSKKELDSLIRVNFIENGRNINVYDEVIGRIFNNQNLFTLIHKMLYGKLSDASKCYFNGSHVRNVLIINQLICSRLGGMKMDNTYLVKKSREAGESLRNKYFNKDSNHKLAGICYRLLNALKTTNENMFMDVTLNCYLYVNSQVPKVITDALGRGKDFSTMGYAFVSGLIDGQDGSGNKEKKAEGE

SEQ ID NO: 364 - protein, 493 aa, Thermocrinis albus
MVVRFYVRDWVSASAAVGLLKALEKLGQEPKEFIDGNSLIFEEKDIIEIFPSAFTKKLIDVSSQKNPKKDSFVDRAYSVLSFLQKNFYSNSPLSNPSSVPKRLEEKSKELEDLYRSDPDKAVFELVKRFVGDTFKKILERETSDHTCFFCGERKASIHNGEPKTFEATNFTPLSASPNTVENLFYNGKNNLYLCSVCEIVFYFAGFGFTKVDKMDNRYIFAYVSDIKETLRLNNTLEYYKGFNKEFVTSFLKDLEHHKSRWILENIYIVEVEKVSKVQSNIYSFSIPPRVAKAMKEYLPKYPKTLEPVFNEFLKYIYFGRSLYQLLFEILYGYFHEEELPDSKDSKKITDALRLGMRLAKGNKGLYPSLLFLSKFQEVVEMKDKSFVEKQVGWAYREGLQLKNALLKELGDKALDRIRSISYSILEAIRRRDIDAFQQNLIRAYLSVEREIPRVFVDALKDESFSRIAYAFLIGLNGTERREEDGGEAEETMG

SEQ ID NO: 365 - protein, 451 aa, Methanocaldococcus infernus
MGNKTFYWTGHPFADAGLSAILLLNNKQNPDEIDENDIKKAIEFASNLYAKNEWVRYLSGKIFPNNGFIMTNPSMSKKRSPENIAKNLWKLYENIPEILEPSSKERRCIICGRRVPYGKGDRSIFPLLGTGKMLNFFHSGNPKGEDICAHCIFLAQFMPLVAYNLSSVLVIHTYPYSKMLRFYDESLRQVRISSLVPDAKGFRKPENFFFKLLIDITKNVESSKYWKNTVVTLYYFINDNRSQNIDIIYIPNDILRFVAFAGEVDPEGWRNIVNMGWSKKDNLNFEEMEKTRVNEVYKKLLNDESILRYFYDGINKKVNASWELLEFYCLEVLKLDKEALDFIKDVGDRIIETIEKLNDNDLRKIVGELERSTKLYEFENFFIRVEKIRQKNGIPRSLLTFDEFARLLMGYGEDITMSWKVVKDLLLFRIYEKLHDRLIKTSEENYEGDEK

SEQ ID NO: 366 - protein, 586 aa, Brachyspira murdochii
MAKTKKSSQHELNLEDNQNNNIKKKEEYFEINLDTFLFNAGVIGFIEVLEKSEAHKGTSLDDKKDFYYEGQTLYINKKFLLNADLSQIYIDAMIKKFSDKTNISESIKKIDIILNDKENKDFKDDIKNIIDYFSAASIKTGLETLISKGISVNIQDNIEKIKEIIKSKNPNTEHIKNYLKEIKSDFENSKEVRDTLLMKNIMYTKINPFWENKAFLLPANSKKDIKEMFYKSFEEPLKELINNKKKFNYNCIVCNESINKDIDTTFLFEVGVDTNRKKSAFWNYNADSFICALCNYIYACTPLGFIDMSNLMLFVNQNDSIETLIKMNEKIDFVNNEDNKTYTAYNEIIRRILSEKTKELKSIQVIVRDKNHYLFNTIGKDSLQIIESMKDELNDIAKIKSIKITDDYWIDIYKDCLENILNFKNQWNLIFKLLKIEDNKFILNTIFNILKIQIAKDIIFLKEDNNMQKQFDLAYIAYKNGNEIRAKLIGANSSANLNSEQNKEADNKLRGLVYQLINYVHTSNRDLFLSNITRLYAGMNLSIPSIFLNIFKSDEEFKVIGNAYILGLKGSFYDNENSKNNDKKDN

SEQ ID NO: 367 - protein, 548 aa, Thermoanaerobacter mathranii
MKERVYLGDWAYNAGIIGFIDIMLDGKDITSQNIITIGPNYIEFDRNSLQGFSDKFFKKAYQRYPRTDELIDLGNKLLQRLENNDFDKNLKQEVSNFKKRVEGFSKLKQLVDSRKLTLPRNFNKTDAEQYVSQITDLLNANKQGLIEDNVKTYLKNASSICGDRSFLNRNFKGELKKKFFDDFEGPIVNQTNRQDKNHDCIFCGLRPAKKDALLDTGLVSFLGANKDNKNFFWNFKPQLPICEICELIYFCIFAGLTEFRIGQTKKFYFVDRNTSVLELYQTNKLFMEMMSREENILKEKGILNFINDYLLLKLKEESKFRLANIMFIEIDLTSSVTPKLYGFSITKQKAEFINSNFDIFKKIAGSFIKFKDNNIYPFSEFMQKFMNNTLSFQFLSFLEGEYLSSQKPNSKINTNLSPYRLQMYNILTYKYLKSIKRGGELMDEKWLWKMYFFGQELKKKFLSSKAENKITSLAYRLISALRIGDVNTFMNLIIRTYMSYNMEVPALFVSCINDRDNFCALGYSFVNGLLGSEKDEKVENSEEVVGNE

SEQ ID NO: 368 - protein, 587 aa, Syntrophothermus lipocalidus
MPKGVEQGKGGEVEFMPHVHWTGNPFVDAGLAALAAAARVSTLEELGAEHIEQAVKELERVLLSDQALGIGVDKAFSGPKKALRQVFPNSELDNPSNWKGRTPKEKEDNARRKFQDALRSELNKAKQCLELEEAGETCFACGERRPKIAMETRRKDKMPLFEGIVNFYPGFSHGVRVCGLCSLAVRFLPLSTMLAGNQNRLWFLHSQHLGLAATVARRYGWEHFDRLITGNKALDFYGSWETAGEAGTVVYLFCELLNSFPDQLRAIYRSGLPSTAYVFSNDNRGGFVQAIHVPNELLAFLAKLQIESKNAFKDFWEGLLKVRGDLREDERKTRAGFVRSISNRMIAGENIVGMCLTSDPPNLQGGWLGHRLYLQEVRGMAPEKLAILERLGISIAASEDAKKLVTELVTAQYHQLYGLLLGYVRKGWLSHQEFYFLLPPNAHKVAGEIRDVLLAVVYEWQHCQQEGKEFPRSTFDKAEASPDETLRRIQEIGRRLTNNLPNLQRWTKELTSARYAERIRGVYLNAVRHGAVGFEDYVFLAPLQDQRAMWLLRDYLLAFLFDVGRVELPEDEYPEFGADEVREIETF

SEQ ID NO: 369 - protein, 602 aa, Geobacillus sp.
MKIELRMGEWMVTMGLVGLYRVFEYGLKNSLIDQQYKNSIRIVPQGLELETGVLPQLPRAYFLYLIDEYSTAKRTKERLLSYLGQAKSENSFSTALSNIKETIKDMGKEIQQYFPNEPVNPLLEAIKSIKKPEQIEQLEQCIAEFQQLLFKETINEKLTLNYFKAAVLKSFFGQVSFLNVSKNHLDLEGHIEQFQADYIVPVQLDLQLEQILRSASTEKEVLRFLDEHAEYEPFKALKRAWRKKTLPQMQEEMNVMYECMFFPGHVAFYNFEEMIFSPIGITGKAFNFNWDLRDKQPKPISSLVKLVLFFAPAGAAIYLKKEVFKKQNKKQNKYRMYAGFVQSDAAFPEILQKNNHLKQMKQQKDPFDRIVSKLVQSVTKEANYVVDHLFFLEFSSDYDSKKTHLHYYHLPLYLARYFVEYPGKLDYVHYDYREQFIQDVLRGADPARVIYEYLRDCIENGRSHIGPYIAVGERSRIMQLKRGGKEMEKTDKRVYALYRCGQEIRKALEQAGSAKTADHYSASPSKKISAIAYRLLNAAKAGDRKSFLDTLFRLHMSADQPISSLFLNALHERDLDFPAVANAFIAGLLSQEGQGEQEEVVS

SEQ ID NO: 370 - protein, 551 aa, Caldicellulosiruptor obsidiansis
MLERVYLGDWAYNAGIIGFIEIMLDGEDIASQNIITIGSNYIEFDRNNLKGFSDKFFKKAYQRYPRTDELLDLGNKLLQRLENNDFDKNLKQEISNFKKRVEGFSKLKQLVDSYKLTLPRNFNNVDAEQYISQIIDLLNANKQELIEDNVKTYLKNTSSICGDRSFLNRNFKGELKKKFFDDFEGPIVNQTNRQDKNHDCIFCGLRPAKKDALLDTGLVSFLGANKDNKNFFWNFKPQLPICEICELIYFCIFAGLTEFRIGQTKKFYFVDRNTSVLELYQTNKLFMEMMAKEENILKEKGILNFINDYLLTKFKEESKFRLTNNIMFIEIDLTSSVAPKLYGFSITKQKAEFINSNYDLLKKTTGSYIRIKENVLYPFSEFMQKFINNTLSSQFLSFLEYQYLNSQKPNSKIKTNLSPYRLQIYNMLIYKYLKSVKRGEDLMDEKWLWKMYFFGQELKKKFLESKAENKVTSLAYRLISALRIGDINTFMNLIIRTYMSYSMEVPALFVSCIKNEENFCALGYSFVNGLLGVEIEKDGEIENSEEVEENV

SEQ ID NO: 371 - protein, 601 aa, Geobacillus sp.
MKVQLHMGEWMITMGLVGLYRVFEYGLRNEIIDQQYRQSISVRPWGLELDIDVLPQLPKAYFLYLIDEYSVAKRDSEKLRLYMKQAEKEGQFPQALSAIKKTMTDTGKKVLKYFSHQPLANALAALKQVKKPENFELLATCIHTFETALHEPKINEKLTLNYFKAAILKAFFGQVSFLNVSKNSLDLQGHIQEFQKDYIVPAQHDLQLEHVLTDAKSSEEIIAFLDKYKDYQPFKSLKRAWKNKTLENIRSHADNTITKCLLLQEHLAFYNFEEMVFSPIGVAKNNAFNFNWNLEDYQPKPISSLAKLVLFFAPAGAAIYLKKEGFNDQGEYRTYAGFVQSDAAFPEILQKNNHFKQLKQQREPFDSIVSKLVQGVTKEAEYVADHLLFIEFSSDYDSKKTHLHYYHLPMYLAKYFQIYKGKLDYIRPYEYREHFVQHVLRGADPAIVVYPYLRYCIEKGYSHIGPYIAVRERNRILQLKKGVKDMSSTDKRVYAVFRSGQEIRKALEQATASKAAEQYSASSNKKVNAIAYRLLNAAKAGNQKSFMDTLFRLHMSAEKPISPIFLNALHERDLDFATVANAFIAGLLSSGLQEEQEDVVS

SEQ ID NO: 372 - protein, 636 aa, Caldicellulosiruptor hydrothermalis
MVERVYLGDWAYNAGIIGFIEIMLDGEDIASQNIITVGPNYIEFDINSLQGFSDKFFKKAYQRYPRTDELIDLGNKLLQKLKDNEFDKNLKQEVSNFKKRVDGFSKLKQLADTQNIALPRNFSKDDAEQYVTQIIGLLNENKQEFIEYDVKTYLATISSIYGQKSFLQNENSIEKFIKKGEKLLDELKNKKLHKDIERKISKFLQEAEELTEKISKYYNSENIQISEMQVNSEGIPDTERFEEFIKNIINILKYLPEKSKFVFYNDFEGPIIERTNKQDKHHTCIFCGLRPAKKDALLDTGLVSFLGANKDNKNFFWNFKPQLPICEICELIYFCIFAGLTEFRIGQNKKQTKKFYFVDRNTSVLELYKTNKLFMEMMSREENILKEKGILNFINDYLLLKLKEESKFRLANVMFIEIDLTSSVTPKLYGFSITKQKAEFINSNFDIFEKITGSFINFKDNNIYPFSEFMQRFLNNTLSFQFLSFLEGQYLSSKKPNSKINTNLSPHRLQMYNILTYKYLKSIKRGGELMDEKWLWKMYFFGQELKKKFLASKAENKITSLAYRLISALRIGDVNTFMNLIIRTYMSYNMEVPALFVSCINDRDNFCALGYSFVNGLLGSEKDEKVENSEEVVDNE

SEQ ID NO: 373 - protein, 470 aa, Caldicellulosiruptor kristjanssonii
MQKLKDNEFDKNLKQEVSNFKKRVDGFSKLKQLADTQNIALPRNFSKDDAEQYVTQIIGLLNENKQEFIENDVKTYLATISSIYGQKSFLQRSVTTGLKNRFYNDFEAPIIQRTNKQDKHHTCIFCGLRPAKKDALLDTGLVSFLGANKDNKNFFWNFKPQLPICEICELIYFCIFAGLTEFRIGQTKKFYFVDRNTSVLELYQTNKLFMEMMSREENILKEKGILNFLNDYLLLKLREESKFSLANILFIEIDLTTVAPKLYGFNISKQKAEFITSNYDVFEKITGNYIRINDNTIYPFGGFMQRFLNNTLSFQFLSFLEGQYLSSQKPNSKINTNLSPYRLQMYNILTYKYLKSIKRGGELMDEKWLWKMYFFGQELKKKFLASKAENKITSLAYRLISALRIGDVNTFMNLIIRTYMSYNMEVPALFVSCINDRDNFCALGYSFVNGLLGSEKDEKVENSEEVVDNE

SEQ ID NO: 374 - protein, 547 aa, Thermovibrio ammonificans
MAERIYLQEWFYNAGIVGLLRLLGGETVKGERLLNKEGLPVEGVKIGENYVEVERQLFKDFAKKYYTEAAKREVEFRSVNSLKVGGSEESLKRAKDTINRLLKELFPHLKEEVELPKRVSKKNLGEASRYIRKAAERVEEEKEKLLRGELPLEAIEHLAKRWLKRGFFSSGGSNKLYESLKNLQEKVEAPLITPPEVFTVKKRKLPCLLCQERFAKEGVNLSKAISDLVGFNKDNLNLLHLKGKKLANKGLPICEICQAVISLIPLGVVRFGNSFLFVNNTTSVQELFSDNQRLRRVLSSSSPLFTFFAEKVLAKEEESAKLISLLGTSVVEMELGALPKVKGLNISYELAELLSDPSFTENLRKLTKAHYRLGSGNKKKSFNLLVEFLENLIQGRRNYSYLYKLFRFLLTADRNREINVAFSPLQLHTLNLALFRAKANLEGRMNRVSENELWSLFYGGQELRRVLTSRGAENRVNSLAFKLLNALKVGDSHRFMDIILRVYAGFSLKVPKGLVKNLEDREAFKSAGYSFIAGLLNEKREGGDNED

SEQ ID NO: 375 - protein, 570 aa, Syntrophobotulus glycolicus
MEEEILRLRLGDWQWNGAVIGFIRIVGRENVLFENESIKFSSKLLENFEEKYFAYFIKAYEKTLSWYKIVSFKEWLEAQEDDEFGTFVLKDLNALNEQIKTVKSLIKSNSYKAAYELMALGEDILVWEKELVSIKEPKSEQAFAADKPELIAKVRETFSTLRKIISYCESPEGKRYIRAKNIIYTVIKNAWNGVSFLNPQTKEKDVYLDYKAHFVDGAIAYLKQNKDKFKYHCFICDEPIKDMSLDLSFMNATGFDVARKSSHVWDFQNDIAVCPLCKLIYSCLPAGFTYVYDRGIYININTSVEDAYEVNYKIHHEVLRKEGNLRSIYPVLIGALHEQENAGASYELADIQVVRYEREAYRFNILSRKMLQLIFDSKDRLDSLINTSFAENKLTVRIYDEAISRIFNNQNLFTLIHRMLYDLLSDPSKCRFNGAHITHLLRINQRIYQTLGGMKMGCEDKDNALVREARTAGEQLKRYYYGKNAQHKLPGICYRLLNALKTSNQEMFLDVTLNCYLYVGFPVQRVHTDSLGQEKDFSTVGYAFVAALIDNSKSEDKGSSPVGEMEEEKK

SEQ ID NO: 376 - protein, 485 aa, Archaeoglobus veneficus
MSSSNLVEDHTEEEKQVDGIEFYWTGHPFVDAGLAAILLIAGKNKPEELNEKDIEKAIDFASKLYATKEWSSSYLHGMIFPNSGILMANPSMTKKRSPEAIAENLWSILEEFKVNNRDSPKCVLCGRRPAYTKKEVYLSVFPLLGTGGVPNFFHSANTRGADICAHCIFLTQFMPLASYRLSKPPRVLVIHAYPYELMFELSKEALEDIKKSKLASQARGFRRPENFLFHLVGEITRKIERDEVWENSSVSLYYFICNNQSQILDVIYVPTPVLRFVAYANLVDEKGWKHIVSMGWGRQPSDEEFEKFERSNRNEVYSRLLNNESILPYFINRTSRQTNTVWSLLAFYCSEVLGLDEKVLDFIKDIGDRIVETIGKLPEHKLDDEVRSLERAEKLYQFEAFFIRVEKLRQNLGIERPLMTFDEFARILTAYGEDINISWRTVKNLLLFRIYEKLHDRLMKSVESKKIEEMRVEESEYAIYGGGEE

SEQ ID NO: 377 - protein, 475 aa, Haliscomenobacter hydrossis
MATIDYKQDYLTQRTGDPFADTGAHVIQLMQEKSPEKTILQLIEEATNIYVRNWGGGINAFFLNSKITQPAFLGERKKEESMAYFQRLLSNEEPYEEGYCRILGQKTKLFSTGRDNHILAGSGTFINFHHGYQEGLKVAKEVIIRMFFVPLGAIQLGKNIAVIGSNLEKVEALFVEDIFKANMVEVSHKQAKGVLKSDFTNPANALFEFASKSLNTSKVVIEEDDQVEIHLYHFTNFGASPEVNLYCFSARLFAFYRKAMKINYRSIWQSFVNDFYRNSKNSGAVYNNATNQYELEVKKEKKNFEYQEYRVWFNVIYHKLLRNQSILKNFLYWSSNKYKQQAVFNIWPVVELYQTQLHNMKKTTLDKIRQIADYLIEDEDKIKRRLNRLRLEVSNVYQLKRFLIQTIGDHYQEKQPARPLITLEEFVDDLFPEGTYGLEIKDLLMIALYERLCEKNIPVELEGEDVLEDDRPNFN

SEQ ID NO: 378 - protein, 555 aa, Hydrogenobaculum sp.
MRYSLIGSFQYDLGIYGLKKILDFFEERYATDGNFYIELDKDPEQILELVILRLVYLNEPKYFLDKIIDEFSKNKNKKIKEKFEESNEYIDDKLRKYKEKFDKLIKEQKSLKKILEEEDNLSDFIFNIFQEVLGEKVAYRKEDIKDILYSKSVRLLNNIILNFQADMRAKGEKVLEKARQKLKLSEDADKERICSFCGQKGAFSIARDRFFFAPSHFNAFWEDNPSIYACPYCIVCSFAIFESFTFLNSKNAIVIYKPNLKDLEQLNDIFLKKRLEKNNIAFGDVVENIIEYEKMKLKKDLIPEEIQVIEFNLDSKNPSIEFYILMDKTIENIIAIERQLKNLYENHRDALYGSIKQGDTEYKIDLSKEIIKYISQNQKLIYLVQRYSRLGIMAEIYRQKEDENPPIKGFYINVLLKILEMHFKLEGIGMNYYEVSKEFGQLLRGKVKKKVTKVNDETKQESIDWNTFGNRIIQLSNSFLDASKGNFQQFMETLSRVIISYDVDIDNSLLKVLDKTNYKEIATTIALSLLVRKEKDERVNNSNNSNERVVAETTL

SEQ ID NO: 379 - protein, 460 aa, Desulfotomaculum nigrificans
MCHETVKYTGEPFVDAGVAVMEHHLGKPCEDFKPEDLEKAARWLIKIYERKSLKGYLTIHFPNSGWCNATISKEKKAEYINKVLQAYNFEPISGRECVYCHRPAQFLADRQHIPMLTGASTIITSPGGVPGLPVCGYCLMAIQFYPLATLKCQGKPLFWWTPEPDLTYSLTGEYFREIEKLIDGGSDKLPNLSWPKTILLDTAQKVLASYGDDKPLADCIGLHVTNYGAGPDYHQYRLPKELLEFLKLVRVKDEAVRSAHTHIIETAWVKDKNNKKQAKSQEKETPSRRNKYFEALVEVFEQANWSEKTKEIVHNFYFHKKPETFQYNNFALCKLFLEKVAGMDKQRLETIKRIADQVTNTLIIGNNETKWLNSLFNHEHKFHEFMRYLIRVQKRLAEKGQVLSLDDILIMLDLSNEEDTVSKDFSLVRDLFLIRMLELVGKNRKDMLNELELTSDTETN

SEQ ID NO: 380 - protein, 482 aa, Pyrococcus yayanosii
MWIIGKRFPDPSLHESSKEDNEKVSLFDWTGHPFVDAGLVALLILNKKRSPEELTEEDIRKATEFASKLYARKEWGSGYIHAMMLPNSGILMANPSMSKKRTPEAIAQNLRDLLQEPEDPNAPICEICGRRHSRPKPVYRSDFPLVGTGGVPNYFPSAKDGLNVCSHCLFLVQFLPLVAYKVGGRVLVMHTYPYELMLELHEEAINDVRKSFLASNARDFKRPENFLFRLLGELTRKTERDDLWGKASITLYHFVNNNQGQDLQIIHVPTPVLRFIAHASREDPKGWKRIVAMGWRKRPSEEDFEKYERSYANEVYSRLLAEESILPYFIDMKNRRANAKWSLLSFYCSEVLGLDKEALEFIKDVGDRIVETLEKLPDNQLSRRVRELERAEKLYQFEAFFVNLEKLRQRLGIEKPLMTFDEFATVLTSYGEDLNVSWRTVKHLLLFRIYERLHDKLMKASEEEEEVEENEEVGIFGMGVEG

SEQ ID NO: 381 - protein, 604 aa, Parageobacillus thermoglucosidasius
MKVQLRMGEWMITMGIVGLYRVFEYGLRNEIIDQQYRQSISVRPWGLELDIDVLPQLPKAYFLYLIDEYSVAKRDSEKLRLYMKQAEKEGQFQEALKNIKKTVESTTKEALKYLTHEQLENVLETLKRIKKYEDLNDLIACVNTFETIIYDKKINQKLTIENFKDKILKSFFGQVSFLNNSKKDLDDLDDYIEVFQKDYVTPIFYDLQLEQVLVTASSSEEIIRFLDDNKDYGPFKHLKKAWKLKTIEHIRAYVKERVNKCLLLHNYLAFHNFEEMVFYPIGVANNKALNFNWDLENKQPRPISSLAKFILFFIPAGSAIYFKKEGFDEQSEHRMYAGFVQTDTIFSEILQKNNHFKQMKQSKEPFDRIVSKLVQSISTEAKYVTDHLFFIEISSNYKDRKKTYLHYYHLPSYLANYFQSSYAKKLDYIKPYEYREQFVQHVLRGADPVPVIYKYLRYCIENEISQIGLYIAVRERNRILQLKKGVKDMSSTDKRVYAVFRSGQEIRKALEQATASKAAEQYSASSNKKVNAIAYRLLNAAKAGNQKSFMDTLFRLHMSAEKPISPIFLNALHERDLDFATVANAFIAGLLSSGLQEEQEDVVS

SEQ ID NO: 382 - protein, 562 aa, Listeria monocytogenes; identical to SEQ ID NO: 355

SEQ ID NO: 383 - protein, 583 aa, Lactobacillus ruminis
MGEKIKFSKGSWLENAGIVGIIRILGIDTDDDNGKNELVIDSSDLINFSEKYFKYFVTKYGRCTKYHDIISFRGQIDDWISGNLEKFDEKDKKKLENLLNKIKQFVDSKSYEKVKELINSKFDVENALKKCRNYYREYNKLCKVEDNDNKKSTSILEMMLKEIGNIIDYFDRDDSHKYFPAKIICYKIISMGWNNVAFLNKNSKEKDFIKEYNDYFINPVVEYFNSNHDKDKYLCSTCGRRIKKGKRCSYSYSFINGMGYDVEKKKSNSWNYVNDLLICPICNFMYSAIPAGFNYNYFDGKGIFINYTRNLNELVKRNDAILTKMISDSGEANRNAKSPYAAFVNSFNFKSIESSKYNLANIQVINFDNSKGCKYIFTTVPKLASAVLYDCINKSFGTDDNLISVLENAWIKDYRGIDRYKILDDVVKRIINSANMDSLIYTIELLKATDSNDLNYNDFCISAILNINYLYYKELNKEGGLGCMTIDEKDLKKFRREGIIIRDAYRSKYNENKAKGLAYRLLQNLKANNQQEFLNNILNSYLYLDRIIPSEFISKQGQDIEFNQLGYAFVAGLISDSKDNVEK

SEQ ID NO: 384 - protein, 562 aa, Listeria monocytogenes
MRTEIEVRANDWLINAGLTGFLNIVGKENVRIDGQAIYFTADLLEDFETKYFNFFIQEYKETLSWYKIVSYKETMEQFRIDEFASFDEVALGNLNKYMKDVVKFYLKKANYIKVFPLIDPSANVTKWLEKLNTINLTKKQKWDEVKADIIEEVKQTYTQLDLIIDFCASEKGLQYLGAKNLIYSVINKGWSGVSFLLKQTKFIDPYLDYKTSFLDPVIDYLDTDLSKAKYNCFNCNQPIKNLKLDLSFMNDVGFDTARKTAHVWDFNNDVATCPICRLIYSCVPAGFTYVYGEGMFVNDSYGVEELHRVNERMRNSILRFNKDGINSTNTYRALVESITMEHENNRRYELADIQLVRYENEHYRFNLLSKKMLHIVNDSKGILKSLIRCGYKEGNLNVNLYKEVIQHLMNNENLFTLIHKLIYYKQTSVNGLYYNMGHVSGILDINTKFLKEMEVMTNISQNQLWFVQNCGKEFKEGYVKKKSENKISGITYKLLNSLKVNDKDGFMDTLLNSYSYLSMPIPDVFIKMFSNNEAFKSVGYAFMLGVGGEKTKKEDGGNTDEK

SEQ ID NO: 385 - protein, 562 aa, Listeria monocytogenes
MQTEIEVRADDWLINTGLTGFLNIVGKENVRIDGQSIYFTADLLEDFETKYFNFFIQEYKETLSWYKIVSYKETMEQFRIDEFASFDEVALGNLNKYMKDVVKFYLKKANYIKVFPLIDPSANVTKWLEKLNTINLTKKQKWDEVKADIIEEVKQTYTQLDLIIDFCASEKGLQYLGAKNLIYSVINKGWSGVSFLFKQTKFIDPYLDYKTTFVDPVLEYLDTDLSKAKYNCFNCNQPIKNLKLDLSFMNDVGFDTARKTAHVWDFNNDVATCPICRLIYSCVPAGFTYVYGEGMFVNDSYGVEELHRVNERMRNSILRFNKDGINSTNTYRALVESITMEHENNRRYELADIQLVRYENEHYRFNLLSKKMLHIVNDSKGILKSLIRCGYKEGNLNVNLYKEVIQHLMNNENLFTLIHKLIYYKQTSVNGLYYNMGHVSGILDINTKFLKEMEVMTNISQNQLWFVQNCGKEFKEGYVKKKSENKISGITYKLLNSLKVNDKDGFMDTLLNSYSYLSMPIPDVFIKMFSNNEAFKSVGYAFMLGVGGEKTKKEDGGNTDEK

SEQ ID NO: 386 - protein, 529 aa, Hungateiclostridium clariflavum
MSFIKIQLSDWLYNAGVIGLVNILKHANDQVDINGQEVTIKTNVLANFEAKYYKYFVDTYGKTMTFTKLINRIDKLLNIELDESKEKEIGDDIDFIKSKVSNNSAYKGIKDKIDLKKLEKPSKKVTSINKEILEELKYLLLENKKEILKSECIGYYDQKSKTSKAPNAIIDKYINTNMLDVGLGVNEVKEYLSNEEKLNFSCFQCGRGIQKIDKGLSFLNRMFFDTARKTSHVWNFVSDIDICPICKIVYYCVPAGFTTVFGNGIFVNYNQSVERAEKINLNIRHEILHSDESKRIYNAFGTMIRSLHEKINDSKKYDLADIQIVRCEDDKYKFNLLSKNVLYALYDSRDELNSLLNTGFQEVNTYFRIYDEVMKNLLNNVNLFILIHKVLVIKISSPKDAKYNESHIRNLIKINFKYMKGVGYMESTEKDIVKISSSAGYYLREAYKSKNSENKLNGICYRLLNALKTSNKSMFMDTILNCYLYTNKPVPTFITECLKDDNVFKTIGYAFVTGLIDGNKNENTDGGDN

SEQ ID NO: 387 - protein, 483 aa, Acetobacterium woodii
MVEEFVIDEKSYFKLSATEWRYSAAALGLMRYFDFLEIPWIEKAFDVLSLPEIAKELQKSIVCVYERSTGFEYLCFAKEYLSEEDYLRFVREIYPNDLYPFLIEEQLKKSVFEEAEIKEINTWLTGNTVMKKIFGKTKFTGENKDEILTIIKANKDLSTKESFRYKKNLYANYANTHQLLNEGGDSCRLSGYSIDMGKKGRSTAYNFNVKTSTNMDTILFDWIPFAFIGDREAFFINANYDLKQLKKINTFLRTQVKKDRDDDKNKNQNVRYSLFNSMIFSSQFINFDVEVIYKNRERDFFETLYIRHESMEILKSMDKINYKAFCFSLKINDNYYIDIQEKITNCILNLVLTDELIELFLKQKNSNGYLVSQCIEINWLIRKGGEVMKKKMSGAYACAKEVVKKIPENKIESYRQRLTSAIVFKDYDRVCQILLQLSNYSNVSFNFAYDLFEDFENNKDIAYTFINALRKGNDNTSNNEGGN

SEQ ID NO: 388 - protein, 428 aa, Thermococcus cleftensis
MEDIEKAIDFASKLYARKEWSSGYIHAMMLPNSGILMANPSMARKRTPEAIAKNLKALLNEQEDESAPICEICGRRHSRPRPVYRSDFPLVGTGGVPNYFPSAKDGANVCSHCLFLVQFLPLVAYKVGGRVLVMHTYPHELMLELHGEAINDVRKSFLASNARDFKRPENFLFHLLGELTRKTERDDLWGRASITLYHFVNNNQGQDLQIIHVPTPVLRFVAHAARYDRAGWRRIVSMGWRKRPSEEEFEKYERSYANEVYARLLAEESILPYFIDIKNRRANAKWSLLAFYCSEVLGLDKEALEFIKDVGDRIVETLEKLPDNQLSKRVRELERAERLYQFEAFFVNLEKLRQRLGIEKPLMTFDEFATVLTSYGEDLNVSWRTVKHLLLFRVYERLHDRLMKASEEAGEEVEENEEVEIFGMGVEE

SEQ ID NO: 389 - protein, 560 aa, Clostridium acidi-urici
MGSTIKLSMNDWLFNAGLVGIYNILKESNFDVKISGQDIEFDYSYLENFEESYFYYFINKYEKSLSWYKIVSYEERIEYHEESNFENFNEKSLEDLNNYIKNVAKYYIKSASYKSTYGLFNNEIDILALEKELSTITLRKKESIEDKIVEVKDRFEKLKVIINFCKSEKGKKYLASKNVIYNIIKNSWNGISFLNPQTKEKDVYIDYKNYFVVPTKEYLDADKSKYKYDCFICDSKIKDLKDDLSFLNMIGFDVNRKSSHVWNFVNDIAICSLCKLIYSCVPAGITYVYDKGIYINDNSSMKNAIDINQKIKSEVLKTDDNTRTLTYKALVTSIQEQSNDKIKYELADIQLIRYEDSKYKFNILSKKSLKVMRDSRDNLDSLIKCGFKEINTYFNIYELVIDSLLNSQNLFTLIHRLFMQKLSSPKDSYFNTFHLISMLKINIRFLKGVGYMKDIDKDAIVREGNASGYYLRKKYDSKGSVDKLNGISYRLLNALKTNNVDSFMDTLLNCYLYAKISVPPIMVDSLKSEEEFKTIGYAFVAGLIEGKDEIKENGGKSDEN

SEQ ID NO: 390 - protein, 607 aa, Clostridium saccharoperbutylacetonicum
MKIYNSEQWFYKLGIVGFNRIINYNKDYYGLDVDKYNYNVSSDFIEFDSELLEDFPTYYYNYFINEYNVSESMNEKLNKLLGAAKDKDKFQERLNDIKKVIGERNKKIEKLQVAEFDKCKDIHSKIGKVKFEQLAEVEELVKKYEDIVQLEHLNHPMTVINFKSILYNSFFGQISFLNLTHNNKSIDYQKEMFFKDYIKPVLDGEKFSKIIKANDEVELKKYIEIKKEDAAKCPKNELNNIDRVVSIINTALFGKKRKAESVNDVLENYNICRICDDNISFGDDYTDGNFIPLAISNANSKNLFWMFDSRYPICPLCKLVLFCTAAGCTKIFKSYLNDKYDYNDKLYYGFVSIEGDLLELIQGNDNFRNVTKKDGTFEEFILDSVKQNRKISSWQLENILYVEFNADYRSRNSKLNYFNIPTYLARFLRDKDTYTELDNMKNSREKMKIFDLMIQRKDLKHVIDLELRALVNEEAYANRDILRTIRIRNYLKQYKGGCKKVDELAKKNLNYLYFQGVDISKIYRSNNSENKITGLSYRLLNSAKAENKKDFMDTIIRIYMSVDKEIPMIFLEVMKESKLDFEEIAHSFIAGLNSKGKENDDRVEGEN

SEQ ID NO: 391 - protein, 555 aa, Hydrogenobaculum sp.; identical to SEQ ID NO: 378

SEQ ID NO: 392 - protein, 740 aa, Hydrogenobaculum sp.
MDCLRFKLYTPTGIFKNPLSIKGVEVYPLPPYSTIIGLIYKAMGKKWNKEHFQISIQGDYETIYRDYVWFKKYNLRDKKLDKLPLQVPILYNLTLLIHIMTENEFLDQIEKALKEPKEVLFLSGGEYPVKVEEVKRVACEKKRISEEDYIKLAYNAYVPKQHLENINTTDKGILFNLSYFYKNSNKYATVHKPKTYHWIDAYYFQKGTYIYGSLMFDGDENPVFLTDLDSDILVEKEQRRQEVCHGSQVCHGSDANEYIRFYSENWLMASACVGVLKVLKKQGERIEDFVEEKTLKIPKDLWEKLPETYADYLLNDSEQLEHALISSYEKEKKKERFNPYNVIILRSFGDFHSNSPFTNPSLSYITKLRGLSISDINNVKSKIKESFIEGYQYFLTKVIETSQVCFFCHERQAKNIVDATNFTPLFSSLDTVKNFIWDPIPICKECEFLLYFASAGFYKSGGKYLFIYIPDNLLETYRLNLVLSTEEEVEQDKLGKIWSVVKHVLGLETQKSSWILQNIYFVEIEMVGNATANIYSFNISPTLAKAIRNLIGKYPKNLQAVFSDFLFYVYTGKSLYEFLLLLISGFIKKESYKNLEIRTIESRIIQTGKKLDYLSKNLLFFIEFQEVLNMSEQKNYIDWAFWEGKKLKGFYTKDPNKEKKLEPLIYRLLEAIRRKDKGYFIHNLIRAYLEVEREIPYVIKESLDDKNFNMIAYAFLIGLNSEEKTEEAQVKNEENITESA

SEQ ID NO: 393 - protein, 564 aa, Thermoclostridium stercorarium
MSSGYITITLKDFLFNAGVVGFIKVLRQEGFNLEDQDIGNTIHVPVSLLENFHENYIKALLNTFQNETLYQSLINQFEHFAGIKPEDIPKEEYKSFIEKLCNKLTSASYKSGYQIIAEKGDDFDVLSRVKMLKTEKDIQKSVSICYELIQYMKKHRETLCMKDIIYTKIIMFWRNVAFFERSNIRKDIKECYYNYFVKPALEYLNRKNKGALQCIQCGNPINASLGMGMSWLNDVGIDMERKRSHFWNFNPDTYICPVCALVYSCVPLGFTVVGGEAIFINNNESIHTLVAEKDIFERGGEKYTTLNQLYYKVLYSFIDDAAQEQTREIQNIQIIRRVSVDTDTGKYVFNTLSKPLLEILKACKSNFKNLINWTFKKDKDTYVNVYQEVANNFFSGRNQYALVHAILQKVFTENLRAPYVRDILQIQRRRMRKFYSEEGGSEAMYISRKEFDAAYNEGLRIRREYANTVTNVKGDNDKNMKINESLRSFVYPLLLALKTKDKAKFNDTMFRFYVGRNESIPKILIEMQQSDEKFQMLGYTFIAGLQGESLNSENAENIVNEEGE

SEQ ID NO: 394 - protein, 569 aa, Thermoclostridium stercorarium
MPQITLRLNNFLYNASIYGFIQVLKTMENDFLDVNYTIKGNTLTFSSDVFENFTEYYLKTLINKFEKDTNYYMIIDKYHALISHDFTEDSSQYKEFLNFLSSKLKKFKGYEIIKKRNEKTDILNTLDLLKRKDIDFDTKKIYLKEIVECLEKHKDIFLLKDIVNTKVKLFWDNIAFLNNNNKNKEMSDCYKNTFIDPVIQYLNKKQRKSANQCIECGRNVSSQKEGSMRWLNDVGVDIKRKISNYWNFNPDIVVCPICKTVYSCAPLGFYIVGNNALFINSNTSIEAIIRMNNLNFKMNTLVDIENAVYYSIARAFNYLSNVESAKKQANSNIQVVKRVAYKNGTTYQFNIIVPSVLTVLSEREKEFRQLLNKYYMFSQKANKKEPRKIINIYDKTIENILNNRDLYMLLYDILKDALDSSQKVDFLYAVLKVQISNLMKGVTGMERTERINKLEKTTFFLRKCGLEIKGTFADNNEIQESGKLKSYIYKLLTALRINNVSLFMDTAIRIFNDTKKEIPITFINMLNDQNQFKILGYAFVLGLLGQDDVSDKNEFNNKNLTEKGEDENE

SEQ ID NO: 395 - protein, 562 aa, Listeria monocytogenes; identical to SEQ ID NO: 385

SEQ ID NO: 396 - protein, 562 aa, Listeria monocytogenes
MRTEIEVRANDWLINAGLIGFLNIVGKENVRIDGQSIYFTADLLEDFETKYFNFFIQEFKETLSWYKIVSYKETMEQFRIDEFASFDEVALGNLNKYMKDVVKFYLKKVNYIKVFPLIDPSANVTKWLENLNTINLTKKQRWDEVKADIIEEVKQTYTQLDLIIDFCASEKGLQYLGAKNLIYSVINKGWSGVSFLFKQTKFIDPYLDYKTTFVDSVLDYLDTDLSKAKYNCFNCNQPIKNLKLDLSFMNDVGFDTARKTSHVWDFNNDVATCPICRLIYSCVPAGFTYVYGEGMFVNDSYGVEELHRVNERMRNSILSFNQDGINSTNTYRALVESITMEHENNRRYELADIQLVRYENEHYRFNLLSKKMLHIVNDSKGILKGLIRCGYKEGNLNVNLYKEVLQHLMNNENLFTLIHKLIYYKQTSVNGLYYNMGHVSGILDINTKFLKEMEVMTNISQNQLWFVQNCGKEFKEGYVKKKSENKISGITYKLLNSLKVNDKDGFMDTLLNSYSYLAMPIPDVFIKMFSDNEAFKSVGYAFMLGVGGEKTKKEDGGNTDEK

SEQ ID NO: 397 - protein, 562 aa, Listeria monocytogenes; identical to SEQ ID NO: 396

SEQ ID NO: 398 - protein, 397 aa, Ruminococcus sp.
MKSIIYTYINRFWNGKCFLLRPNAKKDMREVFEKDFSEPFRKYLSADHKKAKDLCIDCGDPIGPKEKVSIAFMNEVGDDFTRKRSAFWNCKVDAFLCPGCAFIYALSPLGFRLYANKFVFVNINDSISTLLYANHKKGRIDEEGEKTENKKYSQWFAETINILLKEKQKELSNVQVILRGVSADDRYVLSIIHRRIIEIIREPRISDALTALAKAPVTKVRDNFVNIHETVVMNLLQHREQYQLLNCLFKENIKEESKNFYIFWVYEVQLWTELVVAYSSDRDKRREISMSCGAMKKSGADLRKAIMAAKGMTSSEGLRGIEYQLLNALAVRNVNKFMDVVMRLYSAYGSKRNEDGHELLIPTGFVQMLNDKQKFTEYGYAFVMGLVGSYEPKKEEA

SEQ ID NO: 399 - protein, 562 aa, Listeria monocytogenes; identical to SEQ ID NO: 396

SEQ ID NO: 400 - protein, 562 aa, Listeria monocytogenes; identical to SEQ ID NO: 396

SEQ ID NO: 401 - protein, 481 aa, Clostridium sp.
MKVRLQSQTYNTLLLPIEWRYAASVVGLIRYFEYVEETEGMKLYEITKKRDRDQYVIYSEIGGYVQGLLYNEEDITEERYLRFVEHYYGENLQHVVIERKLSDPNREYTEDEISEINSYISGTNSNTILKKIFGKTKFTGNNAEEILHQIDENRFEIIRETYRNKTSMYRKYANIKKLLTPENPHCRLLGYDLDENRKSKSAAYQFDTNTFVANDEPEFDFIPFAFTYSPEAVFINNNNTITDLLKTNDAAREIFEQKQEIVENKVKRDGMQTKLIKTLIYAEDFMQHDTEVIVRKQESECFETLFVRREALQRLRNVYDKYNLKFTYNYGYNYELNVEESVIDCCINDVYLDGILNQLLVLSREKSYAVVIIWNLVRINVEWKGVEGMTEQVERARKAGYVIGRQIKDANGENKAKSYKNKLINAIVSHDRDRVLEIMLQLSGYIGGEIGTIYDILDSGEEWSDIAISFTNSLVEKRDDK

SEQ ID NO: 402 - protein, 559 aa, Blautia sp.
MEKYAITPGDFLKNAGIVGLKYILDCAKAQEGVDFGISEDGQEMWLNYEFIQNADWTSLYFRACVQNFGRFTVYQGVMEKIKCCIGKIQNEKWNPGKTEKDDLKFINDKLLSNSYQAGFENIKDQIEHPEVYITLKKEKLIDKMTAEELLERLSKLQVFLEQEKCKETFIMKSVVYNYINRFWDGKSFLLRSNAKKDMREQFEKDFSEPFRKYFMTDHTKAKDLCIDCGEPVTTKEKVSIAFMKEVGDDFTRKRSAFWNCNVDAFLCPVCTFLYAASPLGFRLFANKFVFVNNNSDMFTLLAANSKNRKSSLEGEKEENQRYSQWFAETLNIILNEKRQELSNIQVILRGTGDKDRYKLSIINKDILNILKREDVEKALKNLGQYPFTKIRNDFVNVHEQAVMNLLGHQNQYILLDSLLREAIAGNAASNFHIHWVYEIQKGTEISYKKEEEKEVLMYCISMKKSGSELRKAIMTAKKDTTGDSLRGIEYQLLNALSVKNTEKFMDIVARLYSSYGSEKLLIPNGMIRMLQDKEKFSEYGYAFVLGLIGCYEGKKEVEQ

SEQ ID NO: 403 - protein, 464 aa, Eubacterium sp.
MKTKIDYFDYDTLLQPTDWRFAAAVVGLCKYFDYFGIDYKVLCDVEEKPDNYIHGFDGIIYKSEDITEEKYLEFAENYFEKYMTHKNILNILESQEFSEEQIKLVNDLVKSKTVLKGLFDKIKFDGTNKDIFICSIEENRAEIIKNIFKNGNNLYKNYCNERLIFTEDNSTCRLRGYNVDKDRKTSNLGFCFSKESFESNDILEFDFIPFAFSNSDMRETYFVNNNFSVKSLTQTNYAFSNQLSSTENKDDKNKLMLVLQNSKDYISYDVEIISKSQDKAYYETFFVRLERLKKLRELSGKSLNFVKKINDDYWFNLEKEVYMRCLNNVLLDDVILMMLKFYFDDNAGKGYIKSRTDMLIDINVSWKGNEIMDEIKSAKSCGFLTSKKLIEMKSSNKINSYKQKIISALCAHDYDRAKEIILSLSAYVGMEFSFFYTFLENAEENKDLAFAFASALIEVSSKNN

SEQ ID NO: 404 - protein, 480 aa, Eubacterium sp.
MYEKNGVEYSTRTECIDWRYSAAILGLVKFYEYAQIKGFDLKFDYDEDYIYYNIEDITEELFLGFAENSFKKDMHHVFVENAIRDKNEFTEDEIKIINERLLGNTTLKKYFSKNKFNGENKSEILDLINANRQEIIRETFRNKTNLYRNYNNTNSLFSEKKENCRVLGYCIDMPKKGKSVGYNFNTSTFVAEDDVVFDFIPFGFVMGSDAVFINNNSSIKNLETTNNVLAMELDKKEKENDNNRALSAKNVLFNMIVESSDYIDYDVEVITKKRENDYFETLYIRKESIEVFQCIKKKIQDYSYFARKYKVNDNYYIDIQDKVIDAVLNMTNVTDIIQILLKDDNASDSLKYSFLIDKLIKVNVMITGGVDMYEEKEKCINSAKYCAFHITKNSLMSGNNSNKLKSYRTKLTSALVFKDYKRYCDILMQMANYLNMELDFAYNLFVDFEENEDIAYAFVNGLAAGKDEKNKETEGKNEEE

SEQ ID NO: 405 - protein, 482 aa, Clostridium sp.
MKSKIDFDGYNTLLQPTEWRYAAATTGLVEYFKFNHISYGVLSELEKKPKESVFGFDGILYNQEDITEERYLDFAEDYFKDDMTHIRILQMLENDEFTEEQIKAVNDMVKSKTVLKKLFGKTKFDGTNKQTVADIINNNRHEIIKSVFRYGKNLYSNYANSNLLLTASNPHCRLAGYTLDEGRKTRFLGFCFAKESYETNDIPEFDFIPFAFSNSDMYETFFVNNNFSVKDLVQTNKRVSEALNSVDKRDSRLKLLTVLQQAKDYINYNIEIIMKSRDNDYYSTLYVRVDRLKQLRNLSDKSLNFVYQISDNYWLNVEKEVYWRCLNNVFLDDVILRMLKIYFDKDVNKIVVKLCTDTLIDINEAWKGNEVMDEIMNARCCGKKVSKKLIEDNKKNKIKSYKHRIINALIANDYDSIKNLISRLSEETSLEFWFFYKLLDSNGENNAEKYKDIIYAFTNAITVNVADKDDSKIEENDSKKEN

SEQ ID NO: 406 - protein, 97 aa, Firmicutes bacterium
MEAGNKRAYGCAKAVAKKKDKVPDNKLISFRQKLTSALTFEDYDRFCDILLNLSNYADEPFDFAYDLFEDFEKNKELAYTFVTALRRDNKNVEEAKS

SEQ ID NO: 407 - protein, 566 aa, Firmicutes bacterium
MERYVITMGDFLKNAGIVGMEYLLETAGARRDVDYGITEDAQGLWLDREFAENVENANWTDMAFKAFVKCFRTSTVYQGVMDRIGRCLDKITEGEWSPEKAEKEDLKFINDKLLSNSYQAGFENIKDKIKAPDVYLKLKKEKLSDKLPVEELQKRLSELQEFLKQPKCEETFIMKSVVYTYINRFWDGKCFLLRANAKKDMWELFEKDFSEPFRSYLKADHKKAKDLCIDCGEPMNTKEKVSIAFMNEIGDDFTRKRSAFWNCKADAFLCPACAFVYALSPLGFRLFANKFVFVNINNNINALIDANSKSRKSSMDGEKKENERYSAWFAESINILLKEKLQGFSNIQVILRGIKAEDKYFLSIVNKRMLKIISRPSVATALQWLAKSPNAKVKNEFLNVHEAVIANLFQQRNQYQLLNRLLRESIENESFSFYVNCIYEIQLWYGMVDKDEKRKEIIMNCGIMKKSGADLRKVIMQAKGTSSGDCLRGTVYQLLNALYVNNVWRFLDIVLRLYNSYGSRKNENGPELLIPTGMVEVLEDKGKFRDYGYAFIIGLDGCYEGKKEEN

SEQ ID NO: 408 - protein, 459 aa, Roseburia sp.
MYDVRIECYDWRYSAAILGLVRFFDYWKIKETNVPAEYDNSADTIEFDSRYITREKYLDFVEYYVNEILHDEMYHTKVETFLRGQESFTDEQIKRINELLKANSIMKEVYGKIKFDGNNRDEILSLLQERHYDIVEKTFQNKKNLYANYCNSKLMGEDTQPHCRLLGYSVDEGRKSKSYAYAFQDVTGVFRDSKYFDFIPFAFTNTMDAIFINNNYNIENLRKSNDYINDQITIYRQKKENEQKPLNVRSLLYQAIIQSVDFIDYDIEIIIKGRDKEYFETLYIRKDKIDIVREIKDISKLMYSYKINDKYYINVGEELIQSVINGLDLSWLIELALKKELDNSNNYAINRLIEINMKIKGVDDMEKKLSSACACAWQVTRKLKQKGQDNKIKSYKVKLASAMTANDKKRVYDILLQLSIYTEESFGFLYSLLDDYDKNQEIVYAFINALGAEPKKKEA

SEQ ID NO: 409 - protein, 447 aa, Clostridium tetani
MKTSIQNEKYDTMLEPSDWRFSAAIVGLLQYLNYHYLDYKMEEDYILYNSSGINEERYLDFVEYKYGDELHHRLVENILSNEEITEEQLKLINEKLVANTIMKKTFGKIKFDNTNKKEILDIINKNRYELIRETFRSKSDMYANYANTNQLFNDSQDYCRLVGYCIDTGKKGKSTGFNFTMNTFVGSDILEFDFIPFAFEGSREAFFINDNYTIQRLKMSNEILSKKIESDLEGESKRKDARQALFKAIMEASDFIKRDVEVILKDISEDYFETLYIRKESIDIFKELINEKIEYKSFCFSHKITDKYYINIQKRVTESILNNVLLDELIEIFLKEKNRSYLVLQLIKINVLIRRDKTMKDRLKGAFACAKQVSKAIESNKLDSYKQKLTSSIIFKDYDRVCQILLQLSNYSGIEFGFVYDLYDDFEENKDLAYTFINALSKKSENN

SEQ ID NO: 410 - protein, 585 aa, Lactobacillus helveticus
MGETSTVTIDFRINSWLENAGIVGLTRILKANPRYRGSYKEKENTLEVDPKVFDNFSDLYFNFFIKNYGQATRYWRIVSEENFLKSLKENGFKDFDNKKLKELTDWFDNVLKYSVNSASYKKVIKFINSDYDIKAEVKDCNKKIRTLNKKNFLTESPEEAKEILQELINQLLKAIEYFSTDQARKYFPAKTLSYTVINKAWNGVSFLNPQAKNLDFYDDYQNYFVAPVQKYLQEDHSKDKYICSTCGRPIKRLEYSYGFLNDMGYDLNRKTSNAWNFKNDLYICPVCQFLYSLVPAGFTYNMASQGIFINENSSIRNLQGKNDATFNSMMRDIRSNTQTSPYRAFSAAFRDAEASGQNAALANIQLITYNNDHYNFQIIPIVASKVLIKAVEKKYTVKQTGEVKSYLANLYNAGISNFRGAGYYSILDNVLNCLFNNTNLFSIIQELELLKVGNTAGCYYNTFQIMTVIRMNGWFLNELHKYRRSENPMKVEEDKLTKARGCGMHVRMGYDNENKAKTLAYKMLEAIRANSTDRFMELLLNAYLYLDKTVPKIFIETQSNTEVFKEYAFAFIAGLIGSSNAEQDK

SEQ ID NO: 411 - protein, 487 aa, Microscilla marina
MGFQSDLVSFLTLTKMKKTIENIAYKWLTKPTGDPFVDVGGVVMDYFARLHPGKDVLGLIESMTDIYVNNWSGKLNAFFLNSTITQPAFKGQKKIDETLKYFKELIQDKRAFQEGYCRITGRKTKLFYAGRDNHILSGSGTFINFHSAFESGLTLSKEVLIRIFFVPFGLLQVSDKIALIQSNDLEVSKYFVLKNCQENIQGIATGASEGVLKSSLKNPASALFGFIDDCVSDLKTVVDDRSKLKDIAFNIYHFTNFGASPEVQLYHLHSTAFRFYLTCLNPRYRDDWQGFVSAHYHNSKFKNIKFNRTSAVWEDKTKVAKYGEYKNWSNSIYNKLLLNQPILAEILNWSKKYPFNFKIVEIYQTHIRNMDKHTLNKIKELADFVIRQKEEDKIKRTITRLRGCKSTHEVRQVLLKWVGQHYQNGEQTPLITLEEYTQYLFPEGINWREIRDLLLIGIYQKLHEHQMQIALESSEGDKEEETETINQ

SEQ ID NO: 412 - protein, 514 aa, Fusobacterium nucleatum
MKYDIDKNEYGFDTAISASDWKYSAAITGLIYYFKKLEKKYEIKKITIHEITDSYLVYNKEDVNEESYLNFIERFYSEEALVHKKLENQLKHTKEFTPEIIKSIKENMSANTVLKKVFSKTKFDGTNKEEVLKLLDENRHSIIKETFRNKKDLYDNYCQTSRLLEKGDNSPCRLKGYYFDPNRKSKATGYNFASSSVDYFDDEIFDFIPFAFTGSPFETIFLNDNLDLEILENMNYKLREYFSEEKEEEIEKIKNFKQEKAIKEKKNEETEGNQNSVPLKKLFLNILQKKVDYIKYGMEIIYKNRDKEYFETWYLRNESIKVLKEIKDFSKLDIRIKITDKYYFNVLNEVFSSILNLSSLTNSILYLLKDRESFIRIDATRENLSKLFKYNYAINELIKVNQIIRNGGKEMDENLKKSIKACSIAVVKKFIKENSLNKLASYRQKLLSSVVAKNHKRILDVLTQLSVYSGVYFSFAFDYIENQTQNEDIIHYFILELDQSRLESKKNKENEDKE

SEQ ID NO: 413 - protein, 553 aa, Clostridium sp.
MGDFLKNAGIVGMHYILDEIAAASEDLDYGYTEDNQQLWLDTDFCQETDWTDLYFRGITTYYRSHSVYQTILDKIKNLLAVLDLPEWDGKKWKDDIKFINDKLLSNSYKSGIASIKDEVDTTEAYEMLKAVKLKESMEPELLRDRLVQLHEFLIQPICAETLIMKSAIYNYINRFWDGKCFLLRANAAKNMREVFENDFSEPFRTYIAIDQKKAKEICIDCSAMIDSKTKVSLAFMKDQADDLARKQSAFWNCKVDAFLCPVCAFVYALSPLGFYLMGNRFLFINTDQNIQELLEVNRKDGIMQDVEREDGERYTSWISRTLNLLLKMKTEELGNIQIITRGRDESERYTFDIINKNILAILNDEKVRAGLDVLSKYPYIKKGTEYINIHETVILNILRYRNQYPLLNILLRQSMDVKTYLVDAYWVYDIQIRVSLLKKDNEDKNKIGGAIVNRYKVRECGYELRNKLLAAKGTSDDSRIRGTVYRLLNAVAVGDVSHFMEIIMRIYCSVNLTVPDAFIECLDNREKFREYGYAFLMGLEGSHYEKKEEKVND

SEQ ID NO: 414 - protein, 462 aa, Anaerostipes caccae
MKELREQLEPLDWRYSAAIVGLEKYLTWLGDEASDWELKEDKLEYDGSYIQKSKFAKFVEYSFPDDMHHLQIEELLQTPDLSDDQISLVNSKMKGNTILKKVFKKLAFDGENAVEVLSLIEENREMITLETFRNKTNLYRNYCNTFQLFEDGKECCRLLGYYIDMPKKGKSISYNFNKANFHGTDMQVFDFIPFAFHGKREMMFINDNIELSCLVETNGRWAESVQQEKKVSEKEGKKLNTRQMFFKLLLESDTFITGDVEVIVKNPDQTFFETLYIRRDSLKILKSLEKSYKYLCFSIKEAENYWVDIQKEVTESILNFTLLDHLINYLLKKPDVNNYGYVINQLIKINIKIKGADKMDGAMKSAFKSAKTVVDKRENGSYKVPDNKLSSYNKKLTSAITFEDYDRFCKILLNLANYADESFSFAYDLFEDFEKNKEVAYTFVNALRRENTETVKEDKGGN

SEQ ID NO: 415 - protein, 566 aa, Clostridium botulinum
MSKIQIELSDWLYNAGVVGLINILKHSEKKVKILNKQCIEIDSEQLVDFQNNYFKYFIDKYVKFTSWYKITSFQGYIESLDTENITKEDIKKVNDYIEYTKNKLKSNSYKSAYLLANDNSLDILNEEKSLKKINITKKQTLQDEEVKENIKNTINTINKVIEYLCKETVKKYVLTKNIIYDVIANFWGGVSFLHTSKNNSDMYKEYKDYFVDNTLNYVELDKSKDKYNCFTCNNTLSKLSKPIAYELAWINKTGVDMSRKSSHFWNMKGDSYICPICNLIYSCIPAGFTVFKGKGLFINKNIGVKTLTKINNQSLDNVTSIEELEQYSYFNIADNMEQGSISQSNKEIDNIQIVKLDSQNESRPYTFNIISKKKLEIINKNKERLKSMIKIHIKISKDEYLNLYNEVLNRIYKGHNLFDLMYKLIYLNLNDSFKRIGYVDMILKINNDLIGGGKMSTTKIDDKLINNCRSYGYYLRKAYIEKGGKNKLGGISYRLLNALKTKNVSRFMDTVFNAYMYLKDKEIPSTFIEALKDKENFQTIGYAFLLGLQGGDGKADKENKEDVVNE

SEQ ID NO: 416 - protein, 445 aa, Clostridium perfringens
MEEKVFDCTLETGDWRYSAAIVGLIKYFDFLYQNGVADKSELYEFEDDYLRYNSNYISEENYLLFVEKYFKDAMHHKVVENILLKDELSEDEIVLINDKLKANQAMKSIFGKIKYTGENKEEILDLIEKNRLKLIKETYRRGKSLYSNFANENLLFSDNNKVCRLVNYCADMGKKGKSLGYYWDNNTFEFKDEKIFDFIPFAFSKSYDTFFINNNVSIKELKKSNSFIENSENTRTTLFGNMKESAEYIGFDVEVILKSRDKNYYETVYVREKAINIFKQSDDFDYKGIKFWYRDDEKNPKYMEPEIVNRILNGIRMDSIIELLFKSKNNHSYNIKTLITINNLIYEGGSEMTKKMKSAYASAKRVSEKLEENKLNSYKQKLISAVTFKNKDRFCEILLQLSSFSGVVFDFAYDLFDDFENNKNLAYTFINALNKEGNKENGGDK

SEQ ID NO: 417 - protein, 565 aa, Clostridium sporogenes
MKKIANIKLELSDWLYNAGVVGICKIFETNDDYYEKHSNYIVFDEKLLEDFEEKYFNYFINKYEKFTSWYKIVSIEDKLINFSEDTVDEKYIEKFNKQIEYVKTKLKSASYKSGYEVIENKEIDLLKEEQKLKKIKKTKKQSIQDVIPMIEEQNKFLQEIIEFLKKEEVKRIIIAKNVIYDVIAKFWSDVSFLYKKSNKKDMYNEYKKYFIDDCIDYIHQNKEKFKYTCFSCNNKISKLSKPASYDLAWINKIGVDMSPTRKMSHFWNFNGDTFICPICNIIYSCIPAGFTILKDKGIFINENSDIDTLVKVNNTAIDNNTSFQELEEKSYFTIGDNMKQSEFERTNKEIDNIQIVKLDSNNERRPYSFNIISKNKLRIIYNNRGNLKLLISKNAKIGDGSYINLYSEVIKRLYDNKNLFDLISQLFYLKLGDKFKGLSYLKNIIKINNSFLGGIMGKKIYYKKIDEIHKLGFCLRKEYEIKKADNKINGITYRLLNALKTKNSNKFMDTLLNAYMYIRKPIPTEFIEGLKDEAKLQTIGYAFLLGLQGDTSKLESNEEGAVNNE

SEQ ID NO: 418 - protein, 463 aa, Anaerobutyricum hallii
MVTRLENDIFDIMVEPSDWRYSAAIVGLSRYFEDRDKMEDEDYEVDEDCIKFCSDSITKEEFLLFAESYYGEEFPHVQVEEILSRKEFSKEMIDLVNKLLKENSIMKKVFSKKKFDGSNQEELLEMIDENRLVLIRETFRNKKSMYANFANESQLFQEKSDVCCRLQGYYVDPGRKSRGAAFAFNNNINVVEDSILLDFVPFGFFGEYESFFVNDSYSVKELIHTNDLLAEKMEEERTEEGKKIRDARKILFRAMQESADFINYDVEVILKERPTQDKPNDFFQTLFIREHSIQVLRDFKKHYKSFCFKRKMRENYDLDIQKEVIDCILNLKRADELILFFLREESAYLVDALIKLNQYIEGSEAAMEKGQRSAFACAKELIRKLPENKRRTYRQRLTSTLILKDYTGYLNILVQLANYADMIFDFAFDLFEDFEKNMDIAYAFVNALGKAPDKKALGSEKAK

SEQ ID NO: 419 - protein, 591 aa, Anaerobutyricum hallii
MDRVIITLGDFLKNAGIVGMKYLLDISEAEEDSDYGITSDEQGIWLDRDFALHADWTDLYFNACVKYFGKNTVYQGVLDRIERCLTKIREDKWNPGREEKDDLKFITEKLLSNSYQNGFNIIKEKVENPEVYLELKKNKLSDKFESDILRKRLEELQQFLTQPLCRETFIMKSIIYNYINRFWDGKCFLLRANAKKDMRAVFEKDFSEPFHKYLEGEHKKAKDTCIDCGNGITGKEKVSIAFMKEMADDLTRKRSAFWNCQVDAFLCPVCAFVYALSPLGFQMYANKFVFMNLNENISVLVDVNGKKRGNGLKEKGEEENYTVWFARILNKVLSDKVKELNNVQVILRGTRAEDNYMFSIIGRDALQILKQEKVQKALKYLEQHPYVKLSNEFVNVHESVVMNILQYHKQYSLLNQILKESLGNTGVIPTAYWVFVVQLCTSIEKRMEVNVGSISEELEQSQQGIEEKLSKAKEGIFMSRIKMRDAGYKLRKEILLAKKAENDECMRGTIYQLLNALSVRNEGKFMDIVIRLYSSTKLPMADGFVYMLGNKEKFSEYGYSFILGLKGSYTDSKDSKSEDTKQSQDESGEEN

SEQ ID NO: 420 - protein, 514 aa, Fusobacterium periodonticum
MKYDVDKNEYGFDTAISASDWKYSAAITGLIYYFKELEKKYEIKNLTIDEITDSFLLYNKEDITEDNYLDFIERFYPEDTLVHKKIETQLKYTKEFTPEIIKNIKENMSANTVLKKVFSKIKFDGTNKEEALKLLNENRNLIVKETFRNKKDLYDNYCQTSRLLEKGNNSPCRLKGYYFDPNRKSKATGYNFASSSVDYFDDEVFDFIPFAFTGNSFETIFLNDNLDLEILENMNYKLREYFSEEKEREITNIRTLKQEKAIKEGKNEPIEETSVSVSLKKIFLNILQKKTDYIKYGMEIIYKNRDKEYFETWYLRNDSIEVLKIVEDFSRLDIRIKITDKYYFNLLDEVFSAILNLSLLTNSILYLLKDRENFIKLDVSKENLSKIFKYNYAIEQLIKINQTIRNGGKGMDKNLKNSIKACASEVMKKFIKDNSLNKLVSYRQKLLSSVVAKNHKRILDVLTQLSVYSGVYFSFSFDYIENPTQNEDIIHYFILELDQSRLESKKNKENEDKE

SEQ ID NO: 421 - protein, 532 aa, Sulfurihydrogenibium yellowstonense
DSHVSPLASHVSRIYLGDWLYNAGIVGFLRINSHLWYVKDEKIISKDENLLKIEDNYIEIDRKIFDGFTDRFFDYAFNLYGRYDRKLKRFKELLENLNDGTFKDVYEDFKEEVNGFTLLKNKLGDIKAKNSQELKHLIEKAIRILEQDKEEFVESDVQIFLRSFNGQKSFLNKTITKDRKKKFYEDFEEPLKTDSNQKDKKFTCVICGDRPAKKDTNYDTGFSPIFGLNKDAVNFAWNFNTKLPSCDICEIVYFCYFAGLTELNGKYYFVNLDDSVESLMLANDLFKEEIEKSPENPFIDFFTEYLLRIKKSQAKYTLSNINFIETELKETLPKVFSFNIDYKTAEFIEKNHENLKSLSKSFFMLPDKNKTRVYILTEFLNLILKKDLNYGLLYKIFKSATQDKAYVSNYNLQRLIIMYLLYKQKVGGKEMGLEEKSLWAMYMQGKNLLERLKERDAENKIQSIAYKLLNALKIGDVNQFMDVMMRVHMAYDLEVPSLLIKALQDKDNFYLLGYSFLNGLLGKENKLQEESQ

SEQ ID NO: 422 - protein, 561 aa, Clostridium botulinum
MSLVKIEIGDWLKNASIVGLLKVLEHKKQSINEVNIQKNYIEFDTSMLEGFEEAYFQVLFKEHGKSISWFKLVSYMDEVNFMAENETTEKSIDRLNKIIDDMKSKSLINSNSYKSAYELLDDENDKIWIANKEKELIKIKHKKKYNPLDFKEEVLEQIAIIKDIINWFKKPEIKKFIMAKNVMYEVIQPFWNNVSILLKTNNKSNMYELYKQDFIDNFINYSESDTSKNKYNCFTCNNKIKKLSKPEAFDLTWLVKTGVDMSRKSSHFWNMNGDAYICPICNLVYSCLPLGFIVKKKKGIFINNNQNIKALKQCNIVATNYEDKKYEEIENLSYYNIFNSMENVSIENIDKEFENIQVVKIDGNNDRRPYSFNILSLRLMKILYFHRKNLESLIKIRVKITEKYYLNLYDEVIRRIYDGKNLLDLIHKLLIMYLDDKKFKGINIIYKILKINSSLMGGKDMRQEDINNFRNYGIRLKEAYEKKNAKSKLSGISYRLLNAIKTKDTGKFMDTILNAHMYMRMELPKELGLALRDNDKLQNIGYAFVLGLQSESLKKEHEGEN

SEQ ID NO: 423 - protein, 562 aa, Listeria monocytogenes; identical to SEQ ID NO: 384

SEQ ID NO: 424 - protein, 585 aa, Lactobacillus helveticus; identical to SEQ ID NO: 410

SEQ ID NO: 425 - protein, 561 aa, Blautia hansenii
MLERFVITTGDFLKNAGIVGMWYMLEISAARDNIDYGISENEQELWIAKDFAIEADWTDMYFKAFVAGLGPFTVYERVLEKIYSCLQKIETEEWKPGKEIKEDLKFINDKLLSNSYQAGFENIKDQIEDVEIYLNLKKNKLSDKLEQQELKMRLQKLQRFLVQPLCKETFTMKSIIYTYINRFWDGKCFLLRANAKKDMRGLFEKEFSEPLRKYWGNDHKKAKDLCIDCGMPMDSKEKVSIAFMKEMADDLSRKKSAFWNCKVDAYLCPVCAYLYALSPLGFQLYANKFVFLNMNESIHSLISANQKSGKSKFLSEKKEEEKYSVWFSRNLNIVLSEKKREISNIQVILRGIQAEDKYICNNIGKEVLSILEKEKVSDALNYLGKHPFIKLNGDFFNVHEVVVMNVLNYQNQYTLLNRLMKEAIENEGILFAAYWVYVVQVWARLVRCGKDKERNITMGQKTMRNNGYNLRKAIMEAKGVTKDDCLRGTIYQLLNALSVKDTGKFIDIVIRLYSSTKLLMPDGFVDMLYGKEVFQELGYAFVLGLKGSCWNNKLEDKKEEK

SEQ ID NO: 426 - protein, 569 aa, Anaerobaculum hydrogeniformans
MVNVHWTGHPFVDAGLAALAAAVQVNNMNDITADTLALAVKELKRILLSDQALGIGVEGAFVRSALSQVFPNSELVNPSNWKKGSTNEEKAKAVREKFSNALEEELNYAQQCLKSYNSSISYDICNICGEKRPESSFVLRRKDKMPLLEGIVNYYPAFSPGIRICGLCALATRFFPLSVMRAGARKRLWFLHTQDLAISKRISEKYGWEHFNSAIAANKTLDFFNDWQIAKTEGNEGTVLYVLYSLLKEMPDQLRNIYENPLPATAYLFSNDNRGGYVSALPIPHELMEFLALLHIESHIEFERFWRDLLEVSGNHDKGSLEARTDYVQSISKLILNSESIIKHCLDHNKLKLRGGWIGHRLYLKEVRKLPESKLNILQCLGISIAKNDEFKKYVMELRTARDNELYGILLRYVKNGWLKHDKFYTLLPPNSYNVVKEIRDTLLAIIYDYHNCKEEGRKFAPSIDTFNITPDETLCRIQRIGERFITNLKNPRKWTRKLQTVKTSSAIRGIYLNCIRSGAMTFDDFVFLAPLGDRRQLWLLRDYLLAFLFEKVKELAEEEEEYSEYNED

SEQ ID NO: 427 - protein, 514 aa, Fusobacterium periodonticum
MKYDIDKNEYGFDTAISASDWKYSAAITGLIYYFKELEKNYEIKSLTIDKITDSYLLYNKEDINEESYLDFIEKFFSKYSEDTLAHKKLENQLKYTKEFTPEIIKSIKENMSANTVLKKIFLKIKFDGTNKEEILKLLNENRYLIIKETFRNKKDLYDNYCQTSRLLEKGDNSPCRLKGYYFDPGRKSKATGYNFTSNSVDYFDDEIFDFIPFAFTGNSFETIFLNDNLDLELLENMNYKLREYFSEEKERGTEEIKKFKQEKAIKEKRNEEIEENLTSIPLKKIFLNILRKKSDYIKYGMEIIYKNRDKEYFETWYLRNDSIEVLKIVEDFSKLDIRIKITDKYYFNLLDEIFSAILNLSLLTNSIMYLLKDRENFIKPDTSKENLSKFFKYNYAIEQLIKVNQIIRNGGKEMDKNLKASIKACASEVVRKFIKDNSLNKLASYRQKLLSSVVAKNHKRILDVLTQLSVYSGVYFSFAFDYIENQTQNEDIIHYFILELDQNRLKNKENEDKE

SEQ ID NO: 428 - protein, 514 aa, Fusobacterium periodonticum
MKYDIDKNEYAFDTAISASDWKYSAAITGLIYYFKELEKKYEIKNLTIDEISDSFLLYNKEDITEESYLNFIEMFYPEDTLAHKKIENQLKYTKEFTPEIIKSIKENMSANTVLKKVFSKIKFDGTNKEEALKLLNENRHLIIKETFRNKKDLYDNYCQTSRLLEKGDNNPCRLKGYYFDPNRKSKTTGYNFTSTSVDYFDDEVFDFIPFAFTGNSFETIFLNDNLDLEILENMNYKLREYFSEEKERENEEIKKFKQEKAIKEKRNEEIEENLTSIPLKKIFLNILRKKSDYIKYGMEIIYKNRDKEYFETWYLRNDSIEVLKIVEDFSKLDIRIKITDKYYFNLLDEVFSAILNLSLLTNSIVYLLKDRENFIKLDVSKENLSKIFKYNYAIEQLIKINQTIRNGGKGMDKNLKNSIKACASEVMKKFIKDNSLNKLASYRQKLLSSVVAKNHKRILDVLTQLSVYSGVYFSFSFDYIENPTQNEDIIHYFILELDQSRLESKKNKENEDKE

SEQ ID NO: 429 - protein, 518 aa, Fusobacterium nucleatum
MKYDIDKNKYGFDTAVSASDWKYSAAVTGLIYYFKELEKKYEIKKITIDEITDSYLLYNKEDINEENYLDFIERFYSEEALAHKKIENQLNHTKEFTPEIIKSIKENMSANTVLKEVFSKVKFDGTNKDEVLKLLDKERDYIIKKSFENKDNLYANYCQVSNGKSKLFTSSEKSPCRLKGYYFDPNRKSKATGYNFASSSVDYFDDEIFDFIPFAFTGSPFETIFLNDNLDLEILENMNYKLREYFFEEKEKEIEKIKNFKQEKAIKEKKNEETEGNQNSVPLKKLFLNILQKKVDYIKYGMEIIYKNRDKEYFETWYLRNESIKVFKEIEDFSKLDIRIKITDKYYFNLLDEVFSAILNLSLLTNSILYLLKDRESFIKIDATRENLSKLFKYNYAINELIKVNQIIRNGGKEMDENLKKSIKACSIAVVKKFIKENSLNKLASYRQKLLSSVVAKNHKRILDVLTQLSVYSGVYFSFAFDYIENQTQNEDIIHYFILELDQSRLESKKNKENEDKE

SEQ ID NO: 430 - protein, 616 aa, Clostridioides difficile
MKLRVYRGDWFFNMGIVGFLNIIKKSNKQAEIFIMEDYIEFDSSFLENFHEYYFNYFMDEYDVSKRIKKSIDYSINFIKSKPDKVKDGIKKIKDTVKQQNDKVKKFDEEKFNLIKEKLDSISKIKSYDEFDSLEILVDETIDIFKIKSINDRLTANLYKYVVQDNYFGQVSFFNVAKAKLDLDGLKQVMFNDYLRQIIYFGELEDLLEENDYDKLKNYLNDRLNSIAKDISEKKVSKSSVNTIEKIMKEINKNFIKKNKSIENIKEYMDSLEICEMCGLYKGILDEYSESNFAPLGVSTNNARNMFWKQEYVSSICDVCKLILFCTPAGATYTRKDYLTNEENEFYLFVNMDTSINELFDRNNSLKAQKSESSNSKDENPFNQLIKSIVEENKLKSEWQLRNILFVEFKASIDSKKCKINYFNIPTYLAKFFVKENKKIQSIYDYKLKSNVLDLILKSKDLKHLINNTLRNIVKSNLESNNKSNISGLSCFNVVQLRTILNNYKRGVYKMDYKKLRKIYESGCEIHDYYIDKNAKNKIEGITYKILNLIKVGNKNDFMQTILRIFSPSEKTPPEEILQIFVEEDLDFESVGYAFVTGLISGKYEGKDKLSNEKEEK

SEQ ID NO: 431 - protein, 616 aa, Clostridioides difficile; identical to SEQ ID NO: 430

SEQ ID NO: 432 - protein, 492 aa, Finegoldia magna
MIEILENNPKFNRRVCPSDWRFSASIVGMIRFFEEEEIEFDLSEDGFYLYYNYEDVSEENDEKYFDYVEKTYHDSLHHTVLKDLLRIKDKSDEQKKIIKEKMNGNSIIKKVLKGVNAEDEETILEKISENREDIIRDTFKNAKFGYAKFANPNKIRSEEGKVCRLNGYYVDTSRKTKSIGFAFDDKTRNYNDFIEFDYIPFAFSQDRESIFINNNISIRHLKNSNDALVHENQDKGKLSYKLNKNFRSEIFYNFSEASNFIDYDVEVILKNQDDDFFETIFVRKEAIGIFESISKIDSEKQYIQKALKYNIKINDDYYINILNYVTNSVLNLQVLDKLIIFLFRYKFNIKSNDNKRAEKSDYGFLISQLIRINRLIYRKLYDGGDNNMTYKNVYETAEEVKRKLKEKNMENKLGSYRSKLIGALTANDKDRFIIVLLNLSSYSQVQFDFLTLLTKDFDLYKNIAFDFVSKLNYFEDNGSNKPSDNTNQNKGE

SEQ ID NO: 433 - protein, 427 aa, Lysinibacillus fusiformis
MEKIQPQIGDAVDALLQIVEHLKHKDAKRFIIPRVLTYQVIQGFWSNVSFLNSNASKKDLYEEYFNYFIKPAQDFLTSKKDEKKYGKNKLTCACCDNKMRSISEAFDLTWVQNLGVDGARKSSHYWNHQRNLFICPICNIVYSCLPLGFTLKNGIGLFINSNQSIVELLAYNKIQLRNDRGEEYTRDKLEEMAYSKIINEMYQHAENKKNVEIDNIQIVKYDKNNESRPYTFNMLSRDKAQQLYDNRNDFHYLTGKFVKENGDYISLYQEVIRRFYNGQRFSDLLYRLIRLVIDDKYTDTFSIYKILKISNYVLSGGSHYMTDKELRSIRISGYELRKVYRGQETKLNAISHRLLNALKVKNPNKFMETIVQAYSYKRHEKLGIPLFFTTTLSDIEKFQTIGYAFLIGLNGKDFKKEDMAKEEQVNE

SEQ ID NO: 434 - protein, 589 aa, Finegoldia magna
MGEIITIKSDDWLKNAGICGLYNILEKAGYKDHIEVRSDEIEFPVELLKGFSDMFFNYLIETYKDTFSLFRIINAEKLLDNWIENDFEKIEKKELDLLNLHIENFKKYIKSNSYKSAYKLIGGNVDPELLEKNLQKIKLKKKEKVLDRIEDIKSQLATMKEIISYFKSDDAIKYIGAKNAIYNIIRNAWDGVSFLNRQCKNPDMYEEYQDYFVNPAIEYIEDIDKNKTKYKYQCLACYSKIKDLNSDIGFIREMGFDTNRKTSHVWDFNNYVAICPICRLVYSCVPAGINYAFNKGLFINYSMDLNDLIKINKKINFEIHENSYSGISIYKSIQDNMNENLNENSQYELSDVQVVRFYRDVDRDSIKYNFNIINKVVLETISSCKTELNTIKQGKYSENSNDKYIYNEVMEKLLNNQNQFLLVQKLLHYKLSIPDSTYYNAGIVSSILKINIKYLEEAGYVKKLENNLVDEARIAGYYLQKAYNISGKGKVEIDEILQQESSESEDNKRNNNLAYNKKLNGIAYRMLNALKTNNKHSFMDTLINAYMYVGKSIPKIFAENLEDDLVFKNIGYAFITGMIGYIKEENKDK

SEQ ID NO: 435 - protein, 589 aa, Finegoldia magna
MGEIITIKSDDWLKNAGICGLYNILEKAGYKDQIEVRSDEIEFPVELLKGFSDMFFNYLIETYKDTFSLFRIINAEKLLDNWIENDFEKFEKKELDLLNLHIENFKKYIKSNSYKSAYKLIGGNVDPELLEKNLQKIKLKKKEKVLDRIEDIKSQLATMKEIISYFKSDDAIKYIGAKNAIYNIIRNAWDGVSFLNRQCKNPDMYEEYQDYFVNPAIEYIEDIDKNKTKYKYQCLACSSKIKDLNSDIGFIREMGFDTNRKTSHVWDFNNYVAICPICRLVYSCVPAGINYAFNKGLFINYSMDLNDLIKINKKINFEIHENSYSGISIYKSIQDNMNENLNENSQYELSDVQVVRFYRDVDRDSIKYNFNIINKVVLETISSCKTELNTIKQGKYSENSNDKYIYNEVMEKLLNNQNQFLLVQKLLHYKLSIPDSTYYNAGIVSSILKINIKYLEEAGYVKKLENNLVDEARIAGYYLQKAYNISGKGKVEIDEILQQESSESGDNKRNNNLAYNKKLNGIAYRMLNALKTNNKHSFMDTLINAYMYVGKSIPKIFAENLEDDLVFKNIGYAFITGMIGYIKEENKDK

SEQ ID NO: 436 - protein, 504 aa, Eubacterium yurii
MINEIEIKYDIDGRSISFNRKIEPSDWRYSAAIVGMIRFFQDRNITYKIDGRYLYYNFEDISGDINDDRDYLYFVEKWFSDKMHHKEVDIRLNKSDFSKSEISEINKKLKEKAVMEKVFKGVKFDGTNNMLIKDLIEENRLEIISNTFCNSKNGYSKFINYKKYRSKKGNVCRLQGFYVDTDRKTNSIGFCFDDNARTYNDEIEFDFIPFAFSRSDTSIFINNNTSIDYLMSSNNEMEDYLEKQFENQKIWNSIFYSYFGGFEFIDFDVEVIIKNMKTDFYESMFIRKAAIEIFKTIAKNKRFSESLNNIFKRNIKVYKQYDINVMEEVTKSILNGLSLDNLIEVLMKVEYRKKSDSMDSKDKAKNNRIDKYGRNEEKPNTYCLSRLIYINELIYKNMEDNMEKSAELIGSSISAAEVTRYFIANGQENKIKGYQQRLANTLISKDYNRFIEIMLQLSSYTQVPFIFMHKLIEDFESNKNLAYNFINSLIIKSNSKEGGITNEK

SEQ ID NO: 437 - protein, 145 aa, Listeria marthii
YCKLIYYKQTSVNGLYYNMGHVSGILDINTKFLKEIEMMATISQNQLWFVQSCGIKFKEGYINKKSENKIAGITYKLLNSLKVNDKDGFMDTLLNSYSYLAKPIPSVFMNVFSNDEAFKTIGYAFMLGVGGELIKNKDGGNTDEK

SEQ ID NO: 438 - protein, 423 aa, Listeria marthii
MQTEMAVRADDWLINAGLVGFLNIVGKENVRIDGQSIYFTADLLEDFETKYFNFFIQEYKETLAWSKIVSYKETMERFRVDGFASFDEDALDNLNKYVKDVVKFYLKKSNYIKVFPLIDPNADVNKWLENLKTINLTKKQEWEDVKADILEQVKQIYTQLDAIIDFCASDKGLRYLGAKNLIYSVINKGWSGLSFLSKQTKFIDPYLDYKTSFVEPVIEYLNTDLSKAKYNCFNCNQPIKNLKLDLSFMNEVGFDTARKTSHVWDFNNDVATCPICRLIYSCVPAGFTYVYGEGIFVSDSYGVNELYRVNERMRNSILRFNKDGINSANTYRALVESITTEHENVRRYELADIQLVRYENEHYHFNLLSEKMLHIVNDSKGILKSLIRCGYKEGSLNINLYKEVIQRLMNNETLYLFIHKLIY

SEQ ID NO: 439 - protein, 562 aa, Listeria seeligeri
MQAEIEVRANDWLINSGITGFLNIVGKENVRIDGQSMYFSTDILEDFETKYFNYFIKEYKETLAWHKIVSYKEKMEYYRAEEFASFDEKALDDLNKYTKDVVKFYLKKPNYIKVFPLIDPEANITEWLGNLTTITISKKQKFEEVKVEILESVKSTYNQIDAIIDFCASEKGLKYLGAKNLIYSVINKGWSGVSFLFKQTKFIDPYEDYKTTFLDPVFEYLDTDLSKAKYNCFICNQPIKTLKLDLSFMNDVGFDTARKTSHVWDFNNDVATCPVCRLIYSCVPAGFTYVYGEGMFVNDSFSIDKLLDVNVHMRESILHFNNEGINSNNPYRALVESITMEKEDKRRYELADIQLVRYENEHYRFNILSKKMLHILNDSKTILKSLIRCGYKEGNLNINLYKEVIQHLMNNENLFTLIHKLIFYKQTNANGLYYNMGHVAGILEINTKFLKEIDVMTNISQKQLWFVQSCGTEFKEGYYGKKSENKIAGITYKLLNALKVNDKDGFMDTLLNSYSYLAKPIPSVFMNVFSNDEAFKSVGYAFMLGVGGERTKKEDGGNTDEK

SEQ ID NO: 440 - protein, 562 aa, Fusobacterium gonidiaformans
METIVIRSEDWLKNAGIIGLYRILEEEESDEKSSISLEEDQIRFSAELLQNFSEKYFRYFIKQYKNVLSLYRTLNFKENISQFKEKNYENFGKEDLEKLNEHVENVKKYLKSNSYRAMYPLIRCPFDPLEKEKELKKVHLRKKESIEDGISDVKKLITHLEEIYDFLQQEDSQKYIGAKNVIYNIIKNAWDGISILNPQVKEQNMYFEFDKYFVQTTQEYLKQEKTKFKYRCFSCGESIKDTNIDLSFMNHIGFDVARKTSHVWNFNNYVHICPLCRLIYACVPAGFTYLYDKGIFVNANTHLKEMLRINDLIFKNVLGEKKDGKSIYGALVSGMSKEMNEHVEYDLSDIQVVRLEKKRYTFSILSRKFLSIIKKCRTDLEYIRKSSFKEGNDIYYIYNETIKRLMQGENLFLLIHKLVRLKISNGEDCYYKMGTVGTIIEINDIFLKEVGYMKDEKKEYNPLERARIIGHHLQEAYGGFEEGKYNKKLDGIAYRMLNALKTNNKIAFMDSLINAHMYVQKPIPSLFSDYLHQELAFKELGYAFVTGMLGEEWKNEGNTSKN

SEQ ID NO: 441 - protein, 474 aa, Fusobacterium gonidiaformans
MRKMKHNLDEGVYGFDTAISASDWRYSAAIVGLRYYLQEFQKKYEIKKNIEIDGIFDDFFLYSSQDIQENTYLSFVEKFYGEDLPHKALENKLKSSSVFSQEEEKWIKEKMGANTTLKKVFSKIKFTGENKQEVLNLIEENRYTIIKETFRNKKNLYDNYCQSGVLFTEAAKDSVCRVKGYYIDAGKKGKSTAYRFRTDSIIYEDDIIFDFIPFAFTGSTFETVFLNDNVDLDTLYKVNFNVKTFFEKKEQEKVSIQQNLMELLQNQTHPMKYGMEIIYKDREKTHFNTWYLRNESIRIFQKVDIPKINLNMKVGENYRNILKETFQNILNLVRLDLIIDFLLKEREKSNLPSIYFAIKELLKINIEIKNIGGENMEFNKNQKFAYACAKEIVKIFKKNNIEKKLDSYRQKLTSSLIFKDYKRTLDILMQLSNYSGVYFGFLYDFMENPSKNDDIIRMFILELNTENFENKVEK

SEQ ID NO: 442 - protein, 476 aa, Fusobacterium necrophorum
MKHSIDPKVYSGFDTAISASDWRYSAAIVGLQYYLEKMKKTYKIEKNIEIDKILDDFFLYRSQDITEKEYLQFVERFYGEELAHKALENKLNSKSTFHEEEVKWIKEKMAANTTLKKIFSKVKFIGENKQEILNLIEENRDFMIKETFRNKKNLYDNYCQSGVLLTEASKDSVCRVKGYYIDTGKKGKSMAYNFKTDTIVYEDDLIFDFIPFAFNGSSFETVFLNDNVDLELLIKMNYNVQVLWKRKEEERIEIPRNLMELLQSKTHQLKYGMEIIYKDREKTHFDSWYLRNESIEIFQKVNISKIQLNLKEGEIYRNILKETFKNIMNLSRVDDTIHFLLKEKEKKINTIGINLAIEELLEINNRIKNGGEKMTGNIKAAKACAREVVKEFKKKNIEKKLDSYRQKLISSLVFRDYKGTLDILMQLSNYSGVSFGFVFDFIENPSQNDDLVRAFVFKLNSTEYEPNGKEKKKEDK

SEQ ID NO: 443 - protein, 250 aa, Fusobacterium gonidiaformans
MKHNLDAGVYGFDTAISASDWRYSAAIVGLRYYLQEFQKKYEIKKNIEIDGIFDDFFLYSSQDIQENTYLSFVEKFYGEDLPHKALENKLKSSSVFSPEEEKWIKEKMGANTTLKKVFSKIKFTGENKQEVLNLIEENRYTIIKETFRNKKNLYDNYCQSGVLFTEAAKDSVCRVKGYYIDAGKKGKSTAYRFRTDSIIYEDDIIFDFIPFAFTGSTFETVFLNDNADLDILYKVNFNVKTFFEKKNKRK

SEQ ID NO: 444 - protein, 314 aa, Lachnospiraceae bacterium
MKDEMVCLEPFDWRYSTAIVGLRKYLEWLGTEEPELIITEDTLEYNRKYLNKSEFLKFAEYYFKDDMHHIEIENKLKEKNPTEDQINIVNEKMKANTILKNKFKKIKFDGHNQDEIQNIIDQNREEIICETFRNKNNLYKNYCNPNQLFKDKQECCRLNGYYIDMPKKGKSISYAFDKSNYVGNDIPEFDFIPFAFSGCREKFFINDNVDLNRLQKTNNQWTRTVKSQMEEAKQKNERVNTKRIFIDCLIEAKDFLQSDIEIIVKKPERAYFETLYLRKESLEILKNMESYYKAFCFSIKISDDYWINILNEVF

SEQ ID NO: 445 - protein, 486 aa, Lachnospiraceae oral taxon
MISKLEFKENSVNYNRRIEPSDWRYSAAMVGMIRFFKDRNISYQTEGRYLYYNFEDIYNEGKDFEGDKDYLLFAEKWFSDKMHHNVVYKRLCQNQFTDEMIKEVNEKLSANTVMKKVFKGVKFDGTNGELIKELVDNNRLELISNTFCNSTSGYRKFINTSKYRSESADVCRLLGFCVDTGRKTKSIGFCFDKDSRTFNDEVEFDFIPFAFSRSGSSVFINNNTSIDYLLKANDEMEYFLAEKFEEQKTWNSVFYSYSEGAGFIDYDVEVIIKNTETDYYESMFVRQNAIEIFEKISDNSEFSDSLKNVFKRHVKVNENYYINVMQEVTDSILNELSLDDLIERLMKVEYDTDSTTPETYCLSRLIYINKIIYEKREGNMEKTPEFKGSSAAASQVVQYFITNRQENKIKGYQQRLANTLISKDYERFIEIMLQLSSYTEVPFTFMHKLIQDFEANKNLAYNFINSLIISSKRKDDNPEGGKSNEK

SEQ ID NO: 446 - protein, 610 aa, Caldalkalibacillus thermarum
MAYIDIHADDWLMSVCLVGLKRLYGDELESTPTGVRLKSEQLSSLAERYFNYLINQYNVAKRNHERLKRWLNEARKEPTRIKDRIGDIRKLMNDQIKKVEKYFPDSEEYARLQALLEQVKGVKKVEELYNLEACIEEFYQIMSTEAINDKLTLNYAKSVIVAPFYGQPSFLQKTASKLNKQEHINKMNQDYVVPAQLEMRLRELIHHTQQADKVLSFLEEHRDYPPFRGWLRGIKKLKNMEEIRGYFSTEVLPCSFIDSMYGTISFEEMMFSPLGLSKNNAINFYWDFNKKTPVPMSALAKLILFMAPIGLAFYTRKLGFGQSGEYHQFAGFVLQDTYFEEVYKSNNYYKREREEGGSFIDVILGLLQDTRKRAEKLSDSYLFVEIYSDYESKKTLLDYYHMSQYTAKYFRKYGQSLQKLYLTECRDAFIRSILRGVDPKQTVFRYLREAVTSPGHAYGAFVTVRERYRWQLVHKGVSDVKDQEKYVYVLYQQGKALRDAIIQGREDAQSATAGYEQEPYRASGEKKVAGIAYRLLNAAKSGNRYAFLDTVFRLHVASQKDVSPLFLDILKEKQGLDFETVAGAFIAGLLGGTQAEPNNDSNEKEVATNG

SEQ ID NO: 447 - protein, 375 aa, Peptoniphilus indolicus
MEKRIELKTGDWLYNTGLLGLYNILKYKDEYVEVSKEGISFELEALEKFEEYYFKYLIDTYYLTLSINRIVSFENSILNWESEDFKNFNDKSLENLNIQIDNVKKYMISNSYKKAYSLIDSEFNPLVKEKELKKIKLSKKDTVESKMSEIKYQISLLKETIDYFKFKDTKKYIGAQNIIYNIIRNAWDNVSILNRQNKNPDMYDEIANYFVKPAIEYLDEYEEKKNKSRYLCMSCGSRISSLNNDICFIRELGFDTKKKNSHVYDFNNYVGICPMCKLVYTCIPAGFTYAYNRGLFVNYSSNFKNLIEINNNIKEDVFKEINKNTSIYYAIQKNMDEKSNEDMKYELSDVQIVRFFRNIDSDQVKYSFNILNRPI

SEQ ID NO: 448 - protein, 625 aa, Clostridioides difficile
MKLRVYRGDWFFNMGIVGFLNIIKKADKQAEIFIMEDYIEFDSLFLENFHEYYFNYFMDEYDVSKRIKKNIDYSINFIKSKPDRIKDGIKKIKDSVKQQNDKIKKFDEEKFNLIKEKLDSMSKIKSYDEFDSLEALVDETIDIFKIKSINDRLTANLYKYVVQDNYFGQVSFFNVAKAKLDLDGLKQVMFNDYLRQIIYFGELEDLLEENDYDKLKNYLNDRLNSIAKDINEKKVSKSSINTIEKIMKEINKNFIKKNKSIEDIKKYMDSLEVCEMCGLYKGILDEYSESNFAPLGVSTNNARNMFWNQAYVPSICDICKLILFCTPAGATYTRKNYLINEENEFYLFVNMDTCINELFERNNSLKAQKSEYSDSKEENPFNQLIKSIVEENTLKSEWQLRNILFVEFKASIDSKKCKINYFNIPTYLAKFFTDKYANKKIQSIYDYKLKSNVLDLLLKNRDLKHLINNILRNKVKNDMESNNKSNISGIDCFRVVQLRALINSYKKGVYKMDSKNLEKNDEKLRIIYYLGCDIHDYFVNKNSKNKIGGVSYKLLNSVKVGNKSDFMDTIIRVFMSAEKQMPAFILDIEIEKDLDFESIGHAFISGLISGKYEGKDKLPNEKEEK

SEQ ID NO: 449 - protein, 480 aa, Peptoanaerobacter stomatis
MISTGNYGKYDTSLEFSDWRFSASAVGIMKYLQYNDMDFYIYDYDDEENDYEYKKDAIYYNKKDILDENKYLDFAEHFFSDKFHHKRVIALLDSDNFDTEKIKRINDTLKANVIMKKIFANIKFNGENKDEIINLIQDNKYEIIKETYRNAKSMYANFCNINSIFSNSQEICRLLGYNVDLGKKKKSLGFNWNYDTYVYNDVFEFDYIPFAFTRTRDVFFINNNFNAKELLKSNENIDLNYFNDNEKKNIRKELFFSSSKNAKYIDYEVEIISKQRDYDYFETMFIRDEAIRIFNAIDDMKDENIVNTLSNPCKYGKSDYLPILNIVVDSIINLLHLDPLIDKLLKDFKNDHWYLISQLIRINILLYKENYEIMENKGDKSNKIARVIATANEVNKKLRIDKSNKIISYKNKLISCLVFKDYDRFCSILLQLATYSSVSFGFAYDLFEDFEKNKNLAYAFVNSLNFKEFDQNKEENKNEK

SEQ ID NO: 450 - protein, 561 aa, Listeria innocua
MQTEIEVRADDWLINASIVGFLKIVGKENVRIDGQSIYFTTDLLENFETKFFNFFINEYKETLVWSKIISYKDSMERFRTDDFASFDEKALTDFNNYIRDVVKYNLKKDNYIKVFKLIDESANVTKWVGNLKPINLKKAEKWNDVKSEKIELIKESFKHLDSIINFCASEKGLKYLGARNVSYTVINKGWSDVSFLNKQAPPDSYEGYESYFLKPLLEYLDTDLSKAKYNCFNCNQPIKTLASGLSFMNDTGFDVGKKASHVWDFNNDVAICPVCRLIYSCVPAGFTYVYGEGMFVNDSYGIDELYRVNERIRNSILRFNRDSINSANTYRALVESITIEHENNRRYELADIQLVRYENEHYRFNLLSKKMLHIVNDSKGILKSLIRCGYKEGNLNINLYKEVIQHLMNNENLFSLIHKLIYYKQTSVNGLYYNMGNVSGILDINTKFLKEIEVMKNVTQSELWLAKSCGTKFKEGYVKKKSENKISGITYKLLNSLKINDKDGFMDTLLNSYSYLAIPVPNVFMHAFSNTEAFKSVGYAFMLGVGGEATNNKDGGTTDEK

SEQ ID NO: 451 - protein, 516 aa, Thermococcus litoralis
MKNIKKERRLNEFLTRLEIQNTQKGRTDSHAISPIFTWTGHPFTDAGLVALLLLSGKEKPEELTEEDVKRAVKFVAKLYSQEGWAQLLARIYRNNNPILMINPSMRKYATPDKLEFSLWGLYQLILSTRKHKDRKVCQICGRYPVVSGLELRSIINTKERERPKEITGDIFPLLGTGDLRNYFPHGNEMGADICAHCLFLAQLSSVGSYVITTKNGKTQGVLIVHAYPYEKMVELNKAAVNSAKKAYLYNTAEGFKQPVNFLFELIRKVAENVETGYWEDVSISAYYYLNGNRTGEQWIEIFYIPNPILRFVAFAARKDGIGWKKIVLMGWRKRPSEKEFEDFKKRYPNDVYSKLLSGESILPYFLDIQNRKVNAGWNLLSFYCSEVLGLDKEALEFIKGVADRIVETVEKLPDNKLSRRIRELERAEKLYQFESFFIRVEKDRQEFGIPEALMSFDDFARILTSYGEDLNVSWKTVKNLLLFRIYEKLHDRLMKASLEKAEVEEAEEEFEEGVEK

SEQ ID NO: 452 - protein, 476 aa, Fusobacterium necrophorum
MKHSIDPKVYSGFDTAISASDWRYSAAIVGLQYYLEKMKKTYKIEKNIEIDKILDDFFLYHSQDITEKEYLQFVERFYGEELAHKALENKLNSKSTFHEEEVKWIKEKMAANTTLKKIFSKVKFIGENKQEILNLIEENRDFMIKETFRNKKNLYDNYCQSGVLLTEASKDSVCRVKGYYIDTGKKGKSMAYNFKTDTIVYEDDLIFDFIPFAFNGSSFETVFLNDNVDLELLIKMNYNVQVLWKRKEEERIEIPRNLMELLQSKTHQLKYGMEIIYKDREKTHFDSWYLRNESIEIFQKVNISKIQLNLKEGEIYRNILKETFKNIMNLSRVDDTIHFLLKEKEKKINTIGINLAIEELLEINNRIKNGGEKMTGNIKAAKACAREVVKEFKKKNIEKKLDSYRQKLISSLVFRDYKGTLDILMQLSNYSGVSFGFVFDFIENPSQNDDLVRAFVFKLNSTEYEPNGKEKKTEDK

SEQ ID NO: 453 - protein, 504 aa, Peptostreptococcaceae bacterium
MINEIEIKCDVDGKNIAFNRKIEPSDWRYSAAIVGMIRFFQYRNIAYKVEGRYLYYNIEDISGDINDDRDYLYFAEKWFSDKMHHKEVDIRLNKSDFSKDEISEINKKLEANSIMKKVFKGVKFDGSNNKLIKDLIEENRLEIISNTFCNSPNGYAKFINKSKYRSKKGDICRLQGFYVDTSRKTNSIGFCFDDNARTYNDEIEFDFIPFAFSRSGTSIFINNNTSIDYLMNSNNEMEDYLEEQFENQKTWNSIFYSYFGGFEFIDFDVEVIIKNMETDFYESMFIRKAAIEIFKTIAKNKGFSESLNSIFKRNIKVNENWYINVMEEVTKSILNELSLDNLIEVLMKVEYRKKSDSMDSKDKAKNNRIDKYGRNEETPNTYYLSRLIYINELIYKNMEDNMEKSAEFKGSSISAAEVTRYFIANGQENKIKTYQQRLANTLISKDYNRFIEIMLQLSSYTQVPFIFMHKLIEDFESNKNLAYNFINSLIIKSNSKEGGTSNEK

SEQ ID NO: 454 - protein, 510 aa, Fusobacterium hwasookii
MKYDIDKNEYGFDTAVSASDWKYSAAITGLIYYFKELEKKYEIKNVTIDEITDSYLLYNKEDINEENYLDFIEKFYSKYSEDTLAHKKLENQLKHSKEFTPEIIKSIKENMSANTILKKVFSKIKFDGTNKEDVLKLLNENRYSIIKETFRNKKDLYDNYCQTSRLLEKGDNSPCRLKGYYFDPNRKSKATGYNFASSSIDYFDDEIFDFIPFAFTGNSFETIFLNDNLDLELLENMNYKLREYFSEEKERETEEIKKFKQEKAIKEKKNEEIDGNLTSTPLKKIFLNILRKKSDYIKYGMEIIYKNRDKEYFETWYLRNESIEVLKAVEDFSKLDIRIKITDKYYFNLLDEIFSAILNLSLLTNSILYLLKDRESFIKNNKILEKYSSAIYQLIKINQIIRNGGKEMNWKLKNSIENCAEKIINYFEKQKTSNKLVSYRQKLLSSVVAKNHKRILDVLTQLSVYSGVHFDFVFNYIENQTQNEDIIHYFILKLVPTDEKEKIKENEDKE

SEQ ID NO: 455 - protein, 481 aa, Peptoanaerobacter stomatis
MISTGNYGKYDTSLEFSDWRFSAAAVGIMKYLQYNDMDFYIYDYDDDEENDYEYKKDAIYYNKKDILDENKYLDFAEHFFSDKFHHKRVIALLDSDNFDTEKIKKINDTLKANVIMKKIFANIKFNGENKDEIINLIQDNRYEIIKETYRNAKSMYANFCNINSIFSNSQEICRLLGYNVDLGKKKKSLGFNWNYDTYVYNDVFEFDYIPFAFTRTRDVFFINNNFNAKELLKSNENIDLNYFNDNEKKNMRKELFFSSSKNAKYIDYEVEIISKQREYDYFETMFIRDEAIRIFNAIDDMKDENIVNALSNPCKYGKLDYLPILNMIVDSIINLLHLDPVIDKLLKDVENEHGYLISQLIRINILLYKENYETMENKGDKSNKIARVIATANEVNKKLRIDKSNKIISYKNKLISCLVFKDYDRFCSILLQLATYSSVSFGFAYDLFEDFEKNKNLAYAFVNALNYKELGQNKEENKNEK

SEQ ID NO: 456 - protein, 514 aa, Fusobacterium periodonticum
MKYDIDKNEYGFDTAISASDWKYSAAITGLLYYFKELEKKYEIKTLTIDEITDNFLLYNKEDITEESYLNFIEAFYPEDTLVHKKIETQLKYTKEFTPEIIKNIKENMSANTVLKKVFSKIKFDGTNKEEALKLLEENRHLIIKETFRNKKDLYDNYCQTSRLLEKGDNSPCRLKGYYFDPNRKSKATGYNFASSSVDYFDDEVFDFIPFAFTGNSFETIFLNDNLNLEILEIMNFKLREYFSEEKEREISNIRTLKQEKAMKEEKNEPIEETSVSVSLKKIFLNILQKKTDYIKYGMEIIYKNRDKEYFETWYLRNDSIEVLKIVEDFSRLDIRIKITDKYYFNLLDEVFSAILNLSLLTNSILYLLKDRENFIKLDVSKENLSKIFKYNYAIEQLIKINQTIRNGGKGMDKNLKNSIKACASEVMKKFIKDNSLNKLVSYRQKLLSSVVAKNHKRILDVLTQLSVYSGVYFSFSFDYIENPTQNEDIIHYFILELDQSRLESKKNKENEDKE

SEQ ID NO: 457 - protein, 567 aa, Lysinibacillus fusiformis
MIELQLDETIYNASILGLCRVFDYAKLEYSKSDYQTISFPESNLANFEEHYFAYLSAQYGHETNYYKMTNPTIVEFLLRAKTDIGDEKNLERLNAHIEKVKYWLSSNSYKNVYPFLSAIPFDFLEAAKSLKKVTQRKKETLEKIQPQIGDAVDALLQIVEHLKHKDAKRFIIPRVLTYQVIQGFWSNVSFLNSNASKKDLYEEYFNYFIKPAQDFLTSKKDEKKYGKNKLTCACCDNKMKSISEAFDLTWVQNLGVDGARKSSHYWNHQRNLFICPICNIVYSCLPLGFTLKNGIGLFINSNQSIVELLAYNKIQLRNDRGEEYTRDKLEEMAYSKIINEMYQHAENKKNVEIDNIQIVKYDKNNESRPYTFNMLSRDKAQQLYDNRNDFHYLTGKFVKENGDYISLYQEVIRRFYNGQRFSDLLYRLIRLVIDDKYTDTFSIYKILKISNYVLSGGSHYMTDKELRSIRISGYELRKVYRGQETKLNAISHRLLNALKVKNPNKFMETIVQAYSYKRHEKLGIPLFFTTTLSDIEKFQTIGYAFLIGLNGKDFKKEDMAKEEQVNE

SEQ ID NO: 458 - protein, 577 aa, Ruminiclostridium cellobioparum
MIYLENEIIRLALGDWSWNASVAGFINIIGEENVTYDGASAQIPVNCLEDFEDRYFRYFIDTYEKALPWYRIVSFKNTIGFYNENGFEGLDLKKLKSINDYIKDTVKRYLTSNSFKSAFELMGEAERMAELEKNLSKVREPKDDTDFEKVKEEVIGELKKQFEIINKIIEYCGNENGRRFIGAKNVIYTIIRNGWNGISFLNPQTKIKDIYEDYRTYFVDEAREYLAADKQKFRYKCFTCGAPIRDMNNDMSFLNQSGFDTARKPSHVWDFVNDIALCPVCKLIYSCLPAGFVYVNNTGLYINANVNMRYNVRVNRSARDSVLKEGRNETASRRIYKVLVEAMERERIEKSRYELADVQVVRYENERFKFNLLPESTIKLIHKYHDEISGLIRTGYKEGKESYSIYEQVLENIFNNQNLFLLVYKLLHFKTASNKDCFFHMGHVEDILSINAGLIKSLGGMENMDENRNYINEAKNSGYHLRKAFMKNNEKTGKIPGISYRLLNALKTGNRNMFMDVLLNSYLYTGNKVPAVISEIFRSDELFSTIGYSFVTGFIAERSDDSGNEANNEKTVNGEEN

SEQ ID NO: 459 - protein, 582 aa, Aneurinibacillus aneurinolyticus
MVLTMESIPIAADEWIVAQGLVGYYRLLKHAGIKVKLTDEGLLFDPEHLENFEHHYFQFFLDRYSVAKRDERTIRREFAKLKQASKLDGKEAKGKIQMAKKTLDERIKLTALDKVEKKFTETAATNRLVKAAKAIRNQKAYTAEMDEWIEEYITALEEQEIDHKLTLNYVKAKVLGAYFGQVSFLNVLHTAKTLEEQKTIFRKEYIEPLLLDLELQKVMLEATSAQEVLQYLESSVHGKAKDLKKKFKNMNIDEIRECISTKVNRCSFFETQWAFEQYSESHFSPLSMSAPKALNFYWGANNTLTTPISKLAKLILFCAPAGASIVGETSLFVQLEGRFEQLIRANDVYEIGRSKEKAFDEILFDLVAEQRTKAQQVSQSYLILEYSSDYNAKKTDLQYLHLTPGLCNLFNSDIYQRWFLQLNYRLRNQLVRSFLLYQDPKALIQSHLRMKLKENYIGNDMVYACLLRHYFLLYTKKGEKIMATDLEIGRKRIWNAYYAGLDMKKKLDEGKARSIAYRLLNAVRANDKNMFLDTTMRMYMSLQEALPPVIINVLDESKIDFPSIADSFIAGLISTEEEKNEK

SEQ ID NO: 460 - protein, 605 aa, Clostridiales bacterium
MKIKVYLADWFYNMGIVGFRRILKFQEDYRSLKLSDFEYQEADNYIEFNPDLLKEFHNYYFDYFLGRYNMARFQSIQLDKYLNLSKKEGKFNESIKVIKDIVKANNNKIKKIDETVFTKAEEIYKSLGDIKRQEQISELEELLLKYKDILELKNINEKITLNKFKSIMSNSFYGQVSFFNVIHTSKTIVEQKDIMFKDYISPIITMEELKTEINENRAGDLEERISKALSDKATPKNIGKLYKNINSKFIKKKKSLEEIEQYIGGKDFALCQMCGEYKSIGSEYGEGDFVPLAVSTDNSRNMFWNFNTSVPLCDICKLILICSAAGATDIFKGYMNANLDNKYKQYFAFVNMDTTFKDLYKTNESFNLKKDKENPFKELIFDIVSEAKERSTWQLQNILYVEFNSDYGSKNCKMNYFNIPKYIAQFFKAKAEVVNSIKDEKFKAEIVDDILSNKDIKFSIDRKLREVLANNYGNPYDCYRAVVIRYYLKVSKGGIKKMATEVDDKRLKFIYMRGLELNKHYTKNGGENKISSIAYRLLNAAKSNNKKEFMDTLIRIHLNAQMEVPTIFLDIMSEKELAFEEIAHSYVAGLISKASSKKDSEENEN

SEQ ID NO: 461 - protein, 548 aa, Caldanaerobacter subterraneus
MKERVYLGDWAYNAGIVGFIEIMLDGEDITSQNIITVGPNYIEFDRNSLQGFSDKFFKKAYQRYPRTDKLINSGNKLLQKLKNNEFDKNLKQEVSNFKKEVDGFSKLKQLADKCNTALPKNFSNDEAKQYVTQIIGLLNENKQEFIENDVKTYMATISSIYGQKSFLQRSVTTGLKNRFYNDFEAPIIKQTNKQDEHHTCIFCGLRPAKKDALLDTGLVSFLGANKDNKNFFWNFKPQLPICEICELIYFCIFAGLTEFRIGQTKKFYFVDRNTSVLELYQTNKLFMEMMSREENILKEKGILNFINDYLLLKLKEKSKFRLANIMFIEIDLTSSVTPKLYGFSITKQKAEFINSNFDVFKKITGTFIKFKDNNIYPFSEFMQKFMNNTLSFQFLSFLEGQYLSSQKPNSKINTNISPYRLQMYNILTYKYLKSIKRGGELMDEKWLWKMYFFGQELKKKFLTSKAENKITSLAYRLISALRIGDVNTFMNLVIRTYMSYNMEVPALFVSCINDRDDFWALGYSFVNGLLGSEKDEKVENSEEVVGNE

SEQ ID NO: 462 - protein, 514 aa, Fusobacterium nucleatum; identical to SEQ ID NO: 412

SEQ ID NO: 463 - protein, 561 aa, Listeria grandensis
MSEIECRANDWLFNAGLVGFINIVGKKNVRMEGQSVFFEESLLDGFEEKYFDYFIREYEKTLSWYKIVSFKVEMEQHRKTDFADFDEKALDRLNEYIANVAKYYLKSASYASVYPLIDASVDPAQWGKNLAKVGQLKKKETFAEKRAEIIQEVKQVYPKLDQIIAFCESDKGKKYLAAKNVIYTVIKNGWNGVSFLNPQTKEKDCYVDYRDNFVAPVVEYRETDLEKAKFHCFTCNRPIKNLKLDLSFMNETGFDTARKTSHVWDFNNDIAVCPLCKMIYSCVPAGFTYVYGNGIFINDSVSAEALHEVNEKIRYEILHNHEDSLTQTSPYRALIEAITNQVEDKRHYELADIQVVRYENEKYRFNILSKRALNIFHDSKNALKMIQKCGFKEGTLNVNFYQETVRRLMNNENLFTFIHKAMYLKVTNVSNTYYHMGHVGSLLEINTNFLKEIEAMTEISKGRIWHINKCGNEFKKAYPEHKRGGFNYKMLNALKTNNRDAFMDIILNSYSYLGKTIPDFFLESFTSDETFKTVGYAFMVGVNGAIETDDKDKDGGNDNEK

SEQ ID NO: 464 - protein, 561 aa, Listeria weihenstephanensis
MREIECRASDWLFNAGLVGFINIVGKENVRMEGQSVFFDADLLDSFEDKYFAYFIEEYEKTLSWYKIVSFKKEMDRYRKDDFASFDEKALEELNNYIANVAKYYLKSASYVSVYPLIDATADPVEWGKNLAKVGALKKKETFDEKRADIIQEVKQVYLKLDQIIAFCNSEKGERYLAAKNVIYTVIKNAWNGVSFLNPQTKEKDTYVDYRTNFIDPVKEHLETNLEKAKFTCFTCNQPIKNLKLDLSFMNETGFDTARKTSHVWDFNNDIAVCAVCKFIYSCVPAGFTYVHNNGIFINDSVSIDTLHAVNEKIRSAILHDPAQTLTHTSPYRALVEAITNQVEDKRHYELADIQVVRYENETYRFNILSKRALNIFRESKNALTALQRCGFKEGNVNVNFYQETVRRLMNNENLFTFIHKAMYLKVTNASNTYYHMGHIGSLLEINTNFLKEIEAMTEISKGRIWHINKCGNEFKKAYPDHKRSGFNYKVLNALKTNNRDAFMDIILNSYSYLGKTVPDFFLESFTSDETFKTVGYAFMVGVNGAIEQEDKDKDGGNDNEK

SEQ ID NO: 465 - protein, 480 aa, Listeria fleischmannii
MLEFEISDWGYNASLAGFINIIGEENVTYLDHQCVQIEEEMLKDFVTKYFNYFIDTYEKVLPWYRIVSYKDSMEATLESKFDNFTEKDLKEMNYYVKNVLKYYFTSNSYKAAYPLIDADFNPEVEVKKLKTINLKKKDDFNEIKAELISQVKENFEIIAKLIDYAKSEKGRKYLAGKNVVYNLIKNSWEGVSFLNRNTKEKDFYIDFEKHFIEPANKYLEADKTKYKYHCTNCERPIKDLELDYSFLTNTGFDTKRKASHVWNNDNDLAMCPICRLVYACMPAGFTFIQREGIFINSNANIQEMVRINRMMKNDLSSKLDDQNKSVYRTLVRMAQESDVEKHRYELADIQVVRHENESYRFNLLAKPVLTLMNRFEKELKSLIGANFKEGNERQYIFQEVVKNILDNQNLFLLAHKLIYYKVANYEQTYYYSYHIMNVLKINSYFTGGTGEMTQTITLDELEKVRANAYYFKEELKNRKT

SEQ ID NO: 466 - protein, 517 aa, Fusobacterium nucleatum; identical to SEQ ID NO: 341

SEQ ID NO: 467 - protein, 583 aa, Bacillus mycoides
MLLTKEAIPLTAGEWAIDQGLVGYYRILKHAGIKVQVTDEGILFEPEHLKDFEQHYFNFFLNRYSVAKRDEQIIRREFSNFKRESELKENTGTRGKIQLAKKLLDETIKRTVIEKVEKKFEDTIIKKRLVEFAHKIRNQKAYILEMEEWIEQYLQALAEPIINHKLTLNYFKAKVLGTYFGQVSFLNVLHTAKTIEEQKAIFRKEYIETLLVDLELQQVISQAQSSDEIMNYLKLSTHESAKQLRMKFKKFEIEQMREYISNSVNHCNFFDSQWAFEQYSESHFSPLSMSAPKALNFYWGANGVLAIPISKLAKLILFCAPAGASIVGDKSLFVQREGRFEQVIQANNIYEIGRSKEKAFDEILFDLIAEQQTKAYQTQQNYLILEYSSEYNAKKTDLQYLHLTSGLCSLFNSDTCSKWFGYLKYTLRSQIVHSFLRYQDPKSMIHHHLRIKLKEGRFANEIVYACLLRYYFIFLVKGEGTLETNLSIGRKRIWSAFYAGVEIRKAMEEGKIRSIAYRLLNAVRANDKKMFLDTLMRLYMSVEKPLPPVFINVLDESQIDFATIADSFIAGLISKEGEKGDEQ

SEQ ID NO: 468 - protein, 487 aa, Microscilla marina; identical to SEQ ID NO: 411

SEQ ID NO: 469 - protein, 492 aa, Finegoldia magna; identical to SEQ ID NO: 432

SEQ ID NO: 470 - protein, 589 aa, Finegoldia magna; identical to SEQ ID NO: 434

SEQ ID NO: 471 - protein, 589 aa, Finegoldia magna; identical to SEQ ID NO: 435

SEQ ID NO: 472 - protein, 561 aa, Blautia hansenii; identical to SEQ ID NO: 425

SEQ ID NO: 473 - protein, 566 aa, Clostridium botulinum; identical to SEQ ID NO: 415

SEQ ID NO: 474 - protein, 561 aa, Clostridium botulinum; identical to SEQ ID NO: 422

SEQ ID NO: 475 - protein, 565 aa, Clostridium sporogenes; identical to SEQ ID NO: 417

SEQ ID NO: 476 - protein, 583 aa, Lactobacillus ruminis
MGEKIKFSKGSWLENAGIVGIIRILGIDTDDDNGKNELVIDSSDLTNFSEKYFKYFVTKYGRCTKYHDIISFRGQIDDWISGNLEKFDEKDKKKLENLLNKIKQFVDSKSYEKVKELINSKFDVENALKKCRNYYREYNKLCKVEDNDNKKSTSILEMMLKEIGNIIDYFDRDDSHKYFPAKILCYKIISMGWNNVAFLNKNSKEKDFIKEYNDYFINPVVKYFNSNHDKDKYLCSTCGRRIKKGKRCSYSYSFINGMGYDVEKKKSNSWNYVNDLLICPICNFMYSAIPAGFNYNYFDGKGIFINYTRNLNELVKRNDAILTKMISDSGEANRNAKSPYAAFVNSFNFKSIESSKYNLANIQVINFDNSKGCKYIFTTVPKLASAVLYDCINKSFGTDDNLISVLENAWIKDYRGIDRYKILDDVVKRIINSANMDSLIYTIELLKATDSNDLNYNDFCISAILNINYLYYKELNKEGGLGCMTIDEKDLKKFRREGIIIRDAYRSKYNENKAKGLAYRLLQNLKANNQQEFLNNILNSYLYLDRIIPSEFISKQGQDIEFNQLGYAFVAGLISDSKDNVEK

SEQ ID NO: 477 - protein, 562 aa, Listeria monocytogenes; identical to SEQ ID NO: 384

SEQ ID NO: 478 - protein, 562 aa, Listeria monocytogenes; identical to SEQ ID NO: 396

SEQ ID NO: 479 - protein, 449 aa, Listeria monocytogenes
MFPLIDPSANVTKWLENLNTINLTKKQRWDEVKADIIEEVKQTYTQLDLIIDFCASEKGLQYLGAKNLIYSVINKGWSGVSFLFKQTKFIDPYLDYKTTFVDSVLDYLDTDLSKAKYNCFNCNQPIKNLKLDLSFMNDVGFDTARKTSHVWDFNNDVATCPICRLIYSCVPAGFTYVYGEGMFVNDSYGVEELHRVNERMRNSILSFNQDGINSTNTYRALVESITMEHENNRRYELADIQLVRYENEHYRFNLLSKKMLHIVNDSKGILKGLIRCGYKEGNLNVNLYKEVLQHLMNNENLFTLIHKLIYYKQTSVNGLYYNMGHVSGILDINTKFLKEMEVMTNISQNQLWFVQNCGKEFKEGYVKKKSENKISGITYKLLNSLKVNDKDGFMDTLLNSYSYLAMPIPDVFIKMFSDNEAFKSVGYAFMLGVGGEKTKKEDGGNTDEK

SEQ ID NO: 480 - protein, 562 aa, Listeria seeligeri; identical to SEQ ID NO: 439

SEQ ID NO: 481 - protein, 561 aa, Unknown; identical to SEQ ID NO: 450
  multiple bacterial species (eubacteria)

SEQ ID NO: 482 - protein, 516 aa, Thermococcus litoralis; identical to SEQ ID NO: 451

SEQ ID NO: 483 - protein, 427 aa, Lysinibacillus fusiformis; identical to SEQ ID NO: 433

SEQ ID NO: 484 - protein, 445 aa, Clostridium perfringens; identical to SEQ ID NO: 416

SEQ ID NO: 485 - protein, 577 aa, Ruminiclostridium cellobioparum; identical to SEQ ID NO: 458

SEQ ID NO: 486 - protein, 375 aa, Peptoniphilus indolicus; identical to SEQ ID NO: 447

SEQ ID NO: 487 - protein, 591 aa, Anaerobutyricum hallii; identical to SEQ ID NO: 419

SEQ ID NO: 488 - protein, 504 aa, Eubacterium yurii; identical to SEQ ID NO: 436

SEQ ID NO: 489 - protein, 514 aa, Unknown; identical to SEQ ID NO: 412
  Fusobacterium

SEQ ID NO: 490 - protein, 518 aa, Fusobacterium nucleatum; identical to SEQ ID NO: 429

SEQ ID NO: 491 - protein, 510 aa, Fusobacterium hwasookii; identical to SEQ ID NO: 454

SEQ ID NO: 492 - protein, 476 aa, Fusobacterium necrophorum; identical to SEQ ID NO: 452

SEQ ID NO: 493 - protein, 514 aa, Fusobacterium periodonticum; identical to SEQ ID NO: 456

SEQ ID NO: 494 - protein, 514 aa, Fusobacterium periodonticum; identical to SEQ ID NO: 427

SEQ ID NO: 495 - protein, 606 aa, Pseudoleptotrichia goodfellowii
MSEKIEIRMSNWLFNAGLLGFINVLENSNEEIRINDEKRSIEFSPKVLENFEYKYFDFLILRYNEILPSTRILRFQENLEKIENFKNSEKENEFISKNIKELLQEINYIKNKKYNNINIEKITFEKFEATKKNIKKLDESKYEIKELKENLKNITEIIKIIEENRNSFQLEDIKTIVRYGWEGIAFLDNANIAIRRKNGIDIGSIYKIYQDFFIKDIQEYIQKDKSKFEGQCSISNAPLPIPYDKKENKNYNKTIQFLGDFFNPNDKKSNVWNFENDIYVSPIVYLIYSCVPAGFIYSNYNSKGSGKGIFINLNYNITQLKKVNNGIFSNIFEKNINEEDKLYRNIFKKFELGNQNYKYDISDIQVIKTFERREIPKKSYPKYRFNILSKRILEFIQKNLNKINSFFGKYYVFKDEKDNPKWDTTVYLYKDIIERLLENRDLFLYIDKLCYVKISERYKYNYSNKNLLDLIYINMNNMWRFRDMKDKVEKSEKEIENEQLTYKDINTIKNNAYHFREKYNKVSNNEDKIKGLQYRLQNALRTNNVDLFMDILISAHAYAGKEIHKLFLKALDNDDDFKTLGYAFLIGLLKGDKEENTNNKQVKGVE

SEQ ID NO: 496 - protein, 610 aa, Caldalkalibacillus thermarum; identical to SEQ ID NO: 446

SEQ ID NO: 497 - protein, 532 aa, Sulfurihydrogenibium yellowstonense; identical to SEQ ID NO: 421

SEQ ID NO: 498 - protein, 594 aa, Bacteroides pectinophilus
MDSVLKGGSVLGKYLITPGDFLKNAGISGMEYMLKMSGARENIDYGIKEQGTVLEDIAEYEYGLWLDVDYAMQADWTGLFFGACVEYYESSTVYRGVLDRIEAILHKIIAGEWKADSNDRDNLKYINDKLLSNSYKSGFDNIRDRVDSAETYIILQNNKLNSRMEEGELKERLEELRTFLNQPICRETFVMKSVVYNYINRFWDGKCFLLRANAKKDMRELFDQDFVKPFKEYIAASHDKDKDMCIDCARPMGNKEKVSIAFMKDMADDLARKKSAFWNCKVDAFLCPACAFVYALSPLGFTLLGNRFAFINTNDSIKGLLTANDKERRNETESDKSEDERYTQWFARMLKRLLDCKLKELSGVQVIIRGTQADDKYNFAVISTDALRIFREKRVQSALEYFGRHPYVKIGAEYINIHESVIMNVIKYKSQTALLDKILKTTFDNPGCISSAFWVYMVMLWSNIVTGNKENGGNVEMNRVAVMNSGFALRAALLAEKGAKDDECLRGTLYQLMNALSTKNAGRFLDIVMRLYSTCKVSSNAEQAGRLMIPSGFVRIINSQDAFEEYGYAFVLGLKGCNMNKKNNDNKEENKEEA

SEQ ID NO: 499 - protein, 553 aa, Clostridium sp.; identical to SEQ ID NO: 413

SEQ ID NO: 500 - protein, 514 aa, Fusobacterium periodonticum; identical to SEQ ID NO: 420

SEQ ID NO: 501 - protein, 562 aa, Fusobacterium; identical to SEQ ID NO: 440

SEQ ID NO: 502 - protein, 474 aa, Fusobacterium gonidiaformans; identical to SEQ ID NO: 441

SEQ ID NO: 503 - protein, 514 aa, Fusobacterium periodonticum; identical to SEQ ID NO: 428

SEQ ID NO: 504 - protein, 476 aa, Fusobacterium necrophorum; identical to SEQ ID NO: 442

SEQ ID NO: 505 - protein, 504 aa, Peptostreptococcaceae bacterium AS15; identical to SEQ ID NO: 453

SEQ ID NO: 506 - protein, 569 aa, Acetomicrobium hydrogeniformans; identical to SEQ ID NO: 426

SEQ ID NO: 507 - protein, 486 aa, Lachnospiraceae bacterium oral taxon 500; identical to SEQ ID NO: 445

SEQ ID NO: 508 - protein, 314 aa, Lachnospiraceae bacterium; identical to SEQ ID NO: 444

SEQ ID NO: 509 - protein, 567 aa, Lysinibacillus fusiformis; identical to SEQ ID NO: 457

SEQ ID NO: 510 - protein, 517 aa, Fusobacterium sp. oral taxon 370
MKYDIDKNEYGFDTAISASDWKYSAAITGLIYYFKELEKKYEIKKITIDEITDSYLLYNKENINEENYLDFIEKFYSKYSEDTLAHKKLENQLKHSKEFTPEIIKSIKENMSANTVLKKVFSKTKFDGTNKDEVLKLLDENRHSIIKETFRNKKDLYDNYCQTSRLLEKGDNSPCRLKGYYFDPNRKSKATGYNFVSSSVDYFDDEIFDFIPFAFTGSSFETIFLNDNLDLEILENMNYKLREYFSEEKENETERLKSLKQEKAIKEKKNEETEGNQNSVPLKKLFLNILQKKVDYIKYGMEIIYKNRDKEYFETWYLRNESIKVLKEIEDFSKLDIRIKITDKYYFNLLDEVFSAVLNLSLLTNSILYLLKDRESFIKIDTTRENLSKLFKYNYAINELIKVNQIIRNGGKEMDENLKKSIKACSIAVVKKFIKENSLNKLASYRQKLLSSVVAKNHKRILDVLTQLSVYSGVYFSFAFDYIENQTQNEDIIHYFILELDQSRLESKKNKENEDKQ

SEQ ID NO: 511 - protein, 480 aa, Peptoanaerobacter stomatis
MISTGNYGKYDTSLEFSDWRFSAAAVGIMKYLQYNDMDFYIYDYDDEENDYEYKKDAIYYNKKDILDENKYLDFAEHFFSDKFHHKRVIALLDSDNFDTEKIKKINDTLKANVIMKKIFANIKFNGENKDEIINLIQDNRYEIIKETYRNAKSMYANFCNINSIFSNSQEICRLLGYNVDLGKKKKSLGFNWNYDTYVYNDVFEFDYIPFAFTRTRDVFFINNNFNAKELLKSNENIDLDYFNDNEKKNIRKELFFSSSKNAKYIDYEVEIISKQRDYDYFETMFIRDDAIRIFNAIDDMKDENIVNALSNPCKYGKLDYLPILNMIVDSIINLLHLDPVIDKLLKDVENEHGYLISQLIRINILLYKENYETMENKGDKSNKIARVIATANEVNKKLRIDKSNKIISYKNKLISCLVFKDYDRFCSILLQLATYSSVSFGFAYDLFEDFEKNKNLAYAFVNALNFKELGQNKEENKNEK

SEQ ID NO: 512 - protein, 480 aa, Peptoanaerobacter stomatis; identical to SEQ ID NO: 449

SEQ ID NO: 513 - protein, 481 aa, Peptoanaerobacter stomatis; identical to SEQ ID NO: 455

SEQ ID NO: 514 - protein, 596 aa, Mogibacterium sp. CM50
MNGITIKNSDWLFNCGILGLYNILKHNNIDDSEDISLSQDELTFPVSRLENFEEKYFSYLIDTYEKTFSIHRITSFEDFLQNHEDSNFENFNTHSLDRLNSQIEQVKRYLKSNSYVSAYKMLDFGFDPIAKEKELKKVSLKKNETVFDKQSEIKKQMDILKETVEFFKRKEVRKYIGGKNAMYSIIKNAWSNISIMNPQNKNPDIYEEFSNYFVEPVKEYLDEIDSSRLKSKYRCVTCNAKIKNLDIDLSFMREIGFDVNRKTSHVWDFNNYVAICPVCRLVYACVPAGFTYLYNRGIFVNSSMDLQEIVRINQIIKKDVLQSSEGGTVIYRALQKQMSRKINETPGYELSDVQVIRFSHDQDSDNVSYTFNIITKFILKTIENCDKCFERIQNGRLSEGNATMYLYDEVMNRLVNNENQFLLIHKLIHYKLSIPDKAMYSMSTIENILKINAEYLREVGVMEKDDKNMIRIAKSHGYYLRDAYGDEKKDNSGNKADVKSNDISNETNVKAKGTGYNKKLGSIAYRMLNALKTNNKYAFMDTMINAHMYVQKPIPAIFAENLENDLKFKNIGYAFVTGMIGYTDEKKVDEKGNEEN

SEQ ID NO: 515 - protein, 439 aa, Listeria monocytogenes
MVNKYWFNWFSKYRWKKKNVRIDGQSIYFTADLLEDFETKYFNFFIQEYKETLSWYKIVSYKEKMEQFRIDEFASFDEVALGNLNKYMKDVVKFYLKKANYIKVFPLIDPSANVTKWLEKLNTINLTKKQKWDEVKADIIEEVKQTYTQLDLIIDFCASEKGLQYLGAKNLIYSVINKGWSGVSFLFKQTKFIDPYLDYKTTFVDPVLEYLDTDLSKAKYNCFNCNQPIKNLKLDLSFMNDVGFDTARKTAHVWDFNNDVATCPICRLIYSCVPAGFTYVYGEGMFVNDSYGVEELHRVNERMRNSILRFNKDGINSTNTYRALVESITMEHENNRRYELADIQLVRYENEHYRFNLLSKKMLHIVNDSKGILKSLIRCGYKEGNLNVNLYKEVIQHLMNNENLFTLIHKLIYYKQTSVNGLYYNMGHVSGILDINTKF

SEQ ID NO: 516 - protein, 93 aa, Listeria monocytogenes
CGKEFKEGYVKKKSENKISGITYKLLNSLKVNDKDGFMDTLLNSYSYLSMPIPDVFIKMFSNNEAFKSVGYAFMLGVGGEKTKKEDGGNTDEK

SEQ ID NO: 517 - protein, 528 aa, Hungateiclostridium cellulolyticum
MDYIKLSLADWLYNAGVVGLVNILKHANDEVSINGQELIIKTDVLENFEEKYFRYFIDTYEETMVFSKLINKIDKLLNMEMDESKEKEVGEDIDFIKTKLKNSAYKAIEGNIDLKRLEKPSKKVTTINSDFLLDLKDLLSKDKESILKSECTGYYDQKAKASKAPNAIIDKYLNTNMLDIELGISELKEYLNNKTKFNLCCFQCGREIRKIDKGLSFLNRMFFDTSRKTSHVWNFVSDIEICPICKIVYYCVPAGFTTVYGNGIYINDNQSVKSSENINFNIKHDILHNEESKGIYNAFGTMIKALHESINDSEKYELADIQVVRYEDEKYRFNLLSKNVLRVLYESKDELNSLIKTGFQEVKTYFRLYDEVMKNLLNNENLFILIHKVLVIKISSPKDAKYNESHIRSLIKVNLKYMKGVGYMEGTEKDIVKTASGAGYYLREAYKSKNSENKLNGISYRLLNALKTSNKNMFMDTILNCYLYTGKPVPTFITECLKDDNVFKTIGYAFVTGLIDGKKTENTDGGDK

SEQ ID NO: 518 - protein, 439 aa, Thermococcus zilligii
MLLLSGKGKPEELTEKDVENAVEFASKLYARKEWSSGYIHAMMLPNSGILMANPSMSKKRTPEEIKKNLLALLSEEEDPNAPVCEICGRKHSRQKPVYRSDFPLVGTGGVPNYFPSGRDGANICSHCLFLAQMMPLAAYRLSRVLIIHAYPYELMLEFHREAINDVKKSELASVARDFKRPENFLFKKLGEIGRKLEAGKLSGASITLYYFVNNNQGQEIDVIYIPNPILRFVALASQHDSAGWARIVSMGWNRGCAKRLAKKQEEIEKSCENDVYHRLLDGESVLHYFIDPQSRRANSSWRLLSFYCSEVLGLDENALEFVKRVADRIVETVEKLPDNKLSRRIRELERAEKLYQFEGFFIRIEKDRQELGIPGALMGFDDFARILTSYGEDLNVSWKTVKNLLLFRIYEKLHDRLMEASPEGAEEEEVEEEFEEGEE

SEQ ID NO: 519 - protein, 465 aa, Thermophagus xiamenensis
MKKTFQTIDYEWLTRTTGDPFADTGGYVIQYLSNIYPDKDIDWLIDYVTKIYVNDWDAKLNAFFLNSKITQPAYKGAKKISETISYFKALIEEKEKNEQGFCRITGRNVKLFNAGRDNSMMSGSGTFINFHHFFDSGLKLSKEVIIRMHFVPLGSLLLAGKVALLKSNDESLSYFFVEKNIENNLANIRNGIKEGVVKSEFKNPANAIFDFVDKSLSQFKRLEKKASLTLYHFTNFGASPEIEIYHLPATVFLFYSLCHKINYKQDWQNFVRAHYKNSKNKGAIYNRQDRTFNIEKKGKVESIDYDEYKTWTNSILDKLLNGQSLVPEFHQWSKKGNKIHFDIIRIYLQNIRNMKKETIDKLLELADFIIKDKSEDQIRKSINKLNGASKAHELRRFLLNLVEENYNNENEKPLITVKDYTDYLFSDSSNTGEIRDVLLIAIYQKMHELNLKIKLAEEITEEVEQ

SEQ ID NO: 520 - protein, 250 aa, Fusobacterium gonidiaformans; identical to SEQ ID NO: 443

SEQ ID NO: 521 - protein, 446 aa, Pyrococcus horikoshii
MFSWTGHPFVDGGLVALLLYSGKTRPEELTQEDIEKAIKFASELYSRKEWSSSYLHALLFPNSGLLMANPSMTKKRTPENIAKNLESLLQEKEDPSTPLCEICGRRHSRSKPVYRSEFPLIGSGGVPNYFPSGKDGANICSHCLFLVQFMPLILYRLPRLLLIHTYPPELMLELHREALNDVLLTRLVSSGRGYKRPENFLFTLLTEVSLKTEDEKLWENASITLYYFTNPNRGRPEMTIIHVPSTVTRFVAHAARHDRAGWERIVAMGWRKGRENEKVHSNEVYQKLLSGESILPYFINMTERKPNASWNLLFFYCTEVLGLNKEALEFIKEVGDRIVETLKELPDNKLSARVRELERSEKLYQFEAFFVNLEKLRQRLGLKGSLMTFDEFARLLTTYGEDLEISWRTVRNLLLFRIYEKLHDRLAKVEASEETEFYGAGEEVEE

SEQ ID NO: 522 - protein, 461 aa, Pyrococcus furiosus
MVLVQKLLLAMGGLLNMFSWTGHPFVDGGLAALLLYSEKTRPEELTQEDIEKAIKFASELYARKDWSSSYLHALLFPNSGLLMANPSMAKKRTPENIAKNLESLLNEKEDPNAPICEICGRRHSRSKPVYRSEFPLIGSGGVPNYFPSGKEGANICSHCLFLVQFLPLILYRLRRLLLIHTYPPELMLELHREALKDVRLTKLVSSGRGYQRPENFLFTLLTEVTIKTEREELWENASITLYYFTNPNRERPKMMIIHVPSSVTRFVAHAARHDLSGWKRIVAMGWKKGSDEKSSPNEVYLKLLNGESILPYFINVAKRRTNASWDLLSFYCTEVLGLDEKALEFIKEVGDRIVETLKELPDNKLSARVRELERAEKLYQFEAFFVNLEKLRQRLGLKDPLLTFDEFARVLTIYGEDLEISWRTVRNLLLFRIYEKLHDRLAKIEASEEAEFYGAGEEVEE

SEQ ID NO: 523 - protein, 517 aa, Fusobacterium nucleatum; identical to SEQ ID NO: 341

SEQ ID NO: 524 - protein, 490 aa, Thermococcus kodakarensis
MRTIRKEKRLDKFLTKSEEQKTQSKDTDTTTTSSLFTWTGHPFTDAGLVALLLLSGKKKPEELSKEDIENVVNFASRLYARKEWSSGYIHAMMLPNSGILMANPSMAKKRTPEAIKKNLLSLLNEKEDPRAPICEICGRRHARIKPVYRSDFPLVGTGGVPNYFPSGKDGANICSHCLFLAQMMPLVAYRLSRVLIIHAYPYQLMLEFHKEAIEDIKKSELASTARDFKRPENFLFEKLTEIGTKFEIGKLENASITLYYFVNNNQSQEMEVIYIPNPVLRFVAFAARVDRAGWKKIVSMGWNKGCAKRLSKKPEEIPKSCSNDVYSKLLSGGSILPYFIDFQNRKVNASWRLLSFYCSEVLGLDREALEFIKGIADRIVETVEKLPDNKLSRRIRELERAEKLYQFESFFIRVEKDRQELGIPEALMSFDDFARILTSYGEDLNVSWKTVKNLLLFRIYEKLHDRLMKASAEEVEAEENEEEFEEGGEE

SEQ ID NO: 525 - protein, 447 aa, Clostridium perfringens; identical to SEQ ID NO: 343

SEQ ID NO: 526 - protein, 546 aa, Caldicellulosiruptor saccharolyticus; identical to SEQ ID NO: 344

SEQ ID NO: 527 - protein, 497 aa, Roseiflexus sp. RS-1; identical to SEQ ID NO: 345

SEQ ID NO: 528 - protein, 554 aa, Alkaliphilus metalliredigens; identical to SEQ ID NO: 346

SEQ ID NO: 529 - protein, 582 aa, Bacillus cytotoxicus; identical to SEQ ID NO: 347

SEQ ID NO: 530 - protein, 501 aa, Roseiflexus castenholzii; identical to SEQ ID NO: 348

SEQ ID NO: 531 - protein, 492 aa, Herpetosiphon aurantiacus; identical to SEQ ID NO: 349

SEQ ID NO: 532 - protein, 500 aa, Chloroflexus aurantiacus; identical to SEQ ID NO: 350

SEQ ID NO: 533 - protein, 539 aa, Sulfurihydrogenibium sp.; identical to SEQ ID NO: 351

SEQ ID NO: 534 - protein, 462 aa, Chlorobium limicola; identical to SEQ ID NO: 352

SEQ ID NO: 535 - protein, 554 aa, Thermodesulfovibrio; identical to SEQ ID NO: 354

SEQ ID NO: 536 - protein, 558 aa, Dictyoglomus thermophilum; identical to SEQ ID NO: 353

SEQ ID NO: 537 - protein, 591 aa, Anoxybacillus flavithermus
MKVKLHMGEWMINMGLVGLYRVFEYGRKNGIISDEYKDSVTVKPWGIELDTDVLPQLPKAYFLYLLEEYSIARRECERLDSYIEQVKKEENFKNVVSSIKKSINDTGKKVLKYFPYPSLEDVLEKLKDVKKAEHVSQLIGYINEFKTIINDQKVNEKLTLNYFKPAILRSFFGQVSFLNVAKNNLDFDGHIEEFYKSYIVPVLNDLIFEQAIETSRSSEEMNAFLETHNDYQPFKQLKREVRKKTIEEIREYVRTNINKCLLFNERVAFYNFEEMVFSPIGVAKDNAFNFSWHFDSQQPKPLSSLAKLVLLFAPIGSTIYYKSEGINEQTERRLYAGFVQTDATFAEILQKNNHFSQLKKKREPFNKIVSQLVQSVKKESEYTVDHLFFLEFFSDYDSKKTHLHYYHLPMYLAHYFKQHADKLDYIKPYDYREQFVQYVLRGADPVYVIYNYLRDCIKNERGTIGPYIAVQERHRILQFKKGVRDMSTTDKRVSALFMQGREIREAIIRSSSSEKKVTSIAYRLLNAAKAGNRKNFMDTLLRIYMSADRPISPIFLNALHERDLDFATVANAFIAGLLANQYKEEQEEVQA

SEQ ID NO: 538 - protein, 562 aa, Listeria monocytogenes; identical to SEQ ID NO: 355

SEQ ID NO: 539 - protein, 500 aa, Chloroflexus aggregans; identical to SEQ ID NO: 356

SEQ ID NO: 540 - protein, 573 aa, Sulfurihydrogenibium azorense; identical to SEQ ID NO: 359

SEQ ID NO: 541 - protein, 567 aa, Persephonella marina; identical to SEQ ID NO: 360

SEQ ID NO: 542 - protein, 562 aa, Listeria seeligeri
MQAEIEVRANDWLINSGITGFLNIVGKENVRIDGQSLYFSTDILEGFETKYFNYFIKEYKETLAWHKIVSYKEKMEYYRAEEFASFDEKALDDLNKYTKDVVKFYLKKPNYIKVFPLIDPEANITEWLGNLTTITISKKQKFEEVKVEILESVKSTYNQIDAIIDFCASEKGLKYLGAKNLIYSVINKGWSGVSFLFKQTKFIDPYEDYKTTFLDPVFEYLDTDLSKAKYNCFICNQPIKTLKLDLSFMNDVGFDTARKTSHVWDFNNDVATCPVCRLIYSCVPAGFTYVYGEGMFVNDSFSIDKLLDVNVHMRESILHFNNEGINSNNPYRALVESITMEKEDKRRYELADIQLVRYENEHYRFNILSKKMLHILNDSKTILKSLIRCGYKEGNLNINLYKEVIQHLMNNENLFTLIHKLIFYKQTNANGLYYNMGHVAGILEINTKFLKEIDVMTNISQKQLWFVQSCGTEFKEGYYGKKSENKIAGITYKLLNALKVNDKDGFMDTLLNSYSYLAKPIPSVFMNVFSNDEAFKSVGYAFMLGVGGERTKKEDGGNTDEK

SEQ ID NO: 543 - protein, 493 aa, Thermocrinis albus; identical to SEQ ID NO: 364

SEQ ID NO: 544 - protein, 451 aa, Methanocaldococcus infernus; identical to SEQ ID NO: 365

SEQ ID NO: 545 - protein, 602 aa, Geobacillus sp. C56-T3; identical to SEQ ID NO: 369

SEQ ID NO: 546 - protein, 548 aa, Thermoanaerobacter mathranii; identical to SEQ ID NO: 367

SEQ ID NO: 547 - protein, 517 aa, Syntrophothermus lipocalidus]
GVDKAFSGPKKALRQVFPNSELDNPSNWKGRTPKEKEDNARRKFQDALRSELNKAKQCLELEEAGETCFACGERRPKIAMETRRKDKMPLFEGIVNFYPGFSHGVRVCGLCSLAVRFLPLSTMLAGNQNRLWFLHSQHLGLAATVARRYGWEHFDRLITGNKALDFYGSWETAGEAGTVVYLFCELLNSFPDQLRAIYRSGLPSTAYVFSNDNRGGFVQAIHVPNELLAFLAKLQIESKNAFKDFWEGLLKVRGDLREDERKTRAGFVRSISNRMIAGENIVGMCLTSDPPNLQGGWLGHRLYLQEVRGMAPEKLAILERLGISIAASEDAKKLVTELVTAQYHQLYGLLLGYVRKGWLSHQEFYFLLPPNAHKVAGEIRDVLLAVVYEWQHCQQEGKEFPRSTFDKAEASPDETLRRIQEIGRRLTNNLPNLQRWTKELTSARYAERIRGVYLNAVRHGAVGFEDYVFLAPLQDQRAMWLLRDYLLAFLFDVGRVELPEDEYPEFGADEVREIETF

SEQ ID NO: 548 - protein, 551 aa, Caldicellulosiruptor obsidiansis; identical to SEQ ID NO: 370

SEQ ID NO: 549 - protein, 601 aa, Bacillaceae; identical to SEQ ID NO: 371

SEQ ID NO: 550 - protein, 636 aa, Caldicellulosiruptor hydrothermalis; identical to SEQ ID NO: 372

SEQ ID NO: 551 - protein, 470 aa, Caldicellulosiruptor kristjanssonii; identical to SEQ ID NO: 373

SEQ ID NO: 552 - protein, 547 aa, Thermovibrio ammonificans; identical to SEQ ID NO: 374

SEQ ID NO: 553 - protein, 570 aa, Syntrophobotulus glycolicus; identical to SEQ ID NO: 375

SEQ ID NO: 554 - protein, 485 aa, Archaeoglobus veneficus; identical to SEQ ID NO: 376

SEQ ID NO: 555 - protein, 546 aa, Pyrococcus sp. NA2
MEIIEKESPLLEWTGHPFVDAGLVALLLIASKSKPEDLTKEDIEKAIDFVAELYARKEWSSSYIHGMIMPNNGIILANPGITGPISTAIKRAIKKERGLKFKEDTKEEIFKRISKNFDSLLAEEVLKFLESLSDKGESDIKNLDEFAKKIAKTVLSQPFVTKAIQRRIKNNLMELFEDILSESDSDGPLCIICGKRKAYTKKEAYRSVFPLLGSGDVPNYFHSANLRGAEICAHCIFLTQFMPLVSYRLPRVLLIHAYPYELMLELSREALKDVRKYKLASEARGFKRPENFLFRLIGEITRKIERDEIWENASVTLYYFTCNNQRQELDVIHVPTPALRFVAYANLVDPLGWKRIVSMGWKKQLSEEQFEEFERSGRLNEVYAKLLNNESILQFFYDSRNRRANASWRLLAFYCSEVLGLDKEALDFIRDVGDRIVETLKELPDNKLRRRVRELEGAEKLYQFEAFFVRLEKDRQELGIKNPLMTFDEFARILTAYGEDINVSWRTVRNLLLFRIYEKLHDRLMKMERSETGEGLDIYAEGGGEG

SEQ ID NO: 556 - protein, 604 aa, Parageobacillus thermoglucosidasius; identical to SEQ ID NO: 381

SEQ ID NO: 557 - protein, 482 aa, Pyrococcus yayanosii; identical to SEQ ID NO: 380

SEQ ID NO: 558 - protein, 583 aa, Lactobacillus ruminis; identical to SEQ ID NO: 383

SEQ ID NO: 559 - protein, 562 aa, Listeria ivanovii
MQKEIELRTNEWLQNAGIIGFINIIGKENVRIDGQTLNFSTDVLADFETNYFNYFIKEYKETLAWHKIVSYKEKMEYYRAENFASFDEKTLENLNKYVKDVVKFYLKKSNYIKVFPLIDPKANVEEWLGKLSPIKLSKKQKLEDGKVELLEEVKETYDQLDIIIDFCASEKGLKYLGAKNLIYSVINNGWSGVSFLYRQTKFIDPYEDYKTTFLDPVFEYLETDLSKAKYNCFICNQPIKTLKLDLSFMNDVGFDTARKTSHVWDFNNDVVTCPICRLIYSCVPAGFTYVYGEGMFVNDSVSIDKLYSVNEHIRESILHFNNDGINSVNPYRALVESITMEKEKQRRFDLADIQLVRYENEHYRFNLLSKKMLHILNDSKTILQSLIKCGYKEGNLNINLYKEVIQHLMNNENLFTLIHKLIFYKQMNVNGLYYNMGHVAGILEINTKFLKEIDVMTNISQKQLWFVQSCGTEFKEGYFGKKSENKITGITYKLLNALKVNDKDGFMDTLLNSYSYLAKPIPSVFMNVFSNDEAFKSVGYAFMLGVGGERTKKEDGGNTDEK

SEQ ID NO: 560 - protein, 529 aa, Hungateiclostridium clariflavum; identical to SEQ ID NO: 386

SEQ ID NO: 561 - protein, 483 aa, Acetobacterium woodii; identical to SEQ ID NO: 387

SEQ ID NO: 562 - protein, 562 aa, Listeria monocytogenes; identical to SEQ ID NO: 385

SEQ ID NO: 563 - protein, 428 aa, Thermococcus cleftensis; identical to SEQ ID NO: 388

SEQ ID NO: 564 - protein, 445 aa, Pyrococcus furiosus
MFSWTGHPFVDGGLAALLLYSEKTRPEELTQEDIEKAIKFASELYARKDWSSSYLHALLFPNSGLLMANPSMAKKRTPENIAKNLESLLNEKEDPNAPICEICGRRHSRSKPVYRSEFPLIGSGGVPNYFPSGKEGANICSHCLFLVQFLPLILYRLRRLLLIHTYPPELMLELHREALKDVRLTKLVSSGRGYQRPENFLFTLLTEVTIKTEREELWENASITLYYFTNPNRERPKMMIIHVPSSVTRFVAHAARHDLSGWKRIVAMGWKKGSDEKSSPNEVYLKLLNGESILPYFINVAKRRTNASWDLLSFYCTEVLGLDEKALEFIKEVGDRIVETLKELPDNKLSARVRELERAEKLYQFEAFFVNLEKLRQRLGLKDPLLTFDEFARVLTIYGEDLEISWRTVRNLLLFRIYEKLHDRLAKIEASEEAEFYGAGEEVEE

SEQ ID NO: 565 - protein, 560 aa, Gottschalkia acidurici; identical to SEQ ID NO: 389

SEQ ID NO: 566 - protein, 607 aa, Clostridium saccharoperbutylacetonicum; identical to SEQ ID NO: 390

SEQ ID NO: 567 - protein, 397 aa, Ruminococcus sp. SR1/5; identical to SEQ ID NO: 398

SEQ ID NO: 568 - protein, 563 aa, Desulfofarcimen acetoxidans; identical to SEQ ID NO: 363

SEQ ID NO: 569 - protein, 589 aa, Leptotrichia buccalis; identical to SEQ ID NO: 362

SEQ ID NO: 570 - protein, 601 aa, Geobacillus; identical to SEQ ID NO: 361

SEQ ID NO: 571 - protein, 546 aa, Caldicellulosiruptor bescii; identical to SEQ ID NO: 358

SEQ ID NO: 572 - protein, 591 aa, Anoxybacillus kamchatkensis
MKVELYMGEWMINMGLVGLYRVFEYGRKHEIISEEHKHSVTVKPWGIELDTEVLPQLPRAYFLYLLEEYSVARRECERLDDYIEQVKNEEQFKNHLTATKKVISDTGKRILKYFPNPELENIVDKMKEIKKYDHMDQLLEYIHAFKNIVNEEKINEKLTFNYFKAAILQSFFGQVSFLNVTKNGLDLDGHEEEFYKSYVLPVINDLQLECALRDSHSIEEISSLLEKQSEYQPFKQLKRAWKKKTLEEVQEYIKTEINKCLLFNERLAFYNFEEMVFSPIGVAKDNAFNFSWHFDSQQPKPLSSLAKLVLLFAPIGSTIYYKNEGINEQTERRLYAGFVQTDATFAEVLQKNNHFRELKKKREPFNKIVSQLVQSVKKESEYVIDHLFFLEFFSDYSSKKTHLHYYHLPMYLAYYFKQYADRLDYIKPYDYREQFVQSVLRGADPIHVIYHYLRDCIKNERSTNGPYIAVRERNRILQFKKGVRDMATTDKRVTALFMQGREIRDAIIRSSGSEKKVTSIAYRLLNAAKAGNRKSFMDTLMRIYMSTDRPMSPIFLNALHERDLDFATVANAFIAGLLANQYKEEQEEVQA

SEQ ID NO: 573 - protein, 582 aa, Aneurinibacillus aneurinilyticus; identical to SEQ ID NO: 459

SEQ ID NO: 574 - protein, 605 aa, Clostridiales bacterium oral taxon 876; identical to SEQ ID NO: 460

SEQ ID NO: 575 - protein, 559 aa, Blautia sp.; identical to SEQ ID NO: 402

SEQ ID NO: 576 - protein, 566 aa, Firmicutes bacterium; identical to SEQ ID NO: 407

SEQ ID NO: 577 - protein, 97 aa, Firmicutes bacterium; identical to SEQ ID NO: 406

SEQ ID NO: 578 - protein, 548 aa, Caldanaerobacter subterraneus; identical to SEQ ID NO: 461

SEQ ID NO: 579 - protein, 447 aa, Clostridium tetani; identical to SEQ ID NO: 409

SEQ ID NO: 580 - protein, 546 aa, Caldicellulosiruptor saccharolyticus DSM 8903; identical to SEQ ID NO: 344

SEQ ID NO: 581 - protein, 497 aa, Roseiflexus sp. RS-1; identical to SEQ ID NO: 345

SEQ ID NO: 582 - protein, 554 aa, Alkaliphilus metalliredigens QYMF; identical to SEQ ID NO: 346

SEQ ID NO: 583 - protein, 582 aa, Bacillus cytotoxicus NVH 391-98; identical to SEQ ID NO: 347

SEQ ID NO: 584 - protein, 501 aa, Roseiflexus castenholzii DSM 13941; identical to SEQ ID NO: 348

SEQ ID NO: 585 - protein, 492 aa, Herpetosiphon aurantiacus DSM 785; identical to SEQ ID NO: 349

SEQ ID NO: 586 - protein, 500 aa, Chloroflexus aurantiacus J-10-fl; identical to SEQ ID NO: 350

SEQ ID NO: 587 - protein, 539 aa, Sulfurihydrogenibium sp. YO3AOP1; identical to SEQ ID NO: 351

SEQ ID NO: 588 - protein, 462 aa, Chlorobium limicola DSM 245; identical to SEQ ID NO: 352

SEQ ID NO: 589 - protein, 554 aa, Thermodesulfovibrio yellowstonii DSM 11347; identical to SEQ ID NO: 354

SEQ ID NO: 590 - protein, 558 aa, Dictyoglomus thermophilum H-6-12; identical to SEQ ID NO: 353

SEQ ID NO: 591 - protein, 562 aa, Listeria monocytogenes HCC23; identical to SEQ ID NO: 355

SEQ ID NO: 592 - protein, 500 aa, Chloroflexus aggregans DSM 9485; identical to SEQ ID NO: 356

SEQ ID NO: 593 - protein, 500 aa, Chloroflexus sp. Y-400-fl; identical to SEQ ID NO: 350

SEQ ID NO: 594 - protein, 546 aa, Caldicellulosiruptor bescii DSM 6725; identical to SEQ ID NO: 358

SEQ ID NO: 595 - protein, 573 aa, Sulfurihydrogenibium azorense Az-Fu1; identical to SEQ ID NO: 359

SEQ ID NO: 596 - protein, 567 aa, Persephonella marina EX-H1; identical to SEQ ID NO: 360

SEQ ID NO: 597 - protein, 601 aa, Geobacillus sp. WCH70; identical to SEQ ID NO: 361

SEQ ID NO: 598 - protein, 589 aa, Leptotrichia buccalis C-1013-b; identical to SEQ ID NO: 362

SEQ ID NO: 599 - protein, 493 aa, Desulfotomaculum acetoxidans DSM 771
VNFQDRLNTYEENNFEEFDLKALEFLNVYIKDVKRYIKSNSYKAAYELIDSEVELLSFEKQLITIKEPKNQQRFDVDKSEIVNEVKRRFLLLQQIINYCASSEGRRYIGAKNAIYNIINNAWNGVSFLNSQTKEKNIYSDYKSYFVDTATGYLQSEKGKYKYNCFVCDAPIKDMSNDLSFLNATGFDVARKSSHVWNFQNDITICPLCKLIYSCLPAGIIYTYNRGIYINQTIKLKDAVRINNKIKSRILRSQDGSMRPIYHALVSVLHEQENDSAKYELADVQVVRYENESYRFNILAKPMLQIIVNSKKELDSLIRVNFIENGRNINVYDEVIGRIFNNQNLFTLIHKMLYGKLSDASKCYFNGSHVRNVLIINQLICSRLGGMKMDNTYLVKKSREAGESLRNKYFNKDSNHKLAGICYRLLNALKTTNENMFMDVTLNCYLYVNSQVPKVITDALGRGKDFSTMGYAFVSGLIDGQDGSGNKEKKAEGE

SEQ ID NO: 600 - protein, 493 aa, Thermocrinis albus DSM 14484; identical to SEQ ID NO: 364

SEQ ID NO: 601 - protein, 451 aa, Methanocaldococcus infernus ME; identical to SEQ ID NO: 365

SEQ ID NO: 602 - protein, 586 aa, Brachyspira murdochii DSM 12563; identical to SEQ ID NO: 366

SEQ ID NO: 603 - protein, 602 aa, Geobacillus sp. C56-T3; identical to SEQ ID NO: 369

SEQ ID NO: 604 - protein, 548 aa, Thermoanaerobacter mathranii subsp. mathranii str. A3; identical to SEQ ID NO: 367

SEQ ID NO: 605 - protein, 587 aa, Syntrophothermus lipocalidus DSM 12680; identical to SEQ ID NO: 368

SEQ ID NO: 606 - protein, 551 aa, Caldicellulosiruptor obsidiansis OB47; identical to SEQ ID NO: 370

SEQ ID NO: 607 - protein, 601 aa, Geobacillus sp. Y4.1MC1; identical to SEQ ID NO: 371

SEQ ID NO: 608 - protein, 636 aa, Caldicellulosiruptor hydrothermalis 108; identical to SEQ ID NO: 372

SEQ ID NO: 609 - protein, 470 aa, Caldicellulosiruptor kristjanssonii I77R1B; identical to SEQ ID NO: 373

SEQ ID NO: 610 - protein, 547 aa, Thermovibrio ammonificans HB-1; identical to SEQ ID NO: 374

SEQ ID NO: 611 - protein, 570 aa, Syntrophobotulus glycolicus DSM 8271; identical to SEQ ID NO: 375

SEQ ID NO: 612 - protein, 485 aa, Archaeoglobus veneficus SNP6; identical to SEQ ID NO: 376

SEQ ID NO: 613 - protein, 475 aa, Haliscomenobacter hydrossis DSM 1100; identical to SEQ ID NO: 377

SEQ ID NO: 614 - protein, 460 aa, Desulfotomaculum carboxydivorans CO-1-SRB; identical to SEQ ID NO: 379

SEQ ID NO: 615 - protein, 604 aa, Geobacillus thermoglucosidasius C56-YS93; identical to SEQ ID NO: 381

SEQ ID NO: 616 - protein, 526 aa, Flexistipes sinusarabici DSM 4947
MSDELIRIYTGDWYFNAGIVGFLRTICNNNFEKLSEFDNQDLYIGDNFLDFNPNILKYFKENFYKQLFLNYFNKTQYLAYINKALTHKNKDNSLNISKSKKEVDKFPFQGLWKTLDQSLESKNDFLEFYAKIESITKEQIYELIKNKDKASLEKLLGYLTNGIIGLSKIGQYINDSVDKKYKIKSKKNRFCISCQERKGKFDVSNAISNIIGFNSDNSNWIWGFDANKVKFCSVCSLIYISASVGLVFSKKGKNYNNCFYFVNHNGNINLLLKSYIQFRYQLEDIKSSFSIYPVMVKESVKFTKSTKAEKTLHNISFVEVKESGMGGQSTKGYNVYSFSMPEKLANFIDKNNQLIPKGYYKIDKSFFDIEENILKSTIEQTLGYKDIDKYIRIYISNTDGGRKFSPYKIIKYILRYINFIHGGNSMDMEKISKKGFANGKEIGNLFRSSERENQINSLVYQFLNDLKVANREKFLDKYLRVTISNGLESRFGNVEMNNKDAFLQFGYSFINGLLNTYQNEKGENNE

SEQ ID NO: 617 - protein, 482 aa, Pyrococcus yayanosii CH1; identical to SEQ ID NO: 380

SEQ ID NO: 618 - protein, 583 aa, Lactobacillus ruminis ATCC 27782; identical to SEQ ID NO: 383

SEQ ID NO: 619 - protein, 529 aa, Clostridium clariflavum DSM 19732; identical to SEQ ID NO: 386

SEQ ID NO: 620 - protein, 483 aa, Acetobacterium woodii DSM 1030; identical to SEQ ID NO: 387

SEQ ID NO: 621 - protein, 562 aa, Listeria monocytogenes M7; identical to SEQ ID NO: 355

SEQ ID NO: 622 - protein, 562 aa, Listeria monocytogenes J0161; identical to SEQ ID NO: 384

SEQ ID NO: 623 - protein, 562 aa, Listeria monocytogenes Finland 1998; identical to SEQ ID NO: 385

SEQ ID NO: 624 - protein, 428 aa, Thermococcus cleftensis; identical to SEQ ID NO: 388

SEQ ID NO: 625 - protein, 562 aa, Listeria monocytogenes SLCC2755; identical to SEQ ID NO: 396

SEQ ID NO: 626 - protein, 562 aa, Listeria monocytogenes serotype 7 str. SLCC2482; identical to SEQ ID NO: 396

SEQ ID NO: 627 - protein, 560 aa, Clostridium acidurici 9a; identical to SEQ ID NO: 389

SEQ ID NO: 628 - protein, 607 aa, Clostridium saccharoperbutylacetonicum N1-4(HMT); identical to SEQ ID NO: 390

SEQ ID NO: 629 - protein, 555 aa, Hydrogenobaculum sp. HO; identical to SEQ ID NO: 378

SEQ ID NO: 630 - protein, 740 aa, Hydrogenobaculum sp. HO; identical to SEQ ID NO: 392

SEQ ID NO: 631 - protein, 564 aa, Clostridium stercorarium subsp. stercorarium DSM 8532; identical to SEQ ID NO: 393

SEQ ID NO: 632 - protein, 569 aa, Clostridium stercorarium subsp. stercorarium DSM 8532; identical to SEQ ID NO: 394

SEQ ID NO: 633 - protein, 397 aa, Ruminococcus sp. SR1/5; identical to SEQ ID NO: 398

SEQ ID NO: 634 - protein, 562 aa, Listeria monocytogenes; identical to SEQ ID NO: 385

SEQ ID NO: 635 - protein, 562 aa, Listeria monocytogenes; identical to SEQ ID NO: 396

SEQ ID NO: 636 - protein, 562 aa, Listeria monocytogenes; identical to SEQ ID NO: 396

SEQ ID NO: 637 - protein, 516 aa, Thermococcus litoralis DSM 5473; identical to SEQ ID NO: 451

SEQ ID NO: 638 - protein, 447 aa, Clostridium tetani 12124569; identical to SEQ ID NO: 409

SEQ ID NO: 639 - protein, 456 aa, Methanosarcina barkeri str. Fusaro; identical to SEQ ID NO: 342

SEQ ID NO: 640 - protein, 447 aa, Clostridium perfringens SM101; identical to SEQ ID NO: 343

SEQ ID NO: 641 - protein, 348 aa, Thermococcus gammatolerans EJ3
METYQTPSVDGIFDLYVAYGYVEALVRGGAKEVTLIPRGTLEGGYYSVRGDGDFRSGLIGALKEMLSLHYAFGNYRYSREGVKVISDADFSAGANVNNTYWDSVPSRLRDVREKLKEGKKLGGKYPLPITLMPSAGKFIPKHMGVQGGNPLKIDPLNYALAWVGFHYYTPYIRYTKGTRTWVHIYQVAPQEELNLFEVLALKDLKKHFPHYYEANMSYLSNPRLALFYHILHTESLGAVEEVTRKFLLVRSYTLERDGNNQAIRSYGEEDLGKLMDFLWELKKRSTYHTVRFFDALLRKESEAVLAVIDAVINDRPEGLYQGLRIAKRAGITPPQSVVEGMEAFIDET

SEQ ID NO: 642 - protein, 395 aa, Methanocaldococcus fervens AG86
MIPIDGFTKEILMHGLSRIMVEDFDEIDNTTLAEIFKNYVYGFKEKLKNAGSSKLSRNDKESYKKTYQNWFNTIPPEEYTSLMLDIIEKTINLLEGNKIDAKKSLRAIKVGKNSVDFGIPYNGSYAILPAIIKQVEYYEFLSEFLTPTTGKKSMINLDPIWFSILAIGFLTCFAGYYGGKYYLMLKNDIERYYLAIKYGMEEEKYELLEILEDLEILTDINIQKRFSLEVEEIYELLLSMELAKKKASGKVFPITLYVIELSGNVYLAKNVLELDLRNSLNFMKKYIDRIKNYSMFESSDAKIPLEELLYLALKELKNPINEDNENLAYIMVKDLYRAINSGKVEILENTLYLLLRKGHSILSSKSSSKSKLNLEKTFKSFAKEGNIISILEGIL

SEQ ID NO: 643 - protein, 395 aa, Methanocaldococcus sp. FS406-22
MIPIDGFTKDILMHGLSRIIVEDVDEIDNSTLAEIFKNYVDSFKEKLKNAGSSKLSRNDKESYTKTYQKWFNINPPEEYVSLMLDIIEKTINLLEDNKIDAKKSLETINVGKNSVNFGIPYNESYAILPAIIKQVEYYEFLSEFLTPTTGKKSMINLDPIWFSILAVGFLTCFAGYYGGKYYLMLKNDIERYYLAIKCGLEEEKYELLDILEDLEILTDINIQRRFSLEVEEVYELLLSMELAKKKASGRIFPITLYVIELSGNVYLAKNVIELDLRNSLEFMKKYIDRIKNYFMFDTSDAKAPLEELLNLALSELKNPVNEDNENLAYIMVKDLYRAINSGKVEILENTLYLLLRKGHSIMSSKSKSKSKLNLEKIFKNFAKEGNVISILEGML

SEQ ID NO: 644 - protein, 416 aa, Desulfurococcus mucosus DSM 2162
MSPGEEGQHCKVSEIEIKVPPIQYPTIRSLVLNFLIELTSKSGGNYSFTGDTFVLRGDACATLREALLDVIDVFESRKNIDERGGYCPKLSSNRNDFDWVGNRIANEMGFQIEKDITICDFFVKLIKASAEIVSREPGVVAEELKSIRMDEGDIYLGRDESAQYPQLQVFKLEKYKYGKKYLSFTEFKGQMKISSIWYSILGAGWLLSFSGYLGSLLLAHIDEDAILSRLMLPGGDPGELLGALKEYTVLPLKEGYQPSHTEAYTLLLYLSIDPGKVDRLRNIPAKYSKIVFANTYVVVEDIGFDISPVYDGVELLIGKEEYAELRERIKEMLRCVLLDYARRPSKYCRDVWGDTSDLSAMVRYLWNIMSKMDPYTNAYRLIRASPPGKRNFRDPYIARKLLKWVDDIMRQGVVLE

SEQ ID NO: 645 - protein, 397 aa, Pyrococcus yayanosii CH1
MILEAIAKLPFEGLSRELMTLGLSWVVIDAGLSPNADDFADALENSMDTLEKRARMNSSRMSRNDRSSYNKLLSAWYGVKAPDTYTELFELAIREAVKLLRSGKLDPAKSLGSIKWDKNGTYLGQPYNGQYAISPAVVKQPEYYEFQSDFLKPTAGQKAQIYLDPLWLAILSTGFLTAFAGFIDGRYYLMTKPGIEAYFPDIEDILDSLLILTNAGIESRARLETEELYELKITMKLAEEKMNVLEEIYPVTLHLISLEGQVYTELKTLQLDLRELSNYLLAYVERIENYMAMGVNLKVKLKEDNIEVERYPLWALVNIAERELRKGIEGDRELLAYILVKDLYRAVNAGRKELIEDSVFRIFRQGRGLLEGTGKASGELRKVLRAFMQEHHLEVLV

SEQ ID NO: 646 - protein, 398 aa, Pyrococcus sp. ST04
MILEAIAKLPFEGLSKELITLGFSWIVMEAGLSPSAEDFADIFENSIENTLKKRAKMNSSRMGRNDKNSYDKVLSAWYGVKAPDTYIELFELAIKEAVKLLRSKKIDPTKSLGTIKWDNKGTYLGQPYNGHYAISPAVVKQPEYYEFQSDFLKPTAGQKAQIYLDPLWLSLLSLGFLTAFAGFIGGKYYLMTKPSIEVYFPDVEEILDGILALTDAGIESKARLDAEELYELKIAMKLAEEGRNVPEKTYPVTLHLISLEGQVYTELKTLQLDIGELSNYLATYIKKIENYMTMGVDLKVKLKEDNIEVEKYPLWALVDIAEKELRSGVNGDGEMLAYILVKDIYRAVNTGRRELIEDSIFRLFRQGRGLLEGTGKASGELRKVLRAFMQEGHLEVLM

SEQ ID NO: 647 - protein, 368 aa, Desulfurococcus amylolyticus DSM 16532
MSLVLYTPGHGLITDSLILHGIIRILAVAGVYNAKVERLGDRFLVKIDNNVNLNDVTSIFKNSELAQLLKSSAKLKFDVKLETPPLNKIFSLNIDKAHNNKWAENVYEILDGTRTSGLDLSSLTYYDHKSQLREGRGGKNKTLYLPMSSIYGKYTVKDYGAKFSQYKVCDTCFLLASLGLLYGAYALVARQGRDKRPLLMTIVPRDRMEARDLLVLQRLLEGYEEVNIKDIPILATPVYALSAGETLISLDSPAEVVTWKLSLTGNSQRSSQRSLDVVTLQFNTIVEFIARLKHEVPEWPRLVECLRTEDGYVILSDLTIALNYDRTPLRAYEVIREILSYAVKEARKGRRVCEELLHRHYKIANILV

SEQ ID NO: 648 - protein, 399 aa, Thermococcus litoralis DSM 5473
MLLEALSNYPYEGLTRELLALGMSWVVMDAGIEPDEEELADALEGALKSLGSRMKAHTSKMGRNDRSSFDKVLNAWFGRSAPETYGELFELVVTETIKLLRDGDIDPSESLSSIKIDKNGTYLGVTYNGEQAILPAIIKQPEYYERQSGFLSPTTGQKAQIRMDPLWFSFTALGFFTGFAGFIGGKYYLMTKPGIEGFWPYEVEDVIRNGLLQLTGAGASGRISLSTEELYEMKLAMKLAEEGRNVVEEVYPVTLHLISLERQVYTELKTTQLNLAGLSEYMTKYMRKIEAISIGGLPLLVELKEGNATVQKYPLWALLDVAEKELWKGVNGDGEMLAYIFVKDLYRAINSGRRELIRDAVFRLFRQGRALLEGSSRASGEFRKVMKTFMWQEHLGVLL

SEQ ID NO: 649 - protein, 375 aa, Methanocaldococcus jannaschii
MIIKGLRVEKEKLQSLQKFWRLRVMLFETPGYNEILDLYIAYGVVECLVREGVENLRFFPIGNKYCIVVEEPTNVNIKNRIEKGMLNALEDMLSLHKAIGKYISTKEDIKIISDVDFSAGANINNVYWDGIPKTLEKIKENIKKGKLSTKSKNTVPLTLMPAAGKYMPKIYGVKGGNPIKIDDSNYALAWIGFHYYAPYINISDNRATYIHIYAIKPLEELGLIEILALKDLKKKINNYQLGKYKFFVNKKLALLYHLTHTESISALEIVTKKNFSVVSYTLENVDNNQAIRSFGEYDLSKLMDFLWYLKATDFYNTIQFVDNILRGDLEVSLTFIDGILYDDLDAVYSAIRKLKSVRISPLIIQSILEWFGNFY

SEQ ID NO: 650 - protein, 399 aa, Thermococcus litoralis; identical to SEQ ID NO: 648

SEQ ID NO: 651 - protein, 412 aa, Thermococcus zilligii
MLSEALAKYPYEGLTRELLSLGMSWIVMNAGIEPEPGELADALEGALRSLGDRAKVHTSKMGRNDRQSFDNVLKVWFNRSAPETYGELFELVIKETTKLIREGRLDPRESLKAVRAEKDSTYLGVDYDGETSKPPGKKVTADHYAILPAIIKQPEYYERQSGFLAPTTGGKAQIRLDPLWFSLVALGFFTGLAGFIGGKYYLITKPGIEGLWPYEVEDVIVNGLLAITEAGIKGRVSLSTEELYEMKLAMKLAEENRSIPEEVYPVTLHLISLEGQVYTELKTVQLDLSGLSRYLNAYVERINALSTGGVPVRVELKEGKETVQKYPLWALAEIAEKELERGVNGDGEMLAYIFVKDLYRAINSGRKELIEDSVFRLFRQGRALLEGSGRASGELRKVLRAIMWQEHLEVLL

SEQ ID NO: 652 - protein, 393 aa, Pyrococcus abyssi
MILEAIARLPFEGLSKELITLGFSWIVMDAGLSPNPNDFADAIENSMDTLKKRAMMNSSRIGKNDRNSYDRVFSKWFGVKAPDTYMELFELVINETIKLLRSGKIDPAKSLQSITRNKNGTYLGQAYNGEYAITPAVIKQPEYYEFQSEFLKPTAGQKAQIYLDPLWFSLLSMGFLTAFAGYIRKRYYLMTKPGIEVYFPDVEEILIDGIIALTDAGISSRARLDAEELYELRIVMKLAEEGRKVPEMTYPIALHISLEGQVYTELKTLQLDLKELSNYLATYVKKIENYRVMGVDLKVKLKEGEKYPLWALVDIAEKELNKGVSGDRELLAYIFVKDLYRAVNSGRKELIEDSIFRLFRQGRGLLEGEGRASGELRKVLRVFMQEDHLEVLI

SEQ ID NO: 653 - protein, 377 aa, Pyrococcus horikoshii
MSWVVMEAGLEPDKEELIEALEGALNSLESRTRINTSKIGRNDRNSFNDVLQAWFNRSTPETYGELFELVIRETIKLLKEDKIDPSASLSTIKTDKNGTYLGVVYKEKQAILPAILKQPEYYEYQSSFLKPTTARKAQIRMDPLWFSFMALGFFTSFAGFISGKYYLITKPGIEGFWPYEVEDIIEHGILPLTSAGASGRISLTTEELYEMKLAMKLAEEEKNIIDEVYPVTLHVISLEGQSYTELKTIQLNLIELNNYITEYVKKIRASKVGSMSLLVELKEGGATVKKYPLWALVDIAEKEVWKGVKGDEEMLAYIFVKDLYRAINSGKKDIIQDSIFRLFRQGRALLEGSSRGSGEFRKVMRTFMWEEHLGVLL

SEQ ID NO: 654 - protein, 399 aa, Thermococcus kodakarensis
MLLEALSSYPYEGLTKELLSLGMSWVVMDAGIEPDEEELADTLEGALKSLGSRVKIHTSKMGRNDRSSFDKVLKAWFGRSAPETYGELFELVVTETIKLLRDGNIDPGESLSTIKTDKNGTYLGIAYNGEQAILPAIIKQPEYYERQSGFLSPTTGQKAQIRMDPLWFSFMALGFFTSFAGFIGGKYYLMTKPGIEVFWPYEVEEIIEKGILPLTGAGASGRISLSTEELYEMKLAMKLAEEGRDVIEEVYPVTLHLISLEGQVYTELKTTQLNLTGLSEYMEEYVNRIESASMGGLPILVELKAGNATIQKYPLWALVDIAERELWKGVNGDGEMLAYIFVKDLYRAINSGRRELIRDAVFRLFRQGRALLEGSGRASGEFRKVMKTFMWQEHLEVLL

SEQ ID NO: 655 - protein, 395 aa, Methanocaldococcus sp. FS406-22; identical to SEQ ID NO: 643

SEQ ID NO: 656 - protein, 397 aa, Pyrococcus yayanosii; identical to SEQ ID NO: 645

SEQ ID NO: 657 - protein, 398 aa, Pyrococcus sp. ST04; identical to SEQ ID NO: 646

SEQ ID NO: 658 - protein, 395 aa, Methanocaldococcus fervens; identical to SEQ ID NO: 642

SEQ ID NO: 659 - protein, 348 aa, Thermococcus gammatolerans EJ3; identical to SEQ ID NO: 641

SEQ ID NO: 660 - protein, 395 aa, Methanocaldococcus fervens AG86; identical to SEQ ID NO: 642

SEQ ID NO: 661 - protein, 395 aa, Methanocaldococcus sp. FS406-22; identical to SEQ ID NO: 643

SEQ ID NO: 662 - protein, 416 aa, Desulfurococcus mucosus DSM 2162; identical to SEQ ID NO: 644

SEQ ID NO: 663 - protein, 397 aa, Pyrococcus yayanosii CH1; identical to SEQ ID NO: 645

SEQ ID NO: 664 - protein, 398 aa, Pyrococcus sp. ST04; identical to SEQ ID NO: 646

SEQ ID NO: 665 - protein, 368 aa, Desulfurococcus fermentans DSM 16532; identical to SEQ ID NO: 647

SEQ ID NO: 666 - protein, 399 aa, Thermococcus litoralis DSM 5473; identical to SEQ ID NO: 648

SEQ ID NO: 667 - protein, 266 aa, Archaeoglobus fulgidus DSM 4304
MIGYLVDVEFVWGFQARIAGLSKTSPSFYYPPPTTFLGAVAEAIAKDKGIGEQRGKEIISELGENLLAIGWKALNCTPLRYSDINRILAVKITSGVLYPNPQDLAKSFDSPARGKTILSSLNDEAPKIRWFLVFKEEAVEEKILWKIHRIGSKESRVAVVDVKKVKVTQKDGLISTDYSFPAEDGVELRGILSQRWEFEVYLNPFEVKYSEKENPLMSYISGKKAVLYRIPIMTSIFSTPECLVEVGGDFKAYEAGGEVVIGRCSK

SEQ ID NO: 668 - protein, 245 aa, Methanocaldococcus jannaschii DSM 2661
MIMEALVALLRFPFYSFGKQSYQVRQSLLLPSPSALKGALAKGIILLGGKKGKSLDEIAKKTVEELENKLIYVGAKPYKSSIIKTPILLKRLRNLEDQKNPEKSDAMRREYVFAREILAIYVFRRKLSEEEKDLMLKAVYLIDQLGDTECVGNVIKTEWVEVKEEKAPLKTYVKFKKVSKMSINGGIIENMLETPNFGNKVKEEPYLLPLIEKRYRRSSYYVESDRIFDGNYKIIAFDEVIGLWI

SEQ ID NO: 669 - protein, 263 aa, Saccharolobus solfataricus P2
MKGVVIFGIHHWGFSVRVPRTSAGGSSYIVPPITTILGALSRGYCSDYAVKNNVSCTKEFIDKFSSDLFWVTYGTEEHMLMPYSDLLREERVPYRQSKNRSLDHVSDWFGVSAFGKVYCENVNFSILLLLNKENSEFWSKLGWQIISLGTKESLVTITDVKVVDVEESSDEDIYTIYYIPAECLTNTEEFEVVNMPVKSVYELSSKPSIGVFSNFLVPRKTPFIGGKVKVKKSNVRGDICKVYKMADKYVITFKEGLEKWYSK

SEQ ID NO: 670 - protein, 240 aa, Saccharolobus solfataricus P2
MIYSKVFLKLHWGFSVVKPLAAKAKPGFYLPPPTTLIGALSYGKFRGVDNINLGNVYGSPAYNFRNIMATARLESEGVYTEDIIRNVISYFQRKERRENPRYIYGVIPTGKVYIPNGRLVVVYVTDSISKEELEKLCWSITRIGCKECLASVENVEVGEAKKVSGRVKTRYYFRDTVKVVGRKEFLEYVTFWEENGYIWGKEGSPVRYILPITTYPLASKEVEVEAKEAYEVGGEYVVFS

SEQ ID NO: 671 - protein, 240 aa, Saccharolobus solfataricus P2
MIYSKVFLKLHWGFSVVKPSAAKAKSGFYLPPPTTLIGALSYGKFRGIDNTNLGKIYGSPAYNFRNVMATARLESEGAYTEDIVRNVISYFQRKDRRDNPRYIYGVIPTGKVYMPNGTLVVVYVTDSMSKEELEKLSWSITRIGGKECLVSVENVEIGEAKKVSGRMKTRYYFRDTVKVVGKKEFLEYVTFWEENGYIWGKEGGPIRYILPVATYPLASKEVEVEAKEAYEVGGEYVVFS

SEQ ID NO: 672 - protein, 230 aa, Pyrobaculum aerophilum str. IM2
MNILLVKLRLPLFSIKHYETYQVAATLPFIPPSTVVGALVQAAARGGLCEGDCLAEVRGWIYKARDVAAPTVKFPVVLKRARGVLEEGKLPLSGEELGGYFDAMVREYAYVAEKAVLVVPSAEAHIGRLEKALWLLERVGDTESYVSVRGVEVLNARPCGAGEVDVAVKLAKVAGGAHLVVRAGDEDGTLSDFAVPLATGGKGYYTPTKIAVKSDVFCAGDVAFPAGHDW

SEQ ID NO: 673 - protein, 263 aa, Pyrococcus furiosus DSM 3638
MDILLVCLRFPFFSVAKRSYQVRTSFLLPPPSALKGALAKGLILLKPEKYASSSLDEAALKAIKEIESKLVDIKAVSVAPLSPLIRNAFLLKRLRNLESGSNAEKSDAMRREYTFTRELLVAYIFKNLTQEEKNLYLKAAMLIDVIGDTESLATPVWASFVKPEDKKAPLAFSAPYTEIYSLLSSKIQAKGKIRMYIEKMRVSPEYSKTKGPQEEIFYLPIEERRYKRIVYYARTIYPPEVEKALTVDGEVLGIWIPKNSSES

SEQ ID NO: 674 - protein, 127 aa, Chelativorans sp. BNC1
MLTDEKNGGNTGENSPAGGDGLAKRFDASARPVLTVDVAKYQVLLDDPSLSEAQKEEFLRALWSIVVTFVELGFGVHPLQEVCGQDSESSFPSAKKAFDQVESKKSVETQDDRDSGPTAGLKDHEYT

SEQ ID NO: 675 - protein, 277 aa, Hyperthermus butylicus DSM 5456
MKPLMLVSKVELAWGFSVRYAGASAAQPALPIPPPTTIVGFYAEPLARLLGLAEYRGFPAKRPCSPAALLAEHTLAASAGLNSDSRSGLVVHSDLSHVATLPYQRRRKTGWEKLAFAAQAVGAAYGPAARLYLALVVDVEGLSRKLGETVESIISALAWAGWRLGSKEGLVSVIHAEAVEPVTLTGGVFETILYQEGGLVEPFSKVELIRDIYMWRLDPKLLCGGEAIPDYILYHIPAAASSTSSILLPPPSTELPGFSPRSRVYCHPSKPLCVAGR

SEQ ID NO: 676 - protein, 292 aa, Staphylothermus marinus F1
MHAYKLRIEFLWGHQSRIVGLSKTNPSYYYPPPTTILGAIAEPIAKEYKLGENSASVRKLLASLSANLLALGLKPVNVLPIKYMDINRILAVKLTGKTLGKKNVVLPYPNPKDLDRSFDAPARGKTIFAPLDFDPPKIDILIVFKENQIYVDRVKVDLDVDLLWDIHRIGSKESIVSVMDVKESRKINIERGISITDYSFPLDRGIKVLDIIDKGWIYETYINPYKLKEENKSILDHYLSSNLLLYMVPIKLTISSEPSVKIIVQEPFAIYNVFFNSNEERVVGVSPKLWPS

SEQ ID NO: 677 - protein, 296 aa, Pyrobaculum arsenaticum DSM 13514
MGGNYLLVKLVFHSPYYSYPAGAEGGRGPTLPPPSTLIGALMAAYLRLRGPREGDPPTSLVNSVKYAYFWAPSYSTTASLNTHFTWLTQRKSRLELIEAMKILGKTVEGTATEEELRKAVSAIKNYGRGPRDLQPEHLKSDPHSWIAKLRAMLFSPWPTYETYFWGDAYALYIIEDEELKEAGNYIFRVGPKETLVSSRVVEVRSAREVKGSVATRFYIPKEATVSACRRVEHMLTSLGAPVELIYIERRAKEFCLPTPYTGELEYYDPAPGWVGVELETDEGVFQVVVPEGYAPR

SEQ ID NO: 678 - protein, 241 aa, Metallosphaera sedula DSM 5348
MPPSELTYSKVWVRLHWGFSISYPTASKEKRATLLPPPTTLVGALSYGKFRGFDVSGDMKGSPAISILDRVKVASARLEGQATYVEDIVRNVVSYFQKPERRADRKYTYNVVPTGKVYSPGSLLKLVYVTTFPEDELRRLSWSITRLGVKEGLVSVEDVEVGRAEVVKGRVRTGYYFKASIPHLMGDAVYVDFWEGGLVWGHEAELVRYVIPMKQVPLRSSELEVEAQEAYKVGDEYVVLS

SEQ ID NO: 679 - protein, 293 aa, Ignicoccus hospitalis KIN4/I
MMGLFFELELAWGFSVRYPMSSAAQLAPPLPPPSTAIGALAEALAITLGLGETIKVAGKAAKRGRKRSKEGLCSTAYAVFKATKGAAFALSPESPVGVALKSEINRLLQAPYLNPGNVHEGDEINKVRMFGVQAITSAYAPKGLLWMMVVLDEKELVGELRAIRKDLKGEEVMDALERVTIRRIGVKEGIVSTKKKEVGEVTKEEEVESCFYARKGSVVRKLGKAVPIVMWRPGRETFCGGDPKYDVYLVPAGPLSDQFFLTPPRGVKGKCEDSLVIKKAWCLNKYCVEGGET

SEQ ID NO: 680 - protein, 278 aa, Candidatus Korarchaeum cryptofilum OPF8
MMNTSAFIVDVEFVWGFQTRIAGLSKTSPSFYYPPPTTFLGALGESIARKLGVGESAGRGIIASLGRELLALGIRPLNCVPLKYEDINKIIAVKLTSGIPYPDPRNMASSYDSPARGKTVMVSLDENSPILRFLLVFRKDKIDLRGKALELDEDYFWRIHRLGSKESRVSVIDVRRKDGINAEEGKIISKYSFPVMKGVQPLEELQRKWLYEAYINPRDIEYSERVNPVLTYMESRSLIPFRIPILVVRTEEPEFIVEVREPSAYYRVNGEVVIGWRG

SEQ ID NO: 681 - protein, 81 aa, Mycobacterium phage Myrna
MMDGALAWDIQKWNSEQDRPTLSTAQVEGLATYLSDKGWGAAKRDVSLGDVRGLVEKGRKLVDDLLGEPRRADAPGQSTHR

SEQ ID NO: 682 - protein, 302 aa, Desulfurococcus amylolyticus 1221n
MIEPQDIRVFYVRASFSWGFTVRYKGVSAAQPSYPIPPPTTVVGAFGYPLARLLGLDPYDKGVEKYGKGFLISPTMKAFLESTITASAALVRTKGSSGGISIYLEPGRIIGLVYRTGGQLSDIKKAKIHTSEFYGKVLGLMQPVQAVGSAYAPGLVLDLLWIVDAGKLVKELGVSRESFEKAASKAVYGVVRIGSKEGLISLHTAGYYNSVKILSAGEKFKTRFYVDARCVEPLDREYAFEIELPGIRYDTGRFYIAAQSASQNLIIPLPEISSPPWYRVLTNCKGFVAPISEEVVGVVLIE

SEQ ID NO: 683 - protein, 240 aa, Sulfolobus islandicus L.S.2.15; identical to SEQ ID NO: 671

SEQ ID NO: 684 - protein, 263 aa, Sulfolobus islandicus M.14.25
MKGIGIFGIHHWGFSIRVPRTSAGGSSYIVPPITTILGALSRGYCTDYAVKNNVSCTKEFIDKFSSDLFWVTYGTEEHMLMPYSDLLREERVPYRQSKNRSLDHVSDWFGVSAFGKVYCENVNFSILLLLNKENSEFWSKLGWQIISLGTKESLVTITDVKVVDVEESSDEDIYTIYYIPAECLTNTEEFEVVNMPVKNVYELSSKPSIGVFSNFLVPRKTPFIGGKVKVKKSDVRGNICKVYKVADKYVITFKEGLGKWYSK

SEQ ID NO: 685 - protein, 240 aa, Sulfolobus islandicus M.14.25
MIYSKVFLKLHWGFSVVKPSAAKAKSGFYLPPPTTLIGALSYGKFRGVDNTNLGKVYGSPAYNFRNVMATARLESEGAYTEDIVRNVISYFQRKERRENPRYIYGVIPTGKVYIPNGMLVVVYVTDSMSKEELEKLSWSITRIGGKECLVSVENVEIGEAKKVSGRVKTSYYFRDTVKVVGKKEFLEYVTFWEENGYIWGKEGGPIRYILPITTYPLASKEVEVEAKEAYEVGGEYVVFS

SEQ ID NO: 686 - protein, 240 aa, Sulfolobus islandicus Y.G.57.14; identical to SEQ ID NO: 671

SEQ ID NO: 687 - protein, 240 aa, Sulfolobus islandicus Y.N.15.51
MIYSKVFLKLHWGFSVVKPSAAKAKSGFYLPPPTTLIGALSYGKFRGIDNTNLGKIYGSPAYNFRNVMAAARLESEGAYTEDIVRNVISYFQRKDRRDNPRYIYGVIPTGKVYMPNGTLVVVYVTDSMSKEELEKLSWSITRIGGKECLVSVENVEIGEAKKVSGRMKTRYYFRDTVKVVGKKEFLEYVTFWEENGYIWGKEGGPIRYILPVATYPLASKEVEVEAKEAYEVGGEYVVFS

SEQ ID NO: 688 - protein, 263 aa, Sulfolobus islandicus M.16.27; identical to SEQ ID NO: 684

SEQ ID NO: 689 - protein, 240 aa, Sulfolobus islandicus M.16.27
MIYSKVFLKLHWGFSVVKPSAAKAKSGFYLPPPTTLIGALSYGKFRGVDNTNLGKVYGSPAYNFRNVMATARLESEGAYTEDIIRNVISYFQRKERRENPRYIYGVIPTGKVYIPNGMLVVVYVTDSMSKEELEKLSWSITRIGGKECLVSVENVEIGEAKKVSGRVKTSYYFRDTVKVVGKKEFLEYVTFWEENGYIWGKEGGPIRYILPITTYPLASKEVEVEAKEAYEVGGEYVVFS

SEQ ID NO: 690 - protein, 240 aa, Sulfolobus islandicus M.16.4; identical to SEQ ID NO: 685

SEQ ID NO: 691 - protein, 267 aa, Thermococcus gammatolerans EJ3
MDVLLVRLRFPFYSVARRSFQVRTSLLLPSPSALKGALARGLVLVKGIKGENLDEVARKAVKDIEDKLVDVRAVEVAPLTPMVKTAFLLKRLRNLEPIRDKKKLKTPEDWEKAMTKDDAMRREYVFTHELLVAYVFKGLSGEEKELYLKAAMLIDTIGDTESLATVVWADFVSPSEKSAPLAFYAPYQEISQALANKVRNGGAVKVHTETMLVSPDYGSRREEVFYLPVEEKRRKRVVYYERTTKVPDVENAIELNGEVLGLWLPGN

SEQ ID NO: 692 - protein, 240 aa, Methanocaldococcus fervens AG86
MPYFLIIEAKPSGILSLRSSPQSKMRSAFRYPTPTSLIGAISYPLFHVKGLRKEVIDGDRCSVEILRNLFKTVAVKVEGNPVIYGSILRINRFHRKEVESAITSLPMSIMYGEKDFKIKIAYIFNDEILESSEYTIKDFKRAGWGIVRIGSRESVVSVENVVTGKSEIKEGDEVETEYSFEFKNISDYEGRGLLQAVVDWREELTNYTNAKKMVVVYPIGKVKIFGDLRFIDANGEVILL

SEQ ID NO: 693 - protein, 263 aa, Saccharolobus solfataricus 98/2; identical to SEQ ID NO: 669

SEQ ID NO: 694 - protein, 240 aa, Sulfolobus islandicus L.D.8.5; identical to SEQ ID NO: 671

SEQ ID NO: 695 - protein, 262 aa, Ferroglobus placidus DSM 10642
MMGMKAFIAEVYFPLFSLKKPLAFQVADTNLLPSPSSLRGALAKVLAYFYSDNFSGGDPQEQIEEWMKSIEEIVPYTTSKPEASIIKGSVLLSRLRTLEQRGREDPRDAMRRGITFIPKLKACFIVDENKATNHLGNDALEKIKRAIYAIDRIGDTESLVCVSKVIGPLDIMQLSSVGEVNTITNIDFAGTLDSPVIDNMDFCFAYEATGRKYKKPRYSRTHFLPLTAEKVGKFVIYKPATYRVKVRKGSIYQIDDLKVVIG

SEQ ID NO: 696 - protein, 240 aa, Methanocaldococcus sp. FS406-22
MPYFLIIEAKPSGILALRSSPQSKMRSAFRYPTLTSLIGAISYPLFHVKGLRREVIDGDRCSVEMLKNLFKTVAVKVEGNPVIYGSILRINRIYRKDVESAITSLPMSIMYGEMDFKIKIAYIFNDEILDNSEYTIKDFERAGWGIVRIGSRESVVSVEDVVTGKSEIKEGNEVETEYSFEFKNISDYDGRSLLQAVVDWREELTNYTNAKKMIIVYPFGRVKVFGDLRFIDANGEVILL

SEQ ID NO: 697 - protein, 298 aa, Thermosphaera aggregans DSM 11486
MSQNIRVFYTSITLSWGFTVRYKEVSAAQPSYILPPPTTIVGAFSYPLARMLGLADSLPEDKAYKNGYLVSKTMKAFLDSTLAASAGVAGEGGLVMHQEPSKIHASIYKGESEADRMRAEPFTEKFYGESLPRIFPVQAIGATYAPGVKLYMTWVLDVDKLLKNLRENGVRVDEEDLDSAARQAVHGVTRVGSKEGIVAVDHDLTGYEKNPEIVNPGGKIRTIQYVPSECVDPEEIIPQITLPYLDYSPRLFYIPSESASNTLLKPYSLPTGKWLRVKHPCKAYAPREFKQEFTSVGI

SEQ ID NO: 698 - protein, 265 aa, Ignisphaera aggregans DSM 17230
MKVLLFEVKSLFYSYKAPIAYQVKASNMLPPPSALLGAVYRNYVRETSSSYSKDSLSEFLRSVAYAGFAVLPVDDRGFVSFRKFVVLLKHWRLEKDEEEPRPDAMLREYVYMHGRLVGVIAYNGLNNETLTKVVETIEYLGNSESLIGIRALESGLSVKSAEECGDGYMTQMISSSVNNLPRHGVIEQCGRVPRSPWGGRETADVCYVWNPLEPAGKDLYRPIRFGDIRTELLEDLRKKVACVESVALNARLVFTSAGFECLKRG

SEQ ID NO: 699 - protein, 241 aa, Vulcanisaeta distributa DSM 14429
MTRAFAVRLKMHGPITVQYPTLSTAGGSYMLPPPSTLIGALYFAHTARNGVYKEVEEFNNDECSPAYGWVKNGVVLDAVAIPVGKMAMTNTLLRLFNWTRSTKENPYTVGYMGLSYITELVAIYAVRDDMFNELKRSAWGIVRLGKKEGLVSVLEVSDVEVIAGTQERLIVNSYFPKDVASLMQYKYDIFMFPDPSSKNTYCGGKPAIKEYVFSEDGVEVGEINPNYKVVKYGDKYAILRW

SEQ ID NO: 700 - protein, 224 aa, Thermococcus barophilus MP
MKWLRLRIHFPSFYSYRIPDYSSQYALALPLIAPSTIKLALVATAIRISGKVSEGKRIFEYVKDAKVGIKLPKIIVVNSVFIKRLKKRKDQPGFQSSFGVREYVHFSGDLEIYLGFSKIGIPKELIIYAQSIRYLGTSDSLVYVKSVEWVDKEPADAIFPSELSKLPEGAIIYPVKDFAKKVTFEQINPYSSKKAGRPYEIKYYPILLSKRPREGKNWKLFVLS

SEQ ID NO: 701 - protein, 240 aa, Sulfolobus islandicus HVE10/4
MIYSKVFLKLHWGFSVVKPSAAKAKLGFYLPPPTTLIGALSYGKFRGIDNTNLGNVYGSPAYNFRNVMATARLESEGAYTEDIVRNVISYFQRKDRRENPRYIYGVIPTGKVYMPNGTLVVVYVTDSMSKEELEKLSWSITRIGGKECLVSVENVEIGEAKKVSGRMKTSYYFRDTVKVVGKKEFLEYVTFWEENGYIWGKEGEPIRYILPVTTYPLASKEVEVEAKEAYEVGGEYVVFS

SEQ ID NO: 702 - protein, 240 aa, Sulfolobus islandicus REY15A
MIYSKVFLKLHWGFSVVKPSAAKAKLGFYLPPPTTLIGALSYGKFRGIDNTNLGNVYGSPAYNFRNVMATARLESEGAYTEDIVRNVISYFQRKDRRENPRYIYGVIPTGKVYMPNGTLVVVYVTDSMSKEELEKLSWSITRIGGKECLVSVENVEIGEAKKVSGRMKTSYYFRDTVKVVGKKEFLEYVTFWEENGYIWGKEGGPIRYILPVTTYPLASKEVEVEAKEAYEVGGEYVVFS

SEQ ID NO: 703 - protein, 241 aa, Vulcanisaeta moutnovskia 768-28
MEDKYGVREPNPDNLYKEAYNIGIHYVTFRAAPYATVMTLERAMSITYQRRLKEMSTSIISKCIDVFTEIENYGLKATENKYGSNNECIKQYKEVIANTFAVASRGITVFNGTSYIAYIVNNEELVKYAWQIVRIGRKEDLVVVRDVKLVGLNELKPLGDVSFNSRFYVPKEPIKGEPMNASLWQMPIYINGSVHEEDVYVPHGLFNSTIMVDSTKAITYEVTIDGMKEFIVIPREVIENA

SEQ ID NO: 704 - protein, 248 aa, Metallosphaera cuprina Ar-4
MTLTFSKVKVRLHWGFSVAYPATSKAKRSTILPPPTTLIGALSYGEYRGVDSLDFPSSPAEAFNSESKASSQPEKVICAAARFDDDSAVTYSEDVIRNVTSYFQKPERRNDERYIFNIVPTGKVYGPNATLRLVYVTTIPPDKLYRLSWSIVRLGSKEGLVSVEDVEVGEAKETSGNLETKYYFPETVEHKTGPVVLANFWKGGFVWGEKVESVRYVIPLNPFPISSTSIEVNAKRAYEVGGEYVVVE

SEQ ID NO: 705 - protein, 279 aa, Pyrococcus sp. NA2
MDILLVLLRFPFFSVARRSYQVRTSLLLPSPSALKGALAKGLIMLEPEKYLGISLDTAAKKAVAEIENKLVNIRAIYVSPRTPLVKTAFLLKRLRNLEPIKDEKKIKTEEDWEKAMTKSDAMRREYTFTRELLVAYIFRDLSEEERERYLKAAMLIDTIGDTESLATPVWASFIKPKKRTATLAFSAPYEEISNLLSRGLKNKGKIKIYYEDVRISPDYSGISGGRGVPEERFYLPIEERRYRRTLYYIRTNSAPEVEDAIEFDGEVLGIWISKSSLKG

SEQ ID NO: 706 - protein, 240 aa, Acidianus hospitalis W1
MIYSKVFLKLHWGFSVSVPSVSKSRPSVYLPPPTTLIGALSYGKYRGYDTVLVNRRPGSPAYNLLNVKAAASFSKDFRGTYIEDIVRNVILYFQRSGRKTDPKYRYGVIPSGKVYSPNGKLNVVYVTDSIDRSELERLSWSITRIGCKECLVSVEDVELGEAKKVSGKVRTRYYFPDNVKIIDGKVEYVEFWNEKGFLWGSESDRIRYALPIITYPLMSVEVEVEAKEAYEVGGEYVVFS

SEQ ID NO: 707 - protein, 284 aa, Pyrolobus fumarii 1A
MECRGGYPGLKGLEAMPAVAVVAVVEAVWGWSVRVPGASVGGGSLPLPPPTTVIGSLAYSLARLLGWPETLYETDTVGVAAYSSARRLASAVLSASAGLLEGRVVTAYDVVRTVNIPFIRPENRRDTSQWLSVNAFGVTIAPRARLCMAIVFDGERLESLGINESLLEKAAWSISRLGSKEGLVSVVEAGVFRAERGAGPTRLYGRRGVLQGEHIVALRAWSPWSDESWMGLQRRGAELLELEAPLRITGPVYEPTPEPPVAIEGWRVEASGLLGECGTIPVLA

SEQ ID NO: 708 - protein, 291 aa, Pyrobaculum ferrireducens
MRYILLKTEFYSPYTSVQFFAEHGSGSIVPPPSTLIGALAAVYYYPVEREIEDEFVSRVKYVTFHVPPYTVVENISRHFTLFSQRKERLKALRAAIDVVAGARELDAAVLKIFTNYGGLRLKKNESVEEALQRMRSSGMTDIDIALTAVQVLLAPATRTETYFWEPAYILYVVDDDLKIEPTGIMRIGPKESIVSVTELKIKNLQRINERIRTRFYVPVRALEGMCGTCNVVYMAQRPGGDPEKVGVEPYYVPRSAPDMSIEGSPAHGWAAVEIEAEDVTLRAIVPEYVAP

SEQ ID NO: 709 - protein, 228 aa, Pyrobaculum oguniense TE7
MEVVLVRARAPLFSVRHLETYQIAVSYTMAPPSTIVGAVGRGLAIMGECSGSEDCINAARSLVLKARDVAVPSARFGVVLKRARGILEERRMPKSFKETGFFDALNREYVFAAEKLFLIVPSDNRRVLERALWHLERLGDTESLIAVYDVAVERAERCEGLVNVVVRWEVARGGGFVVQPGEDERGERQYFAFPVVAKEGGLYVPGGVKIDGGILCAGEVRFPESHDW

SEQ ID NO: 710 - protein, 243 aa, Fervidicoccus fontis Kam940
MNFGIITATKSRTSFRLPPPTTLIGALSYPLAKLKNFPESSEDYMPKLLSSSLRGVYFRSGLSLLPYSTVTKMWFYKKNERELKSDAFAYQRLYVSGESDLSVIYLFDEDAASRNLGHRWKEEVIAASFSMVRLGDKESLISPTKVSYGVAEEICNKEFVTDYTVPLTQIGLKVESFDGGVVEIVEHYDWRKMSGPTSMGMPTIKVAFAYDGSVFTQKKLRVYSDRDICAYAIEENEIKLIEW

SEQ ID NO: 711 - protein, 309 aa, Thermogladius calderae 1633
MVSLSAIRVFYTEALLSWGFVVRHRGASAAQPAYVLPPPTTVVGAFAYPLARVLGLNPNAESEVKWGDGRLISSTMKVFLEATIAAAAGVRAHPHSTGLATAQEPGRIIASPYKGDTERGRIKTEPFESAIPRAMPVQGVGATYAPGVTVGLAWVVDGDKLARELGIQLEKLDAVAEKAPFGVVRLGSKEGFLAVDYSRSMYVKNVKLLGPGDKFRTWLYVDSTCVESLDPVATQVLPMPDLNYRSKRYYVPSQLASHNVVVPLPEHVLPLFKLVEPCRAVQAPEVEGLVVVMSYDSSSHSQKGISAEL

SEQ ID NO: 712 - protein, 269 aa, Desulfurococcus amylolyticus DSM 16532
MKAGSPMALIAEFQAPLFSIKLYETYQVAVSYPLPPPSTIIGALAYSIGLLGYCKPDYKFGTSSDCYKKVAELVDKARAALPSPGERIGLSHRNTKGDLEYLMTKTGVILRRLRKVLEKKKLPRDYQGIVDFSDAMVREYSTLFKFKIVLIPSGIGRNKLDNLVKLMWLIERLGDSESLVSVTNVRVAPLVPCGDGNNFVNVVVKADVVSNGSYMVMKGFDEKYNEVNLAFPVVSYADHYRLGEIMVKNSVKPVYCAEDVRIPDPNREW

SEQ ID NO: 713 - protein, 302 aa, Desulfurococcus amylolyticus DSM 16532
MIEPQDIGVFYVRASFSWGFTVRYKGVSAAQPSYPIPPPTTVVGAFGYPLARLLGLDPYDKGVEEYGKGFLISSTMKAFLESTITASAALVRTKGSSGGVSIYLEPGRIIGSVYKTGGQLNYIKKAKIYTSEFYSRALGLMLPVQAVGSAYAPGLVLDLLWIVNAKKLVKELGVPRESFEKAASKAVYGVVRIGSKEGLISLHTAGYYNSVKILSVGEKFKTRFYVDAGCVEPLDREYAFEIELPGIRYDTGKFYIAAQSASQNLIIPLPEISSPPWYRVLTNCKGFIAPISEEVAGVVLIE

SEQ ID NO: 714 - protein, 263 aa, Pyrococcus furiosus COM1; identical to SEQ ID NO: 673

SEQ ID NO: 715 - protein, 225 aa, Candidatus Nitrososphaera gargensis Ga9.2
MIKALVVEVSFFEALFKVHYTKGFRQSYLIPLPTSVAGIFGAMLGISRNNLHQEFHDILFGAAIKRYKGIVGENVTFFQDKPSNPTIGVAKTLIVNEPTYVIAMSGSVNRLEVFMEKLSRQVEYLPYGGQNDFFVKDFQVHSNLVDVENCDIVNNYAPSSWVDEIKSDGKTEIQILPVMHKLDASPNFHFILDGSLKLSRTVSCVKAYGIGLYSLHDFYLTGDRN

SEQ ID NO: 716 - protein, 297 aa, Candidatus Nitrososphaera gargensis Ga9.2
MGKVVQISILAKIVGNVNADEVIGNRATLKKMYSSDGEVLPFVSARAIKFAIREALRQRSYDIDPYQKKGDQLLDSGNPVKYIDNDLFGYMHAPKKEEGQKKGVIALRRQAPIAISYLKSLRNTPIKSEFAARFPRTDGDGENPVPFEIEVAEFIGRLNCLIYEYVGLKSSDEKKEWELKREERNKRIKDFLEILLTPTYVLPRRTNSLNIPEYYVSLVTLSERGPLPIYQYLDYVNDKTIMLSIDMLNLMMSRPEIRNNIKEAYLIDYHNALDKPVNGFSSPSLSDAIGRIISFLQ

SEQ ID NO: 717 - protein, 240 aa, Sulfolobus islandicus LAL14/1
MIYSKVFLKLHWGFSVVKPSAAKAKLGFYLPPPSTLIGALSYGKFRGIDNTNLGNVYGSPAYNFRNVMATARLESEGAYTEDIVRNVISYFQRKDRRENPRYIYGVIPTGKVYMPNGTLVVVYVTDSMSKEELEKLSWSITRIGGKECLVSVENVEIGEAKKVSGRMKTSYYFRDTVKVVGKKEFLEYVTFWEENGYIWGKEGEPIRYILPVTTYPLASKEVEVEAKEAYEVGGEYVVFS

SEQ ID NO: 718 - protein, 259 aa, Sulfolobus acidocaldarius SUSAZ
MYGILIVGKHHWGYSVRYPSASAGGESFPMPPVSTLIGALSRGYCNHAVNERNESCTKEFVDQLAKKDLFWITYGTEEPLMIRYSDLMREERVPYRQEKNRKLEEMQNWFGVSAFGKIYAPMTTFNVLLLLRGKEELWRKLAWQVTSLGSKESLVSVLKVIEGEVEEMSAPDEINTNFYFPSKCVNSDEGVEMPMTGIYKLSSKAPTSDEKPNVEKFVIPKHGPLFGGFMKVSNLYREECTVYKVNNSLVIVPKGGLRW

SEQ ID NO: 719 - protein, 237 aa, Pyrococcus horikoshii OT3
MKPSGIIALRALPQSKMRIALRYIPPTALIGAIAYPLLHLTGDRGETIYEKKTFRSKAESIASLFKWVTIKMGGRPKLYGSLLKINTIYRGKVQSAVTSFPFAVLYGEFDYILTAAYLIDDDKLAESTYSSKDLTRAAWGITRIGSRESIVSVEDVKIGRTKIEYTEEAKTAYAFPFGKDVKIEGRGTFQAVVDWRSGIGDYSNARRIVMFYPDGIVEVKGKLSVAKLDGEVIVLAS

SEQ ID NO: 720 - protein, 282 aa, Aeropyrum pernix K1
MRPGDWVVVAELATPAFSVKNPESYQVASPLPLPLPSTLLGGLMRGASLLGSCTGGIASQSCIKKTGRIVKAAAPLSKPGQILGVEWEVVLRRLRKVLEPDSEEGSTRENRGNRVLDELSRISDALLRGYITPYNPVYAVFVARGRDNANRIEKALWYIDRLGDSESLVSARPVGRCQLAEFRSKSVNTPVALDSAVGGSFTVVYAPARAGRTGRTRRSEAIAIAMPVKKEAVERGYVLVYSEIEVEGSVYGCSVEGIDGRINVAVHESFHEVSGYGIWMPA

SEQ ID NO: 721 - protein, 260 aa, Sulfurisphaera tokodaii str. 7
MKGVLIYGLHHWGFSIRVPKASAGGKSFPYVPISTILGALSKSYCENYAVKNGTSCTKEFIDKYKGSLFWVAYGADESRLLPYSDIMREQRVSYKQKKYRSAEKLRDWFGVSAFGKTYGESVKFSIAVLLKDKVEDFVKYSWQIISLGSKESLVTIEHVEVVDVEESEEEQFSTSFFIPQQCLIDTGDFELQELPVLSTYNLTKEPDEGVFDKFWVPIRGPLIGGEVKVKKDAINEQCTVYRAGEKYVVTFKEGLTKWLK

SEQ ID NO: 722 - protein, 241 aa, Sulfurisphaera tokodaii str. 7
MIYSKVFLKLHWGFYVSYPEASKAKPSFYLPPPTTLIGALSYGKYRGVDTKAFKGKAGSPALEIKVKAAASFSNEFVGGYTEDIIRSVIMYFQRKERRGDPKFRYGVVPTGKIYAPNQVVKVVYVAEMDKEELERLSWSITRLGCKECLVSVEDVEIGEAKRVKGKVKTSYYFPASVTISEEEKKNVMLVSFWDENGFIWGSAGNVVTYALPVTGYPLKSKEVEVEASEAYEVGGEYVVFG

SEQ ID NO: 723 - protein, 247 aa, Thermococcus kodakarensis KOD1
MVPLTLFLKVQLRPTGIIALRALPQSKMRTALRYVPPTTLIGAISYPLLHISDDRGETIYEKKTFKSKAESVIGLFKWVTIKTEGRPKLYGSLLKINTIYRGKVQSAVTSFPFAVFYGESTNSLTAAYFVDEDALSESTYSAKDLERAAWGITRLGSRESIVSVEDVKMGKAVFREANKVRTAYAFPFKGVNVHGKGTLQAVVDWRLGIGDYSNAKRMVMFYPEETVEVEGGLSIVELDGEVVILAP

SEQ ID NO: 724 - protein, 176 aa, Candidatus Caldiarchaeum subterraneum
PLIEYNDLSKIFSYDVDEKQIRTDAAAVSKIYRGVSSADDSVKIVYLFEEQDVRKFFDVGWEEMLLEAAWSITRLGARESIVSVDKVSIGDVAVLNQKTAQTVYYFPSYMQSSVKGSFLVANVVDWRNTSIGEYLGKPTVNLIVPYDDERKKVSPLHVDLRDGIVYRVGDEELVPW

SEQ ID NO: 725 - protein, 252 aa, Candidatus Caldiarchaeum subterraneum
MKYLKVEATLHWGLYLNYHAFTKSRPALKTIPPTTLIGALAQPIALKNHWAENSESNSSAEKIRTLFKGIYLSQNLPLIEYNDLSKIFSYDVDEKQIRTDAAAVSKIYRGVSSADDSVKIVYLFEEQDVRKFFDVGWEEMLLEAAWSITRLGARESIVSVDKVSIGDVAVLNQKTAQTVYYFPSYMQSSVKGSFLVANVVDWRNTSIGEYLGKPTVNLIVPYDDERKKVSPLHVDLRDGIVYRVGDEELVPW

SEQ ID NO: 726 - protein, 252 aa, Candidatus Caldiarchaeum subterraneum; identical to SEQ ID NO: 725

SEQ ID NO: 727 - protein, 281 aa, Aeropyrum camini SY1 = JCM 12091
MTRVFAYARLRLHWGFIVRQPGASAAQTAYPLPPPTTVAGAFANPLARLLGIIDSYPEKREALPVTNMFMSCILKSTLAAAAGLAGSTGVAVYEEPSRLVGSPYKGGGSFAKAVKSPIYIGSQELLPVQAVGQASAPNAEIVLAWLFDLDRLVSCSGVGAVGVEDVEVASRGVYRLGSREGLASVVDGGAVDDTKIRHLDSGPFESVLYQDSGCVMPDSPVVEIPIPSPPQYREKAYLVPASHGSGSSFVIPPPTPARFFLKSGCRAALYPGVEGVALAYR

SEQ ID NO: 728 - protein, 256 aa, Pyrococcus abyssi GE5
MSIYARRNTFEVISLVFFLKVEASPSGIIALRSLPQSKMRNALRYIPPSTLIGAIAYPLFHIAGYRGETLIDRRNPRSAADKIKDLFLWVTVKGSIKPIIYGSILKINRLHRGSVESAVTSFPFAVMYGEQDYSISFVYLLKEEAVANSTYTLKDFERAAWGISRLGSRESIVSVESVKSGKAKIREGKEARTSYAFPFAGKEVEGEGTLQAVFDWRRGIGSYSNPQYILMFYPDGEVTVRGELKVVSLDGEEVVL

SEQ ID NO: 729 - protein, 247 aa, Thermococcus kodakarensis KOD1; identical to SEQ ID NO: 723

SEQ ID NO: 730 - protein, 226 aa, Thermoproteus tenax Kra 1
MHYYLIEARAPLYSVKVVDVYQVASAYPLPTPHAVVGALGAAMAHAGMCRGLQCMKEAEGLVVAARPAAVGELAKFPAVLWRTRGVLEDKSLPAGLEDYAGARDAMVREYVYAHAVKILLVTRKRVPQHVIRLMARLGDSESYVSVVDVLEGKPRECGGLVNVAVRAAKARRGSYTLYRALDERGNRELFAYPVVEEGGVYRRGGVEVGSKVLCLGEAVFPEGDGW

SEQ ID NO: 731 - protein, 242 aa, Pyrococcus abyssi GE5
MVFFLKVEASPSGIIALRSLPQSKMRNALRYIPPSTLIGAIAYPLFHIAGYRGETLIDRRNPRSAADKIKDLFLWVTVKGSIKPIIYGSILKINRLHRGSVESAVTSFPFAVMYGEQDYSISFVYLLKEEAVANSTYTLKDFERAAWGISRLGSRESIVSVESVKSGKAKIREGKEARTSYAFPFAGKEVEGEGTLQAVFDWRRGIGSYSNPQYILMFYPDGEVTVRGELKVVSLDGEEVVL

SEQ ID NO: 732 - protein, 173 aa, Coleofasciculus chthonoplastes PCC 7420
MTSSEPRWDVLPIEKRYQRDAFDCGYRVLNEYLKKYARQNHQKGIAKTFVAIPASGGLNVDGYYTISASVIEYESFPESYQRKMPAYPIPATLIGKLAVDNTVKGQGLGGELLADALYRIVRAAQDIGIFAVRVDAIDLLAKEFYLKHEFIPFQDKALSLFLPLESIAREFDF

SEQ ID NO: 733 - protein, 408 aa, Streptomyces viridochromogenes DSM 40736
MSDWTDPAGGDRTGQDPARVPPPASRIPPASRVPPAFRVPPPSTRTAPLPGMPSPAAPGRYDGSGEGHGGRGGSRNRRRPTRRRRFLRTAAVLSSVLLLGGAGTYVWADTRLNQEVDLGALGARVPSGEGTNYLVVGSDSREGLSQQDRKQLNTGSAEGRRTDSVILLHTGANGTTMLSLPRDSWVTLPPYVDPDTGRSYRAAPNKLNAAFSLGGPDLLVRTVERNTGVRVDHYAEIGFAGFVGVVDAVGGVNLCLDKAVRDEDSGANLPAGCQTLDGAEALAFVRQRKQEAKGDLGRTRNQQRFLAALARKAATPKTLADPSKSFPTLRAGLDTLIVDEGTELPDLMSLFEALRKAASGGGRQLNVPVADPNLRTSKGSAVKWDDRRARALFTALRKDRTPPSTRGG

SEQ ID NO: 734 - protein, 79 aa, Dysgonomonas mossii DSM 22836
MTRYNKSRIFKAAWSIKRRNASVSFSECLSIAWQRAKCDVLEARREANRKPVDTSIYSFNASNNVGIESYYANRAYSGD

SEQ ID NO: 735 - protein, 265 aa, Metallosphaera yellowstonensis MK1
MKVFALLLRLRPSWGYSVKVPNTSASQPSLSLPPPTTLVGAVAYGVLKLQGRDQETEISGGRVTNFAEKLWSATVYSGASLNGFGAPIMDISKYIIRIYQRKTNRDRPEYQLGAIPTGKVYVTGEIRALLGFHEERLSKIVEKFDEVLPKASYLVTRLGAKESIVSVEEAKWGYSKVLGREVEFCSSFYQPLQHSVPLGGCDGQGFFYKETFWDGGFFDVGKERWYLVPGVRDKYISSLRGRFKADKSCEVHEFEGEGFVVCDVR

SEQ ID NO: 736 - protein, 237 aa, Candidatus Aramenus sulfurataquae
MYSYARVLLKLHWGFSVSVPSASKAKASFLLPPPTTLKGALSFANYRGVDSLKGGSPAKEFEGVFAFARFSDNALASYTEDVVRNVVLLFQRRKGKEHWYNIVPTGKVISPSGELLVVYVTDKISKDDLERMAWSIIRIGSKESLVSVESVEVGDAKEVKGVRVKTKYYFPATVKVPPDYSPLLIYANFWEGGYDFGKEGKIVRYAIPLQKFPIKSVEVEVEAQRAFEVGGEYVVVA

SEQ ID NO: 737 - protein, 226 aa, Thermoproteus tenax; identical to SEQ ID NO: 730

SEQ ID NO: 738 - protein, 266 aa, Archaeoglobus fulgidus DSM 4304; identical to SEQ ID NO: 667

SEQ ID NO: 739 - protein, 256 aa, Pyrococcus abyssi GE5; identical to SEQ ID NO: 728

SEQ ID NO: 740 - protein, 245 aa, Pyrococcus horikoshii OT3
MPLFLKVQMKPSGIIALRALPQSKMRIALRYIPPTALIGAIAYPLLHLTGDRGETIYEKKTFRSKAESIASLFKWVTIKMGGRPKLYGSLLKINTIYRGKVQSAVTSFPFAVLYGEFDYILTAAYLIDDDKLAESTYSSKDLTRAAWGITRIGSRESIVSVEDVKIGRTKIEYTEEAKTAYAFPFGKDVKIEGRGTFQAVVDWRSGIGDYSNARRIVMFYPDGIVEVKGKLSVAKLDGEVIVLAS

SEQ ID NO: 741 - protein, 282 aa, Aeropyrum pernix K1; identical to SEQ ID NO: 720

SEQ ID NO: 742 - protein, 245 aa, Methanocaldococcus jannaschii DSM 2661; identical to SEQ ID NO: 668

SEQ ID NO: 743 - protein, 263 aa, Sulfolobus solfataricus P2; identical to SEQ ID NO: 669

SEQ ID NO: 744 - protein, 240 aa, Sulfolobus solfataricus P2; identical to SEQ ID NO: 670

SEQ ID NO: 745 - protein, 240 aa, Sulfolobus solfataricus P2; identical to SEQ ID NO: 671

SEQ ID NO: 746 - protein, 260 aa, Sulfolobus tokodaii str. 7; identical to SEQ ID NO: 721

SEQ ID NO: 747 - protein, 241 aa, Sulfolobus tokodaii str. 7; identical to SEQ ID NO: 722

SEQ ID NO: 748 - protein, 230 aa, Pyrobaculum aerophilum str. IM2; identical to SEQ ID NO: 672

SEQ ID NO: 749 - protein, 263 aa, Pyrococcus furiosus DSM 3638; identical to SEQ ID NO: 673

SEQ ID NO: 750 - protein, 245 aa, Methanocaldococcus jannaschii; identical to SEQ ID NO: 668

SEQ ID NO: 751 - protein, 240 aa, Saccharolobus solfataricus; identical to SEQ ID NO: 671

SEQ ID NO: 752 - protein, 240 aa, Saccharolobus solfataricus; identical to SEQ ID NO: 670

SEQ ID NO: 753 - protein, 263 aa, Saccharolobus solfataricus; identical to SEQ ID NO: 669

SEQ ID NO: 754 - protein, 102 aa, Enterococcus faecium
MSKKGIIVNEWEKLNRISNRRLSVDDKVHPLKLSWSIDRITIVGKLNDTIAYWTQNGVVFVDFEQLMRLNENQGYLKSVGTNGWQLFDQYGEDIAYIEMLKF

SEQ ID NO: 755 - protein, 408 aa, Streptomyces viridochromogenes; identical to SEQ ID NO: 733

SEQ ID NO: 756 - protein, 173 aa, Coleofasciculus chthonoplastes; identical to SEQ ID NO: 732

SEQ ID NO: 757 - protein, 79 aa, Dysgonomonas mossii; identical to SEQ ID NO: 734

SEQ ID NO: 758 - protein, 265 aa, Metallosphaera yellowstonensis; identical to SEQ ID NO: 735

SEQ ID NO: 759 - protein, 263 aa, Saccharolobus solfataricus; identical to SEQ ID NO: 669

SEQ ID NO: 760 - protein, 240 aa, Sulfolobaceae; identical to SEQ ID NO: 671

SEQ ID NO: 761 - protein, 244 aa, Thermococcus zilligii
MPFFLKATMRPAGIVAIRALPQSKMRIALRYVPPTTLIGAIAYPLLHIAGDRSETVYEEKTFRSSAGGVLELFDWVTVKTLGKPRIQGALLKINTIYRGNVQSAVTSFPFAVTYGTNDILITAVYLINEEALGRSSYTRKDIERAAWGITRLGSRESVVSVEDVETGRAEVAEAEMAKTAYAFPFNGVEVKGKGTLQSVVDWRSGIGDYSKAGRMVMFYPEESVEVRGRLRTIKVGEEVVVLAQ

SEQ ID NO: 762 - protein, 75 aa, Enterococcus faecium
MSKKGIIVNEWEKLNRISNRRLSVDDKVHPLKLSWSIDRITIVGKLNDTIAYWTQNGVVFVDFEQLMRLNENQGY

SEQ ID NO: 763 - protein, 282 aa, Aeropyrum pernix; identical to SEQ ID NO: 720

SEQ ID NO: 764 - protein, 256 aa, Pyrococcus abyssi; identical to SEQ ID NO: 728

SEQ ID NO: 765 - protein, 245 aa, Methanocaldococcus jannaschii; identical to SEQ ID NO: 668

SEQ ID NO: 766 - protein, 266 aa, Archaeoglobus fulgidus; identical to SEQ ID NO: 667

SEQ ID NO: 767 - protein, 245 aa, Pyrococcus horikoshii; identical to SEQ ID NO: 740

SEQ ID NO: 768 - protein, 240 aa, Saccharolobus solfataricus; identical to SEQ ID NO: 670

SEQ ID NO: 769 - protein, 260 aa, Sulfurisphaera tokodaii; identical to SEQ ID NO: 721

SEQ ID NO: 770 - protein, 241 aa, Sulfurisphaera tokodaii; identical to SEQ ID NO: 722

SEQ ID NO: 771 - protein, 230 aa, Pyrobaculum aerophilum; identical to SEQ ID NO: 672

SEQ ID NO: 772 - protein, 263 aa, Pyrococcus furiosus; identical to SEQ ID NO: 673

SEQ ID NO: 773 - protein, 247 aa, Thermococcus kodakarensis; identical to SEQ ID NO: 723

SEQ ID NO: 774 - protein, 127 aa, Chelativorans; identical to SEQ ID NO: 674

SEQ ID NO: 775 - protein, 277 aa, Hyperthermus butylicus; identical to SEQ ID NO: 675

SEQ ID NO: 776 - protein, 292 aa, Staphylothermus marinus; identical to SEQ ID NO: 676

SEQ ID NO: 777 - protein, 296 aa, Pyrobaculum arsenaticum; identical to SEQ ID NO: 677

SEQ ID NO: 778 - protein, 241 aa, Metallosphaera sedula; identical to SEQ ID NO: 678

SEQ ID NO: 779 - protein, 293 aa, Ignicoccus hospitalis; identical to SEQ ID NO: 679

SEQ ID NO: 780 - protein, 278 aa, Candidatus Korarchaeum cryptofilum; identical to SEQ ID NO: 680

SEQ ID NO: 781 - protein, 302 aa, Desulfurococcus amylolyticus; identical to SEQ ID NO: 682

SEQ ID NO: 782 - protein, 263 aa, Sulfolobus islandicus; identical to SEQ ID NO: 684

SEQ ID NO: 783 - protein, 240 aa, Sulfolobus islandicus; identical to SEQ ID NO: 685

SEQ ID NO: 784 - protein, 240 aa, Sulfolobus islandicus; identical to SEQ ID NO: 687

SEQ ID NO: 785 - protein, 240 aa, Sulfolobus islandicus; identical to SEQ ID NO: 689

SEQ ID NO: 786 - protein, 262 aa, Ferroglobus placidus; identical to SEQ ID NO: 695

SEQ ID NO: 787 - protein, 240 aa, Methanocaldococcus sp. FS406-22; identical to SEQ ID NO: 696

SEQ ID NO: 788 - protein, 298 aa, Thermosphaera aggregans; identical to SEQ ID NO: 697

SEQ ID NO: 789 - protein, 265 aa, Ignisphaera aggregans; identical to SEQ ID NO: 698

SEQ ID NO: 790 - protein, 241 aa, Vulcanisaeta distributa; identical to SEQ ID NO: 699

SEQ ID NO: 791 - protein, 224 aa, Thermococcus barophilus; identical to SEQ ID NO: 700

SEQ ID NO: 792 - protein, 241 aa, Vulcanisaeta moutnovskia; identical to SEQ ID NO: 703

SEQ ID NO: 793 - protein, 248 aa, Metallosphaera cuprina; identical to SEQ ID NO: 704

SEQ ID NO: 794 - protein, 279 aa, Pyrococcus sp. NA2; identical to SEQ ID NO: 705

SEQ ID NO: 795 - protein, 240 aa, Acidianus hospitalis; identical to SEQ ID NO: 706

SEQ ID NO: 796 - protein, 284 aa, Pyrolobus fumarii; identical to SEQ ID NO: 707

SEQ ID NO: 797 - protein, 226 aa, Thermoproteus tenax; identical to SEQ ID NO: 730

SEQ ID NO: 798 - protein, 291 aa, Pyrobaculum ferrireducens; identical to SEQ ID NO: 708

SEQ ID NO: 799 - protein, 228 aa, Pyrobaculum oguniense; identical to SEQ ID NO: 709

SEQ ID NO: 800 - protein, 240 aa, Sulfolobus islandicus; identical to SEQ ID NO: 701

SEQ ID NO: 801 - protein, 240 aa, Sulfolobus islandicus; identical to SEQ ID NO: 702

SEQ ID NO: 802 - protein, 243 aa, Fervidicoccus fontis; identical to SEQ ID NO: 710

SEQ ID NO: 803 - protein, 309 aa, Thermogladius calderae; identical to SEQ ID NO: 711

SEQ ID NO: 804 - protein, 269 aa, Desulfurococcus amylolyticus; identical to SEQ ID NO: 712

SEQ ID NO: 805 - protein, 302 aa, Desulfurococcus amylolyticus; identical to SEQ ID NO: 713

SEQ ID NO: 806 - protein, 240 aa, Sulfolobus islandicus; identical to SEQ ID NO: 717

SEQ ID NO: 807 - protein, 240 aa, Methanocaldococcus fervens; identical to SEQ ID NO: 692

SEQ ID NO: 808 - protein, 267 aa, Thermococcus gammatolerans; identical to SEQ ID NO: 691

SEQ ID NO: 809 - protein, 240 aa, Sulfolobus islandicus
MIYSKVFLKLHWGFSVVKPSAAKAKSGFYLPPPTTLIGALSYGKFRGVDNTNLGKVYGSPAYNFRNVMATARLESEGAYTEDIIRNVISYFQRKERRENPRYIYGVIPTGKVYIPNGMLVVVYVTDSMSKEELEKLSWSITRIGGKECLVSVENVEIGEAKKVSGRVKTSYYFRDTVKVVGKKEFLEYVTFWEENGYIWGKEGGPIRYILPIITYPLASKEVEVEAKEAYEVGGEYVVFS

SEQ ID NO: 810 - protein, 244 aa, Sulfolobus islandicus
MWVQMIYSKVFLKLHWGFSVSIPSVSKARPSVYLPPPTTLIGALSYGKYRGYDTVLVNRRLGSPAYNLLNVKAAASFSKDFRGTYIEDIVRNVILYFQRSERKTDPKYRYGIIPSGKVYSPNGKLNVVYVTDSIDRSELERLSWSITRIGCKECLVSVEDVEIGEAKKVSGKVRTRYYFPDNVKIIDGKVEYMEFWNEKGFLWGSESDRIRYALPIITYPLMSVEVEVEAKEAYEVGGEYVVFS

SEQ ID NO: 811 - protein, 229 aa, Sulfolobus islandicus
MYYLLARLRGPLYSVKRLDVYQVSTSYPFIPPSTLIGAVGEGLGILGYCEPNDCLNYARKLVRKAREVFLSDVKISVSSVILKRARGVLENKSLPGSFNEITKYNDALVREYTYSFNRQVLFGIVDGVDVVKKALYNIQRLGDTESMVSVEDVKEVEVEKCDKHEVNVVSDIKNATGRYLIFPAFDEQGKRRYFSVPLYFLGSYYEIGEIKYNKTLCAGEAVFPEGDDW

SEQ ID NO: 812 - protein, 244 aa, Sulfolobus islandicus
MWVQMIYSKVFLKLHWGFSVSIPSVSKARPSVYLPPPTTLIGALSYGKYRGYDTVLVNRRLGSPAYNLLNVKAAASFSKDFRGTYIEDIVRNVILYFQRSERKTDPKYRYGVIPSGKVYSPNGKLNVVYVTDSIDRSELERLSWSITRIGCKECLVSVEDVEIGEAKKVSGKVRTRYYFPDNVKIIDGKVEYMEFWNEKGFLWGSESDRIRYALPIITYPLMSVEVEVEAKEAYEVGGEYVVFS

SEQ ID NO: 813 - protein, 269 aa, Crenarchaeote SCGC AAA261-N13
MKGFLIDAEFVWGFQSRVIGLSKTPPSFYYPPPPTFLGALAESISRRENLGEKEGLKVIEKLSDNLLAIGLRPLNCMPLRFEDINRIIAIKLAKGKQYPTAEDITGSFDSPARGKTILVSLDGNPPTIRWFLVFKDEYIIIDKRKIDLERNDFWKVHRLGSKESRVSVMNVIEFVPQTVSGRQETYYSFPLDMAKLVYKQGRWENETYINPFYLRYSETENPLKNYLLQKNVKVFFLPMLDIRRENPSCIIEAKTVYKYNEEVVVGRAG

SEQ ID NO: 814 - protein, 270 aa, Thaumarchaeota
MIGFMIDFEFVWGFQSKVVGYSKSSPAFTYPPPTTFLGAVAEVLAKKHSLGEQEGRSVIKALSDKLLAIGVRPLNCIPLKFADINKVIAVKYAGGIDYPSIKDVYGSLDAPAHGRTVLSLVSENGEGPTLRYFLTLNDDEIKVRGGGTVRLEEEDLWEIHRIGSKESLVAVTEVKSFTPKVKDGRVTTYYSFPLLEGGKVRPQYYWPKWILEKTINPFKLTNYDPLTSYVLGQNLIDIYYPVIESPQRPPRYIVEVGGAVHASMSGETRG

SEQ ID NO: 815 - protein, 338 aa, Crenarchaeota
MKALRVEGELHWGFWSRFPETSKMQSSFSIFPPTTLIGAIASAIFNLGILKSVGEVYVENKKYVSPAVMVKDFFLSVSAYFKPNVKGFSIEDINKYITLHFHAFAKSNANLQISPEYLVKSIEEIPSLSEEEKLIVEVIKKKGYIEPSKLEKRLKEKLSKGQIRAILQSLKKKGIVTEIERRFLPKYRTGAILVGKTYLSGNFVAIYLLNEEQIAKDLAGELNKLVLAAWNITRIGSKESIASINNVELLEAKKIDSEKVSTILYFPRFLSSEIISGKYYIETFWEGGWGRNYYKKPVDYVVPGSKVPIESMPIEVKLSDKALAYQIKEEDEVLIVKR

SEQ ID NO: 816 - protein, 233 aa, Aigarchaeota archaeon SCGC AAA471-E16
MIGFMIDFEFVWGFQSKVVGYSKSSPAFTYPPPTTFLGAVAEVLAKKHSLGEQEGRSVIKALSDKLLAIGVRPLNCIPLKFADINKVIAVRLTGGKQYPSPEDPYGSFDAPAHGRTFLSLVSENEEGPILRYFLTLDDDEIKVRGGGTIRLEEEDLWEIHRIGSKESLVAVTEVKSFTPKVKDGRVTTYYSFPLLEGGEVRLQNYEPKWILEKTINPFKLTNYDPLTSYVLGQ

SEQ ID NO: 817 - protein, 260 aa, Actinoplanes globisporus
MTFPVTGGYALVLDLDLAAGERTLGLRVPAHSEPIQLAWAPAAGPWPAALRWWELDVCARVIALEDPTLPHPGLVVALLSPFAPATADDDETTVAAMREAAYRSLRRDVPPAEPHGPEQAPLPLFAGDAWWPSPPAASPQVLDEAAIAELSRPPTRFSEVRGGSRFPGESLADLVRRASAHLDRLPRQSWYAGTRPLARHILDTGDLAPIPALLGALTEAGCDHPTVLDALSEPLVPVEACWMVETLAGAEPGTLLRRRV

SEQ ID NO: 818 - protein, 252 aa, Candidatus Caldiarchaeum subterraneum; identical to SEQ ID NO: 725

SEQ ID NO: 819 - protein, 448 aa, Bacteroides intestinalis CAG:564
MTKTIEITKIVAVDDTIKYEIHDHTGLHLLKNEKVEAWVKYYNAESFGFSPEGLPESILAIPVTLYLIPVTWFYGVKLVVPSIDKTLYDDLSTIYAAYSKIYGPFKEEWRGKVTAKIVVENKMPESRFDNIVFFSGGVDALHAGIDNLGKRSVLVSVPSIESVEKTKKENSGWDFLNAKSQLIREFSAISESDWLLITNNFLVNIFDDARIQYDLKNSFNLNSEAFLFDGWFGIKYLNNILSAAPFAYAMGISNLILGSAFEQLEDNLASNLDGANPELSDSIRFAGVFFGEQDGLYTRRSRKVKNILEWCIARGKKTRLWTCFADSTEQCCVCTKCVRTQLNILCAGENPVDWGFANFNEKNFSRLVRSYCYHDRNLCWLWDIVDSIDDSTIYPCCDKLLHWLKKVGYKRYSKRARFVSNVPRILKLHRYPHYVKVVLLKVTGKGHM

SEQ ID NO: 820 - protein, 231 aa, Clostridium sp. 1_1_41A1FAA
MLKVTYKVPALFSLKKFNDSHLLARSYEYPMLTTIRGAILSSMIERKGKVYAEKMFRNIKNAQIFIQYPKEYMINQCKIKRMSNKGYEYNYSEDTIRDWEGKYTVGMREYVLTDKIVFYIDKSIDDIIELLVNIDRIGDSESLVILENIEEVDAMENILIEWNESLGSDMDVYELYDWETKLNKKGDKDNGMNFNDVYIYSSKKSPKYKKRLCYVKDKIAVGDFSGDMCQL

SEQ ID NO: 821 - protein, 281 aa, Aeropyrum camini; identical to SEQ ID NO: 727

SEQ ID NO: 822 - protein, 259 aa, Sulfolobus acidocaldarius; identical to SEQ ID NO: 718

SEQ ID NO: 823 - protein, 64 aa, Enterococcus faecium
MSKKGIIVNEWEKLNRISNRRLSVDDKVHPLKLSWSIDRITIVGKLNDTIAYWTQNGVVFVDLS

SEQ ID NO: 824 - protein, 277 aa, Hyperthermus butylicus DSM 5456; identical to SEQ ID NO: 675

SEQ ID NO: 825 - protein, 292 aa, Staphylothermus marinus F1; identical to SEQ ID NO: 676

SEQ ID NO: 826 - protein, 296 aa, Pyrobaculum arsenaticum DSM 13514; identical to SEQ ID NO: 677

SEQ ID NO: 827 - protein, 241 aa, Metallosphaera sedula DSM 5348; identical to SEQ ID NO: 678

SEQ ID NO: 828 - protein, 293 aa, Ignicoccus hospitalis KIN4/I; identical to SEQ ID NO: 679

SEQ ID NO: 829 - protein, 278 aa, Candidatus Korarchaeum cryptofilum OPF8; identical to SEQ ID NO: 680

SEQ ID NO: 830 - protein, 81 aa, Mycobacterium phage Myrna; identical to SEQ ID NO: 681

SEQ ID NO: 831 - protein, 302 aa, Desulfurococcus kamchatkensis 1221n; identical to SEQ ID NO: 682

SEQ ID NO: 832 - protein, 263 aa, Sulfolobus islandicus M.14.25; identical to SEQ ID NO: 684

SEQ ID NO: 833 - protein, 240 aa, Sulfolobus islandicus M.14.25; identical to SEQ ID NO: 685

SEQ ID NO: 834 - protein, 240 aa, Sulfolobus islandicus L.S.2.15; identical to SEQ ID NO: 671

SEQ ID NO: 835 - protein, 240 aa, Sulfolobus islandicus Y.G.57.14; identical to SEQ ID NO: 671

SEQ ID NO: 836 - protein, 240 aa, Sulfolobus islandicus Y.N.15.51; identical to SEQ ID NO: 687

SEQ ID NO: 837 - protein, 263 aa, Sulfolobus islandicus M.16.27; identical to SEQ ID NO: 684

SEQ ID NO: 838 - protein, 240 aa, Sulfolobus islandicus M.16.27; identical to SEQ ID NO: 689

SEQ ID NO: 839 - protein, 240 aa, Sulfolobus islandicus M.16.4; identical to SEQ ID NO: 685

SEQ ID NO: 840 - protein, 267 aa, Thermococcus gammatolerans EJ3; identical to SEQ ID NO: 691

SEQ ID NO: 841 - protein, 240 aa, Methanocaldococcus fervens AG86; identical to SEQ ID NO: 692

SEQ ID NO: 842 - protein, 240 aa, Sulfolobus islandicus L.D.8.5; identical to SEQ ID NO: 671

SEQ ID NO: 843 - protein, 262 aa, Ferroglobus placidus DSM 10642; identical to SEQ ID NO: 695

SEQ ID NO: 844 - protein, 240 aa, Methanocaldococcus sp. FS406-22; identical to SEQ ID NO: 696

SEQ ID NO: 845 - protein, 298 aa, Thermosphaera aggregans DSM 11486; identical to SEQ ID NO: 697

SEQ ID NO: 846 - protein, 265 aa, Ignisphaera aggregans DSM 17230; identical to SEQ ID NO: 698

SEQ ID NO: 847 - protein, 241 aa, Vulcanisaeta distributa DSM 14429; identical to SEQ ID NO: 699

SEQ ID NO: 848 - protein, 224 aa, Thermococcus barophilus MP; identical to SEQ ID NO: 700

SEQ ID NO: 849 - protein, 241 aa, Vulcanisaeta moutnovskia 768-28; identical to SEQ ID NO: 703

SEQ ID NO: 850 - protein, 248 aa, Metallosphaera cuprina Ar-4; identical to SEQ ID NO: 704

SEQ ID NO: 851 - protein, 279 aa, Pyrococcus sp. NA2; identical to SEQ ID NO: 705

SEQ ID NO: 852 - protein, 240 aa, Acidianus hospitalis W1; identical to SEQ ID NO: 706

SEQ ID NO: 853 - protein, 284 aa, Pyrolobus fumarii 1A; identical to SEQ ID NO: 707

SEQ ID NO: 854 - protein, 226 aa, Thermoproteus tenax Kra 1; identical to SEQ ID NO: 730

SEQ ID NO: 855 - protein, 291 aa, Pyrobaculum sp. 1860; identical to SEQ ID NO: 708

SEQ ID NO: 856 - protein, 228 aa, Pyrobaculum oguniense TE7; identical to SEQ ID NO: 709

SEQ ID NO: 857 - protein, 263 aa, Sulfolobus solfataricus 98/2; identical to SEQ ID NO: 669

SEQ ID NO: 858 - protein, 240 aa, Sulfolobus islandicus HVE10/4; identical to SEQ ID NO: 701

SEQ ID NO: 859 - protein, 240 aa, Sulfolobus islandicus REY15A; identical to SEQ ID NO: 702

SEQ ID NO: 860 - protein, 243 aa, Fervidicoccus fontis Kam940; identical to SEQ ID NO: 710

SEQ ID NO: 861 - protein, 309 aa, Thermogladius cellulolyticus 1633; identical to SEQ ID NO: 711

SEQ ID NO: 862 - protein, 269 aa, Desulfurococcus fermentans DSM 16532; identical to SEQ ID NO: 712

SEQ ID NO: 863 - protein, 302 aa, Desulfurococcus fermentans DSM 16532; identical to SEQ ID NO: 713

SEQ ID NO: 864 - protein, 263 aa, Pyrococcus furiosus COM1; identical to SEQ ID NO: 673

SEQ ID NO: 865 - protein, 225 aa, Candidatus Nitrososphaera gargensis Ga9.2; identical to SEQ ID NO: 715

SEQ ID NO: 866 - protein, 297 aa, Candidatus Nitrososphaera gargensis Ga9.2; identical to SEQ ID NO: 716

SEQ ID NO: 867 - protein, 240 aa, Sulfolobus islandicus LAL14/1; identical to SEQ ID NO: 717

SEQ ID NO: 868 - protein, 281 aa, Aeropyrum camini SY1 = JCM 12091; identical to SEQ ID NO: 727

SEQ ID NO: 869 - protein, 252 aa, Candidatus Caldiarchaeum subterraneum; identical to SEQ ID NO: 725

SEQ ID NO: 870 - protein, 259 aa, Sulfolobus acidocaldarius SUSAZ; identical to SEQ ID NO: 718

SEQ ID NO: 871 - protein, 247 aa, Thermococcus kodakarensis KOD1; identical to SEQ ID NO: 723

SEQ ID NO: 872 - protein, 116 aa, Archaeoglobus fulgidus DSM 4304
MSSTMSFDNLAKVLAVLVAEQGSYTYVDKLGYVPSKDLAVFYLKEALRDLHSIQQKEKFENEKARELVGKIDYERVEKELEDIAKTDERKELREKTSLIAAKALALSAKLGGGSGE

SEQ ID NO: 873 - protein, 150 aa, Saccharolobus solfataricus P2
MAQKSEKENIIGRIANLLAVGFLYSESPTLVDRFANALSKEAVTKVLYDVQRIVQMGIDRSEIATTTITIQGKDYPAQGKDYPAVNVNSSGAKYTVVGYLPTSQDIEDFLRMIEEDVYYARKAGALAMSIANRIKLGSKQSKSEQGGEKK

SEQ ID NO: 874 - protein, 129 aa, Saccharolobus solfataricus P2
MRVANLLAVGFLYSESPTLVDRFANALSKEAVTKVLYDVQRIVQMGIDRGEIVSTTTMIQGKEYPAVNVSSSEGKYTVVGYLPTNQDIEYFLRMIEEDVYYARKAGALAMSIANRTKLVSKSEQGGEKK

SEQ ID NO: 875 - protein, 301 aa, Pelodictyon luteolum DSM 273
MATLKRYPAEKKGELLELGSLEDLKAMARQVRRDIVRMLSMASSGHTGGSLGMADIFTALYFRVLRHRPHDFWDHGDQDLLFLSNGHIAPVWYSVLARSGYFCLSELGSLRQLNSYLQGHPTCEAGLPGIRIASGSLGQGLSVATGAALGQRMNRQGGHVFCLMGDGECQEGQIWEAAMSAAHYGLGNIIGIVDYNNQQIDGEVENVMGIEPFADKWRAFGWNVYHCDGNDIEDFVATVEKVKLAAAPNPSVILAVTIMGKGVPFFEGTMEDNTNWHGKPPSKDDAEKALAILEETRFGDF

SEQ ID NO: 876 - protein, 217 aa, Cenarchaeum symbiosum A
MIVDLHLKGGLVIVVGAGAEGQKKVKSLLTQDCKILVVSREFGPRMEEYALDGRVRLQQSSLEDAGFLSGYAPRVVMATTDDRDLNREIVSKARAAGCLAYASDDPESSDFAHPSVINIEDTVQVAVSTGGRSPAMARKIRQEAERIFRSTIKREDILQIRLQDSMRGEAKKRIGSQEGRKKYMYSIINDDRIMQLIRDDRLDMARERAAVMLDGWR

SEQ ID NO: 877 - protein, 107 aa, Hyperthermus butylicus DSM 5456
MHEQHRLYRLPELLSFFARTRQFGVLDRIANALSPDQALAALYDALRVFRSSCLSESPDKKCPNNAEELVEKARYEVEKITELLLDSHRAEEGLRLARTAAILALGR

SEQ ID NO: 878 - protein, 126 aa, Staphylothermus marinus F1
MSESLTEINLDPISKLLAVIIAENGDYSHVDKLGYVVSPDLAVYYLREALRDYSSLMNKTKWTNPKAYSVAKEIKMKSVEYIIDKISRINDPREVRRIVATIAAKALAKANSLRIETQEKEEGGEK

SEQ ID NO: 879 - protein, 121 aa, Metallosphaera sedula DSM 5348
MEPRLRRVANLLATASIYAETPTLLDRISNALSKEAAVKVIGDCERIVNTGLNRGEIRLQTGENPRIYIDVKEGERTKTYELYGSLSSSEDVTQFIEDVERDIYTARKVGAVAMATVNGVL

SEQ ID NO: 880 - protein, 70 aa, Clostridium beijerinckii NCIMB 8052
MNNELEMHKIFEKYYELSSIEWRKTIVGYEPLDKSIELPSGADRKTAIKISFKNKDWIRVYRIGNKVEWY

SEQ ID NO: 881 - protein, 148 aa, Ignicoccus hospitalis KIN4/I
MGEERRRSNEEYYWLPRALSYFADKEVRQFNIIDRLANAVNEEVALNTLYDAMRTLKTIITSNKVEEVRRFVRKFGELKDEGGRPQYCYEGKCPAECKKVGEECCCDAEALYKLAMREVDDLKHSFVDEKSKKKAFLTLKIIAINALG

SEQ ID NO: 882 - protein, 108 aa, Candidatus Korarchaeum cryptofilum OPF8
MENIAELLAVLVAENESYTYVDKLGYAPSKDLALYYLREALRDFISLKNKPQSQWSSPKAFEEAGKIKMELVEREIESIERISSMKELREAVSLIAAKALSIASRLKG

SEQ ID NO: 883 - protein, 473 aa, Thermodesulfovibrio yellowstonii DSM 11347
MLTLYTPATGFPDLDVKIAYGLTRVGIEAFGIESVAIHYEGGFYRVTFDIDKNDFEKLNKMFNLLCQRLLFSTYIPFSTPGIAGRSAESVTVNENESFSLDFYKSFTIIAKNKKGENVCRHEFDHIGNVIGFTVATSFHNKRDGVDIQLQYKNPKDKNSPKLPRRPTNPKNICKTCGLLALLGIWYTSFIFNVARKEVIVIPIPKGNVSGRKLQEIFALQHQIRKEWFNQDIPQVLIPLVFLSKIPSSADILKGFDLFIAILSRKQGYHVDRIFLIPIENYLKFIRGTPYNIATIDNILTQKAYAALQELNNTIYNLNKTSILKFARLYVQETSPKKGDWVNLLYPETVRYLLKEVAMISLEIIENPALGSLARTLRYFIREKKYGYADDIRNARKESRDFEETIAKMLREGRLRLEQKEQIHLPTDEEVKKVFRLANEDFESTKLALVMLAFSFPSRTEETMETLEEIQGVK

SEQ ID NO: 884 - protein, 127 aa, Desulfurococcus amylolyticus 1221n
MSTPKTPLSEIVDVLAFLGALGDYGYIDRLGNAIDEVTFMEAIRDSIRAYYTNCLDGKKCVEYDKARKAGVLCPDLKSDQLEKIVNSVLDTISNASKVDVIKLSRKIALQAYAKIPVVRENQGCKTE

SEQ ID NO: 885 - protein, 143 aa, Sulfolobus islandicus L.S.2.15
MAQQVKEEKEGIIVRVANLLAVGFLYSESPTLVDRFANALSKEAVTKVLYDVQRIVQMGIDRGEIVSTTTMIQGKEYPAVNVSSSEGKYTVVGYLPTNQDIEYFLRMIEEDVYYARKAGALAMSIANRTKLVSKSEQGGGEKK

SEQ ID NO: 886 - protein, 143 aa, Sulfolobus islandicus M.14.25
MAQQVKEEKEGIIGRVANLLAVGFLYSESPTLVDRFANALSKEAVTKVLYDVQRIVQMGIDRSEIVSTTTMIQGKEYPAVNVSSSEGKYTVVGYLPTNQDIEYFLRMIEEDVYYARKAGALAMSIANRIKLSSKSEQGGGEKK

SEQ ID NO: 887 - protein, 142 aa, Sulfolobus islandicus Y.G.57.14
MAQQVKEEKEGIIVRVANLLAVGFLYSESPTLVDRFANALSKEAVAKVLYDVQRIVQMGIDRGEIVSTTTMIQGKEYPAVNVSSSEGKYTVVGYLPTNQDIEYFLRMIEEDVYYARKAGALAMSIVNRTKLVSKSEQGGEKK

SEQ ID NO: 888 - protein, 162 aa, Sulfolobus islandicus Y.N.15.51
MSFRSEEIESFIYWGRKENNMAQQVKEEKEGIIVRVANLLAVGFLYSESPTLVDRFANALSKEAVAKVLYDVQRIVQMGIDRGEIVSTTTMIQGKEYPAVNVSSSEGKYTVVGYLPTNQDIEYFLRMIEEDVYYARKAGALAMSIANRTKLVSKSEQGGEKK

SEQ ID NO: 889 - protein, 142 aa, Sulfolobus islandicus M.16.27
MAQQVKEEKEGIIGRVANLLAVGFLYSESPTLVDRFANALSKEAVTKVLYDVQRIVQMGIDRSEIVSTTTMIQGKEYPAVNVSSSEGKYTVVGYLPTNQDIEYFLRMIEEDVYYARKAGALAMSIANRIKLSSKSEQGGEKK

SEQ ID NO: 890 - protein, 143 aa, Sulfolobus islandicus M.16.4; identical to SEQ ID NO: 886

SEQ ID NO: 891 - protein, 116 aa, Methanocaldococcus fervens AG86
MKFIEEFNGLIKMLRFFVRTKNFSYIDRIGNALTYEPVEVAIKDALRDFQSIHNSAKIEDGKKVIYDKETNKPIYLPSIPSSEEVEAFLKKAKEDISYARKLAIFALTIPQKGGEE

SEQ ID NO: 892 - protein, 143 aa, Sulfolobus islandicus L.D.8.5; identical to SEQ ID NO: 885

SEQ ID NO: 893 - protein, 116 aa, Methanocaldococcus sp. FS406-22
MKFIEEFNGLIKMLRFFVRTKNFSYIDRIGNALTYEPVEVAIKDALRDFQSLHNSAKTEDGKKVIYDKQTNKPIYLPSIPSSEEVEAFLKKAKEDISYARKLAIFALTIPQKGGEE

SEQ ID NO: 894 - protein, 143 aa, Sulfolobus islandicus HVE10/4
MAQQVKEEKEGIIGRVANLLAVGFLYSESPTLVDRFANALSKEAVTKVLYDVQRIVQMGIDRSEIVSTTTMIQGKEYPAVNVSSSEGKYTVVGYLPTNQDIEYFLRIIEEDVYYARKAGALAMSIANKIKLGSKSEQGGGEKK

SEQ ID NO: 895 - protein, 143 aa, Sulfolobus islandicus REY15A
MAQQVKEEKEGIIGRVANLLAVGFLYSESPTLVDRFANALSKEAVTKVLYDVQRIVQMGIDRSEIVSTTTMIQGKEYPAVNVSSSEGKYTVVGYLPTNQDIEYFLRIIEEDVYYARKAGALAMSIANRIKLGSKSEQGGGEKK

SEQ ID NO: 896 - protein, 469 aa, Desulfobacca acetoxidans DSM 11109
MNPNNTFYTPGTGLPDFEMRIALGLCAAALNAVEPEKIRLVELYDRYCVEIDDDGDVTAKVMKALGWLCQNKISDQSLLLRIPGFRPLHLENQSVGIAKFGKKIANKNSKPKNIFTEKNEIRKGAHASACGHNYSRNDKITGALVSFCPQLGQPPKRDNVTHQITLPLCPFCVVSSLAGTFFFQIDVAINTSDRSKKERFFFLPHFAGIIKGGEMAQYIATAKHISRKIEDIPAPAALLALLSLYPHLIEILRDKVDSFFVGRLDSSGNAPRYEYQVEKSDPKEITFLKNAYNRALVQALLQERIFSQDRSKLLGLLARAFRNIDEKSALDFARTYVGVREGKALLSRKTTDSFAQEIFNMDKSLLEGENFDVIKKIADMLQYFVRERNFGYVDNLRKARDADEFAKLLLDAQREAQSSVLDPKKQYKPYLPGQNTVQQMLQLVNNEKQFRSVQTLVALLAFTYYKKED

SEQ ID NO: 897 - protein, 131 aa, Metallosphaera cuprina Ar-4
MLMSSNLEFTIKKVANLLAAVSIYAESPTFLDRISNALSKEAVVKVIGESERILNVGLNNKEINKLPGEKPQISIKVSKDGEKTVIIYGDLPTPYDVEQFIHDVENNIYLARKAGALAMATVNNALVRVGQ

SEQ ID NO: 898 - protein, 133 aa, Acidianus hospitalis W1
MDEEKIEGIVRRIANLFATTYLYSESSMLVDRFANALSKEAVAKVLYDAQRIVQMGLDRDEIKSDIVKIKEKDYPAIVITKEKEKSVQIIGYLPTDQDVEDFLSLIEKDVYYARKAGALAMSIANRTKLGGSQ

SEQ ID NO: 899 - protein, 480 aa, Mahella australiensis 50-1 BON
MRRIIVVLLIGLMLISLVGCGGTSSTGESNKSSGANNASNNSKQPTSGEKVKVVIWGLNPLAIGSGNKEMIDGFHKSHPNIQLDPQTTPGTGGYATQDVTKLLAAIAGGTPPDITTLDRFTAAQFAARNALSPLDEYIETSGLDLSQFYEYAVSEITFDNKIWAMPNGIDDRLFYWNKDMFKKAGLDPETPPDTWDELLDYSKKLTVTDAKGNFKQIGFIPNYGNSWLYLYGFQNGAKFLSDDGRTALLNAPEVVEALEFMVKGYDILGGAKKVNAYSSTFQAEAGDPFITGQVAMKIDGNWVLNNIARFGPDTNFGTALPPTPTGENKITWSGGWSWAMPKGAKHPEEAFEVMKYMVTDGAKIQEDGIRAYNEKQGRPYVPGLWAYKPINEQLVNENVNKLNEVNSNLGSAFKLAVDAMAVSKARPVSPVGEVLWTEHSRAIDKAIYHEMTPKEALDAGNKVVQAELDKFWAEYDASHK

SEQ ID NO: 900 - protein, 115 aa, Pyrococcus yayanosii CH1
MEEFRGIVNMLRFFVRTKNFGYVDRIGNALTPEPVEVALLEAMRAFRSIWESAKTDEGGRYIEKDGEKIYVPKIPSDSEVENFLNAVRENIRIAKRVATLALAYPSKKEKNGGGE

SEQ ID NO: 901 - protein, 116 aa, Pyrolobus fumarii 1A
MSLVEGQECRSARVDSFRVSKAARLLHEAFVKEARYGPVDKLGLASGPDSLLVALFEVERGVRSVIENVEERRRDEWDSLVEIVEAIASDARRSECVEHALRLAHELAVKALAGGR

SEQ ID NO: 902 - protein, 115 aa, Pyrococcus sp. ST04
MEEYWGIVNMLRFFVRTRNFGYVDRIGNALTPEPVEVALLEAMRAFRSIWEGAKTDERGRYIEKDGEKIYLPRIPSDEEVEKFLNAVRKDVRVAKRIATISLAYPSKKEKSGGEE

SEQ ID NO: 903 - protein, 1671 aa, Lygodium japonicum
MTFFVWIGNASSLLMLGFYHGLLATLPMGPSQILCVRAFFIEGRIGGITALIGSMMGQFLLFSAILYSPLYLAILKPHIATIAVIPYMFFYWFETKNLPDYQVLRPIRSIRNLKIVGILLNSFLFQILNPILLPNPALARLLHLFLFRYSNNPLFLTSSFLGWLIGHVLFGYSANLLVLQVEKNSTIPYPLTKRIIHKTFSIIFFIKLLLCLGRAPVAFLTRKFQNELISYDRSCFDLPSPAHWLCNPWPASFFDPNRTNRALRYRKKSRRSDQRIVKKRQSTYFFDKCLVDGKPRLYFTSLSSASIFGRQLEESLKNFDVLPLEPYSYQNWILDQARKRENLQNELRDRIKLMELNSILSEAIEQKIGLRDEEDAQRTSISKIYDPLSSKFFRVRIPAPQSFLTTNDLIKPITDTYRNYAGEFNYKNRIANLIYSEYTCFENSKIPLPWEDLSIDAIEVLLFTFNELMPYKQSFGIGLETIVKRAKNFSPNKESPFVTWEEIFKLLPMDRALFLLYLEETCGNPSHFRLSNISLLNRVKSIHNLKRKKCLIHRVDDLERELFQNIRLMFDNRFDLAGAESDVRNKRLRNLAISIGKTNARSVKLVKRYTKSSDFRRKLIKGSMRARRRKTLIWEFFQGKAHSPFFMRLMEIPVSSYPSVKESIYLDYETLIDNTGKKLDIDIEQTSKFPSPQGFISRSKYERLGIAARLDVGPIHTGRGLLLVAQSNFRRYIKLPVLIALKNIGRILLFQRPEWFEDWIDLCKETHIICSYDGEEYSQTRFPGRWLKEGIQIKILFPFRLKPWHNQEKRRIGGKIITEYTKSRNSDTIVNYLNTKKAEFTYLTAWGFQTDLPFGTIKEEHPFWKPIRVELMRMIEKNIFLRTRQAYHFLSKQNVLAEFVRNLANKLNFFYTLERTSGKKSWKKKLEKKDLVNSKFKRDEYFFNEKPIDKEVYENSSLTSSNNQSYLGNNEKRMEQKGFALDVQSGMNTTTPNILLGNRLGEQRQDISQIRSNEMNLYGPNLIGSLRLEKELVGIGEKLLKLHELVIESMENCAWYIRTAFRDLYRIIVYFLIQLATLQTQLLRAIDEATYKLEEANKSNLKISDRYSLLTIGNNQSKHLLSHAYLYEKTWRANNLDLTILLDEDAVSLSDRIEGSFCVVNETNWNEISELDVHTQKDSSFRKSRNIISTNNLENPATHKYKYFDERIKIYGERWGLTKSFQKLTRNDWKIWLDRFERYNVPMEVWHRIAPYRWRTDLSNLKKLEEIDKNILDEHSSLFCKSKDDYSIYTENPLLKDRIRNLNKRRRFNYFLENLVDYLGEANVDKFVVRRNGIEQGEINSQARLEYIVTSNGKKNIVSSLISNPKIKWDLRLDLALWSITDITRRDYDKELGFAHKFEKSILTKKYGLLSRSKSYRFGLTLPLSERFFQNQIPQLGRKRFINRESFSSKLRWRFRSKKLQRKLEKLREVVSIVNVIGKEQNITSFYGNIMLEPDLLNVLFTQNRRKVLSHLFFNAHPRRPKVFDDQILMYKMVSTLLKFRGRLKKSLDNESFNVCLLPFLEVTNEKDSSFCNIEDFLLPRRRRQLRFLESLPISKSTRFGSNLLNSIFDSEEIEKRKIRGNPMGVQRIKRFLWPDHRLEDLACINRFCFGTANGSRFSALRIRMYPIIED

SEQ ID NO: 904 - protein, 143 aa, Sulfolobus islandicus LAL14/1; identical to SEQ ID NO: 894

SEQ ID NO: 905 - protein, 167 aa, Sulfolobus acidocaldarius SUSAZ
MVETQKTKKKILHLSLIKMLRVYAVLRRFGYLDPLIYSLDPNVIKDTLTQATREYLSYMQSAVEKEAFIYNRKTRNTEKAKIPCLAILKQSDIKELFVRGYKDVVHEIVKGESSHEKEYCISPVVFLKDGNIRVSVPSEFELKSFMNELNKNIYVARELVELAMGGS

SEQ ID NO: 906 - protein, 121 aa, Pyrococcus horikoshii OT3
MILVVETEYEGIVKMLRFFVQMKNFSYVDRIGNALNPETVEVALFETIRAFRSVRESASIDKEGRRYVEKDGNKILVPGIPRDEEVEKFLEDVRSNIGVAKLVATLALAYPSKRENSGGEE

SEQ ID NO: 907 - protein, 146 aa, Sulfurisphaera tokodaii str. 7
MSVEKTDTEGIIRRVANLLASVFIYSESPTYVDRFANALSKEAVARVIYESQRIIQMGISSGEVKMGNVEISGKSMKITDKKGEESYPAVIIKTKEGRNYIVVGYLPTDKDVEDFMSLVERDIYYARKAGALAMSIANRSLLGGGE

SEQ ID NO: 908 - protein, 121 aa, Thermococcus kodakarensis KOD1
MNRMVKTEYEGIVKMLRFFVQTKNFSYVDRIGNALNPEPVEVALLEALRAFRSIRESASIEGDGRRYVEKDGNKIPMPGIPSDEEVKIFLDDVRSDMGVAKLVATLALAYPSKKENSGGDE

SEQ ID NO: 909 - protein, 211 aa, Aspergillus oryzae RIB40
MLDDVPALEDLVTNILEYGQIWKGDGLFDSGLDGENGVILSARHYKKYIQKSTQREGFAIDRVTDKRSSRAQIGKFKTLSMIDRFGRRLSQAFAETAQGEVYFFTRSGLDRTAFPGTTVWRGWEYPALTRNPRVTKIIQVDPFKEGDLGHTIWTPDQGPSRNPPKSGNVAWNKVWGLRYYAPLVSNCVCLPCTGLMGKGQFFELQRFGSGW

SEQ ID NO: 910 - protein, 131 aa, Candidatus Caldiarchaeum subterraneum
MGENFSKDRKAYFPPITHPYVQTGVLARESRFSEEEWSSLMDVARTFRYFVIESKYGYVDRLANAFNHRIAEVAVMEALREARSAADAGEKVHIPSETHVIKVVELMKKDLSAAKVLAALALAFPEKRGEE

SEQ ID NO: 911 - protein, 131 aa, Candidatus Caldiarchaeum subterraneum; identical to SEQ ID NO: 910

SEQ ID NO: 912 - protein, 125 aa, Pyrococcus abyssi GE5
MEFLLLFMVSNMEGYGEIINMLRFFVRIKNFGYVDRIGNALTPEPVEIALHEAMRAFRSIWEGAKTDEEGRRYIEKDGEKIYLPKIPSDTEIESFLNEVRRDIRIAKRVATLALAYPKERKERGE

SEQ ID NO: 913 - protein, 1674 aa, Plasmodium knowlesi strain H
MNNEITKSLFPYEAKFFKGIFDKYIKNEDYNEDLKVVRSSKHLMEEVISKENGLNFYLDEHFDDIFLQKCKLEFFRKLLKCVYGRKEENIPQGESSSDVVGTGKNVDTVGWQKEKHTSKGVGNVNELPDYFIFNKKINIINSYRIYSYCSNIIQSLPSLTYLSVVKIYLANYPLSVFLSCVYFYTFVTYVCDGENLIEFLESLFFSLLVTMGLVALTAVHYAKENRINSITSKMNNFKENYICRNFIRKKPKGKAMFAKYESRKTIEIKKYSKYFFLKSFLNRINEELLDYEVFSADKRSSYVQENFKEIIPLGCSAVNSEGGAKQEGELAPNGDDFGVQKANTSRVNVEGVFAEGKSKTGSKLLSTEEQKDGRVEMQDEEGSSNAATKKKVLLSNESDGEKSPSSDTQRVDKSGDGRKNSTDIAKEKKRNLLNYIIFENNLYKINSKNILVGDIVYLFKGDVIPADGILIRSNNMVVDESNILKFEKTWKKKISLDEYMYYYEKSKKRKISVNELRKKKLNYFEILNLKVKMTLKKLSREQVGDTNVQITTREHNTDENPEDQGKIDMLNQSGNEKGGENRNSKNNKLATNFEKLFEYSPLVLSESTVKEGTGVMLTTCVSKNKQMFQNTIKDMEESTELEDIINSFSKNVVIIIIFYCILCILFVFIHFLINLVENNMQTSAYNMLMFLLNCIILEILKYLLLSIDQMPLLLQNCIAINSKQIIRENFILKRKNTFEKILFTNIIYVDLERYTKYRCVYFFCNADICFCTGLDVMGDMQVEQKFLNLTEDQEKKAEISRNLFFKILVQGIFTTSNLYHYNENFLYIDLSLLKFLKGFEINLEDYFIPKKHLFRVISSGHDFVISFVLSEEGFWSKEGSGAQGGYPPTILRIFLRGRASLVLPKCSQYLDGDSLRRLVRRGGKVQQVHEEKHEEIICFAYKEVALSAKESEELFQYEDNNDYTFDNKEMNKNLDETYLKYVEQNDYTCVSIMVFEKMLTKHFYFDYKMLQANGMSVKLFSKHSMSKVKKLFCEFPHFFENFKLYNAKLVGEEETLDLHYQNDDERFGNHPQEEDKKNANDIKRKSGDGNEYNETTHLEGSNLGKYTLKKWNSKSLLVNKCRSEILNLKECDDNVMINMASQNDAQKKKHDFLLSNNIFYKCENTELSRLMSISSYYGKNALVTNESSIDCGEGLYSLRICDNRGTGESKEKSDIVILNKSLYDFVKLKNFSNCILTNIKLFIEYNITFYVCLVIFSTVCTLVNGFEFLSTIQILYIYFVKNVIFHYLSCYRKSSISTVGKKKKQTYDFFKENDINSMISSILSKTVILFLVFFFGHLFIPESKWDFVTPDMRNLLEFSEFAYLTDKDKSSFFYTIRSCIRLKKNLENLKIENVIDVKNDYRSLAEWDSYISPGRHGTILFNIFFLFFFFSYVHIYLKSFLRDIHIFWEMYKGPQIDKFSNYIMPLVGIEGEGKKELSEDINQFMEELKEERKSTSLVNLENVKNSGKELNNQFENGAEGKNASGKVPNTDELHNGENKFSLLKIASQIISKSSLPNDSFNVILLNLVLENYMTFIILFFLMGVHIFVIQFGSFFFNLHVTGLTLLQWVFCFACCLLDLVLYFVTLRLGLFLLPASSFKTFQNLYEPRERSVFDTLNEYKRSYMSKRYKYDLKV

SEQ ID NO: 914 - protein, 121 aa, Thermococcus kodakarensis KOD1; identical to SEQ ID NO: 908

SEQ ID NO: 915 - protein, 83 aa, Desulfobacterium sp.
MDKKTLKPDTSKTRETDSTSWKYYQQHPDTSKDYYGGLPSEEEMRQYTGTRMPQRGIWSVVWSDARRLGILQMATISSRSGIF

SEQ ID NO: 916 - protein, 125 aa, Pyrococcus abyssi GE5; identical to SEQ ID NO: 912

SEQ ID NO: 917 - protein, 146 aa, Bacillus cereus BGSC 6E1
MWVGGLGIIVGSVLLFFALLWFINGQSPATVFKTVTVDEIIAEFNKEGLDAKEATELPQKEFGNIREEGKRFLVPHLGKDQGGRIYKFKNKEDLEKAKKYYDELGNNAPILFSHTYAKGEYLLQMNGQMKDDEFYNYKIVMDNLIK

SEQ ID NO: 918 - protein, 331 aa, Blastomyces dermatitidis ER-3
MAHSHPIADPREIEAEENPSDTDSAYEGSLGDASYTTSVTSSIRNYKYENGRRYHAFKEGEYILPNDEQEQDRMDLNHHIYRTLLGGALYLAPVPDNVRRVLDLGTGTGIWAIDFADGHPVAEVIGNDLSPIQPTWTPPNCRFEVDDFEATWSYAQPFDFIHAREMEGMIKDHDRLFQQAHKFLNPNGWLEMQSIEVNIFGDETLKKAQDLVRWRNLLIEASEKFGKSMSTASTWEDRMNKAGFKNVKAEERILPFSPWPKDEKLKELGRYHQLQIFQALGAYSYAPLIRVLGWKPEEVEILLAGVRRDLKDRSIHFYTKVHFVYGQKVVD

SEQ ID NO: 919 - protein, 331 aa, Blastomyces dermatitidis ATCC 18188; identical to SEQ ID NO: 918

SEQ ID NO: 920 - protein, 499 aa, Paenibacillus sp. HGF7
MSETVNIVKNEKGKVITAELAYTPYNSSNQYGSYKQDVKYSSQDIKRLLSNHEKNSVALREMSDYLYITNGTYRRLIDTTKNIVSFEYLIEPSVVNIEKLNTKSYQKKHAEVKAYLADCIMDTTVDDILFKTIKYGRYSAYDRGTFIQPLPLDYTRIIGVASDGNPVLQFNFEYFEQFQTMREREMQLNGYDPLFKKMYMDYKKRIDDSRVNFSNEYNWRTLPYEKTYTIKIGSNMESREGIGLLYGSIDDIQYYDELKELDRSVINSQKRKIVVQQIPVDKEGNSILGEEEIIQSHENLKKLLPNNAGCLTVLGGTKFDDIPLQLSALEKGKVQEVQSDVLMNAGIGEGALKGGNFSAGVLNVEIITNSLVKILGQIQSIWFNRKFKSFGNSQFQFRMKFLGITSFNRDKVIAAFDGLLDKGGSLSHSIAARGMDVSNYIDIVAIEDALEYKDKFKPLQTSHTISGNDGGRPSEPDLSNDNTVKDKTNGGSMAPRTGQ

SEQ ID NO: 921 - protein, 238 aa, Streptomyces coelicoflavus ZG0656
MLVGLAVLWPGGAPSHERTGVGFDRQTQQATVTKVVELSCQAVNGSGATPTGDTSTAEGSSAVQQAKGECKRATIRVDTGDDKGRTFDEIVQPDQSRQLHEGQKVVVAYEPSAPEDLQYSVTDINRRLPLALLAGIFALAVVVVGRLRGLMALISLALSFLLLNFFILPAILQGSNPLVVAVVGSSAIMLIALYLCHGLSARTSVAVLGTLISLLLIGVLGSLFIGWAALTGNTDDNT

SEQ ID NO: 922 - protein, 150 aa, Metallosphaera yellowstonensis MK1
MFDYSIKIAMKSQSLSDFRRVANALALAALVQESTTVIDRMAYALTPEQSVRALNDALRTIASVSQGSTSFQVSQVQVKKEENTYTFTEVKEREGNMRYKIPGGLPTQEEVTDFIDAVTADVRLARKVGAVALSLYVRAKQEVSKGEVKS

SEQ ID NO: 923 - protein, 121 aa, Thermococcus litoralis DSM 5473
MVETEYEGIVKMLRFFVQTKNFSYVDRIGNALNPEPVEVTLLEALRAFRSIRESASIGGDGRRYVEKDGNKIPVPGIPSDEEVKKFLDDVRSDMGVAKLVATLALSYPSKKENSGGDEWCF

SEQ ID NO: 924 - protein, 239 aa, Pseudanabaena biceps PCC 7429
MAIINLIDGEKGGVGKSWVARTMLQYLKDRAIPLAGIEADRSNPTVLNIYKDSKAAFFSENEKMADVPDSIFDYALKKTVVVNLPAQAHRAVSQWINTKGLLDLGKEHGVSFIKWFVSDGESDSIELFIESLEHYQGYITHVFIKNWGRCDEWGYFHEHEAIQKAIAEYGVAVIDFPKLGDGRRIEINAKRLTFEEASNYSEFGIIGRNQIKTFLRDAYKAFESTNLLPQNVQKKEAKS

SEQ ID NO: 925 - protein, 714 aa, Acinetobacter proteolyticus
MTRVVVFSKKNSNILQDAQLKSVVLDQPSIVQMGVNQADIKSMIKQGNDLVITLKNGEKIVVSGFYSDDNLTEHSLALVKEDGTYAVAEFDDSGKFVRYAPASSLTQFAYTDAVTTSVSQSQNVDHDSAISKSQLWKVGLAALVAEGVYLWAVKDDDDDKNKSSNQPIDITPPATPTANLGTDTQTITGKTEAKAKIEIKDAAGKVIATTQADAEGNFTIKLDQPLVNGGKVSVTAIDASGNASKATVVTGNKDTIAPDAPTAQLNADGTIVTGKAEANAKVSIYDADGKLLGSVIANKEGLYSIKVSPALTSEKGGTVVAEDAAENKSTPSKVIAGKDTLAPDQPFVDVNKEGSSIQGRAEANSKVQIKDVDGKIIGSGVTDAQGKFQITLSPALATDKKATIIVEDAAGNQSKPLEITAGKDSIAPDKAVAEINAAGDSVTGTAEANTKIEIRSADGKTLYGSGTVGADGKFSITLSSALTDKNVGKVYIIDAAGNRSDAFDVVGTKDTIAPNKPILQTVMDDVGAVKGAIAAGGDTDDTKPTLAGVGEAKTVLTIYDNGQPIGTVTVGDNGRWSFEIKQDLSVGAHKITLTLTDAAGNISEASDAFSFNVVAPVVKASLADTVDLDALQTQQVEPVSESTSIEKPSLNTLLSSSEPASNQLDTVLDQLLAGQNSTPSISQSSHTDLPNLDYAQTIKADPLDQLVALQHSII

SEQ ID NO: 926 - protein, 715 aa, Acinetobacter sp. CIP 56.2
MTRVVVFSKKNSNILQDAQLKSVVLDQPSIVQIGVNQADIKSIIKQGNDIVITLKNGEKIVVSGFYSNENLTEHNLALAKEDGTYAVAEFDDSGKFVRYAPATSLTQFAYTDAVTTPVSQPQNVDHDSAISKSQLWKVGLAALVAEGVYLWAVKDDDDDKNKSSNQPIDITPPATPTASLDTDTQTITGKTEAKAKIEIKDAAGKVIATTQADAEGNYTVKLDQPLVNGGKVSVTAIDSSGNASKAAVVTGNKDTIAPDAPTAQLNADGTIVTGKAEANAKVSIYDADGKLLGTVIANKEGLYSIKVSPALTSDIGGTVVAEDAAGNKSTPSKVIAGKDTLPPDQPFVDVNKEGSSIQGRAEANSKVQIKDADGKIIGSGITDAQGKFQITLSPALATDKKATIIVEDAAGNQSKPLEITAGKDTIAPDKAVAEINAAGDSVVGTAEANSKIEIRSADGKTLYGSGTVGADGKFSITLSSALTDKNVGKVYIIDAAGNRSDAFDVVGTKDTIAPNKPILQTVMDDVGAVKGAIAAGGDTDDSKPTLAGVGEAKAVLTIYDNGQPIGTVAVGDNGRWSFEVKQDLSVGAHKITLTLTDAAGNISETSDAFSFNVLAPAVAKASLADTVDLEALQTQHAEPVSESNNIEKPSLNTLLSSSEPVSNQLDEVLNQLLLGQNPSTTISHSGNADVTHLDYAQTIKADPLDQLTVLQHSII

SEQ ID NO: 927 - protein, 715 aa, Acinetobacter sp. CIP 70.18
MTRVVVFSKKNSNILQDAQLKSVVLDQPSIVQIGVNQADIKSIIKQGNDLVITLKNGEKIVVSGFYSNENLTEHSLALAKVDGTYAVAEFDDSGKFVRYAPATSLTQFAYTDAVTTPVSQPQNVDHDSAISKSQLWKVGLAALVAEGVYLWAVKDDDDDKNKSSNQPIDITPPGTPTANLGTDTQTITGKTEAKAKIEIKDAAGKVIATTQADAEGNYTIKLDQPLVNGGKVSVTAIDSSGNASKAAVVTGNKDTIAPDAPTAQLNADGTIVTGKAEANAKVSIYDADGKLLGTVIANKEGLYSIKVSPVLTSDKGGTVVAEDAAGNKSTPSKVIAGKDTLPPDQPFVDVNKEGSSIQGRAEANSKVQIKDADGKIIGSGVTDAQGKFQITLSPALATDKKATIIVEDAAGNQSKPLEITAGKDTIAPDKAVAEINAAGDSVVGTAEANSKIEIRSADGKTLYGSGTVGADGKFSITLSSALTDKNVGKVYIIDAAGNRSEASDVVGTKDTIAPNKPILQTVMDDVGAVKGAIAAGGDTDDSKPTLAGVGEAKAVLTIYDNGQPIGTVTVGDNGRWSFEVKQDLSVGAHKITLTLTDAAGNISETSDAFSFNVLAPAVAKASLADTVDLEALQTQQAEPVSESTNTEKLGLSSLLSSPEPTSNQLDEVLNQLLTGQNSSPTISHSANADLTNLDYAQTIKADPLDQLTVLQHSII

SEQ ID NO: 928 - protein, 715 aa, Acinetobacter sp. ANC 3880
MTRVVVFSKKNSNILQDAQLKSVVLDQPSIVQIGVNQADIKSIIKQGNDLVITLKNGEKIVVSGFYSNENLTEHSLALAKVDGTYAVAEFDDSGKFVRYAPATSLTQFAYTDAVTTPVSQPQNVDHDSAISKSQLWKVGLAALVAEGVYLWAVKDDDDDKNKSSNQPIDITPPGTPTANLGTDTQTITGKTEAKAKIEIKDAAGKVIATTQADAEGNYTIKLDQPLVNGGKVNVTAIDSSGNASKAAVVTGNKDTIAPDAPTAQLNADGTIVTGKAEANAKVSIYDADGKLLGTVIANKEGLYSIKVSPVLTSDKGGTVVAEDAAGNKSTPSKVIAGKDTLPPDQPFVDVNKEGSSIQGRAEANSKVQIKDADGKIIGSGVTDAQGKFQITLSPALATDKKATIIVEDAAGNQSKPLEITAGKDTIAPDKAVAEINAAGDSVVGTAEANSKIEIRSADGKTLYGSGTVGADGKFSITLSSALTDKNVGKVYIIDAAGNRSEASDVVGTKDTIAPNKPILQTVMDDVGAVKGAIAAGGDTDDSKPTLAGVGEAKAVLTIYDNGQPIGTVTVGDNGRWSFEVKQDLSVGAHKITLTLTDAAGNISETSDAFSFNVLAPAVAKASLADTVDLEALQTQQAEPVSESTNTEKLGLSSLLSSPEPTSNQLDEVLNQLLTGQNSSPTISHSANADLTNLDYAQTIKADPLDQLTVLQHSII

SEQ ID NO: 929 - protein, 714 aa, Acinetobacter sp. CIP 110321
MTRVVVFSKKNSNILQDAQLKSVVLDQPSIVQIGVNQADIKSIIKQGNDLVITLKNGEKIVVSGFYSNENLTEHSLALAKVDGTYAVAEFDDSGKFVRYAPATSLTQFAYTDAVTTPVSQPQNVDHDSAISKSQLWKVGLAALVAEGVYLWAVKDDDDDKNKSSNQPIDITPPATPTANLGTDTQTITGKTEAKAKIEIKDAAGKVIATTQADAEGNYTIKLDQPLVNGGKVSVTAIDSSGNASKAAVVTGNKDTIAPDAPTAQLNADGTIVTGKAEANAKVSIYDADGKLLGTVIANKEGLYSIKVSPALTSDIGGTVVAEDAAGNKSTPSKVIAGKDTLPPDQPFVDVNKEGSSIQGRAEANSKVQIKDADGKIIGSGVTDAQGKFQITLSPALATDKKATIIVEDAAGNQSKPLEITAGKDTIAPDKAVAEINAAGDSVVGTAEANSKIEIRSADGKTLYGSGTVGADGKFSITLSSALTDKNVGKVYIIDAAGNRSEASDVVGTKDTIAPNKPILQTVMDDVGAVKGAIAAGGDTDDSKPTLAGVGEAKAVLTIYDNGQPIGTVTVGDNGRWSFEVKQDLSLGPHKITLTLTDAAGNISEASDAFSFNVVAPVVKASLADTIDLGALHPQHAEPVSESTNTEKLGLSSLLSSPESTSNQLDEVLNQLLTGQSSSATINSSGNADLTHLDYAQTIKADPLDQLTVLQHSII

SEQ ID NO: 930 - protein, 499 aa, Paenibacillus sp. HGH0039; identical to SEQ ID NO: 920

SEQ ID NO: 931 - protein, 71 aa, Fusarium graminearum PH-1
MARVTYEGLLKGGMSNESVSRSLHDATRELRSQWLKAEMGQDGDTGVRDIVPMEDESDIRPLWVPYVHCGI

SEQ ID NO: 932 - protein, 125 aa, Candidatus Aramenus sulfurataquae
MSQVEEKQERAIENVATLLAVATLYANAPTFTDRMSNALNKESVMRALYDAERVVLAGKNKGDITEGKAVISVKVAENETAKVYGYLPSDLDVEEFLRMAERDIYIARKVGAIAISKVNKVGGGQ

SEQ ID NO: 933 - protein, 130 aa, Thermoproteus tenax Kra 1
MESVQLKKEELVERAARSVRPAVHLEMAYDVLDELSRSPEKYPEQLAKLSRIVVKVLNDVEDELEHNPQNEELQKARNRLAAWGGYVAELAKRLEEADDRERIRMVRLFCAMALAPDKLTVELKKLLKGR

SEQ ID NO: 934 - protein, 116 aa, Archaeoglobus fulgidus DSM 4304; identical to SEQ ID NO: 872

SEQ ID NO: 935 - protein, 125 aa, Pyrococcus abyssi GE5; identical to SEQ ID NO: 912

SEQ ID NO: 936 - protein, 121 aa, Pyrococcus horikoshii OT3; identical to SEQ ID NO: 906

SEQ ID NO: 937 - protein, 150 aa, Sulfolobus solfataricus P2; identical to SEQ ID NO: 873

SEQ ID NO: 938 - protein, 129 aa, Sulfolobus solfataricus P2; identical to SEQ ID NO: 874

SEQ ID NO: 939 - protein, 146 aa, Sulfolobus tokodaii str. 7; identical to SEQ ID NO: 907

SEQ ID NO: 940 - protein, 116 aa, Archaeoglobus fulgidus DSM 4304; identical to SEQ ID NO: 872

SEQ ID NO: 941 - protein, 150 aa, Saccharolobus solfataricus P2; identical to SEQ ID NO: 873

SEQ ID NO: 942 - protein, 146 aa, Bacillus; identical to SEQ ID NO: 917

SEQ ID NO: 943 - protein, 579 aa, Leptospira mayottensis
MNYYLFFPMTAFIANTMFIAFVYARRTSNPIIRSYLLYTIVLDAWLFTYAFGWSFPPTPWMTWAFKILSITWLPLGALYLEFVFTFLNRKPGIFLWLFRIGTPISYLIILSTDWVIQGSIHYYWGNEGEPGPLYFFIIFNFVALPALIGLGVLTKSFFVSGKDQKKQTGLAILGSMFAIFLSFYSEIIQVDDQGRMLSMPLTPIGILIQSFLIFTAITRYGFLRINVEGLAADLFRDIHDGMILVKQDRSLFFMNESAIGILGISNNTPSYFYPSDFLKGYRESPDYLSKEYEPIFNVNCRGVELTRSHIELTGKENGYLYILRDISEKIESREKIERFYSDFNKDLEIAKIAQTSAISTIFPESSKYKFYSHFQPFELVGGDFLRAIERSDGKLDVLFADVSGHGISSAMVTGMLSISFQLVIETNQTPKEALEKIQTLLLNAVLNHHVSAIYFSFDPNTNILEYSYAGHHPILIFRDGEIIPLRGAGRILLITPETELNNYTFQLKKGDILFLYSDCLFEVRNPEGEILGYENFMLKMHEISVYTPVNILKTCIGQALAFGNGKLTDDLTILILEIL

SEQ ID NO: 944 - protein, 579 aa, Leptospira mayottensis
MNYYLFFPMTAFIANTMFIAFVYARRTSNPIIRSYLLYTIVLDAWLFTYAFGWSFPPTPWMTWAFKILSITWLPLGALYLEFVFTFLNRKPGIFLWLFRIGTPISYLIILSTDWVIQGSIHYYWGNEGEPGPLYFFIIFNFVALPALIGLGVLTKSFFVSGKDQKKQTGLAILGSMFAIFLSFYSEIIQVDDQGRMLSMPLTPIGILIQSFLIFTAITRYGFLRINVEGLAADLFRDIHDGMILVKQDRSLFFMNESAIRILGISNNTPSYFYPSDFLKGYRESPDYLSKEYEPIFNVNCRGVELTRSHIELTGKENGYLYILRDISEKIESREKIERFYSDFNKDLEIAKIAQTSAISTIFPESSKYKFYSHFQPFELVGGDFLRAIERSDGKLDVLFADVSGHGISSAMVTGMLSISFQLVIETNQTPKEALEKIQTLLLNAVLNHHVSAIYFSFDPNTNILEYSYAGHHPILIFRDGEIIPLRGAGRILLITPETELNNYTFQLKKGDILFLYSDCLFEVRNPEGEILGYENFMLKMHEISVYTPVNILKTCIGQALAFGNGKLTDDLTILILEIL

SEQ ID NO: 945 - protein, 121 aa, Thermococcus litoralis; identical to SEQ ID NO: 923

SEQ ID NO: 946 - protein, 714 aa, Acinetobacter proteolyticus; identical to SEQ ID NO: 925

SEQ ID NO: 947 - protein, 715 aa, Acinetobacter sp. CIP 56.2; identical to SEQ ID NO: 926

SEQ ID NO: 948 - protein, 715 aa, Acinetobacter; identical to SEQ ID NO: 927

SEQ ID NO: 949 - protein, 715 aa, Acinetobacter sp. ANC 3880; identical to SEQ ID NO: 928

SEQ ID NO: 950 - protein, 238 aa, Streptomyces coelicoflavus; identical to SEQ ID NO: 921

SEQ ID NO: 951 - skipped

SEQ ID NO: 952 - protein, 150 aa, Metallosphaera yellowstonensis; identical to SEQ ID NO: 922

SEQ ID NO: 953 - protein, 239 aa, Pseudanabaena biceps; identical to SEQ ID NO: 924

SEQ ID NO: 954 - protein, 499 aa, Paenibacillus; identical to SEQ ID NO: 920

SEQ ID NO: 955 - protein, 62 aa, Saccharolobus solfataricus
MRVANLLAVGFLYSESPTLVDRFANALSKEAVTKVLYDVQRIVQMGIDRGEIVSTTTMIQGK

SEQ ID NO: 956 - protein, 69 aa, Saccharolobus solfataricus
GKEYPAVNVSSSEGKYTVVGYLPTNQDIEYFLRMIEEDVYYARKAGALAMSIANRTKLVSKSEQGGEKK

SEQ ID NO: 957 - protein, 114 aa, Thermococcus zilligii
MPEYEGIVKMLRFFVQTKNLGYVDRIGNALNPGPVEVTLHEALRAFRSIRENATVGEDGRRYVEKDGEKIPVPGIPSEDEVRAFLDAVRSDIGVAKRVATLALAYPSRKEGGDE

SEQ ID NO: 958 - protein, 125 aa, Pyrococcus abyssi; identical to SEQ ID NO: 912

SEQ ID NO: 959 - protein, 116 aa, Archaeoglobus fulgidus; identical to SEQ ID NO: 872

SEQ ID NO: 960 - protein, 121 aa, Pyrococcus horikoshii; identical to SEQ ID NO: 906

SEQ ID NO: 961 - protein, 150 aa, Saccharolobus solfataricus; identical to SEQ ID NO: 873

SEQ ID NO: 962 - protein, 129 aa, Saccharolobus solfataricus; identical to SEQ ID NO: 874

SEQ ID NO: 963 - protein, 146 aa, Sulfurisphaera tokodaii; identical to SEQ ID NO: 907

SEQ ID NO: 964 - protein, 121 aa, Thermococcus kodakarensis; identical to SEQ ID NO: 908

SEQ ID NO: 965 - protein, 301 aa, Pelodictyon luteolum; identical to SEQ ID NO: 875

SEQ ID NO: 966 - protein, 107 aa, Hyperthermus butylicus; identical to SEQ ID NO: 877

SEQ ID NO: 967 - protein, 126 aa, Staphylothermus marinus; identical to SEQ ID NO: 878

SEQ ID NO: 968 - protein, 70 aa, Clostridium beijerinckii; identical to SEQ ID NO: 880

SEQ ID NO: 969 - protein, 121 aa, Metallosphaera sedula; identical to SEQ ID NO: 879

SEQ ID NO: 970 - protein, 148 aa, Ignicoccus hospitalis; identical to SEQ ID NO: 881

SEQ ID NO: 971 - protein, 108 aa, Candidatus Korarchaeum cryptofilum; identical to SEQ ID NO: 882

SEQ ID NO: 972 - protein, 473 aa, Thermodesulfovibrio; identical to SEQ ID NO: 883

SEQ ID NO: 973 - protein, 127 aa, Desulfurococcus amylolyticus; identical to SEQ ID NO: 884

SEQ ID NO: 974 - protein, 143 aa, Sulfolobus islandicus; identical to SEQ ID NO: 886

SEQ ID NO: 975 - protein, 143 aa, Sulfolobus islandicus; identical to SEQ ID NO: 885

SEQ ID NO: 976 - protein, 142 aa, Sulfolobus islandicus; identical to SEQ ID NO: 887

SEQ ID NO: 977 - protein, 162 aa, Sulfolobus islandicus; identical to SEQ ID NO: 888

SEQ ID NO: 978 - protein, 142 aa, Sulfolobus islandicus; identical to SEQ ID NO: 889

SEQ ID NO: 979 - protein, 116 aa, Methanocaldococcus sp. FS406-22; identical to SEQ ID NO: 893

SEQ ID NO: 980 - protein, 217 aa, Cenarchaeum symbiosum; identical to SEQ ID NO: 876

SEQ ID NO: 981 - protein, 469 aa, Desulfobacca acetoxidans; identical to SEQ ID NO: 896

SEQ ID NO: 982 - protein, 131 aa, Metallosphaera cuprina; identical to SEQ ID NO: 897

SEQ ID NO: 983 - protein, 133 aa, Acidianus hospitalis; identical to SEQ ID NO: 898

SEQ ID NO: 984 - protein, 480 aa, Mahella australiensis; identical to SEQ ID NO: 899

SEQ ID NO: 985 - protein, 115 aa, Pyrococcus yayanosii; identical to SEQ ID NO: 900

SEQ ID NO: 986 - protein, 116 aa, Pyrolobus fumarii; identical to SEQ ID NO: 901

SEQ ID NO: 987 - protein, 143 aa, Sulfolobus islandicus; identical to SEQ ID NO: 894

SEQ ID NO: 988 - protein, 143 aa, Sulfolobus islandicus; identical to SEQ ID NO: 895

SEQ ID NO: 989 - protein, 115 aa, Pyrococcus sp. ST04; identical to SEQ ID NO: 902

SEQ ID NO: 990 - protein, 116 aa, Methanocaldococcus fervens; identical to SEQ ID NO: 891

SEQ ID NO: 991 - protein, 714 aa, Acinetobacter sp. CIP 110321; identical to SEQ ID NO: 929

SEQ ID NO: 992 - protein, 143 aa, Sulfolobus islandicus
MAQQVKEEKEGIIGRVANLLAVGFLYSESPTLVDRFANALSKEAVTKVLYDVQRIVQMGIDRSEIVSTTTMIQGKEYPAVNVSSGEGKYTVVGYLPTNQDIEYFLRMIEEDVYYARKAGALAMSIANRIKLSSKSEQGGGEKK

SEQ ID NO: 993 - protein, 131 aa, Sulfolobus islandicus
MDEQKIEGIVRRIANLFATTYLYSESPTLVDRFANALSKEAVAKVLYDAQRIVQMGLDRDEIKSDIVKIKDKDYPAIVIKKENSVQIVGYLPTDQDVEDFLSLIEKDVYYARKAGALAMSIANKTKLGGSQ

SEQ ID NO: 994 - protein, 129 aa, Crenarchaeote SCGC AAA261-N13
MIMEEKFMNVSIENIAKVLALLATQGNYTYIDKMGYVPSKDLLTYYLRESLRDFHSLLRTGLKEEEAKDLYDSLVTDIKENKINLDRSIDTIVNSIPEGDRKKLREISSLIAAKALAISAKYIGTVTSK

SEQ ID NO: 995 - protein, 126 aa, Thaumarchaeota
MQEDRFVQIPNMLAVLAHEGDYSYIDRIANSQSKPLVLHYLREALRDFNSLKRNPPQEMNREAIELLQEINHDYLERELDRIMVIDDARKLREVVSYLCAKALARASGFIEQSRRARSERKEAGES

SEQ ID NO: 996 - protein, 150 aa, Crenarchaeota
MAEIYKEGRENIIRRHIRVRNLLASVALAMGHYTLLDRLNNAVSIDAVQKTIYEAARIVETLIKQGKVKEVKEEKEEGKPYIFIRIDNDEYKFYGTLPSSSDIDDFLAESIKDVRIARIIGASAMGLIASVIESESKEKAASQGVLGGAT

SEQ ID NO: 997 - protein, 117 aa, Streptomyces
MDAFIDIEGGDRVGELAALVGWLRRERELQGVVRLVRRDVEETELGSGLDVLSVAVGSGGVGVALAQSLSAWLRTRRSDVKVTVTANGRTVEVDARRVSDPVGLITRVLGGDDGTGD

SEQ ID NO: 998 - protein, 475 aa, Streptomyces
MTTPQQPPFPPHDPRRGAGTGHGDGRESGPASPGAHGTGAGGHGHSHAHSHGPAAPVSRHLRKVIAAVLIPFAAAVLVGLAVLWPGGAPPHERTGVGFDRQTQQGTVTKVVELSCQSVNASGVPPTGDTSTAEGSSAVQQANGECKRATIRVDSGKDKGRTFDEIVQPDQSRQLSEGQKVVVAYEPSAPEDLQYSVTDINRRVPMALLAGIFALAVVVVGRLRGLMALISLAVSFLLLNFFILPAILQGSNPLLVAVIGSSAIMLIALYLCHGLSARTSVAVLGTLISLVLIGVLGSLFIGWAALTGNTDDNTGLIHGLYPTIDMSGLLLAGVIIGSLGVLDDVTVTQTSAVWELHEANPTLGRRGLYRAGIRIGRDHIASVVNTLVLAYAGAALPLLLLFSIAQSGVGTVANSELVAEEIVRTLVGSIGLVASVPVTTALAALVVSADRPADRPAAQPTGAAPARGGRGRRRKR

SEQ ID NO: 999 - protein, 126 aa, Thaumarchaeota
MQEDRFVQIPNMLAVLAHEGDYSYIDRIANSQSKPLVLHYLREALRDFNSLKRNPPQEMNREAIELLQEINHDYLERELDRIMVIDDARKLREVVSYLCAKALARASGFIEQSRRARSEPKEAGES

SEQ ID NO: 1000 - protein, 150 aa, Thaumarchaeota
MSATQTQQQMEPTKEYRDVAVLLAAASALTGSPSLIDRLTYALSPEPALKAVADALRIVQSDQNSQEPAITQTKTEKGYSIVSVRVEDKKSPLVIYGRLPGSELVRSFIETVSRDVNIARKIGTFASSLLVEAQLRLGREQGESEREKGE

SEQ ID NO: 1001 - protein, 102 aa, Crenarchaeota archaeon SCGC AAA471-L14
MAEIYKEGRENIIRRHIRVRNLLASVALAMGHYTLLDRLNNAVSIDAVQKTIYEAARIVETLIKQGKVKEEKREIRTFKKNKDIKITISTGTFSILKSEIGY

SEQ ID NO: 1002 - protein, 150 aa, Crenarchaeota archaeon SCGC AAA471-O08
MAEIYKEGRENIIRRHIRVRNLLASVALAIGHYTLLDRLNNAVSIDAVQKTIYEAARIVETLIKQGKVKEVKEEKEEGKPYIFIRIDNDEYKFYGTLPSSSDIDDFLAESIKDVRIARIIGASAMGLIASVIESESKEKAASQGVLGGAT

SEQ ID NO: 1003 - protein, 131 aa, Candidatus Caldiarchaeum subterraneum; identical to SEQ ID NO: 910

SEQ ID NO: 1004 - protein, 280 aa, Haloquadratum walsbyi
MYSELDSLSGTVLIILDEVDKIGEDDTLLYELPRSRDIGYLEDVRVGVIGISNNYTFRRNLSPKVKDSLCETEIKFSPYDATELADILHNRAEQALYDGTYADGIINLVSALAYQEASGSARRAIRLLRGSAEIAEGEGVTQIQKEHVRQANEKIEYGNIVESIAEQDDEKLYILKSLAHLALVEKTPARTRTVHQTYCRVVRAYNEDSGNEPLTRRGMFNHLSKLVMFGFVNTIDRNAGAAGGQWSEHGFSDDIGPSKIKEAIEANGLEWKQISTRGVS

SEQ ID NO: 1005 - protein, 167 aa, Sulfolobus acidocaldarius; identical to SEQ ID NO: 905

SEQ ID NO: 1006 - protein, 344 aa, Aspergillus oryzae RIB40
MIQYPTILDMLLALPGAKGTKYESEDAEHAAKARKAAGDTHCQGGEQAQSPKTNDHPVEEESIINNDATTVEVPHVPNEGAKIVEDAGLKAANQDGLDEALESTRSENDAASQACKRAPGLNCFKNGGKPQYRMLDDVPALEDLVTNILEYGQIWKGDGLFDSGLDGENGVILSARHYKKYIQKSTQREGFAIDRVTDKRSSRAQIGKFKTLSMIDRFGRRLSQAFAETAQGEVYFFTRSGLDRTAFPGTTVWRGWEYPALTRNPRVTKIIQVDPFKEGDLGHTIWTPDQGPSRNPPKSGNVAWNKVWGLRYYAPLVSNCVCLPCTGLMGKGQFFELQRFGSGW

SEQ ID NO: 1007 - protein, 1674 aa, Plasmodium knowlesi strain H; identical to SEQ ID NO: 913

SEQ ID NO: 1008 - protein, 144 aa, Strongylocentrotus purpuratus
AIEEGSLDILDNTDFQDTDIPFEVPLPEKQHIADDLREEVKEWVLSISMDQQVEQVLDKDERDTYVASLVAANSGMKSIPCVITGYPVLRNKLDFKRPDKAANKDDWNKFLMATKMSHSTECQDVLKFVGQWCGATPNPSYTFQ

SEQ ID NO: 1009 - protein, 107 aa, Hyperthermus butylicus DSM 5456; identical to SEQ ID NO: 877

SEQ ID NO: 1010 - protein, 126 aa, Staphylothermus marinus F1; identical to SEQ ID NO: 878

SEQ ID NO: 1011 - protein, 121 aa, Metallosphaera sedula DSM 5348; identical to SEQ ID NO: 879

SEQ ID NO: 1012 - protein, 70 aa, Clostridium beijerinckii NCIMB 8052; identical to SEQ ID NO: 880

SEQ ID NO: 1013 - protein, 148 aa, Ignicoccus hospitalis KIN4/I; identical to SEQ ID NO: 881

SEQ ID NO: 1014 - protein, 108 aa, Candidatus Korarchaeum cryptofilum OPF8; identical to SEQ ID NO: 882

SEQ ID NO: 1015 - protein, 473 aa, Thermodesulfovibrio yellowstonii DSM 11347; identical to SEQ ID NO: 883

SEQ ID NO: 1016 - protein, 127 aa, Desulfurococcus kamchatkensis 1221n; identical to SEQ ID NO: 884

SEQ ID NO: 1017 - protein, 143 aa, Sulfolobus islandicus M.14.25; identical to SEQ ID NO: 886

SEQ ID NO: 1018 - protein, 143 aa, Sulfolobus islandicus L.S.2.15; identical to SEQ ID NO: 885

SEQ ID NO: 1019 - protein, 142 aa, Sulfolobus islandicus Y.G.57.14; identical to SEQ ID NO: 887

SEQ ID NO: 1020 - protein, 162 aa, Sulfolobus islandicus Y.N.15.51; identical to SEQ ID NO: 888

SEQ ID NO: 1021 - protein, 142 aa, Sulfolobus islandicus M.16.27; identical to SEQ ID NO: 889

SEQ ID NO: 1022 - protein, 143 aa, Sulfolobus islandicus M.16.4; identical to SEQ ID NO: 886

SEQ ID NO: 1023 - protein, 116 aa, Methanocaldococcus fervens AG86; identical to SEQ ID NO: 891

SEQ ID NO: 1024 - protein, 143 aa, Sulfolobus islandicus L.D.8.5; identical to SEQ ID NO: 885

SEQ ID NO: 1025 - protein, 116 aa, Methanocaldococcus sp. FS406-22; identical to SEQ ID NO: 893

SEQ ID NO: 1026 - protein, 469 aa, Desulfobacca acetoxidans DSM 11109; identical to SEQ ID NO: 896

SEQ ID NO: 1027 - protein, 131 aa, Metallosphaera cuprina Ar-4; identical to SEQ ID NO: 897

SEQ ID NO: 1028 - protein, 133 aa, Acidianus hospitalis W1; identical to SEQ ID NO: 898

SEQ ID NO: 1029 - protein, 480 aa, Mahella australiensis 50-1 BON; identical to SEQ ID NO: 899

SEQ ID NO: 1030 - protein, 115 aa, Pyrococcus yayanosii CH1; identical to SEQ ID NO: 900

SEQ ID NO: 1031 - protein, 116 aa, Pyrolobus fumarii 1A; identical to SEQ ID NO: 901

SEQ ID NO: 1032 - protein, 143 aa, Sulfolobus islandicus HVE10/4; identical to SEQ ID NO: 894

SEQ ID NO: 1033 - protein, 143 aa, Sulfolobus islandicus REY15A; identical to SEQ ID NO: 895

SEQ ID NO: 1034 - protein, 115 aa, Pyrococcus sp. ST04; identical to SEQ ID NO: 902

SEQ ID NO: 1035 - protein, 143 aa, Sulfolobus islandicus LAL14/1; identical to SEQ ID NO: 894

SEQ ID NO: 1036 - protein, 121 aa, Thermococcus litoralis DSM 5473; identical to SEQ ID NO: 923

SEQ ID NO: 1037 - protein, 1671 aa, Lygodium japonicum; identical to SEQ ID NO: 903

SEQ ID NO: 1038 - protein, 131 aa, Candidatus Caldiarchaeum subterraneum; identical to SEQ ID NO: 910

SEQ ID NO: 1039 - protein, 167 aa, Sulfolobus acidocaldarius SUSAZ; identical to SEQ ID NO: 905

SEQ ID NO: 1040 - protein, 121 aa, Thermococcus kodakarensis KOD1; identical to SEQ ID NO: 908

SEQ ID NO: 1041 - protein, 301 aa, Chlorobium luteolum DSM 273; identical to SEQ ID NO: 875

SEQ ID NO: 1042 - protein, 217 aa, Cenarchaeum symbiosum A; identical to SEQ ID NO: 876

SEQ ID NO: 1043 - protein, 545 aa, Thermotoga sp. RQ2
MLEKIYNLGKIGIESLSDFAEELPLEDGLAIFLESGPNGLIFKDIGPVKKSPGGKSSKVFLYRKQRGNFSSSVSPTMKFLDESSVSRDPLERTFDVFLGFFDHPKISHIKDVLERNKEKIIEKLRNYDLKNRFLTISIDGKFPAEVPEILRAFEDKVTQKKTKGEAKCFLCGKEANSRLSDVFKFATFDKPGFTPFLSRKHPIQICGECRSVLEKARRVIDEKLSFSFFNNRILWIIPSVPNQDILESVIEKISEIKDTDKKSKLRSFARLERKIEDVLSENEKAVYDFILIEKEQQAERIVLHIEEVSPTRVRQILDESDKTESQLKEDGFEISVNFSVIHKFFEDLDRYFNSLFSAVFSEGTFDKKLLLTLFLSKIRSDFFGNDTLLSAREAFATYVYLRRLNVLKGGASVLKGEDFFSRYPEFFDEPWKKAVFLEGVLANYLLYLQYVKRNSKAFTKKLKGLRLTKRDVEGLLPEIRAKIEAYGGMSESVAELFREATEAFLEAGNWSASPDEISFVFVSGLSLGKTFFKEVEVDESGEKQE

SEQ ID NO: 1044 - protein, 723 aa, Halorhabdus utahensis DSM 12940
MLSPDEFREEYPPERLDDELPEIPITSLRTIQYLYGKLYTLATAGGGTYGPYLTPDEAGDLIDTDDSLIVVRVDLSGEEPALAKNGSGPVEVSRYSADLVERVGHCKYPAARGIDHSVTHQAGRNSDPEKLARYAKERLTKWATDSVVQEAAADHEDGWIVEALATLGEDDDALDRIEDDLTTKLGGESTTALLTVQVKTEPDGGYQWPGDLDVFNEAMRQRKLSKLVTKNKADDSSGEATDLVTGQRTRTVGTSEDPQNYFLGKQLEKFPGLDIEEAWRTHSISEDAAVTVMNAETFVEACTYRTFGAKVYYLPYFFGRASTEEIYELYNLLYQAATDDDDLTPVEKAYEDFQGNDDTSLRFYVSAVMPHQMSRYDVFGETLNGRLLYPRDLARHHNRIVSDTSAFNTDTDWSAPLPTNENWGLLTADDEALHSVSSGWYFYQTFGERDDDEADADDPRIEALVSVLGGDAIAVETLLSEYVDRIIADEDDDEVEGFPSFRVASQFAQLCALATETLDLLTTDDPGKRPITIEPDYEVDTMESLEDIQIIPDGGHPAAPKLESFIEETPAIARQSDADDALDEADAERRQSVRNQRRGAFMLGALVGEVGSYQEYSEDRSTTLVDQFPVKSITQSRVKKVTREAIGKTLTYTRQEKKSGGSFPGTKFEHVVEELRKTIVNPDPDDWDIDTEDLRFYYALGVTYGLNDHPEWDSTTEDTEEDI

SEQ ID NO: 1045 - protein, 701 aa, Halomicrobium mukohataei DSM 12286
MLDPDEFYDEYPPEKLEDELPERPISSLRDIQHLYGRLYTLATAGGGDYAAYLTPDQANDLIGTEESLIAVCVDLSGERPTLDAEEPVRVTQYTDDLVQRVAHCKYNAARGIDHSVTHRSGRNSDPEKLARYACERLTKWATDDVVQSIADDHPDGDVIRGLATVGEDENALDRIREAVQTELGGSTTALLTVQVRREEGGEYEWPGQISVFDEAMRARKLSKLVSKGQATNSAGEATDLVSGERTRTVGTAEDPLNYFLGKQMEKFPGLDPDEAWRSHPISEDGAVTLMNAEEFVDACSYRTFNADVYYLPYFLGRPTPEETYKLYAALHRVTRDDDMNPVQALYDEFGDHEAAPEGRLRFYVAAVMKHQMSRFDVYGETLNGRIHYPTEVGQRHEQVTGSWVFDEDDARNGGRTPPMPSHEEWALTNYQRFREMVASGAYLYGTFPFTDEDTDATVDDERIDVHVSILAGDPVPRNQLVSAYVDRLLDRDGDEVPELLIASQFAQLCALENAGLVTTDAGETEPTLIDGPDYDTMEPEHARTDGGTAALDRTEKLESFIEQTDGLDDAERKGAFLLGTLVGQVGTYQQGYHDRSTTVIDQYPIKSMTKTKIKRITQEVIDKDVVYSREMAKKGSEINSTMYKEVTNAIVETMAESDPSDWEISTDDLRFYYALGLTYGMNDRSTNENDAADDETSETNE

SEQ ID NO: 1046 - protein, 729 aa, Haloarcula hispanica ATCC 33960
MANHKSKNKMLKPEKFREEYPENQLTDELPDSPIGSLRDLQYLYGKLYTLATTGGGEYAPYLTPDAAGDLVDTNNSLIVARVDVSGDEPQLADDKLGPIQVTRYTDDLIQQVGHCKYPAARGIDHSVTHQAGRNSDPEKLARYAKERLTKWATDDVVTEAATEHPDGWIIDQLAEFSENETALDTITETLTRKLGGESTTALLTVQVKTEPDGEYQWPGDIDVFREAMRQRKLSKLVTKNKADDSSGDATDLVTGSPARTVGTSEDPQNYFLGKQLEKFPGLDIEEAWRSHPISEDAAITVMKAETFVEACTYRTFGAKVYYLPYVFGRLAPEKVYRLYELLYRTVEDEETTPIEDAYEEERRKTIEEQDFRFYVSAVMPHQMSRYDVFGETLNGRLHYPKQLAIAHNEFVQTVSAFNRDHYTKWTAPLPTNQNWGLLETNDEQLHAVSTGWYFRQTFAERDDDNADADDPRIEALVSVLSGKQIAVDVLLEEYVNRIIDDQTDDSEHEGFPSFLVASQFAQLCVLADEDLRLLQTTDASKNQITQQPSYDTKSMPSVDEILIADGGHPAAPKLESFINETPALSPDHDDDPDSVTSQRRGAFLLGALVGDIGSYQEYSEDRSTTLVDQYPVKSITRSRIKKVTQETVAKTLTYTRQEKKQQGNYPGTKADHIVDRLRDTILNPDPEEWEIETDDLRFYYALGVTYGMNDHPWNRDEADADDSTSEEEH

SEQ ID NO: 1047 - protein, 705 aa, Haloferax mediterranei ATCC 33500
MLSPEEFRRTYPEATLLEELPDRPIASLRDIQYLYGTLYTLATTGGGTYAPYLTPDAAGDLVDEPDSLIVVRVDISGDVPVLASDSQGPVWVTKYTEELIPKVAHCKYPAARGIDHSVTHQAGKNSDPDKLARYAKERLSKWAADSVVQSTAEDHEDGWIIDALAELGENEDTIETLEREVRSNLSGSTTALLTVQVKLDADGPYLWPGDLDVAMAAMRSRKLSKLISKGKASNSAGEATDLITGARTRTVGTAQDPLNYFLGKQLEKFPGFDPDQAWRTHPISEDAAITLMNAETFIDACSYRTFGARVYYLPYFFGKPSVEDTYLLYGILYDTVMQDAEERGLTPIETVYQRREDDAIDDNKLRFYVSAVMPHQMSRFDVFGETMNGRIQYPASLAAAHRDALRTAAFKNDGERTAALPRDENWPLLSDGGLLGLVASGSYFYQTFSTGDDDTDASADDPRIQALVSVLSGDSIPVSTLLESYVDRIIDESGDDEYGFPFFRVASQYAQLCALATAEHDFLEAAGKQRPISEPPSYESRTMPKIEEPITDGGFAGAEKLESFIEDTPALATNDERCASFLLGALVGAVGSYQEYKHDRSTTLVDQFPVQAVTRNRIKKVTESAIEKTITYTRQEKKGNASYPGTKFDYIVDRLRETVIQPDPDDWEIDTADLRFYYALGLTYGMNDRPLGSSIESEQPNPTAN

SEQ ID NO: 1048 - protein, 709 aa, Natrinema sp. J7-2
MLEPKQFRKEYDGELEDELPERPVSSLRDIQHLYGRLYTLATAGGGDYAAYLTPDQANDLIGAEESLIIVRVDISGDRPALDADEPVKITQYAVDLVQKVAHCKYNAARGIDHSVTHRSGRNSDPEKLARYACERLTKWATDDVVQDVADEHPDGEVIRGLATVGDEESNLDRIRSAVKAELGGSTTALLTVQVRREAGEDYEWPGDVPVFNEAMRARKLSKLVSKGQATNSAGQATDLISGERTRTVGTAEDPLNYFLGKQMEKFPGLDPDEAWRSHPISEDGAVTLMNAEEFVDACSYRTFNADVYYLPYFLGRPTPAESYNLYAALHSVTQADDMGPVQTLYDELGDHEANSEGRLRFYVAAVMKHQMSRFDVYGETLNGRIHYPTDVGQKHEKVAGSWVFDEDDDRNEDRTPPIPSHEEWALTAPFDHEQKVREMVASGAYLYRTFPFTDEDTDATVDDERIDIHVSILAGDPVPRHQLISAYVERLLDRDGDDVPELLIASQFAQLCALENADLVTTDTGDTESTLIDGPDYDTMEPEHARNDGGTAALDRTEKLESFIEQTDSLDDPERKGAFLLGTLVGQVGTYQQGYHDRSTTVIDQYPIKSMTKTKIKRITQEVIDKDVVYSREMAKKGSNINSTMYKEVTNAIVETMAGNDPSGWEISTDDLRFYYALGLTYGMNDRSTNEDDATTDDETTDESPDTNE

SEQ ID NO: 1049 - protein, 717 aa, Natronobacterium gregoryi SP2
MLSPDAFETAYPAEELADELPDSPIGSLRDLQYLYGKLYTLATTGGGEYAPYLTPDAAGDLVDTESSLIVVRVDVSGGEPKLADEPVRVTRYTENLVQKVSHCKYSAARGIDHSVTHQAGRNSDAEKLARYAKKRLTKWATDDIVTDAADTHPDGWIVDQLAVLAEDEDALETIEDAVVQELGGDSATALLTVQVKTDGGGDYRWPGDIDVFLEAMRQRKLSKLVTKNKADDSSGDATDIVTGQPARTVGTSEDPQNYFLGKQRETFPGLDIEEAWRAHPISEDAAVTVMNAETFVEACTYRTFGTKVYYLPYFFGRPTAERAYELYGLLYQAATDGGMETPIEDAYATRRGKDLGENDLRFYVSAVMPHQMSRYDVFGETLNGQLHYPTELAFAHNEVVGQASAFNSDADWTPPLPTTESWDLLTDSTTRLNSVSTGWYFYQTFAERDDADADADDPRIEALVNVLSGEPIAVEMLLEEYVQRIIDEQTDDSEHEGFPSLLVASQFAQLCALADEKTQLLTTTDPAKDPITQAPTYEKHTSQTMEEIDIVPDGGHPGDAKLESFIENTPALTPDPDDEDSVANERRGAFLLGALVGDIGSYQEYSEDRSTTLVDQYPVKSITQSRIKKVAQETIAKTLTYTRQEKKKQGDYPGTKADHIVDRLRETIVDPDPDEWEIDTDDLRFYYALGVTYGMNDHPWNNGNAQTDDQSDLEEEH

SEQ ID NO: 1050 - protein, 674 aa, Methanoregula formicica SMSP
MIEAIREIGEYANKGAGDNLLDNFSKKIPLEIKKKKQHVIIFNFDTTNQTITCDYEEVKPDSGKKYLWLGNNPRNKPQIYFTSDVFPFIFGDAISNILERVDNPLKNELQMVLEKFFIAISYKEKKDERKIWRVDFTKFSLPTDLRPTFSEKNKELLKELSSPSQKKDQAKKNSKKYLEALSKNILTSLKSKLASDDVSIYTIKLNGSSLAARQEYRKMLSNEKIGCLFDPKDTNYKKYLNRQGNCSLCNKKNIATTSTATNLSFKYYMTDKLGFSSDLDGKFTRNFNICETCYGNLLSGEAFIKNNLKIKIGKLNGYVIPTLLFKNLELDYARFARYITHKNNAVSNLTVLHIFEKELKNFRDFEENEKNNFVINYLFYRSEQGRDFKILRLIKDVPPSRLDTILDIQQKIALKIDKGYPVQQGFLKISLKSLYYTIPIRIGNKDRTYSTKFLDIIDAVFASRSIDYSLLIDQYTELLRIIFHNRGGYNVSSESHLWRKVLQQNFALVFFRELNLLRGFTMEKVSDIGSVPVEINKFWSDIGVYDDPRKTLFLLGYLIGGIGNKQWKAGHKNKPILNKINFEGMNVQAIIRLTNEVFEKLVQYKILKLHESLFYEYKKMIDIYSQSWNLSNQENVFYILSGYSFATYQAISRGEQEAPTEQETEEDEGGDTDE

SEQ ID NO: 1051 - protein, 47 aa, Methanosarcina mazei Tuc01
MSKYKHDYFEGYENMFMRGYSMVKYEDLEEFFDVFAWPSLREDDTGV

SEQ ID NO: 1052 - protein, 39 aa, Methanosarcina mazei Tuc01
MIETICDIGKIVRKTDGEIDLVDDRFDEVKSLIDLSLKD

SEQ ID NO: 1053 - protein, 614 aa, Ferroplasma acidarmanus fer1
MMPAISSLGSNLTEDSLSNKINNIKFKNTKNKDFYLCILDFSSKESCITISPIKVVKNENDKNIAEKYHWVGNLTGNIPQWHVTSDNLLYALNSLYFLYKKTEIKTLKDKIYNIVKLYYDDNPVIHIKKSKIIDQPSGKVYFFLPNNNEAHVKSKEFNKNYINKFLEDTKDNEYITRAVLYTIFVDGECIAEDKDYIKMLDSREIKEDEYYDGICSLCGSIGKVTANTKELKFKYYNTDKSSFASNMNGSYFKKNLSLCSNCYNNIISGEDYIFKRSASFAGMNLLMIPESLPFKDGDDLYIENIFNVNRDIILKNNEIAHIEDNLDGFYTIDLMFYRKHNNSFKILEFIPEIPESRMIKISKYMYKTSLKFKNVFDNFNYLTINGFYLSIKNTRNSNFNESLRMLSSLFNSKPIDRNYLIRIYLDRIRTDYYNNNINNITMYILQKYAYIEFLEKIDLTKENKKITGDNDMDSEIGNKTLDSGLNFIKNMNLPEESEGLFCIGYAIRYIGMILFKKKINNNPLLEKINYQGMNFRAVEKLMNQIDEKVKQYDIYGEEIAYVLYKAHFVLSKYTLVSSKWPINDAENVFLIMTGYSIENQFIFGKNKKTDNGDE

SEQ ID NO: 1054 - protein, 592 aa, Clostridium saccharobutylicum DSM 13864
MLKECLEVFKKKLDENGDKFIIDSYVLEQGTYLLIEPKGDSYQIREKIDIIFDKKTKEINGKSNSNFENICNYDYNSRIINTNKPMASGTFVNKRIIHSNNYFSFIVKKESLINGKLTNEIIDNYYETLSDPFIKYSKSQNAMKIYESVEKELGKVDKEIVERIRNWIKENIFNLDIDIKGKDYLKIFFEYPIKDYKREGKRYLVPNIYNSNEFNIIVKDKIYGLPNDNMGLNSKKPYLENKTRKIIVPYLIDNTNILLQKKFFDYLMNFVVIGRTNVYIDNCNNKIYVYENEELPDRNFKGIFLRIKLISNKTGKEVEIQDYDIITGYKPNLTRKFKFKNILNIEQNSKSVSIKEYGDYGKIKEMQQLLNDIFFQNKLIKNYFKESKDLLIDDSSLKSNLLLSRETIFNWIYKGIDNDIFPVLNKISLSLLKGSIKNGYISKAKHQFNLRWSLIYYFKEGKRMAEILNEVNEVLRKKINSKEYDPIENDEQYYFSVGQVVAFLLSKYRGKNKPFSLAKPIVNSKNNEIIKENLRKMYNKYSYDPSINIKRFKNFYVMISGYIPEGKVNQDMIIAGFLSNSLVYEKDKEENK

SEQ ID NO: 1055 - protein, 729 aa, Haloarcula hispanica N601; identical to SEQ ID NO: 1046

SEQ ID NO: 1056 - protein, 716 aa, Halobacterium sp. DL1
MSLLPEPSTFEKRYSDDEKLASELPDRPITSLRDLQYVYGRLYTLATAGGGEYAAYLTPEKSTDLFDEPESLLYLRVDLSGDKPRLDPDQPIGVESYGEEKVEAVAHSWYNAAKGFDHSVTHRTGKNKEPEKVAEYLHERLTAWAADDVIQEAVADHEDGWIVDALAELGESEGLRERIETAVEEQLDGKTTALTTVAVKLEPDGEYLLPGEASSVFNEAMRARKRSKLVSKGEATDSIGEATDLVTGNRGPTVGTAEDPLNYFLGKQLEKFPGFDPDEAWRTHPVSEDVAVTLMNASTFVDACDYYTMGANVYYLPYFFGRLGPADARDLYGLLYDLVHAGEMSPLESAYRSYQDTPRLQEVGERFRFYVAAVMEHQTKRFDVFGDSMDGTLFSPVELTRAHQRVLQSWLYDAEGDADHPGPGLRAVFPTPDNWDIFVPEESALLSILATGWYFEQTFAPADDDDASADDYRIRALVAVLSGEPLDVEMVLTEYVERLLEDEGEEFPSFRVSAQYAQLCALAEAGLLTGRDAYEPVTEPRQLTHNHTDDMQQDTPARADGGNVAAARETKLEQFLEQTPALAEDQPERRGSFLLGALVGQVTGYQQVSEGRSTTLIDQYPIKAVTESKLKRLASDVLDKNVIYSRENNMSGTMYREVVDRLVTTLPRIDIDGDWELDTTDLRFYYSLGVAYGMNNWASSDDEQADDQPETEEEEA

SEQ ID NO: 1057 - protein, 688 aa, Unknown
  Uncultured prokaryote
MIEGIRTIGEAVLQKNPSIVEALIREEEVPEGQKRYVVHLNVQLEPLALEVSAKELDYKVLAEVLWVGNAPASNDPQDRLTTDHVQYLVSQTVPNLMNGLPAGALRDKLEELQQAVYIDLGERSELFSEGGDAQYHRYRRLWDLHKLGLARLELIEDPEEREELEGLCQQHPFLTKPFLQEYARQKGSAKAAVELVGSVVEAWVLQQLDIKRREVALYTLQVDGNLLAQHQDYRAYIAKTLVDEAFEDAPEGICHVCGRQGPVTKDMTRFKLLKFYITDKPGFASELRDTGFFRNYVLCQHCYRALLAGERFAENQLRTQLARSSVYVIPVFHVPSIQPTAHTLERWAEYLQTRLAATRTLEEWQRFQKNLEDYEDYQEFENAKASFVLNLLFATKAQGAVKVDKLVQDVPPSRLDQLEVIRNQVWDTAKGYLGESREWDLSLGRIFYLFPIRKQGNQAQTRPFLEFLETLLTGRSVQVQFLIPEFLETACVHYFERYGAYVQTSPGQDRQAVDRALAVFLLQSQLLLHYLKALGQLEGIQGGELMDIESQALEEPLQSYLEELGLDRGRRGLFLLGYLIGRIGSTPEQRRSNKPILNKVHFQGMDPGKIMRLSNEVYEKLRQYKIAEYNEATYAAMKALLDREHKSLDSPQENTYWVLSGYAYATWQAIRAGKLKHEASEEQTPQEV

SEQ ID NO: 1058 - protein, 586 aa, Clostridioides difficile T5
MVIGGENLLKDCLEIFEKEYKSLGNRLITDSYVLSYGTYILVKNFSNIDILEVSKNNVDSTEDIYHKFCELDYLSKLVSIDKSVDSKKIIHSNNYLSFFVKKENLRPDKNNNVKLTEEIIDNYYDALLNPRIKYKSDKRKKEIYDSIENKYGKVDENKLNKIRLWIKTNIFDLVESVKKDKNYLKIFFDEKIELYNDENQKYLYPNIYNKNDFNVIIDGKNYGLPNDNMQLNEKKPFLKLKTRIRNSTPYLISDDEVLLQKAFFDYLMNKAANGEEVVYISSEKGIHRKTDIPNEFSGYILRIKKGKELEIHDFDTVVNLNTKIKRINVECIIPIEYERHNLKPNLEIGYINNLIKLEKTIDTIFFNKFMCNSYFKEIKNINLSDLVLRDILIRHREGLYTWFYKGRDNIVKQTFSNYSMGIIENSIKNNNYIRAKEQYNLRIAIINYFHGGSNMADKIKVISESLFEKINSIKTKCIQSDEEYYFAVGQLASYFISKNKSKNKNHSLINPILNAQNRKKIMLEIEKLFKKYNYDISYDNNRRFKNLYSMIVGYEVEEKKVNRDLLIGGYLYYSLIYTKSEENENE

SEQ ID NO: 1059 - protein, 579 aa, Clostridioides difficile T20
MLKDCLEIFEKEYKSLGNRLITDSYVLSYGTYILVKNFSNIDILEVSKNNVDSTEDIYHKFCELDYLSKLVSIDKSVDSKKIIHSNNYLSFFVKKENLRPDKNNNVKLTEEIIDNYYDALLNPRIKYKSDKRKKEIYDSIENKYGKVDENKLNKIRLWIKTNIFDLVESVKKDKNYLKIFFDEKIELYNDENQKYLYPNIYNKNDFNVIIDGKNYGLPNDNMQLNEKKPFLKLKTRIRNSTPYLISDDEVLLQKAFFDYLMNKAANGEEVVYISSEKGIHRKTDIPNEFSGYILRIKKGKELEIHDFDTVVNLNTKIKRINVECIIPIEYERHNLKPNLEIGYINNLIKLEKTIDTIFFNKFMCNSYFKEIKNINLSDLVLRDILIRHREGLYTWFYKGRDNIVKQTFSNYSMGIIENSIKNNNYIRAKEQYNLRIAIINYFHGGSNMADKIKVISESLFEKINSIKTKCIQSDEEYYFAVGQLASYFISKNKSKNKNHSLINPILNAQNRKKIMLEIEKLFKKYNYDISYDNNRRFKNLYSMIVGYEVEEKKVNRDLLIGGYLYYSLIYTKSEENENE

SEQ ID NO: 1060 - protein, 586 aa, Clostridioides difficile E1; identical to SEQ ID NO: 1058

SEQ ID NO: 1061 - protein, 586 aa, Clostridioides difficile E10; identical to SEQ ID NO: 1058

SEQ ID NO: 1062 - protein, 704 aa, Halorhabdus tiamatea SARL4B
MLSPEEFREEYDDEELAAELPDSPISSLRSIQYLYGKLYTLGTLGGGQYAPYLTPDAAGDLTDTDDSLIVVRMDASSDEPSLADDDQGPVWVTRYSEDLVQNVAHCKYPAARGIDHSITHQAGQNSDPEKLARYSKERLTKWAVDDEVQDVADEHDDGWIIDALAALGDDEDILESIDSGVTDALGGESTTALLTVQVKTEPDGDFRWPGEIDGFMEAMRRRKLSKLVTKNKADDSSGEATDLVTGDGTRTVGTAEDPQNYFLGKQLEKFPGLDIEEAWRSHPISEDAAITVMNAETFVDECSYRTFGAKVYYLPYFQGVPTPDGARELYGLLYHATNDDDMTPVERAYQEFQNRDIDYELRFYVSAVMPHQMSRYDVYGETMNGRLLYPKTLAVEHNNVVGKATAFNSKTDRTAPIPTHGNWALLTGDDRRLHAVSTGWYFGETFAERDDDEAAADDPRIDALIAVLSGDSIAVETVLEEYVDRIDTDENDENVESFPSFRVASQFAQLCALATDELDLLSTDDPGREPITKEPNYEEYSMETAAQILATDGGNPAAEKLETFIEDTPALAHDPEAPLNDQRRGAFLLGVLIGEVGGYQNYSEERSTTLIDQYPVKSITRTRIKKVTQEAIGKTITYTRNEDRTITLFEHVVERLRETILRPDPDEWEIETDDLRFYYALGVTYGMNDHPDWDQTETDTEEEH

SEQ ID NO: 1063 - protein, 642 aa, Microscilla marina ATCC 23134
MQDRAIIEIGRLELAAMQKANKAPYQFFVQNMFPKKADYHMALMVFELHSVAPPGFRCTFKATDLTKVSEKNFEKFAYRKGSARGGDITFTTKFGDLDKKFKTLVNNQFKALMARLSASPHIQEFQVFSAVHRFLLKEENADQVKAELTRLYEDLGKKEQQATGLSMVLEIDGKKHYLSDFKAIQEVLYENGTQEKSKKYDVTSEGTQELCAGCLQPKPVVHGFGSPYKYATVDKPGMVSGFFKQKNNWKNYPICTDCSLVFELGRNYIAQHLSKSFYGKFYYVIPKIILQKDRSQLPRIIEKLEGLYGDLMKQGRQHEKREDKIWEMVAQHDDYFNLNLLFYEENSTTKAIKIKLLLEEIVPSQFRKLFVDTPKQINGHVLYKKAHTSTDKKTKQKTKQDLKFSFGLLKTFFEHDFYRLMQQVFEQQPMAEESLYASFMRVIRANYNKMKTSDGYAENTRLTVLKAHLALRYLAAIEVIELPNKPIQKAMEHTTPSEDVQTATSADQQKTGFDPQRIEQFMQDNPLFLSSDAKRGVFLLGVLVKHVLDVQYNQLNGNTPFENKLKGYQLSPVHLQNLYTEAIGKLRQYKATPSTLLQALNQYFLLHIDQILKMSNNEASFYFVAGMQMIRELKYVNTESKK

SEQ ID NO: 1064 - protein, 581 aa, Anaerostipes caccae DSM 14662
MDVGGGILLRECTEIFREQLQQNRNLLFDSYIPANGTYLIVKEDGSLCEPVELELDKKSGQINRTNRYFTQICQYDYYSRLIDMNKPQDNKKIIHSNSYLSFFVKKESFQNGKLNTEAIDRYFDAVIYPELKYKGQTLKIYQMLEEEIGCVPKDIAEKIRMWIKENIFHLDVDLSKKDYLKIFFEAPMEQYQRENDRYLVPNIYNSNDYNLEVEGEVYGLPNNNLGMNAKKPFLSSRTKKIEVPFLLNKEEVLLQKQFFDHLMNYAMAGKSNVYIDTDERTICAFKNNEIIDRDFKGYYLRIQKGKEVEIHSSDIVPCYHPSVKKPFVYRNALSYTPKEHKEGTEYGAYYTKEKIQSLLDAVFFSKFLKGNYFTPQDKLGMNDGYIKRNLIISREAVFDWLYKDEEVQAAKVLGNVSLDLVLGALKEGYIFKAMDCFNLRHSLLEYFSDKGENTMENKINQIVTDLKAKLDAEETPEIQSADEYFFAVGQLVQYYISLNKGKKKTHALANPFINAKTDAVLKKKLVQFFLKYNYDIGVSSRRFNNLYCMITEYELKGDIEKDLMIAGYLHSSLIYVPKEDK

SEQ ID NO: 1065 - protein, 586 aa, Clostridium butyricum E4 str. BoNT E BL5262
MLKECLEVFKSDLENNRQKIIDSYVPADGTYVIVSHKDDFFEIKDYFDIKYDKKEKKLLGKTNINFYDVCNYDYNSKLIDMNKPIDGKKIIHSNNYLSFFIKKESLENGKLNDEIIDNYYNILKNPIEKYAKNKKAVALYKSIEEEIGEVDAELLEKIKVWIKGNIFNLDMEIKGKDYLKIFFEHPIEKYVNEAKRYLIPNIYNNNDCNIDLDGDIYGLPNNNMGLNAKKPYLENKTRKNTSPYLIDAEEVQLQKEFFDYLMNEVSLGKVNAFIDVYNKKIDVKENGKLPDNDFNGLFLRLKKGKEVEIHDFDTITSYKSILKKELNVENILELDLDSKPNQKYVECYHPFKKKEDVQKILDEVFFSSYLINNYFTDAGDISIKDNVLKNNLLIARSSIFNWIYKGIQKGSVNGIASVLDKVSLNLIKGSINNGYIPKAGHQFNLRWSLKAYFEGGRGMADIVHDLKSTLRDKINEKDTSKIDDDKEYYFAVGQLISYLLSKSKGKKRPHSLANQFINSKSNDDLKGKLKKIYVKYSYDPDINSKRFNNLYAMIVGYLPEGNVNTDLVIAGYLNSSLIYEKSEGDK

SEQ ID NO: 1066 - protein, 593 aa, Clostridium botulinum D str. 1873
MLNQAIKYLLSNYKEDEIDKFIAKNYIPTDGIYIVVEETKDGFNKIEEMQIKQNKKTKQLEDTTGFINFDFICIADYLSKLIDMNKPIDSKKVIHSNNYLSFFVKLDSISGGKLTNEIIHNYYEVLRNPQDKYKKDKKKLTMYEDAEKEFGKVNEERLNKIEEWIINNIYNLVPKDSKEKTYLKIFFKYDLSEYEKESKKYLIPNIYNSTDFNISINDTLYGLPNNNMGLNSKKPYLENKTRKTTVPFLISLKEVLIQKKLFDFLMNMATTGRVNIYLNEKEIIALSNKESLKNNFQGAYIRIKKGKELEILDFDIIEDYKFRLRKPIKIQNVLKINYKNLNINPKDMYKQINLVQSLKSLVNEILFSKFLDSNYFTEAKDLSINNSNLKMNLLLSRNILFNWFFKGNQQGVWEVLSKTSLSLIKGSINNGYMIRASEQFNLRCALKEYFKGDEKSMADVLKEVKDSLRKKINIKFDEATSSIENDDEYYFAVGQLAGYFISLNKSKNKPHSLANPVINARNDKRIKDELIKLYKKYNYAIPYTKGRFENLMAIVKSYEPIGNVQDDLIIAGYLHSNLIFEKTEDSKNENGGN

SEQ ID NO: 1067 - protein, 586 aa, Clostridioides difficile NAP08; identical to SEQ ID NO: 1058

SEQ ID NO: 1068 - protein, 586 aa, Clostridioides difficile NAP07; identical to SEQ ID NO: 1058

SEQ ID NO: 1069 - protein, 597 aa, Methanotorris formicicus Mc-S-70
MLSSVATIGKYIIEKEGKDINNPLSILVENPDVDGKYNIIFKIAFDGDFNYLGVFDDRFDSSMILRLLYKKGSPRGADLSPTSKLVDAEKTFRNKILKAVADAKKYKKTNFLKRLETALKDNAEKIIEDIEKLKKNYPKDGVILTITIRKGDEEFYVGDIGEFMDYFVHKATMDYYYMKTGNIAAKGVGICSICNEKGEVFGLFREFGFYTIDKIGNVSGLNPDEAWKTFPICLKCALYVKEGKNYLDEHLKVRFYGNDLYIIPKVLDEKNVGKVLKRFERMAKDFGTKDYSYRERKLFEFLSKRDIYLYISFMFFREGNDFKITQMVEDVLPSRFRRLYEEIDKIENYGIFKHFKLKYKKLSKKEKEYYTNILQNFEDKEGLRFRFGYIKEFFGNEDFLRLMNIIITNKKVDYNCLINVFISKIREKFIKDEPFELFAYKSFMIILYLMNLNILEGDIMGDDKEYYLYDEIDELFNNYNGFFDRDEKKGVFLLGVLVNKLLNLQYKKRGSKPFQSKLYGLKLDKIKVKNIFKEANQKLMEYEQEDNSLYYKKLREKVAEYLIKAGNDWKLNNNEISYIFSLGMAMSDRFKSKGGDE

SEQ ID NO: 1070 - protein, 656 aa, Parageobacillus thermoglucosidasius TNO-09.020
MIKTIYTLGSKYLTEEKPSMIQAITLPIAKSDGATKYVVIVDFSIAEKKIRLTPKEIGASTSSELLWIGTADGAASPQWYGTVSNVEYLLSQTIPNLLERWDQKDFYYSLLKEARDVFFLDLGAAKKSDERYRYVFNPAYVGGELTETEGKKAVKEVAKQFQAFMEKEANVNIKDVLLYSLAINGQLVVSQPEYERLVIAEKLSVFEDAKKGVCALTNKEAFVTGETTKLKFNYYINDKISFASDLEKKSFVKNLSISKDAYQAIMAGEAYILRHFNTRFSGLPCYIIPDFLYDVPFANVPLQDISEHIHQFVRTVKTVETAEGLHREIEDYKEFDEQMDNHISLHFLFYTKAQSALKVNKLLSDVPLTHLRRLSFEMRKTGEIGQRFFGSEKFNLGLEPIYYLIPMRVQRGENFEKRKILQVYESLLTNKPLSYQWLITQFVQLAKVHMYANYNLYQYSSDKEEPNDFRLVNAMVRAQLFLKMLQNLNLIKEEREMTKVTYDLPDAHMVEYMETMNYNVAQSSLFLLGYLIAKIGAEQVRRTKARAEALGQAWGGKTVNKPILSKINYHGMNKQRLMLLSHEVFDKLRQLKIASLQNETVYIEHKRLFDLALQEKWNLSDRESVFYLLSGYAYGTKRILNSSKKDNSDPDFENEE

SEQ ID NO: 1071 - protein, 715 aa, Natronorubrum sulfidifaciens JCM 14089
MLSPEAFREAYSEEELAEELPDSPIGSLRDIQYLYGKLYTLATTGGGEYAPYLTPDAAGDLVDTDDSLIVVRVDVSGDKPKLADDHLGPVQLTRYTDALVQQVSHCKYPAARGIDHSVTHQAGRNSDPEKLARYAKERLTKWATDDVVTKASIAHEDGWIIEQLAELGEDGDTLETIEDGIVTSLGGESATALLTVQVKTEQDSEFRWPGEIDVFLEAMRQRKLSKLVTKNKADNSSGDATDLVTGEPSRTVGTSEDPQNYFLGKQLEKFPGLDIEEAWRSHPISEDAAVTVMNAETFVEACTYRTFGAKVYYLPYFFGRPTPEKARKLYELLYQAAIDEEDTTPIENAYEEYRERRIDENGLRFYVSAVMPHQMSRYDVFGETLNGQLHYPKELAFTHNRIVENTSAFTTNTEWTAPLPTNKKWDLLAANDDLLHAVSTGWYFYQTFAERDDADADADDPRIKALVSVLNGEPISIEVLLEEYVSRIISEETDDEYEGFPSFLVASQFAQLCALADGDLELLTTTDPGKEPITREPTYEEYTMEIPDILATDGGHPAEAKLESFIQETPALAPDSGEDSVTNERRGAFLLGALVGDIGSYQEYSEDRSTTLVDQYPVKSITRSRVKKVTQETIAKTLTYTRQEKKEGKSYPGTKAEHIVDRLRETILDPDPDKWEIGTDDLRFYYALGVTYGMNDHPDWNQTQSDEATNTEEEY

SEQ ID NO: 1072 - protein, 717 aa, Natronobacterium gregoryi SP2; identical to SEQ ID NO: 1049

SEQ ID NO: 1073 - protein, 709 aa, Natrinema gari JCM 14663
MLEPKQFRKEYDGELEDELPERPVSSLRDIQHLYGRLYTLATAGGGDYAAYLTPDQANDLIGAEESLIVVRVDISGDRPALDADEPVKITQYAVDLVQKVAHCKYNAARGIDHSVTHRSGRNSDPEKLARYACERLTKWATDDVVQDVADEHPDGEVIRGLATVGDEESNLDRIRSAVKAELGGSTTALLTVQVRREAGADYEWPGDVPVFNEAMRARKLSKLVSKGQATNSAGQATDLISGERTRTVGTAEDPLNYFLGKQMEKFPGLDPDEAWRSHPISEDGAVTLMNAEEFVDACSYRTFNADVYYLPYFLGRPTPAESYNLYAALHSVTQADDMGPVQTLYDELGDHEANSEGRLRFYVAAVMKHQMSRFDVYGETLNGRIHYPTDVGQKHEKVAESWVFDEDDDRNEDRTPPIPSHEEWALTAPFDHEQKVREMVASGAYLYRTFPFTDEDTDATVDDERIDIHVSILAGDPVPRHQLISAYVERLLDRDGDDVPELLIASQFAQLCALENADLVTTDTGDTESTLIDGPDYDTMEPEHARNDGGTAALDRTEKLESFIEQTDSLDDPERKGAFLLGTLVGQVGTYQQGYHDRSTTVIDQYPIKSMTKTKIKRITQEVIDKDVVYSREMAKKGSNINSTMYKEVTNAIVETMAGNDPSGWVISTDDLRFYYALGLTYGMNDRSTNEDDATTDDETTDESPDTNE

SEQ ID NO: 1074 - protein, 718 aa, Natrialba hulunbeirensis JCM 10989
MLSPKAFREAYSETELDEELPDSPIGSLRDIQYLYGKLYTLATTGGGEYAPYLTPDAAGDIIDTDDSLIAVRIDVSGDEPTLADDMIGPVQVTRYTETLVQNVGHCKYPAARGIDHSVTHQAGRNSDPEKLARYAKERLTKWATDDVVTNAATEHPDGWIIEDLAALGTDEATLEDIEDAVVTRLGGESTTALLTVQIKTEPNGDYRWPGQIDAFREAMRQRKLSKLVTKNKADDSSGDATDIVTGRSARTVGTSEDPQNYFLGKQLEKFPGLDIEEAWRSHPISEDAAVTVMNAETFVEACTYRTFGTKVYSLPYFFGRPTPEKAYELYKLLYQAATDEGKDTPIEDAYERQREADIDETDLRFYVSAVMPHQMSRYDVFGETLNGRLQYPRELAFTHNRLVDVASAFNSIDDWTPPMPTTDSWGLLASDNNRLNSVSTGWYFYQTFAERDDADADADDPRIEALVSVLSGDTIAVETLLEEYVQRIIDEQTDDSEHEGFPSFLVASQFAQLCSLADGKLELVTTNDSAKEPITREPTYEEHTMPDFEEIAITDGGNPADAKLESFIENTPALSSTGDSEGTVANQRRGAFLLGALVGDIGSYQEYSEDRSTTLVDQYPVKSITQSRIKKVAQETIAKTLTYTRQEKKQQNGYPGTKADHIVDRLRETILDPEPDNWQIDTDDLRFYYALGVTYGMNDHPWDNGAQDDEATTPEEEH

SEQ ID NO: 1075 - protein, 735 aa, Natrialba chahannaoensis JCM 10990
MSQATTEEDELISTVLEEVPDRPVSSLYDVACLYTACDRYSRLAESTIPETMDSEAVSKVTVATDLLPEEESNSIVAARVDLSGQDPELADSPVGVQNYTEDNRFKLGYLKNQRKTSSATDYSITNHSGTSETDVETIAHDSWGNRFLRGRFEVWPHRDGAQKIAESHPDGEIIHQLAALGEDEDAMEELAEALLNTVDFEETRALVTVKIRLEDDGDFLWPGEIPVLNEAAYECRREHFRDGISMSDAEPTGEGTGFITGTDGHVIGGSPGILGQFGKLQPELFPDLNKDDAWRSRPLKPKTAIVVDRFGSIIDEFYTGFQGVRFYLLPYPETELTAETFSRFYTDVYKRLEGASESEFEDEIIELFERKVDIDRLVEKSAASSDVLEEFLGDLEEEGEGGLTTFDGYDTWLRVYGLSVAKGLDPTQVFVDEPAISLGSLTDLEAAYHNLGISLQESELFGDLVERTDYVRPSQDVAKEVLGGRWFYSTIATSPDPDDTSDTDPAPDDAFLSLAGNLVKGNKINADQLIELFTLKIEREFRNNQSNGNGEFPSNVVLGQYARLIALANTNLLSESNIRYTCEHSGAFMDSSTTGDLSRETRLEHFIEEHDALATPEARAVFLLGGLVGRLTAFQHRENVSRKLVEQHPPSSITKQSITSVTCQVMEKNETYAQMEEGRGNMNKRYVSRLADTMLDKQPTSWNLVTQEMRWLYSLGVAYGKSDTSNYTEESPDSE

SEQ ID NO: 1076 - protein, 718 aa, Natrialba chahannaoensis JCM 10990
MLSLKDFKDKYTEDELADELPNSPVGSLRDIQYLYGKLYTLATTGGGEYAPYLTPDAASDIIDTDDSLIVVRVDVSGDEPTLANDATGPVWATRYTENLVQNVGHCKYPAARGIDHSVTHQAGRNSDPEKLARYAKERLTKWATDDVVTDVSEEHPEGWIIDDLATLGENEATLEAIEDAVVTGLGGESTTALLTVQIKTEPNGDYRWPGQIDAFREAMRQRKLSKLVTKNKADDSSGDATDIVTGRSARTVGTSEDPQNYFLGKQLEKFPGLDIEEAWRSHPISEDAAVTVMNAETFVEACTYRTFGTKVYYLPYFFGRPTPEKAYELYKLLYQAATDEGKDTPIEDAYERQREADIDETDLRFYVSAVMPHQMSRYDVFGETLNGRLQYPRELAFTHNRLVDVASAFNSVDDWTPPMPTTDSWGLLASDNNRLNSVSTGWYFYQTFAERDDADADADDPRIEALVSVLSGDTIAVETLLEEYVQRIIDEQTDDSEHEGFPSFLVASQFAQLCSLADGKLELVTTNDSAKEPITREPTYEEHTMPDYEEIAITDGGNPADAKLESFIENTPALSSTGDSEGTVANQRRGAFLLGALVGDIGSYQEYSEDRSTTLVDQYPVKSITQSRIKKVAQETIAKTLTYTRQEKKQQNGYPGTKADHIVDRLRETILDPEPDNWQIDTDDLRFYYALGVTYGMNDHPWDNGAQDDEATTLEEEH

SEQ ID NO: 1077 - protein, 706 aa, Haloterrigena thermotolerans DSM 11552
MLDPDEFYDEYPPERLEDELPERPISSLRDIQHLYGRLYTLATAGGGDYAAYLTPDQANDLIGAEESLIVVRVDLSGDRPALDADEPVKITQYAADLIQKVAHCKYNAARGIDHSVTHRSGRNSDPEKLARYACERLTKWATDDVVQDVADEHPDGEVIRGLATVGEEESNLDRIRSAVKAELGGSTTALLTVQVRREASADYEWPGDVPVFNEAMRTRKLSKLVSKGQATNSAGLATDLISGERTRTVGTAEDPLNYFLGKQMEKFPGLDPDEAWRSHPISEDGAVTLMNAEEFVDACSYRTFNADVYYLPYFLGRPTPAETYNLYAALHSVTQADDMGPVQTLYDELGDHEANSEGRLRFYVAAVMKHQMSRFDVYGETLNGRIHYPTEVGERHEQITGSWVFDENDDRNRDRTPPMPSHEEWSLTTYQDFREMVGSGAYLYRTFPFTDEDTDATVDDERIDVHVSILAGDPVPRTQLVSAYVERLLDRDGDDVPELLIASQFAQLCALENADLVTTDTGDTESPLIDGPDYDTMEPEHARTDGGTAALDRTEKLESFIEQTDGLDDPERKGAFLLGTLVGQVGTYQQGYHDLSTTVIDQYPIKSMTKTKIKRITQEVIDKDVVYSREMAKKGSNINSTMYKEVTNAIVETMAGNDPSGWEISTDDLRFYYALGLTYGMNDRSTNEDDATTDDETTDESPDTNE

SEQ ID NO: 1078 - protein, 716 aa, Halorubrum californiensis DSM 19288
MSLLPEPSTFEKRYSDDEKLASELPDRPITSLRDLQYVYGRLYTLATAGGGEYAAYLTPEKSTDLFDEPESLLYLRVDLSGDKPRLDPDQPIGVESYGEEKVKAVAHSWYNAAKGFDHSVTHRTGKNKEPEKVAEYLHERLTAWAADDVIQEAVADHEDGWIVDALAELGESEGLRERIETAVDEQLDGKTTALTTVAVKLEPDGEYLLPGEASSVFNEAMRARKRSKLVSKGEATDSIGEATDLVTGNRGPTVGTAEDPLNYFLGKQLEKFPGFDPDEAWRTHPVSEDVAVTLMNASTFVDACDYYTMGANVYYLPYFFGRVGPADARDLYGLLYDLVHAGEMSPLESAYRSYQDTPRLQEVGERFRFYVAAVMEHQTKRFDVFGDSMDGTLFSPVELTRAHQRVLQSWLYDAEGDADHPGPGLRAAFPTPDNWDIFVPEESALLSILATGWYFEQTFAPADDDDASADDYRIRALVAVLSDEPLDVEMVLTEYVERLLEDEGEEFPSFRVSAQYAQLCALAEAGLLTGRDAYEPVSEPRQLTHNHTEDMRQDTPARADGGNVAAARETKLEKFLEQTPALAEDQPERRGSFLLGALVGQVTGYQQVSEGRSTTLIDQYPIKAVTESKLKRLASDVLDKNVVYSRENNMAGTMYREVVDRLVTTLPQIDIDGDWELDTTDLRFYYSLGVAYGMNNWASSDDEQADDQPETEEEEA

SEQ ID NO: 1079 - protein, 717 aa, Halorubrum saccharovorum DSM 1137
MSLLPKPAEFRKTYSDDENLAAELPDRPIASLRDLQYLYGRLYTLATAGGGEFAPYLTPEKSTDLFGEPESLAILRVDLTGDDPKLDPKHPVEFQSYSREDVEAVAHAWYDAARGFDHSITHRTGAGKEPEKVAEYLYQRLTYWAADEVIQKAAAEHEDGWIVEELAELGDRDGVKETIVDAVKRQLEGSTTALTTVAVKLEPDRDYELPGACGTTVFNEAMRTRKRSKLVSKNAATNSIGQATDLVTGQDGPTVGTAEDPLNYFLGKQLEKFPGLDPDEAWRSHPVSEDVAVTLMNASTFIDVCSYYTLESNVYYLPYFFGQPTPGDARELYTALYKVADEEDLTPVEQMYSDYNPQEWDDPDGDRLQFYVAAVLQHQTKRYDVFGDEMNASLMHPVELAREHCAILSSWAFDDTADLPNPDVRPALPVHEEWSLLRTDVETMLGLIAGGTYFQSTFATPDDDDTVSADDLRIQALVASLSGGSIPVERVLEEYADRLIEESDEDDEGFPSMFVAMQHAQLCAFAAAGLLTGEDESLTKPAEYATSQMQLDTTQRARTDGGSKAVKRAQKLEQFLDDTPALATENPQRRGGFLLGVLVGQVSSYQQSSENRSTTLVDQYSIKSVTGSKIERLASDVLDKNVVYSRENRMSSTMYAEVVDKLVETLPRAERDGGWDIDTSELRYYYALGVAYGMNNWISDEEADEQTDDDAIPDTNE

SEQ ID NO: 1080 - protein, 720 aa, Haloferax sp. ATCC BAA-646
MLSPSEFRDRYPEDELVDELPDSPVGSLRDLQYLYGKLYTLATTGGGEYAPYLTPDAARDLVDTDDSLIVVRVDLSRDEPQLADDARGPVLVTRYTEDLIQQVGHSKYPAARGIDHSITHQAGRNSDPEKLARYAKERLTKWATDDVVATAASEHPDGWVIDRLAELGTRDAALEAIEEAVVRALGGESATALLTVQVKTERDGDYRWPGDIAAFNEAMRQRKLSKLVTKNKADDSSGDATDIVTGRPSRTVGTAEDPQNYFLGKQLEKFPGLDIENAWRAHPISEDAAVTVMNAEAFVEACTYRTFGAKVYYLPYFFGRLTPERVYRLYEMLFSAVEDGGDATPIEQAYMEERELDDADTRLRFYVSAVMPHQMSRYDVFGETLNGRLHYPKELAFTHNRFVRDASAFNSDTDWTAPLPKNDKWGLLSVNDDQLHAVSTGWYFYQTFAERDDAEADADDPRIEALVSVLSGDAIAVDVLLEEYVTRIIDGESDDDFEGFPSFLVASQFAQLCALADGELELLKTNDPAKIRITREPTYGRLTMPTLDEILIADGGSPAEQKLESFINETPALSPAHDDDEDSVTSERRGAFLLGALVGDIGSYQEYSEDRSTTLVDQYPVKSITRARIKKVTQETVAKTLTYTRQEKKKGKSYPGTKAEHIVDRLRETVLDPDPDDWQIDTDDLRFYYALGVTYGMNDHPDWNQQSSDANDELPADEEY

SEQ ID NO: 1081 - protein, 720 aa, Haloferax sp. ATCC BAA-645; identical to SEQ ID NO: 1080

SEQ ID NO: 1082 - protein, 730 aa, Haloferax prahovense DSM 18310
MNLSLDEIGQAQTDLASVSDEDIEAALPNRPPASLFDIAYLYTTLDTLARTATVEGIDRSYVPYMTPGAKTEVFTQSDADGDHAGNPNVLAARIVIENGEARLDDEPVVAERFSADDVYRLGYSTFQKTSHTTVYSATFQKSGSALKITDALVDQLVKWTDKDGTVAAREEDVYAGVLGPLGDLGDDEVAAEALREATWELFGLDEDSIEGEEPTDEEISKAGNGIIGDAGMFVTLAIRTGGDDTFRYPGEVPAMNEAMARNRSVKLKEGKSATKGMDAYGEGVCLVLDEEQEVYGGSGTPMATSAGKQWGLFDDMDPGSAHRTRPLSRDAANSLSGAQGILDQFRTELGLGQHLYLLPYPHSLDVDAVRDLYVVLDAVRDSDDLTEVDLVPHVTDKEDLSLYAYLLTFEQSSVRLPQFEAPRIVKTRGRELSEAHVKEVAGWVFADEQGPFARYRQFWEADDNKPGWVYATTGPLVLSVLARQRYFAPTVTRPDKDAGTDAASMTYFPHLDFSFRLFEGDDIGATELFDQFAQKCIDYQRTAFEEGWDATPRIAATQYLQACAVAAVDGLDGYAPRNHDYDYTMTDRETRLNSFIESHPAIRDDEERQSAFLLGGLVGRLSAFQRSNGTSNTLMRRHPVASLTERSFADVAADVMELNNVYSETESDGKGIMNSRYPERLMDAGQQSAPTDWGIDRSDLRYHYALGMTYGASDTFVDDDSEAAREQGDD

SEQ ID NO: 1083 - protein, 656 aa, Haloferax lucentense DSM 14919
MLSPSEFRDRYPEDELVDELPDSPVGSLRDLQYLYGKLYTLATTGGGEYAPYLTPDAARDLVDTDDSLIVVRVDISGDEPQLADDARGPVLVTRYTEDLIQQVGHSKYPAARGIDHSITHQAGRNSDPEKLARYAKERLTKWATDDVVATAASEHPDGWVIDRLAELGTRDAALEAIEEAVVRALGGESATALLTVQVKTERDGDYRWPGDIAAFNEAMRQRKLSKLVTKNKADDSSGDATDIVTGRPSRTVGTAEDPQNYFLGKQLEKFPGLDIENAWRAHPISEDAAVTVMNAEAFVEACAYRTFGAKVYYLPYFFGRLTPERVYRLYEMLCSAVEDGGDVTPIEQAYMKERELDDADTRLRFYVSAVMPHQMSRYDVFGETLNGRLHYPKELAFTHNRFVRDASAFNSDTDWTAPLPKNDKWGLLSVNDEQLHAVSTGWYFYQTFAERDDAEADADDPRIEALVSVLSGDAIAVDVLLEEYVARIIDGESDDDFEGFPSFLVASQFAQLCALADGELELLKTNDPAKSQITREPTYGRLTMPTLDEILIADGGHPAEQKLESFITDTPALSPAHDDDEDSVTSERRGAFLLGALVGDIGSYQEYSEDRSTTLVDQYPVKSITRARIKKVTQETVAKTLTYTCLLYTSLSRLAR

SEQ ID NO: 1084 - protein, 720 aa, Haloferax sp. ATCC BAA-644; identical to SEQ ID NO: 1080

SEQ ID NO: 1085 - protein, 705 aa, Haloferax elongans ATCC BAA-1513
MLSPEEFRQTYPNGELLNELPNSPVSSLRDIQYLYGTLFTLATTGGGPYAPYLTPDAAGDLIDEPDSLIVVRVDVSGTAPEFASDSKGPVWVTKYTDALVPKVAHCKYPAARGIDHSITHQAGKNSDPEKLARYAKERLSKWASNSVVQEAAAEHDDGWIIDSLAELGEDETALEQLGDDVQASLSGSTTALLTVQIKVDTDGPYQWPGDLDVTMAAMRSRKLSKLVSKGEASNSTGEATDLITGAQTRTVGTAQDPLNYFLGKQLEKFPGFDPDEAWRTHPISEDAAITLMNAEPFIDACSYRTFGARVYYLPYFFGNPTVEDTYRLYELLYDTLEEDDEKSGLTPIETAYQFREDVPLDENSLRFYVSAIMPHQMSRFDVFGETMNGRIQYPASVATAHRDMLRTAAFKSGVDRTAALPTHEKWPLLSGDDFLGLVASGSYFYQTFPTGDDDTDASADDPRIKALVAVLSGDPLPVSSLLDSYVDRIIDDSGDDDHGFPVFRVASQYAQLCALASAPHTFLEATGTQQPVAEPPTYDSRTMPDITEPIADGGFAGAEKLESFIKDTPALASNDERCASFLLGALVGAVGNYQEHKHNRSTTLVDQFPVQAVTSNRIKKVTESAIEKTITYTRQEKKGDASYPGTKFDYIVDRLRRRVINPDPDDWELDTADLRFYYALGLTYGMNDRPQTSNSETEQPNTATN

SEQ ID NO: 1086 - protein, 651 aa, Haloferax alexandrinus JCM 10717
MLSPSEFRDRYPEDELVDELPDSPVGSLRDLQYLYGKLYTLATTGGGEYAPYLTPDAARDLVDTDDSLIVVRVDISGDEPQLADDARGPVLVTRYTEDLIQQVGHSKYPAARGIDHSITHQAGRNSDPEKLARYAKERLTKWATDDVVATAASEHPDGWVIDRLAELGTRDAALEAIEEAVVRALGGESATALLTVQVKTERDGDYRWPGDIAAFNEAMRQRKLSKLVTKNKADDSSGDATDIVTGRPSRTVGTAEDPQNYFLGKQLEKFPGLDIENAWRAHPISEDAAVTVMNAEAFVEACTYRTFGAKVYYLPYFFGRLTPERVYRLYEMLCSAVEDGGDVTPIEQAYMKERELDDADTRLRFYVSAVMPHQMSRYDVFGETLNGRLHYPKELAFTHNRFVRDASAFNSDTDWTAPLPKNDKWGLLSVNDEQLHAVSTGWYFYQTFAERDDAEADADDPRIEALVSVLSGDAIAVEVLLEEYVARIIDGESDDDFEGFPSFLVASQFAQLCALADGELELLKTNDPAKSQITREPTYGRLTMPTLDEILIADGGSPAEQKLESFINETPALSPAHDDDEDSVTSERRGAFLLGALVGDIGSYQEYSEDRSTTLVDQYPVKSITRARIKKVTQETVAKTLTLSLIHISDG

SEQ ID NO: 1087 - protein, 704 aa, Haloferax mucosum ATCC BAA-1512
MLSPEAFRQTYSDAELAKELPDRPIASLRDIQHHYGTLYTLATTGGGKYAPYLTPDAASDLVDEPDSLIVVRVDLSGDEPTLASDDRGPVWVTKYTDELIPKVAHCKYPAARGIDHSITHQAGKNSDPEKLARYAKERLSKWATDSAVQPAAEEHEDGWIIDSLAELGEDEATLEQLEHDVLATLSGSTTALLTVQVKIDDDPYLWPGDLDVSMAAMRSRKLSKLVSKGKASNSAGEATDLITGAQTRTVGTAQDPLNYFLGKQLEKFPGFDPDQAWRTHPISEDAAITLMNAETFIDACSYRTFGARVYYLPYFFGKPDAEDTYRLYELLYDTVTEDDSERGLTPIETAYQFREEKSLDENKLRFYVSAVMPHQMSRFDVFGETMNGRIQFPASLATAHRDLLRTTAFRDGNERTAALPTHENWSLLSDDGFLGLVASGSYFYQTLPSGDDDTDASADDPRILALVAVLSGDSIPVSTLLESYVDRIIEESGDDEYGFPVFRVASQYAQLCALADANPGFLDATDTRKPIIEPPSYGQRTMSDMVKTITDGGFAGTEKLESFIEDTPALATNDERCASFLLGALVGAVGGYQEYEHDRSTTLVDQFPVQAVTRNRIKKVTESAIEKTITYTRQEKKGGREYPGTKFDYIVDRLRETVINPDPDDWDIDTADLRFYYALGLTYGMNDRPLTSNSEPDQPNPTAN

SEQ ID NO: 1088 - protein, 705 aa, Haloferax mediterranei ATCC 33500; identical to SEQ ID NO: 1047

SEQ ID NO: 1089 - protein, 720 aa, Haloferax denitrificans ATCC 35960
MLSPNEFRDRYPETELADELPDSPVGSLRDLQYLYGKLYTLATTGGGEYAPYLTPDAARDLVDTDDSLIAVRVDLSGDEPRLADDSLGPVLVTRYTSDLIQQVGHSKYPAARGIDHSVTHQAGRNSDPEKLARYAKERLTKWATDDVVATAASEHPEGWVIDRLAELGTREAALEAIEDAVVRALGGESTTALLTVQVKTERDGDYRWPGDIAAFNEAMRQRKLSKLVTKNKADDSSGDATDIVTGRPSRTVGTAEDPQNYFLGKQLEKFPGLDIENAWRSHPISEDAAVTVMNAEAFVEACTYRTFGAKVYYLPYFFGRLTPEKVYRLYKMLFSAVEDGGDATPIEQAYMEERELDDSDARLRFYVSAVMPHQMSRYDVFGETLNGRLHYPRELAFTHNRFVRNASAFNSETDRTAPLPKNDKWGLLSANDEQLHAVSTGWYFYQTFAERDDAEADADDPRIEALVSVLCGDAIAVDVLLEEYVTRIIDGESDDDFEGFPSFLVASQFAQLCALADGELELLKTNEPTKSQITLEPTYERLTMPTLDEILIADGGSPAEQKLESFINETPALSPAHDDDEDSVTSERRGAFLLGALVGDIGSYQEYSEDRSTTLVDQYPVKSITRARIKKVTQETVAKTLTYTRQEKKKGKSYPGTKAEHIVERLRETVLDPDPDDWEIDTDDLRFYYALGVTYGMNDHPDWNQQNSDASDKRTTDEEH

SEQ ID NO: 1090 - protein, 724 aa, Haloarcula californiae ATCC 33799
MSESALDGTEDADDIEAVLLGRPIASLYDISYLYGKLHALNTAKQYDLPIDDRYIGRMTHESRTDYYEQEVGLFSVLVNLTGDSPTLGQASELDEMPDGDTSPFIAESLDREKMLRVGLSRQDSRAAGHNMSLAHDVSKSSEDCDKYVKQLFDRWAASDTVADVADSHDDGWILKALKEVGEDEGLISTIENGVVDSIRESFGDEFNGVLSVRLKLPGTDGYVYPGEVEVLNEAMLYRWVEKRMRSYSEADDASGEGRGYITGDTGEVFGLSDSPLQRYKGKMAEKFPNFVVDESWQQRPLTAEAAFAVSSSVPLLENFVQLLGENTAAYYIPYVPEPTVEQAVALYELAMRAADNSGSIVSVIEDTANNPASPLYGDLQIHYVAAYTPGNKRKFIEEEQCVDPNRIRAIQDAHTSVLTDGLVSPDGDSPPLFPSPPYGRLTDDRDDEQGSKYLRSNAPVVAGVLSGGYFQSTFRHQSTDEDRDDHGTTDLRIEATSTALASDGQIDPDWLFAQYVPRLISEQRSAFKDGNELPESLLTRQYVQMQALARADVLGDASSDDPRTIPVSTETMSDMPEFSDRDDRLAQFIDSHPALAEDEERRAAFLIGALVGRVAAYQSQNEISRTVIRQHPIDAMTRRRISTTLSKVLEKNAYYSSDDEEAGMLMNDRYITRLNDIVNSHPPEEWALSTDDLRMHYGLGLTYGKNDQRLDNQDDEAAGAESDD

SEQ ID NO: 1091 - protein, 720 aa, Haloarcula argentinensis DSM 12282
MLSPEAFQEEYSADVLESELPDSPIGSLRDLQYLYGKLYTLATTGGGEYAPYLTPDAAGDLVDTDDSLIVVRIDVSGDAPRLADDDLGPVQVTRYTDDLIQQVGHCKYPAARGIDHSVTHQAGRNSGPEKLARYAKERLTKWATDEVVTEAADEHPDGWIIERLAELSENETALETIAETLTRKLGGESTTALLTVQVKTEPDGEYQWPGDIDVFREAMRQRKLSKLVTKNKADDSSGNATDLVTGSPARTVGTSEDPQNYFLGKQLEKFPGLDIEEAWRSHPISEDAAITVMNADTFVEACTYRTFGAKVYYLPYVFGRLAPEKVHRLYELLYRTVDDEETTPIENAYDEERRKTIEEQDFRFYVSAVMPHQMSRYDVFGETLNGRLHFPKQLAITHNEFVQTVSAFNRDHYDDWTAPLPTNQNWGLLETNDEQLHAVSTGWYFRQTFAERDDDDADADDPRIEALISVLSGEAIAVDVLLEEYVTRIIDDQTDDSEHEGFPSFLVASQFAQLCVLADEDLRLLQTTDPQKDQITQQPSYDTKSMPSLDEITIADGGHPAAPKLESFINETPALSPSHDDDPDSVTSQRRGAFLLGALVGDIGSYQEYSEDRSTTLVDQYPVKSITRSRIKKVTQETVAKTLTYTRQEKKQQGNYPGTKADHIVDRLRDTILNPDPEEWEIETDDLRFYYALGVTYGMNDHPWNRDETDAGDSTSQEEH

SEQ ID NO: 1092 - protein, 717 aa, Halobiforma nitratireducens JCM 10879
MLSPDAFETAYPAEELADELPNSPIGSLRDLQYLYGKLYTLATTGGGDYASYLTPDAAGDLIDTESSLIVVRVDVSGSEPKLADEPVRVTRYTENLVQKVSHCKFSAARGIDHSVTHQAGRNSDAEKLARYAKERVTRWATDDVVTDAANAHPDGWIIERLATLAEDEGALETIEDAVVQELGGDSATALLTVQVKTDGGGDYRWPGDIDVFLEAMRQRKLSKLVTKNKADDSSGDATDIVTGQPARTVGTSEDPQNYFLGKQRETFPGLDIEEAWRAHPISEDAAVTVMNAETFVEACTYRTFGTKVYYLPYFFGRPAPEKVYELYGLLYQAATDGGMETPIEDAYADRRGQDLEETDLRFYVSAVMPHQMSRYDVFGETLNGQLHYPTELAFAHNEVVGKASAFNSDTDWTPPLPTTDSWDLLTDSTTRLNSVSTGWYFYQTFAERDDADADADDPRIKALVNVLSGEPIAVEMLLEEYVQRIIDKQTDDSEHEGFPSLLVASQFAQLCALASEKAQLLTTTDPAKEPVTRVPTYEKHTTQTMEEIDIVPDGGHPGDAKLESFIENTPALTPDPDDEDSVANERRGAFLLGALVGDIGSYQEYSEDRSTTLVDQYPVKSITQSRIKKVAQETIAKTLTYTRQEKKEQGGYPGTKADHIVDRLRETIADPDPDEWKIDTDDLRFYYALGVTYGMNDHPWRNGNAQTNDQSDLEEEH

SEQ ID NO: 1093 - protein, 733 aa, Halococcus thailandensis JCM 13552
MTEAALDANEDADAINEILLDRPIASLYDMAYLYGKLHALNTAKQYDVPIDDRYIGRMTHESRTDYYDQEVGLFSVLVDLTGDTPTFGEAGELDDISSDDTSPFVAESLDREKMLRVGFSRQDSRAAGHNMSLSHDVTKSSEDCVKYVRQLFDRWAASDSVADVAAEHDDGWILDDLRAIGENSDLMGTLESDVVDSIRDTFGTEFSGVLSVRLKLPDTESYVYPGEVEVLNEAMHYRWVEKRMRSYSEADDASGEGRGFITEEGGEVFGLSDSPLQRYKGKMAEKFPNLVVDKSWQQRPLTSEAAVAVSSGVPLLENFVQILGDDTTAYYVPYVPEPTVEQAVALYELAMKAADNSGAVVSVIEDAASNPANPLFDDFKIHYVATYTPGNKRKFIEEEPCADPERTRLVQEAHTELLQSAIFTSDRDDGLPLFPSPPYGRLSDGGDSDQGSRYLRVEDHTAVITGILTSWYFQSTFRYQSTDEDRDDHGTTDHRTEATSITLSSNGRIDPDWLLGQYVPRLISEQRSAFENGNELPESLLTRQYVQMHALARAGVLGDSSSDDPRTTPIDTTAMSDTIDINNRDDRLAQFIDNHPALAEDEERRAAFLLGALIGRVAAYQNQSGLSRTVIRQHPIDAMTRRRVSTTLSKVLEKNAHYSSDNDSAGMLMNDRYITRLNDIVNRHSPSEWSISTDDLRMHYGLGLTYGKNDTSIDDKDAADMEEEAAIETQADN

SEQ ID NO: 1094 - protein, 717 aa, Halorubrum kocurii JCM 14978
MSLLPEPSTFEERYSDDEELASELPDRPITSLRDLQYVYGRLYTLATTGGGEYAAYLTPEKSTDLFDEPESLLYLRIDLSGDEPRLDPDQPVGVESYGEEKVEAVAHSWFNAAAGFDHSVTHRTGKNKEPEKVAEYLHERLTAWSADDVIQEAAVDHEDGWVIDALATLGESEGLRERIEAAVDEQLDGKTTALTTVAVKLEPDGEYLLPGEASPVFNEAMRARKRSKLVSKGEATNSVGEATDLVTGGRGPTVGTAEDPLNYFLGKQLEKFPGFDPDEAWRTHPVSEDVAVTLMNASTFVDACDYYTMGANVYYLPYFFGRLGPTDARDLYGLLYDLVHAGEMSPLESAYRSYQDTPRLQEVGERFRFYVAAVMEHQTKRFDVFGDSMDGTLFSPVELTRAHQRVLQSWLYDAEGDADHPGPGLRAAFPTPDNWDIFVPEESVLLSTLATGWYFEQTFAPADDDDASADDYRIRALVAVLSGEPLGVETVLTEYVERLLEDEGEEFPSFRVSAQYAQLCALTEAGLLTGRDAYKPVAEAPQLTHDYSTHDMQQDTPARADGGDVAAARETKLEQFLEQTPALAEDQPERRGSFLLGALVGQVTGYQQVSEGRSTTLIDQYPIKAVTESKLKRLASDVLDKNIVYSRENNMAGTMYSEVVDRLVTTLPRIDIDGDWELDTTDLRFYYSLGVAYGMNNWASSDDEQAGDQPAAEEEEA

SEQ ID NO: 1095 - protein, 703 aa, Thermoanaerobacter thermohydrosulfuricus WC1
MNLPLITAAIGAQFRDDIDVLDSRIKSIKLEEDEKDRAYNIFMTFNLDEDKLLFDDPLLYNERHTREFKYFGNNSGSSLQTYVVREVKALYYLLAEVWMDLYKALEKENMNNSELYQLLKELEENKFVFLKEKKGKMCINFKKLILPQDIEIEIKSDDKKKILVKDKKNEKEQTMNYENFIKYIRGEGKSKYKYVLVVPRIIKDGNEKIVSKHPDYIELIKRLNKIGEGTSDNSIETVETAQKRVCYICGNSKVGVSSSKTSKFSRSGINKFFTITTKNSARFLESTIDNYDDVYSFCDECYQNLLIGEKVIEEKFKGNIAGESAYILPESMMGEFNFNYISKIKEHVDFAFNVNDSLNWLKSVEAEAIIDQKNPYVVNFIIYRTDGRSVELLDAFEDIPFSRFVKLNELFKEKVKKIKPHLEYFSLSSIYHIIPVRKVKVNQKEKQIDIGRVLTLYKSILSDYQVERETIYSYASEALDKGIRQLSKGKIDNYENLQLTKYIGNTDFFIKTIIMSYIVLMKVLQELKIVDKYFFKNRQFWEGEKLMDEKKEFLLAQVEQIEVFLEQQGFTDEEKALFYLGTLLYRVALAQFIKEHKTKPILKKIQFQGMNINEVLRLYEDIIEKLRQYDKMTLFAENLINRFHNYFGHLRKRWPLSDQANVFYIMAGYAYMVGQKTPDITKEEESAVEKEKIAMAELEKLSE

SEQ ID NO: 1096 - protein, 704 aa, Halorhabdus tiamatea SARL4B; identical to SEQ ID NO: 1062

SEQ ID NO: 1097 - protein, 716 aa, Candidatus Halobonum tyrrellensis G22
MSLLPEPSTFEKKYDDKELASELPDRPITSLRDLQYVYGRLYTLATAGGGEYAAYLTPEKSTDLFDEPESLLYLRVDLSGDESRLDPDQPVGVESYGEKKVEAVAHSWYDSARGFDHSITHRTGKNKEPEKVAEYLHQRLTSWADDDVIQEATADHEDGWIVDALAELGESEGLRERIEAAVDEQLDGKTTALTTVAVKLEPDGEYLLPGEASPVFNEAMRARKRSKLVSKGEATNSVGEATDLVTGNRGPTVGTAEDPLNYFLGKQLEKFPGFDPDEAWRTHPVSEDVAVTLMNASTFVDACDYYTMGANVYYLPYFFGRLQPTEARELYRMLYAVVRDEEMTPIERVYREFQNDPALQEYGERFRFYVAAVMKHQTKRFDVFGDTLDGSLLSPVELISSHIDILESPLFDVYDDAERDTPELRPAFPAPENWDIFVPSEHALLSTLATGWYFEQTFALADDDDASADDYRIRALVAVLSGESLDVETVLTEYVERLLEDEGEGFPSFRVAAQYAQLCALAEAGLLTGRDAYEPVAEPLQLTDDHPADDMQQDTPARADGGNVAAARETKLEQFLEQTPALAEDQPERRGSFLLGALVGQVTGYQQVSEGRSTTLIDQYPIKAVTESKLKRLASDVLDKNIVYSRENNMAGTMYREVVDRLVTTLPQIDIDGDWELDTTDLRFYYSLGVAYGMNNWASSDDEEVDDQPETAEEEA

SEQ ID NO: 1098 - protein, 621 aa, Methanolobus tindarius DSM 2278
MIEAIKEIGEYALKKDEKNPENPIEIIIEDPASSPTYKHILAIILNETETETETEFTYGGIQLEEYSKEKKEKYLYKGGSSRGTDLSPTSKITTLDKTWNNKTIAWFRKVLNDKNLDIEEVESKFLESIYDCLEINKDIILNDLTEKSSDFAKNENAIITLVINATNLSPQYIGDINVFKKIVEQYYSQNLSHSATYKIDSIGHNQVCSVCNHESEEVYGLVTTYKFYNVDKPGFVSGGFDRSESWKNYPVCLKCSLALEAGKQYLEEYNKYKSYGINYYIIPKLLQQNGSSDIYEVFEDYNENILDGNLTIKKEYGRLLSETEEEIFELLSNQSNTLSNNILFFEKTNAAFRILLYVEDVLPSRLRKLFEIKKIVDKKSTFNNLYKRNHPLSFTFGNIWYLFSNQEQDGTKYFLEIANNIFSNQTLSYTFLVKKIVDKVRRDFVNDRSTIDSTLKGLQLLDYINYLGLLDNFNGENKVRTDFDDTLNKCNTSIDEKANQLFSEFPDFFNQPAKRAIFLQGALTQYLLNIQWHDRGASPFRTKLHGLKLDEKLVKKLFPEIQNKLEEYGKNYYLDLETLISKYMLQAGNDWNISKDEINFYYVLGMNLSYIFKNQGENADE

SEQ ID NO: 1099 - protein, 586 aa, Clostridium butyricum DORA_1
MLKECLEVFKSDLENNRQKIIDSYVPADGTYVIVSHKDDFFEIKDYFDIKYDKKEKKLLGKTNINFYDVCNYDYNSKLIDMNKPIDGKKIIHSNNYLSFFIKKESLENGKLNDEIIDNYYNILKNPIEKYAKNKKAVALYKSIEEEIGEVDVELLEKIKVWIKGNIFNLDMEIKGKDYLKIFFEHPIEKYVNEAKRYLIPNIYNNNDCNIDLDGDIYGLPNNNMGLNAKKPYLENKTRKNTSPYLIDAEEVQLQKEFFDYLMNEVSLGKVNAFIDVYNKKIDVKENGKLPDNDFNGLFLRLKKGKEVEIHDFDTITSYKSILKKELNVENILELDLDSKPNQKYVECYHPFKKKEDVQKILDEVFFSSYLINNYFTDAGDISIKDNVLKNNLLTARNSIFNWIYKGIQKGSVNGIASVLDKVSLNLIKGSINNGYIPKAGHQFNLRWSLKAYFEGGRGMADIVHDLKSTLRDKINEKDTSKIDDDKEYYFAVGQLISYLLSKSKGKKRPHSLANQFINSKSNDDLKGKLKKIYVKYSYDPDINSKRFNNLYAMIVGYLPEGNVNTDLVIAGYLNSNLIYEKSEGDK

SEQ ID NO: 1100 - protein, 641 aa, Anoxybacillus flavithermus NBRC 109594
MIDENPSIVQAITLPLEKPDDTIKYAVIIDLSLQTKKVQLSLKEIGSSTSTDLLWLGTADGAASPQWYGTVRNIEYLLGQTIPNLLERWDREDSYYRLLKEAHQLFFLDLGATKKSDERYRYVFNPIYIGGTLTEVDGKKAVSEVAKQFQHFVEKEAHVNSKDVLLYSLAIDGKLIVKQPEYERLVISEKLSVFKDAEEGICALTNKKAPVTGETTKLKFNYYINDKISFASDLDKKSFVKNLSISREAYQAIMAGEAYILRDFNTRFSGLPCYIIPEFLYDVPFANTPLQDISERIRRFIRTVKTVETAEFLYRDIEDYKLFEEQMDNYISLHFLFYTKSQASLKINKLISDVPLTYLRALGRGMRNVEDIGRRFFSSGKFNLGLDAIYYLIPMRTQRGENLEKRKILYVYESLLTNKSISYQWLVTQFVQLAKVHMYANYDLYQYKSKKEYNDFQLIDSMIHAQLFLKLLYRLNLIKEGRKMTDISYDLPDAEMAEYMETMNYMTAQRALFLLGYLIARIGAEQVKRSNERSEVLGQARAGKTVSKPILSKINYHGMNKQKVMMLSTEVFEKLRQLKIASLYNESIYAAHKHLLDVALREKWSLSDRESVFYLLSGYAYGTKRILENAKKGKTELDDEE

SEQ ID NO: 1101 - protein, 593 aa, Clostridium botulinum; identical to SEQ ID NO: 1066

SEQ ID NO: 1102 - protein, 510 aa, Clostridium botulinum
MNKPIDSKKVIHSNNYLSFFVKLDSISGGKLTNEIIHNYYEVLRNPQDKYKKDKKKLTMYEDAEKEFGKVNEERLNKIEEWIINNIYNLVPKDSKEKTYLKIFFKYDLSEYEKESKKYLIPNIYNSTDFNISINDTLYGLPNNNMGLNSKKPYLENKTRKTTVPFLISLKEVLIQKKLFDFLMNMVTTGRVNIYLNEKEIIALSNKESLKNNFQGAYIRIKKGKELEILDFDIIENYKVKLKQPMKVKNILQINYEKLSRKSPDYYHEITLVESLKIFINEILFSKFLDSNYFTEAKDLSINNSNLKMNLLLSRNILFNWFFKGNQQGVWEVLSKTSLSLIKGSINNGYMIRASEQFNLRCALKEYFKGDEKSMADVLKEVKDSLRKKINIKFDEATSSIENDDEYYFAVGQLAGYFISLNKSKNKPHSLANPVINARNDKRIKDELIKLYKKYNYAIPYTKGRFENLMAIVKSYEPKEKVKDDLIIAGYLHSNLIFEKTEDSKNENGGN

SEQ ID NO: 1103 - protein, 586 aa, Clostridium butyricum; identical to SEQ ID NO: 1065

SEQ ID NO: 1104 - protein, 717 aa, Halorubrum saccharovorum; identical to SEQ ID NO: 1079

SEQ ID NO: 1105 - protein, 705 aa, Haloferax mediterranei; identical to SEQ ID NO: 1047

SEQ ID NO: 1106 - protein, 656 aa, Haloferax lucentense; identical to SEQ ID NO: 1083

SEQ ID NO: 1107 - protein, 720 aa, Haloferax denitrificans; identical to SEQ ID NO: 1089

SEQ ID NO: 1108 - protein, 720 aa, Haloarcula argentinensis; identical to SEQ ID NO: 1091

SEQ ID NO: 1109 - protein, 717 aa, Natronobacterium gregoryi; identical to SEQ ID NO: 1049

SEQ ID NO: 1110 - protein, 718 aa, Natrialba chahannaoensis; identical to SEQ ID NO: 1076

SEQ ID NO: 1111 - protein, 735 aa, Natrialba chahannaoensis; identical to SEQ ID NO: 1075

SEQ ID NO: 1112 - protein, 651 aa, Haloferax alexandrinus; identical to SEQ ID NO: 1086

SEQ ID NO: 1113 - protein, 706 aa, Haloterrigena thermotolerans; identical to SEQ ID NO: 1077

SEQ ID NO: 1114 - protein, 718 aa, Natrialba hulunbeirensis; identical to SEQ ID NO: 1074

SEQ ID NO: 1115 - protein, 717 aa, Halobiforma nitratireducens; identical to SEQ ID NO: 1092

SEQ ID NO: 1116 - protein, 724 aa, Haloarcula californiae; identical to SEQ ID NO: 1090

SEQ ID NO: 1117 - protein, 733 aa, Halococcus thailandensis; identical to SEQ ID NO: 1093

SEQ ID NO: 1118 - protein, 657 aa, Haladaptatus paucihalophilus
MDQDDSLVVVRADVSGDKPRLETGDRRGPVWITRYTKERIPKVAHCKYPAARGIDHSITHQAGKNSDPEKLARYAKERLTKWPKDDVVQSVADDHKDGWIINALSDLGEDESVLKTIEESVTTQLKGSTSALLTVKVKTEPDGEYHWPSDGNLDVLMAAMRRRKLSKLVSKGQASDSSGEAIDLVTGARTRTVGTAEDPLNYFLGKQLEKFPGFDPDEAWRTHPISEDAAVTLMNAETFVDACTYRTFNTNVYYLPYFFGVPEPEETHLLYRLLYSIVSESDSSEQLTPIENAYLHQKERFGDDADANGLRFYVSAVMPHQMSRYDVFGETMNGLIQYPANLAFAHAQVVQTTAFREGHKRTGALPNHENWQLLNGENILGSVASGSYLYQTLPSGDDDTDASADDFRIRALVAILSGEAIPISSLLERYVERIIEDSRDDENGFPVFLVASQYAQLCALARADHDFLTVRDANKALRPITNPPTYESRPMQSRQEKPVPDGGFAGATKLESFIEDTPALAKNDERCASFLLGALVGAVGDYQEYEQGRSTTLVDQFPVKSVTRNRVKKIAEDAIEKAVTYTRQEKKGGMSYPGMKFDYIADRLREKIIRPDPDDWSIDTDDLRFYYALGVTYGMNDRKIRSNDTDEQPAETSQVDQ

SEQ ID NO: 1119 - protein, 730 aa, Haloferax prahovense; identical to SEQ ID NO: 1082

SEQ ID NO: 1120 - protein, 715 aa, Natronorubrum sulfidifaciens; identical to SEQ ID NO: 1071

SEQ ID NO: 1121 - protein, 704 aa, Haloferax mucosum; identical to SEQ ID NO: 1087

SEQ ID NO: 1122 - protein, 705 aa, Haloferax elongans; identical to SEQ ID NO: 1085

SEQ ID NO: 1123 - protein, 716 aa, Halorubrum; identical to SEQ ID NO: 1078

SEQ ID NO: 1124 - protein, 709 aa, Natrinema gari; identical to SEQ ID NO: 1073

SEQ ID NO: 1125 - protein, 704 aa, Halorhabdus tiamatea; identical to SEQ ID NO: 1062

SEQ ID NO: 1126 - protein, 720 aa, Haloferax; identical to SEQ ID NO: 1080

SEQ ID NO: 1127 - protein, 717 aa, Halorubrum kocurii; identical to SEQ ID NO: 1094

SEQ ID NO: 1128 - protein, 614 aa, Ferroplasma acidarmanus; identical to SEQ ID NO: 1053

SEQ ID NO: 1129 - protein, 579 aa, Clostridium tetani
MLKDVISIFKREYEKIGDRYVTESYIPSDGEYIIVDTFENDFKILDKVIIKKDRKTQKIDDSNQYFPFIREADYLSRLLDMNKPIDHKKIIHSNNYLSFFIKKENVNNGKLSDEIIDRYYEILKDPLIKYKNTKAEKLYEEVEEEHGKVNEKLIDEIKNWIKEKIHDFVDKGSKEKEYLKIFFKYDLDKYRKESEKYISPNLYNSNDYNVKIKEEIYGLPNDNMGLNSKKPYLENKTRKSKVPYLISKEEVLIQKKFFDYLMNQVAIGKSNIYINEKGIKGISNKETLGEDFTGYYLRIQKGKEVEIHNFDTIVNYRAKIEPFKLENVLELEKSELNYNVFIYEIGKLKDLIDNVFFYKFLSGNFFTKAEDLNINDATLKRSILLSRDTLFTWFYKGVDNNTWNNLNISSLNLIKGSINKRYLLKAGEQFNLRCSLKNYFEGGISMADVLLEVKNSLREKINKTVKENKNHEDVTLDNDREYYFAVGQLAYYLISLSKSKNKSHSLVNPIINAKTNERIKDEIRRLYTRYNYRIEFGSKRVERLYSMISSYVPKGKINGDLIIAGFLKNNLIYEKSEEE

SEQ ID NO: 1130 - protein, 710 aa, Haloarcula marismortui
MLSPEQFRERYADTLADELPDGPVTSLRSLQYLYGKLYTLATAGGGDYAAYLTPDEAGDLVDSEDSLIVVRVDLSGNEPQLATDDRGPVWVTKYTDDRVEKVAHCKYPAARGIDHSVTHQAGRNSGPEKLARYAKERLTKWAKDEVVQEAATEHEDGYIVEALAELSEDEATLDAIEEAVKRELAGESTTALLTVQVKVDPDGDYLWPAERDVFLAAMRRRKLSKLVTKNKADDSSGQATDIVTGASTRTVGTSEDPQNYYLGKQLEKFPGLDIEEAWRTHPISEDAAVTVMNAGTFVEACTYRTFGTKVYCLPYVWGTISTSDAFDLYKLLYDATTEDDGMTPIERQYENRNTLFGDAQLRFYVSAVMPHQMSRYDVFGETLNGRLLYPKELATKHNQLVQQSAAFHSGAEWTPPMPTHPNWDLLAGSDEQLHAVSTGWYFAQTFAQRDDDDADADDPRIEALVSVLSGDAISVETLLEEYVARIITEQTDDDVEGFPSFRVASQFAQLCALATDKLDLLTSDDAAKEPITREPTYDTQTMEPPTDILAADGGHPAAAKLESFIEDTPALAPDEDAPHNDQRRGAFLLGALVGEIGSYQEYDQDRSTTLVDQFPVKSITKSRIKKVTQETIGKTLTYTRQEKKAGQSYPGTKAEHVVERLRETILKPDPDEWDLDTDDLRFYYALGVTYGMNDHPEWDSTAIDDTEEDI

SEQ ID NO: 1131 - protein, 594 aa, Clostridium novyi
MLKQAVDYLLSSYSEDKIDNVIAKNYIPDDGDYIILEETEDGFRELERLVIKKHNKTKEIDTTGFINFDFICIADYLSAVKDTNKSIEKKKVIHSNNYFTFFVKKDSFLNGKLTNEIIHSYYEALRNPQNKYKQNKLKMYEEAEKELGKVNEERLDKIEQWILNNVYDLVPKDSKEKTYLKIFFKYDLSEYEKESKKYLIPNIYNNTDWNSYIEDTLYGLPNNNMGLNSKKPYLENKTRKTTIPFLISLKQVLLQKKLFDFLMNMANKGKVNIYLNKEKIIALNNNESLNEDFQGIYMRIKKGKELEILDFDVIEDYKVRLREPIKIQNVLKINYDKLDRNPQDMYKQINLVESLKSLVNEILFSKFLNTNYFTEPKDLSINNSNLKMNLLLSRNVLFNWFVKGREQGAREALNRVSLSLIKGAINNGYIVRASEQFNLRCALKKYFKGEEISMADVLKGVKDSLRKKINIKYDENTPSIENDQEYYFAVGQLTGYFISLNKSKNRPHSLANPVINARNDKRIKDELIKLYKKYNYTIPYVKGRFENLMAMVKSYEPTGNVQDDLIIAGYLHSNLIFEKSQNHDDKNGGNGDDE

SEQ ID NO: 1132 - protein, 545 aa, Thermotoga sp. RQ2; identical to SEQ ID NO: 1043

SEQ ID NO: 1133 - protein, 717 aa, Halorubrum lacusprofundi
MSGPTREDFAAAIDDYWHGRPPTSLEDVMSLYGVLAVAESGGSLYGTPSTLDPFIDDGRLVVIDLDLTGDEPTYEQGGAGISVDTLRTDDIAKLAYSHKSSGRGAKYSLTQIGSKNGNDASGVAGTILRRVRSWTNQDSVQSITGDNGHPDAWVIETLDKVFTKDGETLERIQSDIESLLPTDDSVPTVLTVRCRINDTDLSTTDNDDTDWFWPADLDVLNRAMRRYATANATDKNISSGPASEGEAVGVVTDQVGRVVGTPESPLEVFSVKHPDAQPGLRRDQSWRNYPVSADVAMLFSKGQDLIERCVLRRGGVETYTLPYFAGELTELKAETLYRAIHSLDSESEYTDSSHAPMARVTYEIQENDDPAVRALKDEIRFYVVSLPISDDKNIIAEEPSAGIYWVSELAKSLVDTVQGPTLSPESGGFRTYDNWDLLDFPDETGQARNVAFGKIVGHTFTDAVFAYRDEEGDDFRRIVDHRLIAGVPLDASMLFSEYMQRWGDEFDGDDPVPQQVIAQQLVHLESLSRAGLLTGLDAAVEPTDTETMTAIEDTDTDLSNLAAIRKYRLESFLDRPMFTENAERKATALAGVLVGQISWHQADERDLGRPLDSKTRGDQLTKNGLEQAVKTALEKAKVYAHDSKQYADRDILFPETVDLLLETTEQMPTKWEIDKRDLQFAYVLGHAHGRRSMPNAFDLYKKDDASEESEAAESPAN

SEQ ID NO: 1134 - protein, 729 aa, Haloarcula hispanica; identical to SEQ ID NO: 1046

SEQ ID NO: 1135 - protein, 681 aa, Haloquadratum walsbyi
MDTEALEDVADETIRSTIPRRPVASLRDIEVLYGALYTLGRGLTGPYGAYLTPDAAADQIGNETLVVVRVDLRGEKATLVDPPVSLEMFPEDLVLRVAHSKYSAGNGDDYSITHQSGQTNGPEKQGDHALERLTSWSNQEAIEETASKHEDGWIIEKLAELGADDETEKKIREEVESLISEEGQLLHTVAIAFDDNRVNTTAQFQSNETWHYPGEIEVLQEAMAARKTGKFRTNTQGADDASGDGTCFVFDTDETVYGIVGDPMKHYLSKQMEKFPAFDADRSWQTQGLGRDAAVRAQNADTFLNACTTSAPGTSAFYLPYPTGKIDANSAKVLYELLSEQVNSDDEYSPVGSKYRRLKATDKLDAIRFSLVIVNKYQKDRWRVLAATPTASTHIIEDVTQQHLAVLDSRWVTEEKIFPKREKFSLLSIEEAESLSNVVSSVAYLGETCLGDDADDPSSNDFRFRGTAMIASGKQLRVEELLEEYVAKLVNKFDPDDQYPFPMATLTQQYVQLNALRACDLLTADDERLVIQSQHMSDQTSQATADNRQEQFEQFIEDHSALSDETRQGVFALGALIGRISRYQSDDGRSTTAISQYPIGNLTKHNIRRIATEVVESNVIYSEKEGYKQTMYGELMQAVADGLESTDQDELTLSTEDLRFHYAMGIAYGKNDPSTSDYKNE

SEQ ID NO: 1136 - protein, 709 aa, Natrinema sp. J7-2; identical to SEQ ID NO: 1048

SEQ ID NO: 1137 - protein, 701 aa, Halomicrobium mukohataei; identical to SEQ ID NO: 1045

SEQ ID NO: 1138 - protein, 723 aa, Halorhabdus utahensis; identical to SEQ ID NO: 1044

SEQ ID NO: 1139 - protein, 657 aa, Haladaptatus paucihalophilus
MDQDDSLVVVRADVSGDKPRLETGDRRGPVWITRYTKERIPKVAHCKYPAARGIDHSITHQAGKNSDPEKLARYAKERLTKWPKDDVVQSVADDHKDGWIINALSDLGEDESVLKTIEESVTTQLKGSTSALLTVKVKTEPDGEYHWPSDGNLDVLMAAMRRRKLSKLVSKGQASDSSGEAIDLVTGARTRTVGTAEDPLNYFLGKQLEKFPGFDPDEAWRTHPISEDAAVTLMNAETFVDACTYRTFNTNVYYLPYFFGVPEPEETHLLYRLLYSIVSESDSSEQLTPIENAYLHQKERFGDDADANGLRFYVSAVMPHQMSRYDVFGETMNGLIQYPANLAFAHAQVVQTTAFREGHKRTGALPNHENWQLLNGENILGSVASGSYLYQTLPSGDDDTDASADDFRIRALVAILSGEAIPISSLLERYVERIIEDSRDDENGFPVFLVPSQYAQLCALARADHDFLTVRDANKALRPITNPPTYESRPMQSRQEKPVPDGGFAGATKLESFIEDTPALAKNDERCASFLLGALVGAVGDYQEYEQGRSTTLVDQFPVKSVTRNRVKKIAEDAIEKAVTYTRQEKKGGMSYPGMKFDYIADRLREKIIRPDPDDWSIDTDDLRFYYALGVTYGMNDRKIRSNDTDEQPAETSQVDQ

SEQ ID NO: 1140 - protein, 701 aa, Halomicrobium katesii
MLDPDEFYDEYPPEKLEDELPERPISSLRDIQHLYGRLYTLATAGGGDYAAYLTPDQANDLIGTEESLIAVRVDLSGERPTLDAEKPVDVTQYTDDLVQRVAHCKYNAARGIDHSVTHRSGRNSDPEKLARYACERLTKWATDDVVQGVADDHPDGAVIRGLATVGENENALDRIREAVQTELGGSTTALLTVQVRREEGGEYEWPGQISVFDEAMRARKLSKLVSKGQATNSAGEATDLVSGERTRTVGTAEDPLNYFLGKQMEKFPGLDPDEAWRSHPISEDGAVTLMNAEEFLDACSYRTFNADVYYFPYFLGRPTPEETANLYAALHRVTRDDDMNPVQALYDEFGDHEAASEGRLRFYVAAVMKHQMSRFDVYGETLNGRIHYPTEVGQRHERVTGSWVFDEDDARNGDRTPPMPSHEEWALTNYQRFREMVASGAYLYGTFPFTDEDTDATVDDERIDVHVSILAGDPVPRNQLVSAYVERLLDRDGDEVPELLIASQFAQLCALENAGLVTTDASETEPTLIDGPDYDTMEPEHARTDGGTAALDRTEKLESFIEQTDGLDDPERKGAFLLGTLVGQVGTYQQGYHDRSTTVIDQYPIKSMTKTKIKRITQEVIDKDVVYSREMAKKGSNINSTMYKEVTNAIVETMAERDPSDWEISTDDLRFYYALGLTYGMNDRSTNEYDAADDETPETNE

SEQ ID NO: 1141 - protein, 579 aa, Clostridioides difficile
MLKDCLEIFEKEYKSLGNRLITDSYVLSYGTYILVKNFSNIDILEVSKNNVDSTEDIYHKFCELDYLSKLVSIDKSVDSKKIIHSNNYLSFFVKKENLRPDKNNNVKLTEEIIDNYYDALLNPRIKYKSDKRKKEIYDSIENKYGKVDENKLNKIRLWIKTNIFDLVESVKKDKNYLKIFFDEKIELYNDENQKYLYPNIYNKNDFNVIIDGKNYGLPNDNMQLNEKKPFLKLKTRIRNSTPYLISDDEVLLQKAFFDYLTNKAANGEEVIYISSEKGIHRKTDIPNEFSGYILRIKKGKELEIHDFDTVVNLNTKIKRINVECIIPIEYERHNLKPNLEIGYINNLIKLEKTIDTVFFNKFMCNSYFKEIKNINLSDLVLRDILIRHREGLYTWFYKGRDSIVKQTFSNYSMGIIENSIKNNNYIRAKEQYNLRIAIINYFHGGSNMADKIKVISESLFEKINSIKTKCIQSDEEYYFAVGQLASYFISKNKSKNKNHSLINPILNAQNRKKIMLEIEKLFKKYNYDISYDNNRRFKNLYSMIVGYEVEEKKVNRDLLIGGYLYYNLIYTKSEENENE

SEQ ID NO: 1142 - protein, 586 aa, Clostridioides difficile
MVIGGENLLKDCLEIFEKEYKSLGNRLITDSYVLSYGTYILVKNFSNIDILEVSKNNVDSTEDIYHKFCELDYLSKLVSIDKSVDSKKIIHSNNYLSFFVKKENLRPDKNNNVKLTEEIIDNYYDALLNPRIKYKSDKRKKEIYDSIENKYGKVDENKLNKIRLWIKTNIFDLVESVKKDKNYLKIFFDEKIELYNDENQKYLYPNIYNKNDFNVIIDGKNYGLPNDNMQLNEKKPFLKLKTRIRNSTPYLISDDEVLLQKAFFDYLTNKAANGEEVIYISSEKGIHRKTDIPNEFSGYILRIKKGKELEIHDFDTVVNLNTKIKRINVECIIPIEYERHNLKPNLEIGYINNLIKLEKTIDTVFFNKFMCNSYFKEIKNINLSDLVLRDILIRHREGLYTWFYKGRDSIVKQTFSNYSMGIIENSIKNNNYIRAKEQYNLRIAIINYFHGGSNMADKIKVISESLFEKINSIKTKCIQSDEEYYFAVGQLASYFISKNKSKNKNHSLINPILNAQNRKKIMLEIEKLFKKYNYDISYDNNRRFKNLYSMIVGYEVEEKKVNRDLLIGGYLYYNLIYTKSEENENE

SEQ ID NO: 1143 - protein, 398 aa, Clostridioides difficile
DEKIELYNDENQKYLYPNIYNKNDFNVIIDGKNYGLPNDNMQLNEKKPFLKLKTRIRNSTPYLISDDEVLLQKAFFDYLTNKAANGEEVIYISSEKGIHRKTDIPNEFSGYILRIKKGKELEIHDFDTVVNLNTKIKRINVECIIPIEYERHNLKPNLEIGYINNLIKLEKTIDTVFFNKFMCNSYFKEIKNINLSDLVLRDILIRHREGLYTWFYKGRDSIVKQTFSNYSMGIIENSIKNNNYIRAKEQYNLRIAIINYFHGGSNMADKIKVISESLFEKINSIKTKCIQSDEEYYFAVGQLASYFISKNKSKNKNHSLINPILNAQNRKKIMLEIEKLFKKYNYDISYDNNRRFKNLYSMIVGYEVEEKKVNRDLLIGGYLYYNLIYTKSEENENE

SEQ ID NO: 1144 - protein, 579 aa, Clostridioides difficile; identical to SEQ ID NO: 1059

SEQ ID NO: 1145 - protein, 592 aa, Clostridium saccharobutylicum; identical to SEQ ID NO: 1054

SEQ ID NO: 1146 - protein, 716 aa, Candidatus Halobonum tyrrellensis; identical to SEQ ID NO: 1097

SEQ ID NO: 1147 - protein, 545 aa, Thermotoga sp. RQ2; identical to SEQ ID NO: 1043

SEQ ID NO: 1148 - protein, 723 aa, Halorhabdus utahensis DSM 12940; identical to SEQ ID NO: 1044

SEQ ID NO: 1149 - protein, 701 aa, Halomicrobium mukohataei DSM 12286; identical to SEQ ID NO: 1045

SEQ ID NO: 1150 - protein, 729 aa, Haloarcula hispanica ATCC 33960; identical to SEQ ID NO: 1046

SEQ ID NO: 1151 - protein, 705 aa, Haloferax mediterranei ATCC 33500; identical to SEQ ID NO: 1047

SEQ ID NO: 1152 - protein, 709 aa, Natrinema sp. J7-2; identical to SEQ ID NO: 1048

SEQ ID NO: 1153 - protein, 717 aa, Natronobacterium gregoryi SP2; identical to SEQ ID NO: 1049

SEQ ID NO: 1154 - protein, 674 aa, Methanoregula formicica SMSP; identical to SEQ ID NO: 1050

SEQ ID NO: 1155 - protein, 614 aa, Ferroplasma acidarmanus fer1; identical to SEQ ID NO: 1053

SEQ ID NO: 1156 - protein, 704 aa, Halorhabdus tiamatea SARL4B; identical to SEQ ID NO: 1062

SEQ ID NO: 1157 - protein, 592 aa, Clostridium saccharobutylicum DSM 13864; identical to SEQ ID NO: 1054

SEQ ID NO: 1158 - protein, 729 aa, Haloarcula hispanica N601; identical to SEQ ID NO: 1046

SEQ ID NO: 1159 - protein, 291 aa, Methanococcus vannielii SB
MVNSREFLLIWDSTMANPNGDMLNDNKPRQDEATGQLEVSDVRIKRFIRDHWISNGKNVLVQTKTDKNGKVMTCQGIVKEMASENNLKDEEIPNYLLEKYIDVKLFGAVITKPKYDITGPLQIAWSKSVHEADVKFMQGNAAYASGEGKDQASIWSKFISPYALFKTYAVYNDKVAEKQGINVSDDDLNDFKDALLNGLKNYRSTSKNQMPRLLIEVIYNNNKLDGELNYVDITYENQDLELRDISQVVINLGKLSEYALEKSASIEKIIIYKHKNVNLINVPENAEENLI

SEQ ID NO: 1160 - protein, 299 aa, Thermotoga sp. RQ2
MNPVKNRSEVLFIYDVKWANPNGDPLDENRPRFDEETSRLFVTDVRLKRTVRDYLAEYYNETLWVTGEAVVPEERVKELEIQDVSDACKKCIDIRLFGAVIPQSKKGAMESSITGPVQFRYGTSLHRVKLMTIQGTAAFATKDSKQRSFREDQLVPYALIAFYGVINQNSAKFTGLTEEDVSKLLEGIWMGTKNLITRSKMEHNPRLLMRVVYKEGVNYHSGELDYLVKVVSEKEDEEIRDVSELKLDVTELKQVLESLKDKIERIEYSVDNRFKLAENKEEKSFEEIFGGFQLVKLEW

SEQ ID NO: 1161 - protein, 310 aa, Desulfobacterium autotrophicum HRM2
MENLARHSEILFIWDATMCNPNGDMASDNAPRFDDVDEKAIVSDVRVKRTIRDDLQYRKKKLIYINNEEIVQRGQNAEDRFKQIKDQSDLKEDLPVFLTCIDNRLFGGVAPKSNIQLVGPVQFSWTKSLNKTETVLKPGTGGFATKGKDGEAKYTKTFRADNYIPYGLFAMYGTINRLQAVRANTSEEDVREMLDSLWFGTKLINTRSKQGQKSRLLIRIVYKENSSYFIGLINELVKVRNEESEMIRGLDEIDIDFTNLISAINKADRFIDTVHVVCDDSLQRYRTELEKINSVKIIDEVEFASLGNEN

SEQ ID NO: 1162 - protein, 359 aa, Halorhabdus utahensis DSM 12940
MSEPTQTVENRSEIVFLYDAVDANPNGNPLSGSNRPRIDPQTQQAIVTDVRLKRYLRDQLDDDGHGVYIRNVQEEGTQYTRAELLEDRLKAVDPDDYDLDDDEAAAQFRDDVFGEYLEESADVRYFGATMSVDTDNAYAKHLPDHFTGPVQFSPGKSIHAVNENEEYDSLTSVIATQEGKEQGGFDLDDHRIQYGLIRFHGLVDEHGAADTNLTRADVERLDTLCWRAIKNQTISRSKVGQEPRLYCRVEYGEESYHLGGLDKDLTLDDEASKDHDELRNIRDLTLEIDDFVDRISNASDQIERIRVVASDVLELSHGTDSGGPDLLYDALRTAIGPDRVDVVDVYDEYPETLPQSTGE

SEQ ID NO: 1163 - protein, 351 aa, Halomicrobium mukohataei DSM 12286
MSEHYPTVSNRSEIVFAYDAVDANPNGNPLSGANRPRIDPHTDQAIVTDVRLKRYLRDQLQDDGHGVYIRNVKEDDGDQATREDLLEDRLKDIDLDDVDEADIENAVFGQFLENSADVRYFGATMSIDMDDEKVDHLPDHFTGPVQFSPGKSLHRVMENEEYNSLTSVIATGDDKAQGGFDLDDHRIQYAFIGFHGLVDEHGAEGTLLTDGDVRRLDTLCWRALKNQTISRSKVGQEPRLYLRVEYADESFHLGGLDQDIDLDSSESAPVEEIRNVRDICVDVSALLERLDAASDRIDTVHVVASDVLELSVDGETGGPEFLYDALESRVGSESVREIDVYEDAKATMPEE

SEQ ID NO: 1164 - protein, 291 aa, Methanococcus maripaludis X1
MVNSREFLMVWDSTMANPNGDMLNDNKPRQDESTGQLEVSDVRIKRFIRDEWISNGKNVLVQTKTDKNGKVMTCQGIVKERASENNLKDEEIPNYLLENYIDVRLFGAVITKPKYDITGPLQIAWSKSVHEADVKFMQGNAAYASGEGKEQASIWSKFISPYALFKTYAVYNDKVAEKQGITVSDDDLNDFKDALINGLKNYRSTSKNQMPRLLVEVIYNNNKLDGELNYIDITYENQDLELRDISQVVIDLSKLCEYALEKSESIEKIIIYKHKNVNLINVPENAEENLI

SEQ ID NO: 1165 - protein, 360 aa, Haloarcula hispanica ATCC 33960
MSDTVDPVTNRSEIVFLYDAVDANPNGNPLSGANRPRIDPQTQQAIVTDVRLKRYLRDQLDDDGHGVYIRNVQEDGDQYTRGQLLEDRLEEVDPDDYDLDDDEEVEEFRDDIFGEFLNQSVDVRYFGATMSVDTDEAYAKHLPDHFTGPVQFSPGKSMHAVNENEEYDSLTSVIATQENKQQGGFDLDDHRIQYGLIRFHGLVDEHGAADTNLTAADVERLDTLCWRAIKNQTISRSKVGQEPRLYCRIEYADESFHLGGLDRDLEIDGEHSKPDEELRTVRDLTLDVTDLVDRLDGASDRIKRVRVVASDVLQLSYDGELGGPSILYGALEDAVGADAVEEIDVYDEQTATLPSDDDTA

SEQ ID NO: 1166 - protein, 351 aa, Haloferax mediterranei ATCC 33500
MTVHTDPVENRSEIVFLYDAVDANPNGNPLSGANRPRIDPQTQQAIVTDVRLKRYLRDQLDADGHGVYIRNVQEEGEQYTREKLLEDRLKEVDPDEYDDDGELAGVVFQAFLEESTDVRYFGATMSVDLDGKYGSLPDHFTGPVQFSPGKSMHAVNENEEYDSLTSVIATQTGKEQGGFGLDDHRIQYGLIRFHGLVDEHAAEDTALTAEDVERLDTLCWRAIKNQTISRSKIGQEPRFYLRVEYATESFHLGGLDKDLELDRTDGRTKSDDELRNVRDLTLSVDSLVDRLERSTNRIERVHVTASDVLSVSHGDEVGGPEVLYEALEDRLGTDAVHVIDVYDEHVETLPN

SEQ ID NO: 1167 - protein, 360 aa, Haloarcula hispanica N601; identical to SEQ ID NO: 1165

SEQ ID NO: 1168 - protein, 299 aa, Thermotoga maritima MSB8
MNPVKNRSEVLFIYDVKWANPNGDPLDENRPRFDEETSRLFVTDVRLKRTVRDYLAECYDETLWVTGEAVVPEDRVKELGIKDVNDACQKCIDIRLFGAVIPQSKKGAMESSITGPVQFRYGTSLHRVKLMTIQGTAAFATENSKQRSFREDQVVPYALIAFYGVINQNSAKFTGLTEEDVSKLLEGIWMGTKNLITRSKMEHNPRLLMRVVYKEGVNYHSGELDYLVKVVSEKEDEEIRDISELKLDVTELKQVLESLKDKIERIEYSVDNRLKLAENGEEKPFEEIFGGFQLVKLEW

SEQ ID NO: 1169 - protein, 356 aa, Halorhabdus tiamatea SARL4B
MTANTDIVENRSEIVFLYDAVDANPNGNPLSGADRPRIDPQTQQAIVTDVRLKRYLRDQLDDDGHGVYIRNVQEEGEQYTRADLLEDRLKEIEPDKLNLPEEGDKLRAKVFDEFLDESADVRYFGATMSVDTDNVYAKHLPDHFTGPVQFSPGKTIHAVNENEEYDSLTSVIATQEGKEQGGFDLDDHRIQYGLIRFHGLVDEHGAEDTKLKRDDVKRLDTLCWRAIKNQTISRSKVGQEPRLYCRVEYAEESFHIGGLDKDLELDEDESKPEEELRNVRDVVVSVDDFVDRLGRASEQIEQVRMVASDVLQVSYEGEVGGPELLYGALTDELDEETVDKVDVYDEYQQTLADADE

SEQ ID NO: 1170 - protein, 356 aa, Halorhabdus tiamatea SARL4B; identical to SEQ ID NO: 1169

SEQ ID NO: 1171 - protein, 376 aa, Halorubrum saccharovorum
MSEHAYADDEYEPVENRSEIVFCYDAVDANPNGNPLSGANRPRIDPRTEQAIVTDVRLKRYLRDQLDADGHGVYVRNVKGEGGNQAQRWELLENCLKSLDPDEWDLDDLDEEEAAELREEVFGTFLDDAADVRYFGATMSMDMQGNYEGFEDYLPDHFTGPVQFSPGKTIHSVTENEEYNSLTSVIATGADKEQGGFDLDDHRIQYGFIAFHGLVDEHGSDDTKLTPADVERLDTLCWRAIKNQTISRSKVGQEPRLYLRVEYADEGFHIGGLTRDLAVDESTSEPVDEIRNVRDLTVDLTDLVERLGRHADRIERVRVATSDVLDVAVDGERLAAGAEVGDHGLHDVLRDVVGDDAVSVVDVYDEAAETMPSADD

SEQ ID NO: 1172 - protein, 351 aa, Haloferax mediterranei; identical to SEQ ID NO: 1166

SEQ ID NO: 1173 - protein, 299 aa, Thermotoga; identical to SEQ ID NO: 1168

SEQ ID NO: 1174 - protein, 340 aa, Haloarcula sinaiiensis
MTTLNRSELLFVYDAQDCNPNGNPIGDNRPRRDPDTGKGIITDVRLKRYLRDQLQDDGFDIYVKKIAGESRTRTTLIKDVLGGVSDAEDLEDIEDIGESFLEAATDVRYFGATLSFEASDDEEDEAFREALNSAFPNHYQGPVQFLPAKSLNEVEENEEYDSLTSVISTGEGNRQGGFDLDDKRIKYGIFPFYGLVDNHGAETTNLSAADVERLDTLCWRALKNQTTSRSKLGQEPRLYLRVEYAEDDYHIGGLQNLLDLDGGDNLLRSISDVVLDVSDLLSTLDKNRDRIETIHLIADDRMTLDTGDEAISGDQLATELDSRGLDVHEIDVVDERDLAR

SEQ ID NO: 1175 - protein, 359 aa, Haloferax denitrificans
MSDTNDAVTNRSEIVFLYDAVDANPNGNPLSGSNRPRIDPQTQQAIVTDVRLKRYLRDQLDDDGHGVYIRNVQREGNQYTRGELLEDRLKDVEPDEYDLDDGEESERFRNDVFGEFLDNSVDVRYFGATMSVDTDDVYAKHLPDHFTGPVQFSPGKSVHAVNENEEYDSLTSVIATQENKQQGGFDLDDHRIQYGLIRFHGLVDEHGAADTNLTTGDVERLDTLCWRAIKNQTISRSKIGQEPRLYCRVEYADESFHLGGLDRDLVLDDDRSKPDKELRTVRDLTLEIDGFVDRLAAASARINRIRIVASDVLDISYDGDVGSSELLYGALREAVGDDAVEVVDVYEEHAETLPAGDAA

SEQ ID NO: 1176 - protein, 359 aa, Haloarcula argentinensis
MSDTADPVTNRSEIVFLYDAVDANPNGNPLSGANRPRIDPQTQQAIVTDVRLKRYLRDQLDDDGHGVYIRNVQEDGDQYTRGKLLEDRLKAVEPDDYDLDDDEEVEEFRDYIFGEFLNESVDVRYFGATMSVDTDEVYAKHLPDHFTGPVQFSPGKSMHAVNENEEYDSLTSVIATQENKQQGGFDLDDHRIQYGLIRFHGLVDEHGAADTNLTAADVERLDTLCWRAIKNQTISRSKVGQEPRLYCRVEYADESFHLGGLDRDLELDDEHSKPDEELRTVRDLTLDVTGLVDRLDGASDRIERVRVVASDVLQISYDGELGGPAVLHDALKDAVGADAVEEIDVYDEQTATLPNDDTA

SEQ ID NO: 1177 - protein, 349 aa, Natrialba chahannaoensis
MADTTATNGNEVTNRSEIVFLYDAEDANPNGNPLSANDRPRIDENTQQAVVTDVRLKRFIRDQLHDDGLGVYIRNPAKEGEQGRTRDDLFLDLLEVTQDELKEMEAEEIFDTFLAKATDVRYFGATLSFDDTVQKALEDAEISTPQYTGPLQFSHGRSMHEVVENSESKKLSVTIQNDADDEQGTFAEDNRLQYALINFHGILNEVNGSMTGLSQTDVERLDTVIWRSLKNQTLTRSKMGHQPRLYLRVEFDSGYHEGDLDDLLSIDADESASPREMRDISDVTIQIDDLVARLASQSVSDRINTIRAHANRYVSVSYDGEIGGPDLLYSALEEVGDVQVIDPYEQNEN

SEQ ID NO: 1178 - protein, 342 aa, Haloarcula californiae
MTDTNDATIQNRSEIAFVIDAKDTNPNGDPLTADNEPRIDPVTGQCVVTDVRLKRYLRDQLVEDDHVVLIANPNDEVLTRKEMYDAVESEMGVSTDEAEPEELLEAFVKTAADVRYFGATISLDTDLAEDLPNQFEGPVQFNHGRSYHEVARNTESKQLATVIANEDDDGGKKDQGTFATDNRISYGVIGFGGRINDNAAKDTHLTEDDVERLDTLCWRALKNQTVTRSKAGQQPRLYIRVEYKQDGFEIGRLNDRIGVDSDLPEDEIRGTDDFNLDVSELVTTLADNDARIDTVHITADSAVTFALPDGETGDREALYTVLNDILGAEAVDAYDVYERYVN

SEQ ID NO: 1179 - protein, 348 aa, Haladaptatus paucihalophilus
MTNETTTVENRSEIVFLYDAVDANPNGNPLSGANRPRIDPQTRQAIVTDVRLKRYLRDQLDDDGHGVYIRNVHEDGQQATREDLLEDRLKEVDLDETPDENLADEVFGEFLANSSDVRYFGATMSVDTDDKYAQHLPNHFTGPVQFSPGKSMHAVNENEEYDSLTSVIATQDEKAQGGFDLDDHRIQYGLIRFHGLVDEHGAEDTNLTTEDVERLDTLCWRAIKNQTISRSKVGQEPRLYIRVEYDTDSFHLGGLDKDLELDSDRTKPDDELRNVRDLTLSVDSLVSRLETNANRIESVHVVVSDVLPISYGDEVGDAELLYEALEDALGAESVRVVDVYEEHLATLP

SEQ ID NO: 1180 - protein, 356 aa, Natronorubrum sulfidifaciens
MSDNTETVQNRSEIVFLYDAVDANPNGNPLSGSNRPRIDPQTQQAIVTDVRLKRYLRDQLDDDGHGVYIRNVQEDGNQYTRGELLEDRLKAVDYGKYDLDEEADQFRDDVFGEFLENSVDVRYFGATMSVDTDEVYAKHLPDHFTGPVQFSPGKSIHAVNENEEYDSLTSVIATQENKQQGGFDLDDHRIQYGMIRFHGLVDEHGAEDTKLTTDDVERLDTLCWRAIKNQTISRSKVGQEPRLYCRVEYAEESFHLGGLDRDLELDDERSKPDEELRTVRDLTLEVDGFIRRLENASEQVDKVRVVVSDVLEVSYDDDVGGPEILYNALREALGSEAVEVVDVYDEHTATLPNAAE

SEQ ID NO: 1181 - protein, 351 aa, Haloferax mucosum
MSEHSDHVENRSEIVFLYDAVDANPNGNPLSGANRPRIDPQTNQAIVTDVRLKRYLRDQLDADGHGVYIRNVQEEGNRYTREKLLENRLKEVDPDEYDDDEELSEAVYRTFLEESVDVRYFGATMSVDLDDRYGSLPDHFTGPVQFSPGKSMHSVNENEEYDSLTSVIATQDDKQQGGFDLDDHRIQYGLIRFHGLVDEHAAADTNLTTEDVERLDTLCWRAIKNQTISRSKVGQEPRLYLRVEYATDSFHLGGLDKDLDLDRKDGRTKPDDQLRTVRDLTLSVDSLVARLEKSANRIERVHVAASDVLSVSHDDDVGGPEVLYDALADRLGTDAVHTIDVYDEHTTALPN

SEQ ID NO: 1182 - protein, 351 aa, Haloferax elongans
MTEDLDTVENRSEIVFLYDAVDANPNGNPLSGANRPRIDPQTQQAIVTDVRLKRYLRDQLDADGHGVYIRNVQEEGEQYTRERLLKDRLKAVDPDDYDDNDELSEAVFRTFLEESADVRYFGATMSVDMDDSYGSLPDHFTGPVQFSPGKSMHAVNENEEYDSLTSVIATQEGKEQGGFGLDDHRIQYGLIRFHGLVDEHAAEDTMLTTEDVERLDTLCWRALKNQTISRSKVGQEPRLYLRVEYADDSFHLGGLDKDLELDQNDGRTKPPEELRNIRDLTLAVDTLVDRLEQNASRIEQVHVATSDVLSVSSNGDVGGPEVLIGALEAALGANAVHVIDVYDDHVETLPN

SEQ ID NO: 1183 - protein, 356 aa, Halorhabdus tiamatea; identical to SEQ ID NO: 1169

SEQ ID NO: 1184 - protein, 359 aa, Haloferax sp.
MSDTNDAVTNRSEIVFLYDAVDANPNGNPLSGSNRPRIDPQTQQAIVTDVRLKRYLRDQLDDDGHGVYIRNVQREGNQYTRGKLLEDRLKDVEPDEYDLDDGDEAERFRNDVFGGFLDNSVDVRYFGATMSVDTDDVYAKHLPDHFTGPVQFSPGKSMHAVNENEEYDSLTSVIATQDNKQQGGFDLDDHRIQYGLIRFHGLVDEHGAADTNLTVGDVERLDTLCWRAIKNQTISRSKVGQEPRLYCRVEYADESFHLGGLDRDLVLDDDRSKPDEELRTVRDLTLEIDGFIDRLAAASARINRIRIVASDILDISYDGDVGSSELLYGALREAVGDDAVEVVDVYEEHTETLPTGDAA

SEQ ID NO: 1185 - protein, 291 aa, Methanosarcina mazei
MANTREYLLVWDSTMANPNGDMLNDNKPRHDEITGQLEVSDVRIKRFVRDEWQSRGHNVLVRTKKGDDGKVMSCTALIKEVMEKAKVKEAELPSHLLNEYIDVRLFGAVITKPKYDITGPLQVMWSKSVNPAEIKFMQGNSAYAGGEGKSQSTIWSKYISPYAIFKTYAVYNDNAAKRQGIETSEKDLNEFTAALINGLINYRSTSKNQMPRLLVEVIYKEHRIDGELNYVDVNFDTEAEEVRDISQVTLDLEKLCKYYDCKKESIDTVRIYKHGSVKVNNLPDDFKVIDF

SEQ ID NO: 1186 - protein, 357 aa, Haloarcula
MTDTTDIAQHRSEIVFLYDAVDANPNGNPLSSANRPRIDPQTQQAIVTDVRLKRYLRDQLDDDGHGVYIRNVQEEGEQYTRADLLEDRLKSVDYDSYDLDDDEEAEQFREDVFGEYLRKSADVRYFGATMSVDTDDVYAKHLPDHFTGPVQFSPGKTMHAVNENEEYDSLTSVIATQEGKEQGGFDLDDHRIQYGLIRFHGLVDEHGAADTRLTQEDVERLDTLCWRAIKNQTISRSKVGQEPRLYCRVEYADESFHLGGLDKDLRLDEEASKDDEDLRNVRDLAVEIDDFVDRLDGAGAQVERIRVVASDVLQFTHEGEPGGPELLYNALRDAVGADRVEIIDVYDEHLETLPAAE

SEQ ID NO: 1187 - protein, 291 aa, Methanococcus vannielii; identical to SEQ ID NO: 1159

SEQ ID NO: 1188 - protein, 299 aa, Thermotoga sp. RQ2; identical to SEQ ID NO: 1160

SEQ ID NO: 1189 - protein, 340 aa, Halorubrum lacusprofundi
MTLNRSEILFIYDAQDCNPNGNPIGDNRPRRDPDTGQGIITDVRLKRYLRDQLLDDGFDIYVKKLDGDARPRTTLALDVLEDIDDVDDIEEIEDVGERFLAAATDVRYFGATMSFESSDDEEDEKLRQALGSALPNQYQGPVQFLPAKSLNEVEDNEEYDSLTSVISTGDGNRQGGFDLDDKRIKYGIFPFWGLVDNHGAESTNLSETDVKRLDSLCWRALKNQTTSRSKLGQEPRLYVRPEYKPDNYHIGGLHNHVTLSDENDKPLRSINDVVLDVSNLVTALDRAEDRIETVHVVGSDYLTLTTGDKTIPASEFGDHLESEGHSVHQIDVLEERDFAE

SEQ ID NO: 1190 - protein, 310 aa, Desulfobacterium autotrophicum; identical to SEQ ID NO: 1161

SEQ ID NO: 1191 - protein, 291 aa, Methanococcus maripaludis; identical to SEQ ID NO: 1164

SEQ ID NO: 1192 - protein, 360 aa, Haloarcula; identical to SEQ ID NO: 1165

SEQ ID NO: 1193 - protein, 351 aa, Halomicrobium mukohataei; identical to SEQ ID NO: 1163

SEQ ID NO: 1194 - protein, 359 aa, Halorhabdus utahensis; identical to SEQ ID NO: 1162

SEQ ID NO: 1195 - protein, 351 aa, Halomicrobium katesii
MSEHYPTVSNRSEIVFAYDAVDANPNGNPLSGANRPRIDPHTDQAIVTDVRLKRYLRDQLQDDGHGVYIRNVTEDDGDQATREDLLEDRLKDIDLDDVDEADIENAVFGQFLENSADVRYFGATMSIDMDDEKVDHLPDHFTGPVQFSPGKSLHRVMENEEYNSLTSVIATDDDKAQGGFDLDDHRIQYAFIGFHGLVDEHGAEGTLLTDRDVRRLDTLCWRALKNQTISRSKVGQEPRLYLRVEYADESFHLGGLDQDIDLDSSESAPVEEIRNVRDVCIDVTSLVNRLDGASDRIDTVHVVASDVLELSVDGETGGPEFLYDALESRVGSESVREIDVYEDAKATMPEE

SEQ ID NO: 1196 - protein, 355 aa, Halarchaeum acidiphilum
MTAPTDPVQHRSEIVFCYDAVDANPNGNPLSGSNRPRIDPQTQQAIVTDVRLKRYLRDQLDDDGHGVYIRNVQEEGEQYTREQLLEDRLKDVEPDDYEEDTELADAVFGEFLDESADVRYFGATMSVDLDDEYGDLPDHFTGPVQFSPGKSMHAVNENEEYDSLTSVIATQEGKEQGGFDLDDHRIQYGLIRFHGLVDEHGGTDTNLTTADVERLDTLCWRALKNQTISRSKVGQEPRLYCRVEYADESFHLGGLDRDLALDEAESKAAEELRDVRDLAVAVDDFVERLDRAAADDRIERVRVVASDVLSVSHGDEVGGPDVLYDALRDTVGEDAVDVIDVYDEYVETLATDDAA

SEQ ID NO: 1197 - protein, 291 aa, Methanococcus vannielii SB; identical to SEQ ID NO: 1159

SEQ ID NO: 1198 - protein, 299 aa, Thermotoga sp. RQ2; identical to SEQ ID NO: 1160

SEQ ID NO: 1199 - protein, 338 aa, Thermotoga neapolitana DSM 4359
MSNPKAITATIVFESSAVNRDENIANNIQSLKKLRREDGVYTFFSRASMRHHVFNALVRKHGWKPARVAKDGDVIQFDVLEESILTSEELDFFGYMRTFESASLSRKAPVGMTKAVSLEKWEGDMAFYANHDLVQRAREIGESADPNPFSKEEHLSLYKYSVVVDLENIGKEKVIINEKQCEKLNRLFGIDLKELKEKESIANDKGTISLESVGEKSYRILVTLNDPEKQKRLKQFFDIIINGFEIHSSTESWCVSPVFIVIATTRLPVTLFNPYIKLDDGKIDVDLVAKIAEENTNVIDYRIWGVPFILKGEVDKLCKGPKDLNDWVTGVIGGKENS

SEQ ID NO: 1200 - protein, 310 aa, Desulfobacterium autotrophicum HRM2; identical to SEQ ID NO: 1161

SEQ ID NO: 1201 - protein, 359 aa, Halorhabdus utahensis DSM 12940; identical to SEQ ID NO: 1162

SEQ ID NO: 1202 - protein, 351 aa, Halomicrobium mukohataei DSM 12286; identical to SEQ ID NO: 1163

SEQ ID NO: 1203 - protein, 340 aa, Haloferax volcanii DS2; identical to SEQ ID NO: 23

SEQ ID NO: 1204 - protein, 291 aa, Methanococcus maripaludis X1; identical to SEQ ID NO: 1164

SEQ ID NO: 1205 - protein, 360 aa, Haloarcula hispanica ATCC 33960; identical to SEQ ID NO: 1165

SEQ ID NO: 1206 - protein, 351 aa, Haloferax mediterranei ATCC 33500; identical to SEQ ID NO: 1166

SEQ ID NO: 1207 - protein, 356 aa, Halorhabdus tiamatea SARL4B; identical to SEQ ID NO: 1169

SEQ ID NO: 1208 - protein, 360 aa, Haloarcula hispanica N601; identical to SEQ ID NO: 1165

SEQ ID NO: 1209 - protein, 299 aa, Thermotoga maritima MSB8; identical to SEQ ID NO: 1168

SEQ ID NO: 1210 - protein, 269 aa, Methanothermobacter thermautotrophicus str. Delta H
METLAVEIFQPFAQFRNPFTFDYAQTYPLSPKSTVTGMLQNATGRYYDQDISEISVSIHGLFESTFWNYQSFIVGDIALKYHHNKLKLWNKGYPLYSVNKKSQRSPSYQQELFNGHYYIFLRGDDDIIEEVCDSLRKPTKPLSLGRSEDIIFIRGIHRDFEVIEREVKKNLWMTYPTYIKLSNGKTHFPIRNERFPVYSIPERVIFRNGESIISNKAEIGESTERIPTFQTVIYTGMNQVIFLNDTVRTEIYKLEDGSTFKIPADFGWL

SEQ ID NO: 1211 - protein, 219 aa, Aquifex aeolicus VF5
MECLKAEFFSPIALFKTPFSIKGIETYPLPPYSTVIGLLYTASGKKWKGERFNISVQGDYEAIFRDYVRFRKYNKKDKKLETLPLEVPLFYNFRLTVHILGDENLLKEFEKALKFPYVFPYLSGGEYPVKITKVKMVACRKEYFDTFNIPKNAYIPENIFTEEFRVSLEGHGVYYRVPSFLISQKPRQHEWVGVYYVQKGTKVSEMELLVDEEGEPVWV

SEQ ID NO: 1212 - protein, 220 aa, Thermotoga maritima MSB8
MKVLVFDVSAPYALFRRPYTTTSSYTLPFPPRTTLLGLVGCVLGYSTPERLDSAKVAVQIKNPLKFLRTGTNFVETKKDKKASKRTRISLQLLKNPAYRVFFSWEDEDFERLKNLLEHSETIFTPYLGVASFIARLNYVGKYEATRVADFPCEVHTVVPNTVKLLPEPSHYLIFERVTRKMDKERNMLESAVYIFKRDLSPVKVEGGEVWRVGEQNIVWM

SEQ ID NO: 1213 - protein, 232 aa, Methanosarcina mazei Go1
MDCLVFRAKSGYAKFRKPYTTTSALTFLCIHPPAVKGLIGAVLGIDKTEIYRNTLDLKIGIQVLSPVRKDMQVLKLVSMKAEKDLFNFPVNAEFLRDPEYRIFVSWLPDKLDELEDRLQNQMPIFTPYLGVSEYIAKLDYEKRVNAELLTKSSSIDSLVPSRFIDLQHSDYHIFTDNIPVSNNEKREYISYEKILFAFREDDTCKKEIACSLMGNLKRDVYKVDENIVFFFE

SEQ ID NO: 1214 - protein, 256 aa, Clostridium tetani E88
MDALKFSLSGRTAFFKKPDVNSFFYFTYGNVHKVALLGILGAICGYGGYNSQCLNKEQIYPEFYEKLKDINIGVVPKNEKGYIDKKIQVFNNSVGYASKELGGNLIVKEQWLENPKWAIYILMDENVPKDLKDRLLNFKFKYIPYLGKNDHMANITDVEYLENIEKLDNTNKLDSIFIKDKYEIQKESKNFNDLKNIIKKSSSKIQEFKYEEMLPISLEETTNKYNLETFIYTNSNLKPLADTKTYKCGDKNIFFF

SEQ ID NO: 1215 - protein, 234 aa, Nanoarchaeum equitans Kin4-M
MKALAFRISFFEHLFKNHYTKAFKLSYPTLLPTEALGLIGNICGYDRKNVYKELKDLYFGSTFLDGYYIEENITFIQFKKETGGKYRSGIVKSQVYHNSEHLVIIAGDEKKLNEKILNKIKTLNSDPIENNLGKWLLVKPIRYPYGGWNDFFAKDIRILDKFLEVEEKENVRGYVPLDWVKSINENSEIETMPVKYKNKMEYFVFIKRGYALLKEKVKTVLDIPIYSLEDFNYL

SEQ ID NO: 1216 - protein, 265 aa, Haloarcula marismortui ATCC 43049
MSQESLDEWSETDSDWSPERCLSLTVRGPWGHFRRVEGNVVKQTYRVMPRTTVAGLIAAVLGIERDGYYDLFAPGRSAIAIEPVRGLRTLNMPVNALSTAADNLKSLNSRGKLSVKLPDPMDLRQQHNYEVLVDPAYRIDVALADSETYRELRQTLEAGRSHYVPSLGLSEHLANISFHGEFTIEEGPDDTVVSVDSTLPNAVDDVVLDSDTRCGIEESPAFMTTDAGGRTTTAFTTYAYNPDAEPLRVRNMQPSRVDGRTVVFV

SEQ ID NO: 1217 - protein, 248 aa, Carboxydothermus hydrogenoformans Z-2901
MRKVIVFEIRGPAAHFRKFYTNSSSLSYAFPARTTLAGIIAAVLGLPKDSYYSLLTGNKAHYALRLMTPVRKIMQTVKFVRTKTLKEVNGSGGPTMIPTEIILPVRGRELIYRVYFYHDDPSFQEELAKQLALGPKFPVYLGRSEFLAKIDFLGVFPGTALETNFVDTVVNLELLKDEELLFSTLHGEDLRYLKEKMPFSFNPDRSIASTASVVYEIGGKKVGGKFSVPAIKIDSLGDVILFLEPGVI

SEQ ID NO: 1218 - protein, 264 aa, Methanococcoides burtonii DSM 6242
MAASKLIQANTMDTTIESFSSFEENIAQSEKLLTFRLYGSFAHFNQPISNRFRNTYSIIPKPQLLGLIGSIVGLSGYKNAAVSPEFYSKLSDLKVFIKCNSLSEKKFTLSYNSLNSFLNNRIDSGSPNVIIKEQVLLDPDYEVGIVVNENNPLHLEIIDKIRMNCGVFPIYFGKNEFFANVQFGHLKDFEYDNSESNKCCSIFPFEEVESVNTRNMKLELLPVDFDDMFKYIYRLMAIPSEKCNVSLKNSDNYIASEGSVYYVF

SEQ ID NO: 1219 - protein, 258 aa, Rubrobacter xylanophilus DSM 9941
MGQNPLLIFDLCGAYGMFRKFYTNSSSLSYPFPPRTTLAGLIAGMMGCERDSYAEDLSLERCQIAVSVITPVRRVMQQVNYVMTEGHVWTKNTGGFDGSSGPIQVPVEWVFPEVGHRELRYRVYATHEDRGWLKRLAEILEGGVPIYPPYLGMSECPGRVEHVATLEGWGLGHREDELPVRTVLPSEAVSGPPRLEEGVQIVKERIPLALDERRRLIAAADVLYNRAGPHITARLRAPVFEAAYPGAEGGREFGVFLR

SEQ ID NO: 1220 - protein, 246 aa, Syntrophomonas wolfei subsp. wolfei str. Goettingen G311
MKSLRFTLSGPLACFRQPDVNAKVYFTYNNIHKVALLGLLGAVIGLSGYRNADLYGQGEKLYPEFYEVLSPLLVSVVPNVKNGYFSKKIQYFNNSVGYASKEEGGNLQVREQWLENPNWTVFLAQHKLDASIWDKLCDYMLRGQCVYIPYLGRNDFPAQISDVCLVELSVSKSLRIDSLFLYSGDLNTLDGGDPSQYLFVETAPTSLVPKHNFYEFGRYIFTNCTLPEDELPPYLYSDGVRQYSFY

SEQ ID NO: 1221 - protein, 231 aa, Syntrophomonas wolfei subsp. wolfei str. Goettingen G311
MALFRKPYTTTSMVSYPFPPPTAIAGLIAGIIGINHEASQDAKNARYWEKMREVQVAIALLSPIRWINTAVNLMKYKNSNADMSEHIQVKHQLVKKPRYRIYVQGGEIYKILKQRLEREEFIYTPCLGAAYALADIKYHGEYEPAEAEMDSGFNTIVPGYEGLELDIVRSGAVFSEQIPVQMTVTRCLSHTVQVYYAQPGKAGSPLLYLRNQGALQSNMINGEKVAWFNAW

SEQ ID NO: 1222 - protein, 190 aa, Lactobacillus gasseri ATCC 33323 = JCM 1131
MIILAKKRALDRSKVIDQAIAIISDKGLSELTMPALAKALGIRSQSLYHYVANRNDLLVLVCVNRLQVLRQYLMKKVIGHSGLDALFRFADEIRDFLLHDKAISGIYCGLNEYVQNEQIHEEVMKIVELGEKLDVDNKNIVSLHSLLGAVLGYVFLDRYVIDETEKEADDNYHEMLLRLVAPKLQVEGTK

SEQ ID NO: 1223 - protein, 233 aa, Methanothrix thermoacetophila PT
MRDSVLVFDVWGDYAHFRKIYTTSSPLTYSFPPRTAISGIIGAIAGLSKESYFRYFSRDKASIGCRILEPVKKVRVGENLIDTKRSMHRIHNRTQVRFEFLKDPRFRIYLSHSDDRFSRDLRDMLEDHRCVYTPCLGLSQLVCNFKFVGELGLRRCGDGLQEINSVVPLKSLLESPEFEEGREYFSEIMPCVIGEGREVTDYSEVLYERNGGSIRARTRDAWELDNGERVVFI

SEQ ID NO: 1224 - protein, 237 aa, Hungateiclostridium thermocellum ATCC 27405
MVEKYLVFDISASYGHFKKPYTTTSPLTYSIPTRTAVSGIIAAVLGFGKEDYQEHFTKPQAKIAIGIRNPVKKVRISENLINTKKSMNIIHERTQIKIEFLKDACYRIYFTHTDKQIYERLKESLKEHRTVYTISMGLSENLANYTFTGEFDGREVKGNKEIVEFSSVVPLDILKKGDIEFEDDREYFTETIPVEMDAERNINEYREVLFERNGCKVRARVDSYIKIEGIDENILII

SEQ ID NO: 1225 - protein, 233 aa, Methanococcus maripaludis C5
MDVDKILEFELYGKFAHFKKFYSNASSLTYSVPPRTVLMGIVASVLEEKRDSYYNWLSKDNAGFGIQILSESRKGMYNTNYIGKNGTSPTSVEIVMPVNHNVRYMVYFYSTDQEKYELFKKRLIDENWGYGLYFGQRQFRAFAKFHKEYVGAEIVRKNDFDGLVSTCISENNIIDINFEKEKQLLRERMPIDFNGSRESSNKSEIIYEKSGKPISGKFKEVFGISNKNICFLE

SEQ ID NO: 1226 - protein, 250 aa, Caldicellulosiruptor saccharolyticus DSM 8903
MKFLVFDLKGKFAHFRKFYTNSSSLSYLVPPRTVIEGMVAAILGFERDSYYGVLSAENLLVAVQKIERTYKIVQTVNYIKATTVNELKNPNTHTQVPLEILAGYNGFVGFRVFVMPKDEEIYSLLRARLESGKSEFPIYFGSAPFAAKTEFLGEFEACRWEDSRAGILTVLDAGLIKSLSLELESTSSLALMKDRMPCDFDKDRFATKVKTYIHDENLNPIWVDLDSSAQDKVYYIKEFSGDRKECICVM

SEQ ID NO: 1227 - protein, 275 aa, Caldicellulosiruptor saccharolyticus DSM 8903
MKETKNSIYALKIKIYQPQAHFRIPFSYQRRHTYPIPPYSTVLGLIANILGIKNLPGQEEPCVKDNCNCLYHKLKQIKIGVCGNFETKVEEYFWLRNLKAESHIGRFGSITNRYVGGHIEHIGGQMPCIVDVLHNARILIYLYHCDKEFLEVIKSSFENPVNKTSVMHLGRAEDWIVIEDISYVNLIIDKINGNYKNFFWVPEKVFGFDGNFDFKKVNGLAYNMTSFYKIQNGVRNFRCIKAKLNNGDFGDIVAYFDTEDNIPVFLADFEEDKDE

SEQ ID NO: 1228 - protein, 253 aa, Thermosipho melanesiensis BI429
MKAFSFELKGDMGFFKKNDTNATVYATYNFIHKLNLFGIFGAILGLEGYKRDKSGNFMEYYEKFKNFKVAITPLYNKPPKKTLVIFNNSTGHASREAGGVLQIKEQVIVESIGYRIFIPCLETFTDEEKNVYEKLEKMVKKNYSEYPIYFGKNEFLAYFENYCSIELERLEFEESTVNSLVRLKDIEFFKENLDDIELFEEETDYISILEELPYDFNENHLYLKDVFVFTNKKLRLKRKENFWRTNNEVIYVF

SEQ ID NO: 1229 - protein, 225 aa, Methanococcus vannielii SB
MKSVVFSAKSEYGRFRKPYTTTSALTFLCIHPVAAKGLIGALVGIDKLDLYEETKDLKIGIEVLGEINKDLQSVKLLNLKEGVSGGMFHFPSNIEFLRCPHYRFYVMWNENKLNELNDKLNVGEWEFTPYLGVSESIAKMNYEGMFEVSKVEKADFVNTIIPTKNILPKINLNTKMYSDKIPVKNNSNREYIEYEKIVFAEKNPLFGKISNTDIYQVGERNVYFF

SEQ ID NO: 1230 - protein, 256 aa, Methanococcus aeolicus Nankai-3
MKMIVFDIWGDYGHFKKIYTTTSPLSYDFPPKTSIYGMLGAFLGLDKEDYLKHINKDTVKIALKIKNPIQKTNIALNLIDTKRDKIKKSNISLDNKSIKSIKIYNVNLIPNRTQIRFEMLKNPKYRLYVHLTDEKLYSKLKKLLEQHKTVYTISLGLSELLANFEYMGEFEFEKKVSDDEYTTINSLIRRDNIINDDINLELNKEYLFSKIPNEMDENRLTTEYIDIFYERNGESINCKVKEYYHIPELKENITLI

SEQ ID NO: 1231 - protein, 232 aa, Bacillus cytotoxicus NVH 391-98
MKVIRLKLFQETACYTKPFANKVAETYPLPPYSTVKGMIHQLLQANELLPLRFSIQGNYETKLIDYRKSYMVKKKSVSMPIIFDGLAMEVPEQEHMTSMPLYTHMLFNVELVIHIAGEEALLERIYQHFIELNQHLSLGRHEDLVRVDEVTFVELEECDEWYSKYAIYVPKYYYKTDFPAGIPYRLNWTYKIVNGIREWNKIPSLYVNGNNPHFEDGKLFHTDGEHIVLWNE

SEQ ID NO: 1232 - protein, 237 aa, Campylobacter hominis ATCC BAA-381
MKALSFKLSGKFAFFKKPDVNEHVYFSYNNIPKPTLLGLLGAIIGLGGYAKECELGNRNNPEFYEKLKYLKIALIPLAKFGRFNKKIQTFNNGVGANQDGNLIIKEQWLENPAWQILIKDDKSDEFSKISKFLMEKKAIFIPYLGKNDHFASISEVKIVNLDEFKEKKGEIISLVLEKNVKNPGRNPSKDSFIFSEYYPIGFDENGFYTLEKTIFTNQTYEIGDGFYKYKESAICFL

SEQ ID NO: 1233 - protein, 230 aa, Pseudothermotoga lettingae TMO
MKVIVFDVKGKYALFRRNYTTSSSTSYNFPPRTSICGLLGAIMGIQNEATQFSKHLRIFDNAHIALRVLVPIRKTTMGVNYAETKSGKNQRTQIILELIKEPVYRIYVSEFSQFDQLRNHLENNTCVFTPYLGQAQFIAKISHVGVFEAKSVFPPVVVHSVLKITDGIRIQPQENSILLREQMVLNMDDERHPVAFASYWVEKNARPLEVIKHPNIFRIEELDENICWMD

SEQ ID NO: 1234 - protein, 242 aa, Petrotoga mobilis SJ95
MALVFDITGEYAMFRKFYTTTSSASYPFPPPTAVGGLIAAIIGVENKSENKAHLASYWEALYGNRISISIRSPIKWFTTSINLWNYKDPKKGIHNIIKHQFVKRPKYRIYVEGPIEEKLKPFLEQGNFVFTPYLGTAYSFANIDYIGSFNPVKINDGEVNIKSIIPADIKPKINLKKTKGIFKDIVPLQMDEERGLTKSLSVFYPVNSDTGIIVDNPEEIGGVLVGNDEIVWLPEWSRKPSG

SEQ ID NO: 1235 - protein, 237 aa, Thermoanaerobacter pseudethanolicus ATCC 33223
MKTLVFDVFGDYGHFRKYYTTSSPLTFSFPPPPTVKGMLGAIAGIDKKEYLKVFSEENCKVAIRILNPIKKIRLGLNLINTKGNYWIPYKAKNHEARTQVKTEFVKDAAYRIYFMHKDNDLFEDIVEKIKNRRNVYTLSLGLSEMIADYKFIGVYEAEEIENAEVDILSVLPFQSIVEDKIYFENGKKYFKEKIPAGMNEDRVVLSYEDVLYEVNGQSIKCHVKKCWEVKGEHVIFF

SEQ ID NO: 1236 - protein, 220 aa, Thermotoga sp. RQ2
MKVLVFDVSTSYALFRRPYTTTSSYTLPFPPRTALLGLVGCVLGYSTPEKLDSAKVAVQIKNPLKFLRTGTNFVETKKDKKASKRTRISLQLLKNPAYRVFFSWEDKDFERLKNLLEHNETIFTPYLGVASFIAKLDYVGEYEATRVEDFPCEVHTVVPNTIKIVPEPSHYLVFERVTRRMDKERNLLESAVYIFKRDLSPVKVEGGEVWRVGDQNVVWM

SEQ ID NO: 1237 - protein, 250 aa, Dictyoglomus thermophilum H-6-12
MKVIVFDLLGKMAHFRKFYTNSSSLSYHFPPRTTIVGLIAGLLGYERDTYYEIFSTDKAKITIGVKSPLRKILQVVNYVWAENVKQLNQSRGQHTQIPLEIIFPQDMKEDICYRIFFHHKDEKIMEDLKNKLVNFDFCFPPYLGITEFVGKVDFIGEGMAEISRADKVLIDSVVSVDYIKKNSLILEPQVGAQYVKEKMPLSFNKDRLLEDPPKEFIGEIKIGKISLKGNVEYYKVEVRDLVQNVIFMED

SEQ ID NO: 1238 - protein, 233 aa, Anoxybacillus flavithermus WK1
MKALRLKLFQETACYKKPFASKVAETYPLPPYSTVKGMIHALLNADQFIPMRLSVQGTYEEKLLDYQRYYFFKKKELSSFPLVLDGLARMEFSYDKNEITTMPMYTHLLHNVHLLIHIEAEQHILKQIIHAIEYSMTHYSLGRWEDLVRIDEYKLVDVQELEEEKTLQWNAYIPSNFLDRETKSIPYQLNWKYEIVNGIRQWEKINVGYVQKEIEAPEGVWIDEDGELVFYHL

SEQ ID NO: 1239 - protein, 236 aa, Thermosipho africanus TCF52B
MEFLVFDIKGKFAHFRKFYTNSSSLSYSIPPRTTLEGIIAAILGFERDSYYEILNAEKLNIGLKKVTPTRKIIQTLNYIKAKNPGDVYDPDEHTQIPFEIITSNDKVIYKVYVNHIDQRIMEFLEYRLKNNKFYFIPYFGVASFNVSIEFKGKFQVEPKFSEDFVKVSSVIRRSLISSLKVEEEIILLKEKMPRDFSKERTVIEMEDYIFEESGKAIEVKLNSHYYVINEENIVLM

SEQ ID NO: 1240 - protein, 257 aa, Thermosipho africanus TCF52B
MKAFCFNIKADMGFFKKNDSNARVFTTYNFIHKPAVLGIFGAILGYSGYDRDRKNNGIEYYEKLKNFKIAIKPLYKKPLKKTVVVFNNSSGLASEETGGVLQAKEQVIVESLGYTIFVPFFETFSEAEKKIYEKLEYMVKNKYAEYPIYFGKNEFFAYFENYRSLNVEELERKEAVVDSLVKMKDVDFFGKTDEEEFDLFEEHKEEQKITLIEELPYELDENYMYVKDLFIFTDKELKIKNNEGFWRTIDDEIIYVF

SEQ ID NO: 1241 - protein, 238 aa, Dictyoglomus turgidum DSM 6724
MKVLVFDIFGDLAHFRRFYTTSSPLSFSFPPPPTILGMIGAIAGIDRKKYLEVLCPENCKISLQIMNPIKKIRLGLNLINTKDNFWQPVKTKNHNARTQVKTEFIKDPRYRVYFYHKDENIFEDVINKIKNHETFFTFSLGLSELIGDFQFIKVAEFIEIKEKEEVYIHSLLPMSYISESKIIFEEGKSYFRERIPVIMNKERVVEKYEDVIYESNGKPIKAFVNSYYKGENLNVIFF

SEQ ID NO: 1242 - protein, 231 aa, Desulfitobacterium hafniense DCB-2
MKGLAFDVLGTVGHFRRPDTTATQLTYPFITPTAAKGLVGAILGIEDFVTTDRVGIELLRPVRTVAQQMSMLGKDPGSTFNRPTTIELLVNPGYRIYYTGEEYTEQLLDFLTGERAVYTTYLGTAYALTKPILYKVYPEVSYPVAEGKEIEMRTVVPTALIREIVLKADRYYCRAGGYLYEYKGQRTFEKSVDFLYEKDGKPIAFIPKSDGPDSPLDLRVAQFGEDLVCLV

SEQ ID NO: 1243 - protein, 238 aa, Halothermothrix orenii H 168
MDINQVLVFKIKGKIAHFKKYYSNKSSLTYKIPPRTVLMGIVASILEKPRDSYYELLSPQQAKFGVKIESESYTHFECMNYLKEDGGHTQVRLQLLLPANNMLSYKVFFTHQDESLLKELATKIKNKIYGYGIYLGQRQFRATAEFDDLIEDIDIIKDYTGNLKTLTYKDNIKKLNDTTTYNLILDNMPVSFKKVNSGREPEKVVEVCYEENGANINGSFYEVIKLKDDYISFYTPVR

SEQ ID NO: 1244 - protein, 260 aa, Thermotoga neapolitana DSM 4359; identical to SEQ ID NO: 26

SEQ ID NO: 1245 - protein, 250 aa, Caldicellulosiruptor bescii DSM 6725
MKFLVFDLKGKFAHFRKFYTNSSSLSYLVPPRTVIEGMVAAILGFERDSYYDMFSAENLLVAVQKLEKTYKIVQTVNYIKAQTISELKNPNTHTQVPLEILAGYNGFVGFRVFVMPKDEKIYSFLRARLESGKSEFPIYFGSAPFAAKIEFLGEFEACRWEDSRAGILTVLDTGLIKSLNLSLEFSSSLALMKDRMPCDFDKDRFATKVKTYIHDENLNPIWVDLNSSAQDKVYYIKEFSGDRKECICVM

SEQ ID NO: 1246 - protein, 280 aa, Desulfobacterium autotrophicum HRM2
MFRDPLTITQNMTFPIPPKTTVGGMLAAILGIDYNDYLNDPEFFNFRYSLVLEKPVRKKSFVQNYVANYTKGSEKKFNAIKKYLESGKKQKDLLFEKEQLEEESDLTKKEEKLLGSIGGKIESESMTLEKASASCSKVFNESFTSPKPIFRELLVAPEYLVFIHDFKYEKEILHSLENHFSEFSLYMGNSEFSANYTYVDCEWSLEESERLDSFTLNPSKIVFEEGKKYTNVYMATKAVGQREYRDYKNFILCDKQITLSGKTQVHAIVTKVRSYYCEFV

SEQ ID NO: 1247 - protein, 229 aa, Sulfurihydrogenibium azorense Az-Fu1
MEVLVFDVWGDFGHFRKFYTTTSPLTFSIPPPTAVFGIIGAILGIDKKDYLKIINAETTKVAIEIVKPVKKIRFTINYIDTKVSFSRIKNRTPIRTEFLKDAHYRLYINLNEENLFRELKDRIKERKTYYTVSLGLANLIANFKYIGQYQVEPLDASNYVNTVISSENIENIEMVEGKRYFKEKMPVDIDENRVVKSYKDIVMELQGKPIEGSFKNVFKVEDKVISFLT

SEQ ID NO: 1248 - protein, 253 aa, Persephonella marina EX-H1
MMRYIKDKWGKMFMKILRIKAYQLFANYRKPMSYNYWDSYPLPPLSTIRGWFHYVVWNGNKDENRHYIPISMSIQGKFSSVIQDLQTLIKFDRKRNTKGEIVIEGFNKAFSKSPTYVTNIFDINLHIYIKAEEHFLHRFIENVFKLEYPSIGRYEDLVRIDELKIIEPEPIDLYEEPHDIYYGIYINKKTADYFGLRGINYRMNFKYDGDLLNKTGLRYFERKDIVYVDNAVLGEGEILFDKEENRVIDLVGD

SEQ ID NO: 1249 - protein, 236 aa, Kosmotoga olearia TBF 19.5.1
MKVLVLDISSDYAHFRKPYTTTSALTYSIPPRTAVLGIIGSILGISSGGFGKSEHSKFFETNNVKTGVRLLTSIKKTTFNLKYLHTKNGGSILVPVECVVSPIYRIYVSGNEDFLAKLESVVKNKECYYTPYLGISEFLASVSYVGFFEGKRVDEIPTLVDSVIYLFDKGEIKFESGLNLFHETHAVRMDCERKVQEYSEIVYEENGKKIQLLKKSEKTSVISLVIGEQKEVIMLV

SEQ ID NO: 1250 - protein, 245 aa, Geobacillus sp. WCH70
MNVLVFDIRADFGHFRKIYSTSSPLTYSIIPPTSFFGILGAIIGLGKEENEYLRYVNHETVNMAIRVMSPVRKMRIGLNHVNTKGNVWVPKQRREGARTQIRTEFLRFPYFRCYVHVKEQSLFQQLIEYVQQHRSVYTVCMGLSECIADVRYVSLEEFRLVNNNAEAVSIASVIPEKYVTSLCIESGKEYRKERFAFQIDTERIVSDYEEVLFEASGEAIRAVVSHYWENKVGERIVFLYDHGKE

SEQ ID NO: 1251 - protein, 233 aa, Geobacillus sp. WCH70
MKALRMKLFQETACYKKPFASKVAETYPLPPYSTVKGMLHALVRADEFIPMRLSIQGQYEAKLLDYQRYYFFKKKEMESFPLILDGVRDVDFSYGKNEITTMPMYTHLLYRVELLIHVEAKDEVLENIIQAIETGSGHYSLGRWEDLVRIDEYKLVHVQELDEEKELRYNAYIPKHLLDEEIRYIPYEVNWKYEIVNGIRQWETVHVGYVLKGTTAPEGAMVDEDGELVFYHV

SEQ ID NO: 1252 - protein, 218 aa, Thermococcus sibiricus MM 739
MEKGVTIDVLFDLAHFKVHTTMKGRTSYLIPLPTTVLGFFFSILGKGREAYLRERNQFKAGAKLLSIKGIARENAQLLKLKRGQEVRTTEELMLLVKPKYRFAIWGKQELINNLYERVRTFDFEFVPYGGISEFIISEIETPQLYDEYEEKDTIKDSYVPQPLLNSLRILDNGIVYNLPYVYSGKPKFVIMGWNVELNLKQKIPTIGGVPLYPPFMVI

SEQ ID NO: 1253 - protein, 264 aa, Halorhabdus utahensis DSM 12940
MDQESSNGRTGTDGSDLDRCLSFEIRGPWGHFRRVEGNVVKQTYRIVPRTTVAGLIAAVLGIDRDGYYDLFGPEVSAIAIQPVEELRTVNMPMNTLSTAAGDLTSLNPRGKISIKLPNPTKLRQQHNYEVLVDPAYRIDVALADDERYEQLRETLAAGKSHYVPSLGLSEYLAEIDYLGEFDVKPGPASGTIAVDSAVPDAMDDVVLDPETRCQIEQSPAFMASDGSGRTTTEYTTYTYNPDAEPLQVRDVPTSRVDDRTVVFV

SEQ ID NO: 1254 - protein, 258 aa, Methanocaldococcus fervens AG86
MWGLKFRCEGIYFVSFRKPVTTSLSLTYKLPPFTAIRGLIANALGMPRDSFEIQNWFKIGMRVEGKIEIGREMAKFLKMISRKSCYRCENCRFEKIADSKPKKCPNCGKENLVKVEKMIYERAFPSSPMHREFLIMPKYWIYLVGEEKKIKKIYYALKSPERPLYLGTSDDLVDIEVFKPVKVKEVEENEINSILDGIHENCILEKLPYRFIPVKDKKGKLKEVYSEYKLVSIPRKFPYSTEKPLKAWDFGDEFIRVF

SEQ ID NO: 1255 - protein, 254 aa, Leptotrichia buccalis C-1013-b
MKAIKLKLYQNMVNYKVPTSFQLKESYPLPPYSTVIGMVHSLCDFKEYKPMKISISGNYFSKVNDLYTRYEFKNGNPFEMGRHQLNVNGYGINRGVATAELLVDVNLTIHIIPEDQSEEFLNTIFEAFKYPREYPSLGRREDIVLIKDVRIVDVEKKEMEEDLENGEEVFAYIPLSFVYDEKVEFGNPASGVRICGTRYELTKNYETKNIGTKAKPKFIREWKKEEVLYSSNITALEEEIVPVDEDNEIVFCEL

SEQ ID NO: 1256 - protein, 262 aa, Halomicrobium mukohataei DSM 12286
MSEHAPTASGLPDGAETCLSFTVSGPWGHFRRIEGNIVKQTYRVIPRTTVAGLIAAMLGIERDGYYDLFAPGESLVAIEPTSELRTMKLPMNTLSTADEHMASLNPRGKLSIKLPDPSKPRQQHNYEVLVEPAYRIDVWLADDERYDRLRSLLESGESYYVPSLGLSEHLATIDYHGEFPVEHGPDGETVAIDSTVPEAVDSIVPDPETRYQIEQTPAFMERDDGGRTTSAFVSYAYNPDGGSLRVADVSTYSVDDRAVVFT

SEQ ID NO: 1257 - protein, 250 aa, Desulfofarcimen acetoxidans DSM 771
MKAIRLRLWQDMVNYKKPTSFQLKETYPLPPYSTIIGMVHSLCGYEEYKSMKVSVQGKYFSKVNDLYTRYEFKNAMKYELARHQIQVGEYGICQGVATAELLVDVELLIHIAPEDQTLVDEIYDAFIRPREYPSLGRREDILTIEEVKLVTLTETELEQQIKSLDGYYAYIPYEMVRDERVNLTNNVTGVTYTGTRYKLTKNYELVNYGSKKVPKLFRRWNKVDVVYASVTALAEETFMIDEDNFVAFMV

SEQ ID NO: 1258 - protein, 246 aa, Desulfofarcimen acetoxidans DSM 771
MKSLRFTLSGSAACFRQPDVNTLVYFTYNNIHKVALLGLLGAVLGLSGYRNAKLHGQEDPIFPEFYEVLSSLQISVVPNTKNGYFTKKIQYFNNSVGYASREKGGNLQVREQWLENPSWTIFLKQNNLDDIVWDKLCSSLLEGRCVYLPYLGRNDFPAQIEDMHMVELFPSRQSRIDSLFLYDGDLNALGGGGPAQYLFVETAPTGLVPKYNFYEFGRYIFTNCTVPEAVLPPLLYADGELQYCFY

SEQ ID NO: 1259 - protein, 253 aa, Desulfofarcimen acetoxidans DSM 771
MKIISFHLRGKMAHFRRYYANSSALSYSIPPRTTLIGIVAGLLGWERDKYYEIFSLNSCKVAVASCAPVKKCMQKLNLLMIKKAGDLNGSAEHHSQTATELIIPQNIRTGIIDYQVWLHHRDNKIMDMLGKLLQLEGRGYKSLGISLALGTVFNLGWVDDGCIIEGVEKEKSNDLSIASVIPVKKLIGIQTERMGADEYRLVKEEIPLEFDSQRHITERGLGNMMINLNSSPIPAGVESYVQLENGKCIMWME

SEQ ID NO: 1260 - protein, 266 aa, Ammonifex degensii KC4
MVNVAVFDLVGPFAHFRKYYTNSSSLSYAFPPRTALMGTVAAVLGWERDSYYEKLGLSEARFAVVIKVPVRRLIQTVNYIRTKEEDLNRLRKLEAVKGTQVPLELLLPGGTASSLCFRVYFAHRDDQVTRELAERLAAGRSYFPLYLGLTEFIAQARLVDFKPPDEIIPAGQEVELHSVLAADYLRRPVLRGEVALNRERAPQSFGAGRKLMPPRSYIYEMQARPWRAELLIPAYSFFLPSGKETVAFMEGELWPSSPTVTAKESA

SEQ ID NO: 1261 - protein, 247 aa, Geobacillus sp. Y412MC61
MNVLVFDIRADFGHFRQLYSTSSPLTHSFIPPTAFFGLLGAITGVGKEENEYLRVFNHKTTNMAIRLMGPVRKTRVGINYVNTKGNIWVPKQRREGARTQIRVEFLRFPHFRCYVSMNDHERFSYLIDLVRQHKSVYTPCLGLSECLADVQFVAMEDFRFVQGAERKTVSICSVLPRKDVQVLEVEEGKEYRKERVAWEMDPERVVSRYEEVIFEAAGRPILASVPHYWENEQGERVVFFYSDGKGE

SEQ ID NO: 1262 - protein, 264 aa, Thermobaculum terrenum ATCC BAA-798
MPNKMIIFDLAGAYAMFRKFYTNSSSLSYPFPPRTVLAGLIAGIMGYERQGHRNTYAEHLAPGVADIALSVRVPVRRVMQTVNYVMTEGNVWSRNAGGFDGSRERTLTPVEWVFPASGRRQLRYRVYLTHRDEGWLERFAGYLRSGAVYPPYLGMTECPAVIEPVAEVEDWELGVREEVLPISTVINADKIVDLPLPDADAQIVKERMPIALDNDRRLLQIGNFVYEQRHNRPIEAKVSVPVFTVTYTDIDGGQLTEHGVFMSE

SEQ ID NO: 1263 - protein, 266 aa, Spirosoma linguale DSM 74
MSSRSLEKKRREELLSFDLQADFGFFRKPDVNEGIQYSYNMLHKPALLGIMGAIAGLKGHQQKGQWPQYYTLLKSVLVGIAPLNHERGSFTKVAITYTNTVGYANADGTLIVHENTLRCPAYRVFVLLDQADELQSRLAARIRQHEAEFIPYLGKNEFTAWWDNVNEYEVDRTRPTQSFELVTLFDKRLKTDRKSMTRESDQLDLVDMSNQKGSYIYFERLPAGFNEELFQYDLVNFAYTDYLIKAPTQLANLYQLNQTNSYAQLM

SEQ ID NO: 1264 - protein, 287 aa, Methanobrevibacter ruminantium M1
MKIIEVDIWSSFGCFSKHFSNTGGVLTHLIPPKTSIIGIIGAILGYDVNDYEDNDDGTKTYKIESLNNIKVSIYPLFEFKTKRVIFNLVSGTNLDLDIKNINQDVLISPRYKLFISFPSELDEVEELFLNRVKNNKTIYNLYMGRNEFPLNLEFVREINAEKHIFSNDNSDELKSIKVYGSLNRSSIKSLNLSYEDNDSKVDSDALSLISSLLISNSADGVRHLKSFHEFTIKDYPIKRENFTDFSYSPVSFYSSKKFGECFFSNLQLKDGEIELVNIGDDKWLSLI

SEQ ID NO: 1265 - protein, 258 aa, Methanocaldococcus sp. FS406-22
MWGLKFRCEGMYFVSFRKPVTTSLSLTYKLPPFTAIRGMIGNALGMPRDSFEIQNWFKIGMRVEGKIEIGKEMAKFLKMISRKSCYKCKDCGFEKISESKPKKCPNCGKENIVKVEKIIYERAFPSSPMHREFLIMPKYWIYLVGEERKVNKIYNALKNPERPLYLGTSDDLVDIEVFEPVKVKEVEENEINSILDGIYENCILEKLPYKFIPVKDRKGKLKEVYSEYKLVSIPRKFPYLSENPIKVWDFGDEFIRVF

SEQ ID NO: 1266 - protein, 237 aa, Thermoanaerobacter italicus Ab9
MKTLVFDIFGDYGHFRKYYTTSSPLTFSFPPPSTVKGMLGAIAGIDKKEYLKVFSSSNCNIAIRILNPVKKIRIGLNLINTKGNFWIPYKMKNHEARTQVRAEFVKDAAYRIYFAHKDNALFEDIVDKIKNHKNVYTLSLGLSEMLADYKFVGIYDSHEVKNVEVDILSVLPFEFIVEDKIYFEKGKKYFKEKIPMDMNEDRVVLSYQDVLYEANGQSIKCHVMKCWEVNGEHVIFF

SEQ ID NO: 1267 - protein, 265 aa, Haloferax volcanii DS2
MSPHIDANGVPIDCLSFTVRSTWGHFKRVGRSVTKQTYRIPPRTTVAGMLAAIVGADRDSYYDVFGADNSAIAITPLSDLRTVNIPTTGLGTDPKQDVTETAGSWRTYKLTYQNTTGDRQLHSYEVLADPAYRIDVALENEEFYDSLREHLVNGTSIYPPSLGKSEYLAVIEDVEVDREPEVQDIDETLDIDSVVPISLSEAVPQGKVTYGVERSPAVMVRESGGRRTTRFDDYVYAQQASNPVRIGEQTDVAPVQVGDRTVVFR

SEQ ID NO: 1268 - protein, 266 aa, Zunongwangia profunda SM-A87
MEILSFKISGKMAHFRKYYANNTAFSFSIPPRTTIMGIVAAAMGWAKDSYYEDLASENIQIGVRVLNPLKKSFHRLNFLSIKSTGDMAKNWSSDFRGEGGPIQTPFEVITAWDLAKADVAYQVFVKASDNGKAVYESIKTHFLEKDPVYNITLGTANFTANLSDIEVFKDNQIDMRSADDYVQIHSAVLVELVEDLKFDKEEFQNYNFVEEDMLPGDFIANGNREVRKMNRLLFSITPHPLSVKLKGSYYVLKNDTGDLNIQFMDA

SEQ ID NO: 1269 - protein, 251 aa, Kyrpidia tusciae DSM 2912
MKVLSFRLQGKMAHFRRYYSNSSALSYSIPPRTTVVGIVAGLLGWSRDTYYEVFSLNRCRVAVRNAAPIKKQIQKLNLLMVDRPNDLNGSQPHHSQTPTELVMPQDIRQGFLDYQVWFWHEDEDVMSRFESVAAEIPGYRSKGIALALGAACHLGWLVPEGSIRGERIQTEDLLPVASAIPLRNLRHVDMSRGHGHYRFIREELPLEFDGERRPTERGRGDMLINLTGDPVPAVVSSAVQLDGGTYITWME

SEQ ID NO: 1270 - protein, 234 aa, Kyrpidia tusciae DSM 2912
MRLLVFDLKGTLAHFRRPDTTATHASYPVITRTALRGLLGSILGLAEFSGESWAGIQLLSPVRTVLQELSLLGKGFLTSGPAMNRPTSIELVVNPAYRIYYHGDYQEELMARIREGRSHYHTYLGSAFALTFPRFVGSWEVPEVELTPGMTYRCRTVLPTQVVQGLVMSPGDSKLQVGRIGGVHYHYLGGRRFRGAVHLVYEVQGQPISFVPAASPAEPKVRFAQLGDEVVCLW

SEQ ID NO: 1271 - protein, 239 aa, Methanocaldococcus infernus ME
MNVLVFDIWADYGHFKKIYTTTSPLTYDIIPKTTIYGILGAILGLKKNEYLKYINGSTSYIGLRILNPIKKCYFGINLINTKDNYFIPVKKTGHEPRTQIRFEMLKNPKYRIYVSLKDDKLHEKLKNLLEEHKTVYTLYMGISELIANFKYIGEFEAIKNLNSNNFVEINSVIRKDHIKDILFEENKEYLFSKFPNDMNLERVTTEYVDIFYEKNGYPIRCKVNEFFKLKELNENITFI

SEQ ID NO: 1272 - protein, 238 aa, Thermincola potens JR
MAIAFNIAGPIAMYRRPYTTTSSVSFPLPPPSAVAGLLAGIVGLGNGSHEESCASEYWEEIKGTRIAIAILNPISWYTGTVNFWNLKEPQKSPHIRVKHQFVKNPKYRIYVHGGVEKELRRHLEAGTFIYTPCLGTAYALAEIEYLGYFDIQPVTENKINLSSVLPLLPEHTIEIDIIASKGVFRDKLPFRLTPQRALAENITTLYSASVEGKICLTAWEGLDVTYFGDECIAWFPSW

SEQ ID NO: 1273 - protein, 248 aa, Thermoanaerobacter mathranii subsp. mathranii str. A3
MLNSLLKIKIYQPFANFRKPFSYGIVDSYPLPPPSTVKGWLHNILGAREGKYYKMAVSICGKFNSVVYDIQRIIKFDRLRGENDNAPVVNEVSARVVNGIIYVTNLVDVQLCIHVNAERDVLEKIYKNIFDSYWGLGRKEDLMRIDEIKLFEPRKVEYRKYIKKRPPEIGMYLKSSTAETLMIDGIRFRLNNRYEKTKDGLRIFTDKKDIVFIETLEQLNPMAMVDKEVMVDDENIIIDLIGDEEYEN

SEQ ID NO: 1274 - protein, 237 aa, Thermoanaerobacter mathranii subsp. mathranii str. A3
MKTLVFDIFGDYGHFRKYYTTSSPLTFSFPPPSTVKGMLGAIAGIDKKEYLKVFSSSNCNIAVRILNPVKKIRMGLNLINTKGNFWIPYKMKNHEARTQVRAEFVKDAAYRIYFAHKDNDLFEDVIDKIKNHKNVYTLSLGLSEMLADYKFVGIYDSHEVKYVEVDILSVLPFEFIVEDKIYFEKGKKYFKEKIPMDMNEDRVVLSYQDVLYEANGQSIKCHVMKCWEVNGEHVIFF

SEQ ID NO: 1275 - protein, 235 aa, Geobacillus sp. C56-T3
MIMKALRLKLFQETACYKKPFASKVAETYPLPPYSTVKGMIHALLRADRFIPMRLSVQGEYEAKLLDYQRHYFFKKRDVAAFPLILDGIQDESFSYDANEITTMPIYTHLLYRVDLLIHVEAEKEVLERVIHAIETGENHYSLGRWEDLVRIDEYKIVQVDELDEEKDLRYYAYIPHHLLDIDIKHIPYELPWKYEVVNGVRKWEKVNVGYVRKGTTAPEGACIDEDGELVFFHL

SEQ ID NO: 1276 - protein, 241 aa, Methanococcus voltae A3
MDKNVLVFNVQSNYGRFRKPYTTTSALTYLCIHPVALKGLIGAILGIKKEDLIHETSNLTLGIEVLSAIDKDLQSVKLLSLKSGMFHFPANVEFLRNPNYNIYVKWDSKNYNALKDKLASGEVFFTPYLGVSENVAKISYVGEFKELNEIGNTKIEHTDIKHIDSIFPVAEFNIEIDLNDANKKYYFDTIPIKNNEKREYTEYKRVLISKDAIRINCNNLNNLHNFSNLSKIGEKCVYFFK

SEQ ID NO: 1277 - protein, 240 aa, Listeria monocytogenes
MVRAIRVRIHQDSANYKKKMSFQLKESFPLPPFSTVIGMVHVACGFDSYHEMDISVQGNYFNTFNDLYTRYEFGNKKFEKGRHHINAGGLGVTRGVATVNLLNNIDLLIHIIPKKEEDFELILNSLRRMPTRFLSLGRHEDLITINEVAQTEIVSKKLQFDRITEFGGYVPYEQGMDLNLGRTLFVLNKNYTLVNKGTEKKPRIHRVFEEKRALFFSKENIVPKGTQLLLDSENNFVFPF

SEQ ID NO: 1278 - protein, 232 aa, Thermosediminibacter oceani DSM 16646
MKLLVFELRGDIAHFRRPDGIVTHPTYPAMPRTVLCGLIASILGKSVLDGENWMGYSILSPVRTVTQEMSMLGKGWMGNSGDYFNRLTSIQLIVNPHYRVYYAGDHFETLVEMIRERRSVFHTYLGSAFCLTFPRFTGVIDAEEISPAPGDILTAITIVPTNIVERLITETGERYIPMRGARYTVDRDRNFKGTLNFIIEESGRPIKFRTRDSAGSVNYRILKVENGVICLW

SEQ ID NO: 1279 - protein, 248 aa, Caldicellulosiruptor obsidiansis OB47
MLNSLLKIKIYQPFANFRKPFSYGIVDSYPLPPPSTVKGWLHNILGAKNGEYYEMAVSVCGRFNSISYDIQRIVKFDRLRKEDTIAPVVNEVSARVQNSIIYVTNLVDVQLCIHVNAERNVLEKIYKNIFDSYWGLGRKEDLMRIDEIKFFEPRKVEYRKYIKKRPPEIGMYLKSSTAETLMIDGIRFRLNNRYEKTKDGLRIFTDKKDVVFVETLVQLNPMAIIEKEVFVDDEDIIIDLIGDEMYEN

SEQ ID NO: 1280 - protein, 243 aa, Caldicellulosiruptor obsidiansis OB47
MKVAVFDIKADFGFFGKFYSTSSPITYPFPPFPTIQGMVGAILGLDKKEYLDVLEYGKFRAGIRILNPVKKIRIGINHIDTKEGRWQPIKTKNRQPRTQMRFELLKDPCFRIYATHTSESIFFKLVEFLEQHRSYFTLSMGLSEFLADFEFVGVFEAFEKDMPDDYVSLCTPIPLSYLDSKADTPLRFEAGKSYFKERMPLYMLTTREVVKYEDVIFEPTGKELLARPSSYVEVQNGENILLF

SEQ ID NO: 1281 - protein, 237 aa, Thermoanaerobacterium thermosaccharolyticum DSM 571]
MKSLIFDIYGDFGHFKKYYTTSSPLTFSFPPPPTIKGMLGAIGGISKTEYLKTFRSDKCKIAVRILRPVKKIRMGLNLINTKDNFWIPFKKKNHEARTQVKMELLKDPMYRIYFSHEDDELFNDIVEKVRNHHNVYTLSLGLSEMIADYRFVDVKDAFETGDVETEISSVLPYKYILDNKIVFEDGKKYFKEKIPFDMDEDRVVLDYSDVVYEANGKSIRSYVSKSWVIDDEYVMFF

SEQ ID NO: 1282 - protein, 246 aa, Eubacterium callanderi
MKALRFLLRGKTAFFKQPDVNTYCYYTYGCIHKIALLGIFGAVMGFRGYNGQTKAETYPEFYEKLKSLKVSICPLNEKGYIPKKVQTFNNSVGYASKEEGGNLIVKEQWLENPKWEIAFLVDDPQSENLAERILESRFEFLPYLGKNDHTAVIENVEEVELEAETKRENLRVYGLFPANQGSLSENSVRRPLGREVPYKYQERLPVALEPACNQYVTQAMIDTNQRVSLTDAASVFRLEERHYVFF

SEQ ID NO: 1283 - protein, 253 aa, Hydrogenobacter thermophilus TK-6
MKVLVFDLFGDLGHFRKFYTTSSPLTFPFPPQPTIRGIIGAIMGFGKEEYLDKTKDIYVGVKIVNPIKKLRTGLNLIFTKGSSGEFDPTLDPSRKGDANKTLRTQVKFEFVKDPRYRIYISASEEFLKKLTDMVKNHKTYYTVSLGLSELLADFSFVGVFDSHPIDVSDRADSVIPSRIIREIDIGKVQKIGKERIPVVMDSNRMVKMYEDVVFSVEGGAIYGKFTDLIKLGNGEVIYLWKQSQESTPIQESL

SEQ ID NO: 1284 - protein, 233 aa, Geobacillus sp. Y4.1MC1
MKALRMKLFQETACYKKPFASKVAETYPLPPYSTVKGMLHALIRADAFIPMRLSIQGQYEAKLLDYQRYYFFKKKEMKSFPLILDGVRGLDFSYDKDEMTTMPMYTHLLYRVDLLIHVEAEEEVLENIIQAVETGSNHYSLGRWEDLVRIDEYKLVHVQELDEEKELRYNAYIPKHLLEEEIRHIPYEVNWKYEIINGIRQWETIHVGYVLKGTTAPEGTMVDEDGELVFYHA

SEQ ID NO: 1285 - protein, 244 aa, Geobacillus sp. Y4.1MC1
MKMLIFDLIGKMGHFRKIDTNSSSLSYAFPPRTTIVGMIAGILGMERDSYYEVFSPDQCQIAISVRTPIRKVMQTVNYMFVKSKAHLNNSGGHTQIPLEFVLPGGEEANLRYRIYFSHSDRSVYESVKERIQSGRYVYPPYLGLSELLGQLQWVAEAEGMLKESNDLVPIHSVVRIPDLRERSIQFSRDTRFLKEFMTRQFTNERMIQETDYYLFEQSRQLIAVPAVPYIAVAYGEAKENILWM

SEQ ID NO: 1286 - protein, 248 aa, Caldicellulosiruptor hydrothermalis 108
MLNSLLKIKIYQPFANFRKPFSYGIVDSYPLPPPSTVKGWLHNILGARDGKYYKMAVSICGKFNSVVYDIQRIIKFDRLRGEDDTAPVVNEVSARVVNGIIYVTNLVDVQICIHVNAEENVLERIYENILNSYWGLGRKEDLMRIDEVKFFEPSKVWYKKYIKKRPPEIGMYLKSSTAEKLMIDGIRFRLNNRYEKTKDGLRIFTDKKDVVFIETLEQLNPMAMVDQEVMIDDENIIIDLIGDEEYEN

SEQ ID NO: 1287 - protein, 250 aa, Caldicellulosiruptor hydrothermalis 108
MKFLVFDLKGKFAHFRKFYTNSSSLSYLVPPRTVIEGMVAAILGFERDSYYEVLSAENLLIAVQKIERTYKIVQTVNYIKATTVNELKNPNTHTQVPLEILAGYNGFVGFRVFVMPKDEKIYSLLRARLESGKSEFPIYFGSAPFAAKTEFLGEFEACRWEDSRAGILTVLDAGLIKSLSLELESASSLALMKDRMPCDFDKDRFATKVKTYIHDENLNPIWVDLDSSAQDKVYYIKEFSGDRKECICVM

SEQ ID NO: 1288 - protein, 239 aa, Halanaerobium hydrogeniformans
MNKALVFDIWADYAHFKKYYTTTSPLTFSIPPKTTLYGIISAILGFSKEEYLKKFNEGLCKIAIQIKNPVNKTRINLNLIDTKKAALMSQIETRTQIKTEFLKDAKYRIYFMHQDEDLYNNLKEKLKNHKTVYSISLGLSENLANFKYIEEIEVEKINENSWQEINTVMRIDTENISKGDIDFSQNGREYFSDKIAVEMKSDRTVTDYAQVLFEKNGKSIKVNVNKYYKDSNNNRLLFL

SEQ ID NO: 1289 - protein, 248 aa, Caldicellulosiruptor kristjanssonii I77R1B
MLNNLLKIKIYQPFANFRKPFSYGIIDSYPLPPPSTVKGWLHNILGARDGKYYKMAVSICGKFNSVVYDIQRIIKFDRLRGEDDTAPVVSDVSARVVNGIIYVTNLVDVQLCIHVNAEKYVLEKIYENIFDSYWGLGRKEDLMRIDEVKFFEPSKVEYKKYIKKRPPEIGMYLKSSTAEKLMIDGIRFRLNNRYEKTKDGLRIFTHKKDVVFIETLEQLNPMAMVDQEVMVDDENIIVDLIGDGEYEN

SEQ ID NO: 1290 - protein, 250 aa, Caldicellulosiruptor kristjanssonii I77R1B
MKFLVFDLKGKFAHFRKFYTNSSSLSYLVPPRTVIEGVVAAILGFERDSYYEELSAENLLIAVQKIERTYKIVQTVNYIKATSVNELKNPNTHTQVPLELLAGYNGFVGFRVFAMPRDEKMYSQLKSRLESGRSEFPIYFGSAPFAAKTEFLGEFEAYRWEDSSARILTVLDTGLIKSLNLSLESSAGLALMKDRMPCDFDKDRFATKVKTYIHDENLNPIWVDLDSSAKDKVYFIKEFSSDKELCISLM

SEQ ID NO: 1291 - protein, 243 aa, Caldicellulosiruptor kristjanssonii I77R1B
MKVAVFDIKADFGFFGKFYSTSSPITYPFPPFPTIQGMVGAILGLDKKEYLDILEYGKFRAGIRILNPVKKIRMGINHIDTKEGRWQPIKTKNRQPRTQMRFELLKDPRFRIYATLATESLFSRLVEFLQQHRSYFTLSMGLSEFLADFEFAGVFEAVEKGMPDDYVSLCTPIPLSYLDSKAEIPLRIEAGKSYFKERMPLYMLSTREVVKYEDVIFEPTGKELLARPSSYVEVQNGENILLF

SEQ ID NO: 1292 - protein, 275 aa, Caldicellulosiruptor kronotskyensis 2002
MKETKNSIYTLKMKIYQPQAHFRIPFSYQRRHTYPIPPYSTVLGLIANVLGIKNIPGQEEPCVNKNCKCLYHKLKQIKMGVCGNFETKVEEYFWLRNLNIGNHIERFGSITNRYVGGHIEHIGGQMPCIADVLHNVRILIYLYHCDKEFLDIIKSSFENPINRTSVIHLGRAEDWILIEDIRYVDLIIDKINGNYKNFFWVPEKVFGFDGNFDFKKVNGLAYNITSFYKIQNGVRNFRYVKVKLNNGDFGDITTYFDTEDNIPVFLADLEEGKDE

SEQ ID NO: 1293 - protein, 250 aa, Caldicellulosiruptor kronotskyensis 2002
MKFLVFDLKGKFAHFRKFYTNSSSLSYLVPPRTVIEGIVAAILGFERDSYYEVLSAENLLVAVQKIERTYKIIQTVNYIKATTVNELKNPNTHTQVPLEILAGYNGFVGFRVFVMPKDEKVYYNLRSRLESGKSEFPIYFGSAPFAAKTEFLGEFEAYRWEDSRAGILTVLDTGLIKSLNLSLESSSSLALMKDRMPCDFDKDRFATKVKTYINDENLNPIWVDLDSSAQDKVYFIKEFSSDKKECVSLM

SEQ ID NO: 1294 - protein, 224 aa, Calditerrivibrio nitroreducens DSM 19672
MLRIEIYQQNACYRIPEIGNPILTFPLVPPSTIFGLLRYITSYSSINKYNTKIAISGIYESKIRHIITNHITGISDKGKYKSNIIPTEELFNVKHIIHIESNFENKINECIDKATRLGRMEDLINKIEIITSSEKKSNSCDLSEIKNLNYYIYVPFDKFESMNSLAIFNVPLDSDKDLLDKGFLKTYRVKLLFLRVQRLLLNQINQTKSDYCIDKDGYCYVWIN

SEQ ID NO: 1295 - protein, 253 aa, Thermaerobacter marianensis DSM 12885
MGTTARLTVPLLIFDVAGHLAHFRRPDTAVTHATYPFPTRTALRGMLGAILGRPEWVDTEHEAWTGVRILNPIRTRAQELSMLGKGWFGNGDAFNRPTAIELVVEPAYRIYYTGPDGQELAERIRQRRSHFPTYLGSAYALTVPRFIAWEEAEEVGGEAAVAGGAVNVAPEGPLESPAVVPTHAVLDVEPVPGRVYARVGGVLHTHLGGRRFRRSLSFLYEPNGQAIRFWPAPGPYDPPVRWVRCSDGLVCLW

SEQ ID NO: 1296 - protein, 247 aa, Geobacillus sp. Y412MC52; identical to SEQ ID NO: 1261

SEQ ID NO: 1297 - protein, 245 aa, Thermovibrio ammonificans HB-1
MRALKVKLYQPFACYSTPFSFGAVNTYLLPPPSTVKGFVHSTAGARQDYPISVAIQGELGGTVYELQKLLKFDRKRAGQPELKGFSRSFLKAPTHVETLTDVHLTLYILFPPESEELEKDFLNGLLLKEFPSLGRKEDIARLEEEPRFVELDPLEEETVLPSFAYFTRETATELGLGGAFYRLPLSYDGELAKELGWRFFKRRDLLLAPPGQVVEPLSDKVLYDPSEDRVVELIEVPAGYKHVLS

SEQ ID NO: 1298 - protein, 237 aa, Thermoanaerobacter brockii subsp. finnii Ako-1; identical to SEQ ID NO: 1235

SEQ ID NO: 1299 - protein, 259 aa, Odoribacter splanchnicus DSM 20712
MNNQRLISFDIQADFGFFKKPDYNDGVLLTYNMLHKPALLGILGAIIGLRGYRKKGEWPEYYQRLAALPVGIEPLEGRHEKGNFQKTIVKYTNTVGYANQDGNLLVEESMLIRPAYRCYLLLSEEHPDHRKLYEYIREGWAEYIPYLGKNEYPAWFGDSFREYAFKTFVPETDFRVSSLFIKEGVLKGQQVKASFSFSLKGIVNRGSFVYFERLPVGFHPVLMQYELADFAFTDWTLQAATQMVNLYQLEEEGKIVQLF

SEQ ID NO: 1300 - protein, 252 aa, Syntrophobotulus glycolicus DSM 8271
MKAVRVRLHQDMVNYKKPTSFQLKETYPLPPHSTVIGMVHSLCGYTEYQPMQVSVQGKYFSRVNDLYTRYEFKNAMKYEAARHQLQAGEYGINQGVATAELLVDVELLLHIMPEDQEKVEEIHQALKNPKEYPSLGRREDLATFEEVKVVELSLTELEEPVDAPDDYYAYIPLSLLEDESVQLLHHNRVMGDRQPGTRYRLTKDYELVDYGTKKAPKRFRRWNKVDVIYGVPTALIEGKVTLDEDGLVAYLV

SEQ ID NO: 1301 - protein, 237 aa, Methanothrix soehngenii GP6
MPERVIVFDVWGDYAHFRKNYSTSSPLTYSFPPRTALSGLIGAVVGLDKAEYFRHFCKVDANIGCRILAPVKKVRIGENLIDTKSAVKMHLIKNRTQIRFEFVKDPKYRIYFSHSDEQLYKKLKDLLTSHQSVYTPCLGLSQLICSYQFIGEFGLKSSGEEVQEIDSVVPGKCLLTPEFEEGKEYFSEVMPGEMGEAREVTDYSEILFERNGRSIRAKAKELWEVENGEHGERIVFL

SEQ ID NO: 1302 - protein, 237 aa, Clostridium botulinum BKT015925
MKGFKFNVSGKTAFFRKSDINQHINFSYSNIHKPCILGLLGAIIGLDKDKYYHALKHLRIAIVPNKSYFNKSIQVYNNTTKFGNKSLNNPTTLNIREQWLEDVSWYIYVITEDDDITYDKIYEYIKEFKSVYNIYLGRKEHIANVRFIEDIDIEDIHDDIAQINSLFPYSIIKDIEANKPEYCEDRISYFLKETMPIGYDDKGLYDYDTLVHTNHEIYELNNTNNIYKINNNILYFL

SEQ ID NO: 1303 - protein, 238 aa, Thermodesulfobium narugense DSM 14796
MKVLSFEIFGDYGHFRKFYTTSSPLTFAFPPFSTIAGMLGAICGVDKNDYLNVFGYDKCKIGLKIVNPIRKVRLGINYINTKDNLWRPIKKGRHEPRTQIRVEFLKNPRYRIFVYHENEKWMDKLSSFLKEHKCFFTLSLGLSELIANFMFKGYYSAERFSNLKDEIATPVGLSKVVNNEFIFEENKKYFKERIPIEMNQERIVKFFDDFIFEPNGKTIKCKVQEFYKLESGENIVFF

SEQ ID NO: 1304 - protein, 254 aa, Tepidanaerobacter acetatoxydans Re1
MKVISFHLKGKMAHFRKFYSNASALSYFVPPRTTICGIIAGLLGLERDGYYDDFSLDNCKITITSCSPLKKTMQKLNYLMIKSVQDLNGSQENHSQTATELVIPQDIRSGYIDYKIWFHHCDNKIMSDVESIINDCSPFYESKWSCVALGSAFNLGWIEKGEILEAEEKFVKSKKLVSSSIPIHNIEEIKVDEINTNKVYKLIKEEVPLEFDQQRRITKEGLKEILINVNGDYIPAVVDSFVSLDNGEVITWLE

SEQ ID NO: 1305 - protein, 255 aa, Mahella australiensis 50-1 BON
MTENGLLVFDVKGLMAHFRKYYTNSSSLSYAFPPRTAAAGMIAAVLGYERDSYYELFDTVRCGIGISVKTNIRHMTQTVNYVRTKGPRELNGSFGPTQVPLDIILPAVNESMLVYRIYFWHDDQTVMSKLKELIWDGRTDYPLYMGISEFIAFSQPVAYVPGSDIREIEPGEMIDLATVCNVENIANGGLAFESPDGQAMQYIKERMPISFGDNRQLKSFGSFLFEKNRCVIRAKLKVPCYRIDYNGHVENIVFM

SEQ ID NO: 1306 - protein, 237 aa, Thermoanaerobacterium xylanolyticum LX-11
MKLLIFDVYGDFGHFKKYYTTSSPLTFSFPPPPTIKGLIGAIEGIGKKDYLKVLSSEKCKLAVRILNPVKKIRMGLNLINTKDNFWIPFKKKNHEARTQVKMELLKDPMYRIYFYHTDEDLFNDIIEKLKNHQNVYTVSLGLSEMIADYRFVGVKDAFEEKNSEVFVSSVLPYKYILEDKIVFEDGKKYFKEKIPADMDEERIVLDYADVVYEANGKSIRSYVSSSWVIDDEHIVFF

SEQ ID NO: 1307 - protein, 223 aa, Hydrogenobaculum sp. 3684
MLRLEIRQESAHFRIPTVGNPFLSYPLPPPSTVYGFLRAITNYESINFENTKLSIQGTYKGVSFEKERLVLRTKTETKTNIIPIQKLHQCSWVVHIKSSEEFENKIINALKNTSRILSLGRREDLIIDFNAFRVEEKPLDKSKKIAQKTTKIYKAWNENEDIKEGSIFRMALDTIVNENKEIIAYKQISLIYMGVKNLIPSQFYDKKQHSKTYDGEYLIEWII

SEQ ID NO: 1308 - protein, 255 aa, Desulfofundulus kuznetsovii DSM 6115
MKRVLIFDLTGPMAHFRKYYTNSSSLTYGFPPRTVLMGVVAAVVGYERDSYYELLDRGRFAVAVKVPGRRLVQTVNYVRTKREDLTELRRLGRARGTQTPVEFLLPEGDYRRLRFRIFFSHPDAGLVEEAAARLRENRTYYPLYLGLTECIAAGEYVALAGPDDYDVLPAGTALTLTSVLNAALLQEILLSGETPSRRLVRERAPHSFGPGRILRPPVSVIYEARAQSLNVRLAVPACRFLVGDNAVETVAFLEG

SEQ ID NO: 1309 - protein, 281 aa, Desulfofundulus kuznetsovii DSM 6115
MEYLRLCFKAPTAHYRIPFTYKVRHSYPIPPYSTVIGLLCNILGEEGTIACFLGQPFGLYIVGRYQTLTREYTWLRNLEPKSHYKRFLSKDSRHSGQVAEHPGGQSPVVLDVLNEVETTVYLAHPDCDVLARLQENLFRPGRWINHLHLGRAEDWVVPEGVGCITLFPSSEVDPAWTVDRGYYFWLPHPEETWELGEWGDRQEYTELFGKIMGSPQLVCTLYRKVKVRNEKGKSWGIRNFNHVRAKLCRGQIPLVQFGSLPRVMVDPEFMLPVFPAHIAWR

SEQ ID NO: 1310 - protein, 223 aa, Hydrogenobaculum sp. SHO; identical to SEQ ID NO: 1307

SEQ ID NO: 1311 - protein, 242 aa, Desulfotomaculum ruminis DSM 2154
MKNAIQFRLSGRFGHFLKAEAGTSALSYPVPTRTVLLGIVGAVLGLEKDTPQELLEPVQFAISGKSPKTHWHKAKFRKDPPTPLQHIIKRTQKQDANTKLEQATLIVQEWLINPCYNVWAILPDNYHVEFEERIKDRRWHFQPCLGVSEMLAEIEYIDTEPVQKLDPAVYAVSNVIRQKQANINFQELYDNSLTIQLLRMPRTVTPNRIFTHDNYLFEANARPIMIRTSDAYKIGKRVVMFL

SEQ ID NO: 1312 - protein, 227 aa, Pyrococcus yayanosii CH1
MLGLVIEARPLQAHFRIPYNSLLLDSYPFPPRTTAIGLLAGAMGLSEEGFKKLLGELRYGVIIEDPGARVEETAAIFKNPGSPLYPITKVLYHKPHYRLFFAGDENIIERAYEALLDPVFTPYMGDSESLFYPAKREYARIVSAEEGKESTLRSLIPGDEYARGARFMVLRKNNLTPREYRMPVNFTYRGKGRRAVYRRVVAFAGGYVELANEVDVLLFDGEPVFVF

SEQ ID NO: 1313 - protein, 233 aa, Parageobacillus thermoglucosidasius C56-YS93; identical to SEQ ID NO: 1284

SEQ ID NO: 1314 - protein, 244 aa, Parageobacillus thermoglucosidasius C56-YS93
MKMLIFDLIGKMGHFRKIDTNSSSLSYAFPPRTTIVGMIAGILGMERDSYYEVFSPDQCQIAISVRTPIRKVMQTVNYMFVKSKAHLNNSGGHTQIPLEFVLPGGEEANLRYRIYFSHSDRSVYESVKERIQSGRYVYPPYLGLSELLGQLQWVAEAEGMLKESNDLVSIHSVVRIPDLRERSIQFSRDTRFLKEFMTRQFTNERMIQETDYYLFEQSRQLIAVPAVPYVAVAYGEAKENILWM

SEQ ID NO: 1315 - protein, 235 aa, Pseudothermotoga thermarum DSM 5069
MMNMKILVFDVKGKFALFRRSYTTTSSTTYPFPPRTAICGIIAAILGIENPPDRPSWYLRKFDNARISIRLLNPIKKIRLGINYVETKPDKDTPRTQILAEIIKDPAYRIYISEFEKFDELVKLIRSHECVFTPYLGLSEFIADFSYVGVFEAKKVSLPTLVNSVVKIIDGTKSFPERGTALIRERMVLRMDDKRTPLEFAEYWVEKNGKALQILEYSEDILEIEELNERICWID

SEQ ID NO: 1316 - protein, 249 aa, Bacillus coagulans 2-6
MRALAFELRGRTAFFKKPDVNANIYFTYSHIHKIALLGMLGAILGLKGYEAQSRDIKANGDNEANRYPEFYEKLKDLKVSIVPHGDRGYFSKKIQVFNNSVGYASFEQGQNLIIKEQWLENPHWTVYLLDDGTEICMELFNRLKSHQSVYLPYLGKNDHPASITKVREVELENAWAPGSCIDSLFCSKGVDLGRSRTEPYLYQEFLPIKMDDILNSYVFEQMFFTNQVVNKIQNSNVIYCAEEKNLFFF

SEQ ID NO: 1317 - protein, 239 aa, Flexistipes sinusarabici DSM 4947
MISLKLSLYQNMVNFRKENSFGHVQSYPLPTPSMVRGMAHQILELTKYNPLKISIQGNSDSVTVNMQKVMKFDRDPKSRPINPYIVKVGNSVKTATHGIAFVDNLINCKLIIHIAFENEELTKNLYEKVMKNTVILGRNEDIARVNFDETKLTEISYSDDENELPYSIYVNSEDAKKLQLSGTSFRLPFRYENVTSFSDSRIFHKVNCQFISKNTILNEYTAETFLIDEDGLFVSFLET

SEQ ID NO: 1318 - protein, 232 aa, Sulfobacillus acidophilus TPY
MDVMVFELRGPLAHFRRPDTTSTHATYPFITRTALRGLLAAILGRETWPEDSWTGVSLVHPVQTRVQQLSMLGKGFLESGPMFNRPTAVEMVVNPHYRIYYSGPLIDELATWVSQGRSTYPTYLGSAFALTYPEWEGRYQLREWGAEGLVPKPLVTVIPVHAVTEIEPEPGVSFARVGGVLYQALDGRRFRGTMAFIYERNLRPYRVKVAHQVHPAVRFVYTPDETGLIALW

SEQ ID NO: 1319 - protein, 221 aa, Methanococcus maripaludis X1
MKSVVFSAKSEYGRFRKPYTTTSALTFLCIHPVAAKGLIGSLMGIDKSDLYEETKDLKIGIEVLGEINKDLQSVKLLSLKNGMFHFPSNIEFLRCPHYRFYVTWNENKLNELNDKLNVGEWEFTPYLGVSESIAKINHEGMSEVLKVNKADFVNTIIPTKNILPKINLNIKMYSDKIPVKNNSNREYIEYEKIVFAEKNPLYGEISSDDIYQVGGKNVYFF

SEQ ID NO: 1320 - protein, 228 aa, Thermococcus sp. 4557
MLGLVLEVRPLQAHFRIPYNSLLLDSYPFPPRTTAIGLVAGAMGLPEGGYRELLKEMRYGVIVEDPGVRVEEKAAIFKSPDSPLYPITKVLFHKPRYRMFFAGDDDLIERAYDSLIDPVFTPYLGDSESLMYPAKRDYVRIVEVNDGKESILRSIIPGDEYTKGARFVLMKRTNLTPREYRMPVDFTYGRGKGRRAVYRKVVAFAGGYVELANPIDVLLFDGEPVFAL

SEQ ID NO: 1321 - protein, 265 aa, Haloarcula hispanica ATCC 33960
MSQQSLDSWTANGNDGQPDRCLSFTVRGPWGHFRRIEGNIVKQTYRIIPRTTVAGLLAAVLGIERDSYYDLFAPDSSAVAIEPVREIRTVNMPMNTLSTADGNLQTLNSYGKISVRLPDPTTLRQQHNYEVLVDPAYRIDVALADEQWYTELRETLAAGESHYVPSLGLSEHLADIEYHGEFDIADGPLTDTVEVDSAVPNAVDDVVLDAGTRCQIEESPAFMESDSGGRTTTGFTNYAYNPDADSLNVRDTTAASVDGRTVVFV

SEQ ID NO: 1322 - protein, 250 aa, Caldicellulosiruptor lactoaceticus 6A
MKFLVFDLKGKFAHFRKFYTNSSSLSYLVPPRTVVEGVVAAILGFERDSYYEELSAENLLIAVQKIERTYKIVQTVNYIKATSVNELKNPNTHTQVPLELLAGYNGFVGFRVFVMPRDEKMYSQLKSKLESGRAEFPIYFGSAPFAAKTEFVGEFEAYRWEDSSARILTVLDTGLMKSLNLSLESSAGLALMKDRMPCDFDKDRFATKVKTYINDENLNPIWVDLDSSAQDKVYFIKEFSSDKELCISLM

SEQ ID NO: 1323 - protein, 243 aa, Caldicellulosiruptor lactoaceticus 6A
MKVAVFDIKADFGFFGKFYSTSSPITYPFPPFPTIQGMVGAILGLDKKEYLDILEYGKFRAGIRILNPVKKIRMGINHIDTKEGRWQPIKTKNRQPRTQMRFELLKDPRFRIYATLATESLFSRLVEFLQQHRSYFTLSMGLSEFLADFEFVGVFEAVEKGMPNDYVSLCTPIPLSYLDSKAEIPLRIEAGKSYFKERMPLYMLSTREVVKYEDVIFEPTGKELLARPSSYVEVQNGENILLF

SEQ ID NO: 1324 - protein, 256 aa, Lactobacillus ruminis ATCC 27782
MKAIRLEIYQQTANYRIPNSCFFRESYPLPPYSTVIGMIHNLCGYTEYHPMYVSVQGSFASTTSDLFTRYEFGNSKFDEKRHQFNVGGYGVCRGIGNTQLLVDVNLLIHIIPQNQEEIGKIYESLSNPKEYPSLGRREDLALFKDVEIVEVRKMSDDDALPERVDCMSAYIPLVLDNSIMGIDGEIKQSKMVALRYKDLVKGTEYNINKDYTLHEMQRGRFERMWNKVKVTYVSDYKVKWGNVFIDADNNCPIFPA

SEQ ID NO: 1325 - protein, 229 aa, Bacillus coagulans 36D1
MEAVVFDLKSDLAHFRRPDTTSTQLTYPFISPTAVKGIAGAILGIEDFTTRDKIGIQLLHPVKTVSQQMSMLGKDSGSTFNRPTTVELVVKPFYRIYYAGDEYVRDLYRFLSKGRAVYPTYLGSAYALTKPVLQAYYEQVEPLREWSEPLRTRCVVPTRLVKEMKFEPERYYSRAGGFMLVYKGSREFEKSIDFVYERNGDAITFLPDKRQISDELQIVQIGDETVCLF

SEQ ID NO: 1326 - protein, 234 aa, Thermovirga lienii DSM 17291
MPTVFEISGRMAMFRKPYTTTSSISYPFPPPSALAGMIAAILGYTHGAEDKGWNALYWEKMKGTQVALRIMNPVSWHSETINFWNVKEPQKKHIQVKHQFLREPRYRVFVKGPLEEELDSFLSKGCFLYTPYLGVAYALCDVKYLGRFKEEDCIPPVKVNTVIPFGDGLKVDVLGSGGVFRELVPFSMDEERSLKKSITVLFQLSPSKGILIKEKGDVEIARCGDDVVAWFPAW

SEQ ID NO: 1327 - protein, 237 aa, Hungateiclostridium clariflavum DSM 19732
MAQKFLVFDVSAPYGHFKKPYTTTSPLTYSIPTRTAVAGMIAAILGFGKEDYQKLFTKDLAQIGIGIRKPIKKVRISENLINTKKSMNRIHERTQIKIEYLKDVCYRIYFTHKDEKIYGKLKEFLTRHCSVYTISMGLSENLANYTFVGEFEGQEISGSKEFVEFSSVLPVDRIAKGDVEYEDDREYFTENIPVEMDEERNVKEYREILFERNSRKIKAKLENFTKIMEIDENIMIL

SEQ ID NO: 1328 - protein, 249 aa, Hungateiclostridium clariflavum DSM 19732
MKAVRLKLTQELVNYKVPTSFQLKETYPLPPYSTISGMVHSLCGYKEYHPLKISVQGKYLSKVNDLYTRYEFRPGMPFEAGRHQLEVNGFGISRGVATCELLTEVELLIHIIPEEQSIIHEIENAFKFPPEFPSLGRREDLVIINEVKVVDVNEKVLEDYIELDKNYSAYIPEKMLSNDSIKISGFAGLECGTRYNINKCYEKVNYGTKKNPKIFRKWEKVRVVYSSRISAIEDESILIDEDGNIVFAI

SEQ ID NO: 1329 - protein, 258 aa, Niastella koreensis GR20-10
MVNEKLISFDLYSDFAFFKKPDFNDGLQLSYNMLHKPALLGILGAIIGLEGYKRKGELPQYFQLLKDIPVSIEPLRHECGNFQKTSVKYTNGVGYANADGNLLVEETMLIKPAYRCYLQLDLTNKTQAKIYEYICTEQCEYIPYLGKNEFQAWVTDMQEWNTLPLKPSASFSINSLFIKEGSVRNQRAETDIAFAFDSMESIGSFSYFERLPTGFNEELMQYQLSDFAFTDWKLKPESKISSLYQLKALQEEKIIQLF

SEQ ID NO: 1330 - protein, 232 aa, Sulfobacillus acidophilus DSM 10332; identical to SEQ ID NO: 1318

SEQ ID NO: 1331 - protein, 241 aa, Mesotoga prima MesG1.Ag.4.2
MKVLAFDISSDYAHFRQPYSTTSSLTYAIPPRTAALGIIGAIVGIESGGFGRSEHVAILEKANTKVGIRLMNKIEKTRFNMNYSYTKADVTTKNVLHIQVPVEMVRNPVYRLFVTADSELFEKLEGMVINSECYYTPYLGISEFVAKVKYVKTYEALIVETADEIWTAIEMLKKTSLSFSSGQKIFTETHAASMNSQRHVTRYVEVAYEAEGSSLKLQSVDPDSLLAKISTDAGDEVVMLW

SEQ ID NO: 1332 - protein, 268 aa, Haloferax mediterranei ATCC 33500
MTQQTLTEWNDTQNESGTAGPPRCLSLTVRGPWGHFRRVEGNIVKQTYRIIPRTTVAGLLAAVLGIERDGYYELFARGRSAIAIEPVAPLRTVNMPVNTLSTADESMKSLNPRGKISIKLPDPTKPRQQHNYEVLVDPAYRLYVWMSDSHWFETLHETLDEGKSHYVPSLGLSEYLAEITYHGRFEVESGPTDTAVAVDSAVPNAVDHVVPDAESRCQIEESPAFMTVDGGGRTTTDFTSYTYNPDAGPVRVRNPDTAIVDGNTVMFV

SEQ ID NO: 1333 - protein, 224 aa, Pyrococcus sp. ST04
MGLIVEARPLQAHFRIPHTSLLLDTYPFPPKTTAVGMLAGVMGYPPDSYFRLLREVNYGVIIEDQGERIEEISAIYKNPHSPLYPITKVSLYKPHFRMFFTGPEEFIERAYEALLDPKFVPYLGDSESLFYPASPGYVKLVEVKHGKEKTLRSILPANVEVESVDVFRKRILAPKEYEVPVAFVYRGKHRRAVYRRFLAFSGVVIRLKEPIDVMLFDGEPVFTF

SEQ ID NO: 1334 - protein, 237 aa, Thermoanaerobacterium saccharolyticum JW/SL-YS485
MKLLIFDVYGDFGHFKKYYTTSSPLTFSFPPPPTVKGLIGAIEGIGKEDYLKVLSSDKCKLAVRILKPVKKIRMGLNLINTKDNFWIPFKKKNHEARTQVKMELLKDPMYRIYFHHTDEDLFDDIVEKVKGHKNVYTVSLGLSEMIADYRFVGVKDAFEVENKEVFVSSVLPYKYILEDKIVFEDGKKYFKEKIPADMDEERIVLDYADVVYEANGKSIRSYVSKSWVIDDENIVLF

SEQ ID NO: 1335 - protein, 227 aa, Thermococcus cleftensis
MLGLVVDVRPLQAHFRIPYNSLLLDSYPFPPRTTAIGMLAGAMGLPEEGFRRLLGELRYGVIIEDPGSRAEETAVIFKSQSSPLYPITKVLLHRPRYRLFFAGDEETIERAHDALLDPVFVPYLGDSESLFYPAGGEYVRLVEVKEGKESILRSLVPADEYERGARFTVLKRNNLFPRDYRMPVGFTYRGKTRRAVYRNVVAFAGGFVELANPVDVLLFDGEPVFTF

SEQ ID NO: 1336 - protein, 236 aa, Acetomicrobium mobile DSM 13181
MPVVFDVSGQMAMFRKPYTTTSSISFAFPPPTAIAGLISGIVGISNGSNDDGCNAKYWESLIGTKVSVALLSDISWMWHAINFWNVKQPQKSPHIQVKHQFVINPKYRIFVDGGIEDKLRCMLEKDSFKFTPYLGTAYAIANVVYIGQFSNQSLTEDEVFVDSVVPWNEKVRILNILDVGGTFKEEMPFKMDVTRKFIESIEVLYSPSPQKKLLINKGAGDVTKCGNDVVAWFPRW

SEQ ID NO: 1337 - protein, 225 aa, Natrinema sp. J7-2
MKQTYRVIPRTTVAGLIAAMLGIERDGYYDLFAPGESLVAIEPTSELRTMKLPMNTLSTADEHLSSLNPRGKLSIKLPDPSKPRQQHNYEVLVDPAYRIDVWLDNDERYNQLRSLLESGESYYVPSLGLSEYLATVDYHGEFPIEQDPSDDTVAIDSTVPEAVDSIIPDPETRYQIEQTPAFMERDDGGRTTSAFVSYAYNPDGGSLTFTDVSTYSVDDRTVVFT

SEQ ID NO: 1338 - protein, 225 aa, Candidatus Nitrososphaera gargensis Ga9.2; identical to SEQ ID NO: 715

SEQ ID NO: 1339 - protein, 240 aa, Thermacetogenium phaeum DSM 12270
MTLVFDVWGDLAMFRKPYTTTSMVSFPFPPPTAVCGLIAAIVGLDHGASEGALKAEYWDRVRGMQVALGLRRPVAWFSTAVNLIKFKSPSGDMGEHIQVKHQLLKRPAYRIYVRGGEVYDELKKRLERQEFIFTPYLGVAFALAEYSYVGEFRETPVEEEAMGIDSVLPLYGDVRLDLQQSGCLHSEVVPFRLDGIRRQQETVNVIYPEYRVNSRIYLRNRGDVEVSLVGTERVAWFEPW

SEQ ID NO: 1340 - protein, 270 aa, Natronobacterium gregoryi SP2
MGQQSLDAWEHDEGDSAFPERCLSVTVRGPWGHFRRIEGNVVKQTYRIIPRTTVAGLFAAVLGIERDGYYELFGPNRSAIAIEPVREIRTINMPMNTLSTADGDLQSLNGRGKLSVKLPDPTTLRQQHNYEVLVEPAYRIDVALADEERYRELRSMLEDGRSHYVPSLGLSEHLAELEYHGEFDIGPGPKATADDQPVAVDSAVPDAVENVVFEAGTRCQVEESPAFMTTDPGGRTTTEFTAYTYNPDAEPLRIRDVDAATVDGRTVVFV

SEQ ID NO: 1341 - protein, 229 aa, Thermobacillus composti KWC4
MRGVVFDVKADLAFFRRPDTTNTQLTYPFMTPTAIKGLVGAILGIEDFVTGDRVGLSLLSPVRTVAQQLSMLGKDTSSSTFNRPTTIEVIVSPGYRIYYAGNDKAEQLAQFLREGKAVCHTYLGSAFALTKPVFVREVDKVEVLQSDSEVETATVVPTRFVKSIVPESGKYYSRAGGFMHRYLGGRVFERSVDYIYERYGRSIRFVPKRDIDPDDGLICHFGEEVVCLV

SEQ ID NO: 1342 - protein, 237 aa, Thermoanaerobacterium thermosaccharolyticum M0795
MKSLIFDIYGDFGHFKKYYTTSSPLTFSFPPPPTIKGMLGAIGGISKTEYLKTFRSDKCKIAVRILRPVKKIRMGLNLINTKDNFWIPFKKKNHEARTQVKMELLKDPMYRIYFSHDDDELFNDIVEKVRNHHNVYTLSLGLSEMIADYRFVDVKDAFETGDVETEISSVLPYKYILDNKIVFEDGKKYFKEKIPFDMDEDRVVLDYSDVVYEANGKSIRSYVSKSWVIDDEYVMFF

SEQ ID NO: 1343 - protein, 250 aa, Thermoclostridium stercorarium subsp. stercorarium DSM 8532
MKAVRIEAYQNMPCYRKASSFRLRETYPLPPYSTVIGMVHKACGFTGYHSMRISVQGEYCSTVNDIYTHYEFNPVPKGKTESKDYVERYNIGYYSKDNTHHRLNRGTGYHELLTDVRLLIHVCPDDESMVDAIYQGMLNPSYYPSLGRWEDLLRIDLVEKCEIYENIINNATFTLNRNAYIPVEFYKGNEFNYKITGTRYKINKRYTINPKTELRQWVEQIDVIYASPQSKIVKGAIYSKDSKGDAVFLA

SEQ ID NO: 1344 - protein, 236 aa, Thermoclostridium stercorarium subsp. stercorarium DSM 8532
MKGIRIEIEQPFASYSVPGSFQLRETFPLPPYSTVIGMVHNACGFKKYVDMDVSVQGNWASVCNDIYTRYEFSPNRQFEKERHQGYFEENGRKYGVVIGVGHVELLADVNLLIHIVPKNQDIVETIYNGLLYPQNFLYLGRTEDIVRINSLETVDIIEEILDYEEILKYNAYIPVSYKVENEIGTIYRLNKKYIINKSQTRYWEERIEALFAPKEKELTIGTKIYKDSKGDLVFLA

SEQ ID NO: 1345 - protein, 218 aa, Clostridium saccharoperbutylacetonicum N1-4(HMT)
MKLYQETVCYKKPYAFKVTETYPLPPYSTVIGMLHGIIGAGKDDYHEMEVSVQGKYEGIFTAYNTTRFYNGDDITSMPLNVHMLYGVSLVIHVVSDEDTLNKIYEGFRTTDTAFTLGRREDLARLDDIKFVELNKLLKEDEFDDEKDIKLKYSMYVPDKYQTSLRGIGYKINKVYRIVNDLRQWGKINVKYVECDESLDNGEYYIDDDSIEKDIAFLA

SEQ ID NO: 1346 - protein, 223 aa, Hydrogenobaculum sp. HO; identical to SEQ ID NO: 1307

SEQ ID NO: 1347 - protein, 223 aa, Hydrogenobaculum sp. SN; identical to SEQ ID NO: 1307

SEQ ID NO: 1348 - protein, 250 aa, Thermoclostridium stercorarium subsp. stercorarium DSM 8532; identical to SEQ ID NO: 1343

SEQ ID NO: 1349 - protein, 236 aa, Thermoclostridium stercorarium subsp. stercorarium DSM 8532; identical to SEQ ID NO: 1344

SEQ ID NO: 1350 - protein, 246 aa, Desulfallas gibsoniae DSM 7213
MKSLCFTLSGPAACFRQPDVNTQVYFTYNNIHKVALLGLLGAVLGLSGYRNAKLHGQEERVFPEFYEVLSSLLVSVVPNGKNGYFTKKIQYFNNSVGYASKEKGGNLQVREQWLENPSWTIFLAQHNLDDVVWDKLCSNLLQGQCVYIPYLGRNDFPAQIEDVLMVELSPSRQSRIDSLFLYEGDLKALDGGGPSRYLFVETAPIGLVPNYNFYEFRRYVFTNGTIPEAALPSFLYTDGDRQYCFY

SEQ ID NO: 1351 - protein, 242 aa, Desulfallas gibsoniae DSM 7213
MKKKVLIFDLYGDYAHFRKYYTTTSPLTFSIIPPVTLMGVLGAILGLSNQDNLYLKTLNEAGTKVGIQLMKPVKKFRMGMNLINTKNDYWVPRHRNEGARTQIKYEFLKDVAYRIYVSMDNEELLNQLEYNVSRHKCVYTISLGLSELLADFSFVDMQDFNWRENDGKFIDIVTAVPMNDVLQGGIDISPGERYLKENMPIKMDSNREVTQYSEMLTETMGNHIKLKINGFWESHGLNINLL

SEQ ID NO: 1352 - protein, 220 aa, Thermotoga maritima MSB8; identical to SEQ ID NO: 1212

SEQ ID NO: 1353 - protein, 240 aa, Listeria monocytogenes; identical to SEQ ID NO: 1277

SEQ ID NO: 1354 - protein, 240 aa, Listeria monocytogenes; identical to SEQ ID NO: 1277

SEQ ID NO: 1355 - protein, 248 aa, Clostridium autoethanogenum DSM 10061
MKVVRFKLSGKTAFFKKPDVNTYCCFTYGNIHKIALLGIMGSVLGFRGYNEQSRNFKKNVYPEFYEKLKNAKVAVVTINKHGYISKKVQEFNNSVGYASRESGGNLIVKQQWLQNPKWMIYVKIDNITDEFSNMIRKNKAKFIPYLGTNDHFADITKVSELEVHKEDDVDKVDSIFETKYFKIDKYQDEEEDTDTAWKYTEYLPVALDKDLNQYQFSDFTETNMAVDSFNESVDVYRDEELDKNLYFF

SEQ ID NO: 1356 - protein, 265 aa, Haloarcula hispanica N601; identical to SEQ ID NO: 1321

SEQ ID NO: 1357 - protein, 220 aa, Thermotoga maritima MSB8; identical to SEQ ID NO: 1212

SEQ ID NO: 1358 - protein, 235 aa, Thermococcus paralvinellae
MLQNALNDWYGNERGLDTWWNLKVSIHGGFESVFWNYQQLIKGTKDGISLVRFKGRPILWNQDRPLYYYPIKSQRTPVYQQELFNGWLYIFLRGSVNLLEEIREALLVPDKVLSLGRSEDVIFVRRAEFVEPAKRYKAKEIIFTYPTYIRLPNELLKVKRFPAYSIPVRVLFRNDGRPIMHKAEISSSTERDVYFESVLYAGADYIVTLAEKVWVERFEVDGLRPFKILLNYGWL

SEQ ID NO: 1359 - protein, 263 aa, Halobacterium sp. DL1
MAQESLESWTDEGDGLPETCLSFELRGEWGHFRRVEGNIVKQTYRIIPRTTVAGLVAAMLGLDRDSYYEAFSQNVSAVAVEPIDELRAINMPMNTLSTAKEHMTTMPSRGHARISMPDPSELRQQHNYEVLVEPAYRVDLQLANDDLRGRLQDRLCDGTSYYPPSLGLSEHLAEVTYLGEFEVTPHERETTNVDSAVLEAVDSVELTPETEVKVERSPAFMAADEGGRTTTAFQSIAYATGAEPLRVHDVKTHEVDGRRVMFS

SEQ ID NO: 1360 - protein, 253 aa, Sulfurospirillum multivorans DSM 12446
MKALRFILSGKTACFRKPDVNVFAYFTYNNIHKPALLGMLGAIIGLGGHNQLSNKNRGLKKASSSYDDGFPEFYGKLKELKIAITPLAPNGYFSKKIQTFNNSVGYASFEQGGNLIVREQWLENPVWQILILDDESEVFQKISEYFLNGKSVFIPYLGKNDHPAKIDDVRIIELLPFIKEQKVSSLFEENKLQIVKSPPRGELSYYFKEVSPIRLNEQHHFYEYANLIFTNHKIENENVEDVLSCEGNNYAFI

SEQ ID NO: 1361 - protein, 227 aa, Pyrococcus horikoshii OT3
MSELLGLIVDARPLQAHFRIPHTSLLLDTYPFPPKTTAVGMLAGCMGLGEEGFKKLLEKIKYGVIIEDPGEKIEEVSVIYKNPYSPSYPITRVSLYKPRFRMFFAGEERVIEEAYEGLLDPKFVPYMGDSESLFYPGKKRYVEVVDVQEGKEDILRSVIPEVKFKEFVPLRRKVLVPKVYEAPVKFTYKGKSRRAVYGRFIAFSGGYVKLEKKIDVLLFDGEPIATF

SEQ ID NO: 1362 - protein, 253 aa, Hydrogenobacter thermophilus TK-6; identical to SEQ ID NO: 1283

SEQ ID NO: 1363 - protein, 56 aa, Hydrogenobacter thermophilus TK-6
MNFFRLNVIVHIVGEEQLLRTFKGALERPSVFLSLGGGEYPALVKNKLHRKGDIPS

SEQ ID NO: 1364 - protein, 230 aa, Deferribacter desulfuricans SSM1
MKVLVFDIWGDFGHFKKFYTTSSPLTFSVPPPTAVYGMLGAILGFGKNEYLQYLNVKTTKIAIQILNPIKKTRMTINLIDTKNSNSFHLIKSRTQIKTEFLRNPAYRFYVNINNEDLFNKLIQRVKNKETYYTLSLGLANLLANFKYIGAFKAEPTGNADFVNSAILSKNVENIEVEEGKKYFKEKLPIDMNQNREVLKYEDVIMELNGQKLEGNFKNCYKIEDKIVSFF

SEQ ID NO: 1365 - protein, 231 aa, Deferribacter desulfuricans SSM1
MKVLVFDIWGDYAHYRKFYTTSSPLTFSCPTPTAVYGMLGAILGTKGYKHLEIFNYSTTKLGIQILKPITKVRMSTNYVLAKEINDLWYLKDRTPIQVEYLKNPSFRLFIHINNNEIFTNLINKIQNKLLYYTVSLGTANLIANYKYIGVFKAEHINHTDTIKTIIPLENIENIKAVSGKKYFKETLPVDMSTDRQVKLYKEILMELNGAALEGEFKECYKLDNGDIISFI

SEQ ID NO: 1366 - protein, 387 aa, Caenorhabditis elegans
MGKFFFFGFVGLLLSWGALYYRYSDEKNTSARKYRFDPPPALVGNLFINAGLEKAEHILDGKIVGPESMVVDDEAIYVSVNDAKVLKIVDGRVVSKASYSEKSKFFPDCGHFDTEPECGRPLGIRRLVAGKPKFVVCDAYLGVYIVDFTDEQNPISTQILDSKVPIDGLKPRFLNDLDVISEDELIISDSSTRHDRRHFMAAILEHQADGRIFHLKISTKSVKVLADKLYFPNGIQLTEDKKSVIFAECSMARIKKLTIASKKVEMFAANLPGLPDNIRSSGRGTYWVGLTATRSATHPSLLDRLGSLPGIRQFLVDIVPGPYWKPLLGLFKNPHSIIIELDSVGKIVRSLHDVTGKHVGDASQVTEHNGHLYIGSFADHYIAKVKL

SEQ ID NO: 1367 - protein, 233 aa, Clostridioides difficile 630
MKVLKLDLFQETACYKKPFAMKITETYPLPPYSTINGLIHKILNATEYIPFNISVQGTYESIFNNYQTTYFYKKDSITSMPMNSHMLLNVNLIIHIGGDFDLLEEIYDSLLNYDEHLSLGRKEDLVRINDIRFVEVNKFEVDEDIQLDDYENYKLSECNIRMPIYIPKTSLQDTDIDGISYRLNNYYDNNAVEDKKRVWNKVDSYYVEDGNTISIGDILLDNEGDLLYFNNIN

SEQ ID NO: 1368 - protein, 233 aa, Clostridioides difficile CD196; identical to SEQ ID NO: 1367

SEQ ID NO: 1369 - protein, 233 aa, Clostridioides difficile R20291; identical to SEQ ID NO: 1367

SEQ ID NO: 1370 - protein, 262 aa, Listeria seeligeri serovar 1/2b str. SLCC3954
MLIMKAIRVKLWQDLVNYKKPTSFQLKETYPLPPYSTVIGMIHTLCGFTSYHEMKISIQGKYFSKVNDLATRYEFKNGMTYDATRHQIKVDNYGVSRGISTVELLVDLELLLHIIPEDPALVPVIEKAFKEPIEYPSLGRREDIATIQAVDVVEVEKRKPKENKSVNISKDYNAYVPISLAESKVVRFKSQESSVGRSKLLGTRYLLTEKYERVNHGTEKAPKFFRKWRKKDVIYSSRIFVSKNDVFFLDKDDCLVFIEEEV

SEQ ID NO: 1371 - protein, 147 aa, Megamonas hypermegale ART12/1
MEILKFKLSGKNAFFKKPEVNTYCYFTYGNIHRIALLGILGAILGYKGYSQMQDILSNKKKKGKLESSYPEFYEKLKDLKIAILPLNPKGIISKKIQTFNNSVGYASEEQGGNLIVKEQWLENPKWEICILLDCEEAKKNQRSYTKS

SEQ ID NO: 1372 - protein, 237 aa, Ruminococcus sp. SR1/5
MERAIRIKCFQNLVNYRKPGSFIIKETFPLPPYSTVLGMIHAACGYTEFHPMKLCIQGTNSGTVSELYTRYSFSAGTKYEEGRHQICVEDGEKYGIFRGIANVELVCDNDMVIHVIPEEEAFEKVYNSLKYPPRYLSLGRYEDLLDIERVDIVNIHQEDEVVIKRDMYIPVSYGSELGARRGTIYNLTKEYEITKQGLRRWKKENGRVKAYYCSEGVVIDEGAYVDDFEKDAALIFC

SEQ ID NO: 1373 - protein, 241 aa, Fretibacterium fastidiosum
MAVMFDCSSDMALFRKPYTTTSSVSFAFPPPSAIAGLVSAIVGLDNGASGDASHAFYWRELAGTRVAVALLRQTRWMRAAVNFWNVKNPQTTPHIQVKHQFVASPRYRVYVAGGVEARLRGHLERGSFIYTPCLGVAYALAQIDYIGACDPQPMGEGEVRVDTVVPWEGEGMELNLAESGGIFSERVPFRLTTERALAESIKVVYSSDVSRPLCVRKRGGLHVTRCAARGVEDVVAWFPEW

SEQ ID NO: 1374 - protein, 240 aa, Listeria monocytogenes serotype 7 str. SLCC2482; identical to SEQ ID NO: 1277

SEQ ID NO: 1375 - protein, 240 aa, Listeria monocytogenes SLCC2372; identical to SEQ ID NO: 1277

SEQ ID NO: 1376 - protein, 240 aa, Listeria monocytogenes; identical to SEQ ID NO: 1277

SEQ ID NO: 1377 - protein, 935 aa, Albugo laibachii Nc14
MDPSDVRILVVEDDAFTRIATIDILQSCKYNVSAVENGKEALQTLQQSYQQYDLVLCDVMLPCMTGIELLEAIQAHPTRFNHIPIVMTSCNEGMDVVKNCLSKGAKDYLIKPIQVNTAKTLVRHVWLHRQQHSNQQNAQADSSERVPCYSSIWQNLHIIRQIGKGTHGNIMLAKRKEDGAIVAIKRIQTADFSEQGKKQADNEVVLLKSLYHVNIVRFYDHFMLGDELNIVMEYSDGGNLRQLIKLRARDEMGPFPETVIMSWFAQLVLAVAYIHGKNVLHRDLKAQNVFLTRKNVIKLGDFGISKALSDDVTANTACGTPESMSPEICRSEPYGKKSDVWSLGCILYELIMLSRPFEAKSLSEIFTKICKAEYNPIPQRFSRELRLLVQLMLQLDPSKRPTIDDICRFPFVQAPIQTFLSAHVSEFQEALELEAKLHQPSLFSADTSIDTSNRSELQQESLKHFVDNQQIMQSLENYSENETLKAKLKAESFTFNLKDGACQLSSSKEMLDDQVSMKSVSVHEGTLEAHKMSPETSWNFSSISKSLPTSEYQEMDFADNLRGCVCVQDIRNGLFSAHVACISGVDLIRNLKCQLGKSGEEAFDLLNVLLHHRRLKLIVADDMNEPDFACTNTLFRFQVDDVSEPLNMRYIHNYPAAENPMQVALEARLCIKKIHESKQYPDRISTGFRGFQTVTKYSMHRHRSFTSKGLHMRNSSGSIETALSSAYRHFLRSVAKLQTVELNAVSKHDRQAFFINVYNTMVLHGMIEYGIPQYSSQYRKFERDVQYQIGEYKFTLSDLKHGIIRCNRKPPRNYWERQLQPQDPRLQFRLHIRDPRSLLVLIEPCEPLIVSNEAAIIHTGRTDTDLEEQVGAYCARRVEVHVETQEVVLPRLFRVFHNDFGATERDMISWLGDYVPNVPVDFTGFRIKYAGGITC

SEQ ID NO: 1378 - protein, 276 aa, Haloquadratum walsbyi C23
MQSQLDDHADESTSQDTEATPDSLPDQCLSFRLSGPWGHFRRVEGNTVKTTYRIIPRTTVAGLLAAVLGIGRNQYYDLFGPESSAMSIEPVSELRTMNLPVNNLTTSQEGLKGVNTRGKVSVYYPDPTEDRQRTNYEVLVEPEYRIDLWLGDEERYDELREYLSEGKSYYTPSLGLSEYLADIEYLGEYEVTAVAQSEPHAVDSAVPDPDGVIPEPNVNYGTERSPAFMERTTTSGEFSGRRTTSYLTYTYSPDGDALTVSDTAAASVDNRTVVFR

SEQ ID NO: 1379 - protein, 246 aa, Clostridioides difficile T5
MEVLKFNLSGKTAFFKKPDVNSIIYFTYGNIHKIALMGILGACLGLGGYNQQSKEDEYPEFYSLLKDIKMSIVPKHEFGYINKKVHIFNNSVGYASKEEGGNLIIKEQWLENVSWDIYIQLEDSTTSRELKRRFLSNKFVYIPYLGKNDHIANISEIEIITDFYKTEDINRVDSFFIREDFEFEKSYFDDNDDYEEPFKYQEKLPYRLHRMTNQYILETIIFTNMSVKLINKKEVYQVKGLNLIFI

SEQ ID NO: 1380 - protein, 265 aa, Clostridioides difficile T5
MKVLQCKLKQPTAHYRDPKVFQNEYISTLNLPSKTTIMGMITYLCDRRLNSDIDIGIIGTHHHRELEFSRGENIDFWNEYTNMRKGKDKEKFLLKGNYYDYYKEHKAQNSILNYEVLKDVELTIFISCKDDEELEFIRKKLESPCKYANLGRKEDFVIPSEKGCFVKEVELKEVIPMNTRDAIKENIKLKNTYVRVDLRDKENVETIINQGVLIALPHKYKDLEANRDDRVYEFCHYIYVDNDGIYPKNIKVNVCIDTKEVFTWL

SEQ ID NO: 1381 - protein, 233 aa, Clostridioides difficile T5
MKVLKLDLFQETACYKKPFAMKITETYPLPPYSTINGLIHKILNATEYIPFNISVQGTYESIFNNYQTTYFYKKDSITSMPMNSHMLLNVNLIIHIGGDFDLLKEIYDSLLNYNEHLSLGRKEDLVRITDIRFVEVNKFEIDEDIQLDDYENYKLSECDIRMPIYIPKTSLQDKDIDGISYRLNNYYDNNAVGDKKRVWNKVDSYYVEDGNTISVGDILLDNEGDLLYFNNIN

SEQ ID NO: 1382 - protein, 246 aa, Clostridioides difficile T20; identical to SEQ ID NO: 1379

SEQ ID NO: 1383 - protein, 265 aa, Clostridioides difficile T20; identical to SEQ ID NO: 1380

SEQ ID NO: 1384 - protein, 233 aa, Clostridioides difficile T20; identical to SEQ ID NO: 1381

SEQ ID NO: 1385 - protein, 265 aa, Clostridioides difficile E1; identical to SEQ ID NO: 1380

SEQ ID NO: 1386 - protein, 233 aa, Clostridioides difficile E1; identical to SEQ ID NO: 1381

SEQ ID NO: 1387 - protein, 246 aa, Clostridioides difficile E1; identical to SEQ ID NO: 1379

SEQ ID NO: 1388 - protein, 246 aa, Clostridioides difficile E10; identical to SEQ ID NO: 1379

SEQ ID NO: 1389 - protein, 265 aa, Clostridioides difficile E10; identical to SEQ ID NO: 1380

SEQ ID NO: 1390 - protein, 233 aa, Clostridioides difficile E10; identical to SEQ ID NO: 1381

SEQ ID NO: 1391 - protein, 265 aa, Clostridioides difficile E13
MKVLQCKLKQPTAHYRDPKVFQNEYISTLNLPSKTTIMGMITYLCDRRLNSDIDIGIIGTHHHRELEFSRGENIDFWNEYTNMRKGKDKEKFLLKGNYYDYYKEHKAQNSILNYEVLKEVELTIFISCKDDEELEFIRKKLESPCKYANLGRKEDFVIPSEKGCFVKEVELKEVIPMNTRDAIKENIKLKNTYVRVDLRDKENVETIINQGVLIALPHKYKDLEANRDDRVYEFCHYIYVDNDGIYPKNIKVNVCIDTKEVFTWL

SEQ ID NO: 1392 - protein, 233 aa, Clostridioides difficile CD002
MKVLKLDLFQETACYKKPFAMKITETYPLPPYSTINGLIHKILNATEYIPFNISVQGTYESIFNNYQTTYFYKKDSITSMPMNSHMLLNVNLIIHIGGDFDLLKEIYDSLLNYDEHLSLGRKEDLLRINDIRFVEVNKFEVDEDIQLDDYENYKLSECNIRMPIYIPKTSLQDTDIDGISYRLNNYYDNNAVEDKKRVWNKVDSYYVEDGNTISVGDILLDNEGDLLYFNNIN

SEQ ID NO: 1393 - protein, 233 aa, Clostridioides difficile E16; identical to SEQ ID NO: 1367

SEQ ID NO: 1394 - protein, 265 aa, Clostridioides difficile E16
MKVLQCKLKQPTAHYRDPKVFQNEYISTLNLPSKTTIMGMITYLCDRRLKSDIDIGIIGTHHHRELEFSRGENIDFWNEYTNMRKGKDKEKFLLKGNYYDYYKEHKAQNSILNYEVLKEVELTIFISCKDDEELEFIRKKLESPCKYANLGRKEDFVIPSEKGCFVKEVALKEVIPMNTRDAIKENIKLKNTYVRVDLRDKENVETIINQGVLIALPHKYKDLEANRDDRVYEFCHYIYVDNDGIYPKNIKVNVCIDTKEVFTWL

SEQ ID NO: 1395 - protein, 233 aa, Clostridioides difficile T22; identical to SEQ ID NO: 1367

SEQ ID NO: 1396 - protein, 233 aa, Clostridioides difficile E25; identical to SEQ ID NO: 1367

SEQ ID NO: 1397 - protein, 233 aa, Clostridioides difficile T15; identical to SEQ ID NO: 1367

SEQ ID NO: 1398 - protein, 265 aa, Clostridioides difficile T11
MKVLQCKLKQPTAHYRDPKVFQNEYISTLNLPSKTTIMGMITYLCDRRLNSDIDIGIIGTHHHRELEFSRGENIDFWNEYTNMRKGKDKEKFLLQGNYYDYYKEHKAQNSILNYEVLKEVELTIFISCKDDEELEFIKKKLESPCKYANLGRKEDFVIPSEKGCFVKEVELKEVMPMNTRDAIKENIKLKNTYVRVDLRDKENVETIINQGVLIALPHKYKDLEANRDDRVYEFCHYIYVDNDGIYPKNIKVNVCIDTKEVFTWL

SEQ ID NO: 1399 - protein, 265 aa, Clostridioides difficile E15; identical to SEQ ID NO: 1398

SEQ ID NO: 1400 - protein, 268 aa, Clostridioides difficile T23
MKVLQCKLKQPTAHYRDPKVFQNEYISTLNLPSKTTIMGMITYLCDRRLNSDIDIGIIGTHHHRELEFSRGENIDFWNEYTNMKKGKDKEKFLLQGNYYDYYKEHKAQNSILNYEVLKEVELTIFISCKDDEELEFIKKKLESPCKYANLGRKEDFVIPSEKGCFVKEVELKEVMPMNTRDAIKENIKLKNTYVRVDLRDKENVETIINQGVLIALPYKYKDLEANRDDRVYEFCHYIYVDNDGIYPKNIKVNVCNVCIDTKEVFTWL

SEQ ID NO: 1401 - protein, 233 aa, Clostridioides difficile T23; identical to SEQ ID NO: 1367

SEQ ID NO: 1402 - protein, 268 aa, Clostridioides difficile E19
MKVLQCKLKQPTAHYRDPKVFQNEYISTLNLPSKTTIMGMITYLCDRRLNSDIDIGIIGTHHHRELEFSRGENIDFWNEYTNMRKGKDKEKFLLQGNYYDYYKEHKAQNSILNYEVLKEVELTIFISCKDDEELEFIKKKLESPCKYANLGRKEDFVIPSEKGCFVKEVELKEVMPMNTRDAIKENIKLKNTYVRVDLRDKENVETIINQGVLIALPYKYKDLEANRDDRVYEFCHYIYVDNDGIYPKNIKVNVCNVCIDTKEVFTWL

SEQ ID NO: 1403 - protein, 233 aa, Clostridioides difficile E19; identical to SEQ ID NO: 1367

SEQ ID NO: 1404 - protein, 233 aa, Clostridioides difficile E24; identical to SEQ ID NO: 1367

SEQ ID NO: 1405 - protein, 233 aa, Clostridioides difficile T42; identical to SEQ ID NO: 1367

SEQ ID NO: 1406 - protein, 233 aa, Clostridioides difficile T6; identical to SEQ ID NO: 1367

SEQ ID NO: 1407 - protein, 233 aa, Clostridioides difficile E14; identical to SEQ ID NO: 1367

SEQ ID NO: 1408 - protein, 233 aa, Clostridioides difficile T17; identical to SEQ ID NO: 1367

SEQ ID NO: 1409 - protein, 265 aa, Clostridioides difficile E9
MKVLQCKLKQPTAHYRDPKVFQNEYISTLNLPSKTTIMGMITYLCDRRLNSDIDIGIIGTHHHRELEFSRGENIDFWNEYTNMRKGKDKEKFLLQGNYYDYYKEHKAQNSILNYEVLKEVELTIFISCKDDEELEFIKKKLESPCKYANLGRKEDFVIPSEKGCFVKEVELKEVIPMNTRDAIKENIKLKNTYVRVDLRDKENVETIINQGVLIALPHKYKDLEANRDDRVYEFCHYIYVDNDGIYPKNIKVNVCIDTKEVFTWL

SEQ ID NO: 1410 - protein, 233 aa, Clostridioides difficile E7; identical to SEQ ID NO: 1367

SEQ ID NO: 1411 - protein, 233 aa, Clostridioides difficile T3; identical to SEQ ID NO: 1367

SEQ ID NO: 1412 - protein, 233 aa, Clostridioides difficile E28; identical to SEQ ID NO: 1367

SEQ ID NO: 1413 - protein, 233 aa, Clostridioides difficile E23
MKVLKLDLFQETACYKKPFAMKITETYPLPPYSTINGLIHKVLNATEYIPFNISVQGTYESIFNNYQTTYFYKKDSITSMPMNSHMLLNVNLIIHIGGDFDLLEEIYDSLLNYDEHLSLGRKEDLVRINDIRFVEVNKFEVDEDIQLDDYENYKLSECNIRMPIYIPKTSLQDTDIDGISYRLNNYYDNNAVEDKKRVWNKVDSYYVEDGNTISIGDILLDNEGDLLYFNNIN

SEQ ID NO: 1414 - protein, 265 aa, Clostridioides difficile E12; identical to SEQ ID NO: 1409

SEQ ID NO: 1415 - protein, 233 aa, Clostridioides difficile E12; identical to SEQ ID NO: 1367

SEQ ID NO: 1416 - protein, 265 aa, Clostridioides difficile T19
MKVLQCKLKQPTAHYRDPKVFQNEYISTLNLPSKTTIMGMITYLCDRRLNSDIDIGIIGTHHHRELEFSRGENIDFWNKYTNMRKGKDKEKFLLQGNYYDYYKEHKAQNSILNYEVLKEVELTIFISCKDDEELEFIRKKLESPCKYANLGRKEDFVIPSEKGCFVKEVALKEVIPMNTRDAIKENIKLKNTYVRVDLRDKENVETIINQGVLIALPHKYKDLEANRDDRVYEFCHYIYVDNDGIYPKNIKVNVCIDTKEVFTWL

SEQ ID NO: 1417 - protein, 233 aa, Clostridioides difficile T19; identical to SEQ ID NO: 1367

SEQ ID NO: 1418 - protein, 233 aa, Clostridioides difficile T10; identical to SEQ ID NO: 1413

SEQ ID NO: 1419 - protein, 265 aa, Clostridioides difficile T14; identical to SEQ ID NO: 1409

SEQ ID NO: 1420 - protein, 233 aa, Clostridioides difficile T14; identical to SEQ ID NO: 1367

SEQ ID NO: 1421 - protein, 233 aa, Clostridioides difficile T61; identical to SEQ ID NO: 1367

SEQ ID NO: 1422 - protein, 254 aa, Tepidanaerobacter acetatoxydans Re1; identical to SEQ ID NO: 1304

SEQ ID NO: 1423 - protein, 267 aa, Halorhabdus tiamatea SARL4B
MARQSLDESASEASGRPVPDRCLSLTVRGPWGHFRRVEGNIVKQTYRIMPRTTVAGLLAAVLGIGRDEYYELFGAEQSAIAIEPVRELRTVNMPMNTLSTAAGDLTSLNGRGKISIQLPDPTKLRQQHNYEVLVEPAYRIDVSLSDGNRFDELQSMLAAGKSHYVPSLGLSEHLADIEYHGTFDVEPIDRASDQFEVDSAVPGGFDDVIMDDDQRCQIEESPAFMTTDAGGRTTTAFTTYAYNPDARSLTVADANAARVGDRTVVFV

SEQ ID NO: 1424 - protein, 81 aa, Coprobacillus sp. CAG:183
MACMVIYGDFSNIADTYLSLVNWLQKMLSIRFQDPIALSVVEVIVIDYQTEIVSIPYIDINPYTPNLEESAYFAWADEFDF

SEQ ID NO: 1425 - protein, 252 aa, Anaerostipes sp. CAG:276
MEVCKVTLKGRTAFFKKPDVNSYYYFTYGQIHKVVLLGIFGAILGYSGYESIKTEKRKKDSAEGPGFPEFYERLKDCRFSIVPKNEKGWIPKKIQYFNNSVGYASREQGGNLIIKEQWLESPEWDIFILLDGEESRKLSETLMDRRCVYSPYLGKNDHPADLLNPEIMEAEEIPPENRQLDCLLPKGKVTFAYLDEDDDEEEDFYKYEEGLPYALDPYTNLYVTEPFVYTNQYVKECELPLYRAGKNIIVFY

SEQ ID NO: 1426 - protein, 237 aa, Hungateiclostridium thermocellum BC1; identical to SEQ ID NO: 1224

SEQ ID NO: 1427 - protein, 239 aa, Candidatus Contendobacter odensis Run_B_J11
MDTLSFRWSAKYGHFLRAEANVNALSYPTPPRTAVLGMLAAILGLEKDALATDLAGIRVAVSGAVPARFWHRVKLRKDPPTPLPWEVKRSQRGAENPAPEKAALINQEWLLKPNFLVHVAWPEQPARLAELAERIENRRWHFSPCMGLSELLCDVEFVARQVASPLPTGRHIVQGLCMADDVRLLTADNLGIHLLRLPHSVSANRVFRHVPYYLEHRGQPFPVETAAAWRVGEWTGLFS

SEQ ID NO: 1428 - protein, 253 aa, Clostridium tetani 12124569
MDALKFSLSGRTAFFKKPDVNSFYYFTYGNIHKVALLGILGAICGYGGYNRQCLNKEQIYPEFYGKLKDINIGIVPKNEKGYIDKKIQVFNNSVGYASKELGGNLIVKEQWLENPKWDIYILMDENVPKDLEDRLLNFKFKYIPYLGKNDHMANITDVEYLENIEKLDNTNKLDSIFIKDKYEIQKLDNDLFDMLNDSYKDVCEYKYEEMLPVSLDETTNKYNLETFIYTNSKLKSLTESKTYQCDSKNIFFF

SEQ ID NO: 1429 - protein, 220 aa, Clostridium bornimense
MKSLKIKIYQETVCYKKPFAFKVTETYPLPPYSTIIGMLHNVMGVRSGEYIPMDISVQGSYEEIFNTYNTTMFYKKKNVTSMPMNVHLLLGVNLIIHVLAEENILLQIIDGFKDSKESFTLGRREDLARLDSIKLVNLEKRYISKFSGEEYRLKNNAYIPQKYNYRVNGITYMLNKKYTTLNELRNWEKVEAIYVEKGELIDQEYLIDDDIIEQDIVFLG

SEQ ID NO: 1430 - protein, 201 aa, Campylobacter curvus 525.92
MGFLGAVIGEEQYHKLSDIKYSIKIDGQISKKSFVFNGIKFALSSSMHLKEGYQDASEKKQFYRELIKNPSYIIFLNLENLKDGYRKTIIKNLKEHKSAFTPYLGINFCIADFEWIDVKNCFLIEENESEIDTFTLLDDFIFDTASCDIKLTTARMACECEEARIFKDFNDFIIKVSGPNKIRSKNRKNIYQIDEDKVYFV

SEQ ID NO: 1431 - protein, 253 aa, Clostridium sporogenes ATCC 15579
MKAIRLKIYQNLVNYKKPTSFQLKESYPLPPYSTVSGMIHSICGFKDYKDMDISIQGNYYSKVNDLCTRYEFAGSSFEEGRHNIKLKSNEIDKKTGELKEKYYGVIRGVSTAELLVDVKLLIHIRPKDESLLNIIYKGLKNPKEYISLGRREDIARIDEVKIVDIEKMDTEDESKKLEYDAYIPVDMFNNSEFVSKSTIYNLNKCYEKVKVKKDVCIRQWKKVKVLHGVMNRDEINEEVKLLQDENNYPVFFA

SEQ ID NO: 1432 - protein, 249 aa, Clostridium hiranonis DSM 13275
MKVLKFKLSGNTAFFKNNEVNAYYYFTYGNIHKVALLGMLGAIMGYGGYQKQQNENAIYPEFYDRLKDLKIAIEPLTEVGQFAKKIHTFNNSVGYASDENGRNLIVKEQWLEEPAWNIYFLIDSEVGEELAEKIINRECVYIPYLGKNDHPANIEDVEIIENVEKVSDKNLIINSLFKYEERESYMIEDDDEEEEEDLKIIYRYTEYLPIGLDEKNNMYELAKFVFTNERIIKFNSQVFKAGEKNIVFY

SEQ ID NO: 1433 - protein, 245 aa, Anaerococcus hydrogenalis DSM 7454
MKALRFRLSGKTGFFKQPDVNTYLYYTYGQIHRVALLGLLGATLGYKGYNEKDREKYPEFYKKLRDLKISVVSEGNNGVFDRKLQAFNNSTAFASNEEGGNLIVKQVWLENPSWLIYILLDNDQSELIKEYILDKKTTFTPYLGTNDHMANISDCEIVDIEKSDENIIDSLFWSDDFKLRLKSKIYKYEENLPFFLEEDTERYIRKKTLASNGEVRKKTDKNVIFEDNDNKLKLVFYSEEGIYET

SEQ ID NO: 1434 - protein, 275 aa, Thermococcus sp. AM4
MAEKTLLIELFQPFAQYRNPFTFYYAQTYPLPPKSTIIGMLQNALNDWYGNERGIDEWWNLRVSVHGGFESVFWNYQQLIKATKTGISIVRFRGKPTLWNQKLPLYGFPVTSQRSPVLQQELFNGWLYILLKGEEEFLSEIKEALERPRKVISLGRSEDVVFPRRAEFIEGKKDEAREIGIKYPTYVRVPIEMLRKKEYPTYSIPIRVVFKNNGKPVKHKAEISVETFRDVDFRSVIYVGAWTFLKFSNKVSFEEYSFDGVQLKVVADEKASGWL

SEQ ID NO: 1435 - protein, 266 aa, Caldanaerobacter subterraneus subsp. pacificus DSM 12653
MKIAVFDLRGPFAHFRKYYTNTSSLSYPFPPRTVLMGIIAAILGWERDSYYEKLNPDNARFGVVIKVPVRSLFQTVNYIRTKEEDLNVMKKLGFMKGTQVPLELLLPGGGAPMLNYRIYFGHREEKITEEVAKRLKQNKPYFPLYLGLTEFIAQAQLVYFGEPSKVISAGKEVMLHSILTVDFLKQPFLTNGITLNREKAPEAFSEGRNLLPPKSYIYETQGRPWKAILSVDAYSFALPSGEENVAFMEGELWFTMPTENKKPSIA

SEQ ID NO: 1436 - protein, 241 aa, Bacteroides pectinophilus ATCC 43243
MVKAIRLQCYQNLANYRKPSSFIIKETYPLPPYSTVSGMIHAACGFKELHRMKLSIQGTNRGTISEVYTRYSFSAGAKYEEGRHQICLKDGENYGIYKGVANAELVCENNMIIHILPEREEDMDVIYNGLSNPLMYLSLGRYEDIIDIRSVDIVSLCEENDVETKHNIYVPVSYMRKQGYENINATVYTLNKEYEITKQGLRRWKPESEGGRVRAYYYPAGNVLDTAYVDDTEYQDAVVFA

SEQ ID NO: 1437 - protein, 363 aa, Anaerobutyricum hallii DSM 3353
MKAFRLIIKQTSANYRKPETIKNKMTYPLPPFSTVIGALHNACGYTEYKEMNLSIQGKYESMHREPYTDYCFLNRLEDDRGILVWLPNASFFSNAFVRVAHTQKSQGNSFRKGVTIQVENQNLLDEYRRLKDLNDSITEFKKTRLNPVLALIKKRKKTLKEKKKVRKQEGLDCIAVLTRENELKEIEKQIKEWFEKYKYENYTEPLSHFRNLVKSVKYYEILNNIELVIHVQASDEVLHDLEEHWTDIKSIGRSEDMVDVQEAKIVELQEKLNKEVNNIYSAYIDYDTIKRGNSEGVRIYPLGRKDKYVRGTVYYLNKNYEISPENGKRIFQKKKVVYTSNYEINKVGENVYIDEDEYIVNFI

SEQ ID NO: 1438 - protein, 249 aa, Anaerobutyricum hallii DSM 3353
MLIMKAIRVECFQNLVNYRKPSSFIIKETFPLPPYSTVLGMIHAACGFTTFHPMELSIQGKNKGTISELYTRYSFSAGVKFEEGRHQICVHDKEDYGVFKGIANVELICENNMILHILPSEEDFDTVYQSLLNPPQYLSLGRYEDLLDIKKVEIVHLSWEEEVSVHNNIYIPVDYETEDGERIFEDGEGGATIYNLTREYEITKNGLRRWKKDGGRVRAYYYPAGKVLDQGYVDDSEAESAVVFSKNIR

SEQ ID NO: 1439 - protein, 255 aa, Bacillus thuringiensis serovar huazhongensis BGSC 4BD1
MKAIAFELKGRTAFFKKPDVNANIYFTYSHIHKIALYGLLGAIIGAGGYTQQQKSIIDEGNSTSNQYPEFYQLLNKLKVSIVPHGDRGYFSKKSQVFNNTVGYASREAGGNLIVQEQWLENPHWTIYLWNDGSLEEEIFNNLKNHLISSAYKYLPYLGKNDHPANIEHVRLVELEEVDELCGIESLVYSKDVYFSTNGTYDNTPIFFFEEHIPIQLNPDLNYYEFDEIVHTNRKIKQTSSTLFAFQTEGRVIAFI

SEQ ID NO: 1440 - protein, 255 aa, Bacillus thuringiensis serovar pulsiensis BGSC 4CC1
MKAIAFELKGRTAFFKKPDVNANIYFTYSHIHKIALYGLLGAIIGAGGYAQQQKSIINEGNSTSNQYPEFYQLLNKLKVSIVPHGDRGYFSKKIQVFNNTVGYASRETGGNLIVQEQWLENPHWTIYLWNDGSLEEEIFNNLKNHLISSAYKYLPYLGTNDHPANIEHVRLVELEEVDELCGIESLVYSKDVYFSTNGTYDNTPIYFFEEQIPIQLNPDLNYYEFDEIVHTNRKIKQTSSTLFAFQTEGRVIAFI

SEQ ID NO: 1441 - protein, 81 aa, Coprobacillus sp. D7; identical to SEQ ID NO: 1424

SEQ ID NO: 1442 - protein, 359 aa, Fusobacterium periodonticum 2_1_31
MEALRIILKQSSANYRKAGTIDNKMTYPLPIPSTIIGALHNICEYTEYHPMDISIQGKFTSLSRKVYTDYCFLNSALDDRGNLIKVVDPNAFSGAFVKVASAKKSQGNSFKDRITIQVHNEELLQEYCNLKEKSKEIEELKNSEYKKKLEEFKTLKKEIADKKKKEDKKSEVFKQLSEEEKKIKLEEEKYKEEFKKFEYENYTKPYSHFQNLVTSLKSYEVLNDIFLILHVKADDETLKDIENNIFNLQSLGRSEDFVEVIECKIVELQEVEDIIESNFSMYINAKDFYEEKIFTETVDGEHSSGGTKYYLDKNYEIKKGKREFKKVPVIYSTSVLAEDSSENVKADIYNEETILVNFI

SEQ ID NO: 1443 - protein, 340 aa, Fusobacterium periodonticum 2_1_31
MEALRIVLKQSSANYRKAGTIDNKMTYPLPIPATVIGALHNICGYREYHSMDISIQGNFEAVSKDMYKNITVLNTISDRGTLVKMIAPNAISNAYIEVAEAVDDNANFITEKNIKIKNKELLEEFKNLKILKEKLDSEKKLKLEEFKTRKKELSDKDELKKIRSEEKNYKEEFKKFEDENYSKPYSQFRSIVKKPMFYELLNNIFLILHIKSDEKTLKDIENNIFNLQSIGRSEDFVEVVECKKVELQEFDTEIKSAEGLSIYLNYNDFQEEKIFNLDVDGNVVKSGTKYYLDKYYKIVNLKREFEKTLAIYSNYFKANNSSENVKLDEYNNTKLLVNFI

SEQ ID NO: 1444 - protein, 256 aa, Fusobacterium nucleatum subsp. animalis 7_1
MKALKFTLSGNSAFFKDNVINTVYLTYGNIHRVALLGMLGAILGYGGYSKQNDMLKKKNKKMPDYPEFYEKLKDIKISIVSNGKNGYFNKKLQTFNNSVGYASKEEGGNLIVKQFWLENPSWDIYILLDCDEAKKIADYIQNRKAIYLPYLGSNDHLANIMDVEIIDIEEKMSSEDETIEILSMIKDSDISEKKKNVFSMDKNSTRDDIYKYSEYLPVALSKELNQYEKEKMTITNMSVVLKKSYYKVEDKNIVFY

SEQ ID NO: 1445 - protein, 262 aa, Clostridium butyricum E4 str. BoNT E BL5262
MRILKFTLRGKSGFFKKPDVNSNLYFTYGNIHKVALTGLLGAVLGYGGYNSMNIKNIFNKKKKEAVQDFPEFYERLKDLKISIVPNGEKGFISKKVQIFNNSVGYASKEQGGNLIVKEQWLENPSWDIYIIIDDEESEKIEEAITKHKTVYTPYLGKNDHIADITNVQIINESQIAVNKEINKLDCLYLKDDFQINNVEDDFGDFSDDDIEDYFKYEEKLPYELEKNTNMYITKSFICTNMKIKKCSDIDVYRIKEKNIVFY

SEQ ID NO: 1446 - protein, 187 aa, Lactobacillus gasseri 202-4
MAKKRALDRSKVIDQAIAIISDKGLSELTMPALAKALGIRSQSLYHYVANRNDLLVLVCVNRLQVLRQYLMKKVIGHSGLDALFRFADEIRDFLLHDKAISGIYCGLNEYVQNEQIHEEVMKIVELGEKLDVDNKNIVSLHSLLGAVLGYVFLDRYVIDETEKEADDNYHEMLLRLVAPKLQVEGTK

SEQ ID NO: 1447 - protein, 247 aa, Clostridium botulinum E1 str. BoNT E Beluga
MNKKRAVRLEIYQNLVNYKKPTSFQLKESYPLPPPSTVIGMVHFACGYKEYHDMDVSIKGNFNSRVYDLYTRYEFAGASYEDKRHQLALLSNDGKTYGVTRGVATSELLVDVNLVLHICPKNQEEVQEIYENFRFPKEYISLGRREDLIQIKNVEIVELEEEYEDDDEIVDKRMNMYVPMEKIENREVESKATVYTLNKTYTKKTIKKDTEVRNWERVKVAYCVAEKTSVGYTDVYKDSNKEIVFLI

SEQ ID NO: 1448 - protein, 250 aa, Fusobacterium varium ATCC 27725
MEILKFTLSGRTAFFKIPEVNSYVYFSYGHIHKVSLLGLLGAVMGYEGYNSQGEKEFPEFYEKLKDIKISIMPKNTNGSFSKKIQIFNNSVGYASNEEGGNLIVKEQWLEDVEWDIFIKMEDTDIHKELKERMENYKFEYTIYLGKNDHLATINNVEVLQGESFLEDESEINSLFLRKDIEGFLEEEFNILGSEEDEIKYDYKYEEKLPISLDSISNQYKVESLIFTNKKCILKDKSNFAKINNQIIEFY

SEQ ID NO: 1449 - protein, 245 aa, Ruminococcus sp. 5_1_39BFAA
MRALKFTLSGKNAFFKKPEVNAYFYFTYGQIHRVALLGILGAIVGYKGYGCTGTYPEFYEKLKDLKVSVVPRNSQGYIQKKVQMFNNTVGYASQELGGNLIVREQWLENPVWDIYILLDSREADKIAEMILDKKCVYIPYMGKNDHLADICAAKVVELDVVTCENVVLSCLYEKKDGKLGIADEEEEEYEDEEEVPEFKYEEKLPVGIDSHLNLYQYETFCFTNMKVTLKGKKIFKTEDRMLVFY

SEQ ID NO: 1450 - protein, 237 aa, Clostridium phage D-1873
MRGFKFNVSGKTAFFKKPDINQYINFSYSHIHKPCILGLLGAIIGLDKDSYYNTLKHLKISIVPNKPYFNKSIQVYNNTTKFANKSLNNPTTLNVREQWLENVSWDIYIIAEDKDVIYDKIYEYIRGFKSVYNIYFGRKEHITSIMFIEDFDIQDVPEDVFQINGLFPYNIINEIGTNKSDESKDKVSYFLKETMPIRYNNKGLYDYSILVHTNHEIYKLNNTNNLYKINDNVLYFL

SEQ ID NO: 1451 - protein, 253 aa, Clostridium botulinum D str. 1873
MEVLKFNLKGETAFFKRPDVNTYVYFTYGNIHKIALLGILGAIMGYKGYNNQCNKIYKHEKEQCIYPEFYEKLKGLKVGIVPINHHGYNLKKVQTFNNSVGYASKEQGGNLIVKEQWLEKPKWEIYILIENEITRELADRLKNYKFKYIPYLGKNDHIADIGFVEVIKNAEKIHSVDKLDGLFMKKYFTLNLDNEDEEEESIWKYEESLPISLEEVTNKYELETFLMTNAIVNIKDYDEVQIYKCNNKNIYFF

SEQ ID NO: 1452 - protein, 245 aa, Anaerococcus vaginalis ATCC 51170
MKALRFRLSGKTGFFKQPDVNTYLYYTYGQIHRVALLGLLGAILGYKGYNEKDREKHPEFYKKLKDLKISIVSEGNDGIFDKKLQIFNNSTAFASNEEGGNLIVKQVWLENPSWLIYILLDNDQSKSIEEYILNKKTIFTPYLGTNDHMANISDCEIVDIEKSNAKIINSLFWDEDFKLRLKSKIYKYEENLPFFLEEDTERYIRKKTLASNGEVRKKSDKDVIFEDLDNKLKLVFYSEEGIYET

SEQ ID NO: 1453 - protein, 236 aa, Thermoanaerobacter ethanolicus CCSD1
MVIFDLYGKFAHFRKFYTNSSSLTYSVPPRTTAEGIIAALLGYERDTYYEILGAGSLHIAVRKMSKTKKIMQSVNYIKATSFNELHSPKQHTQVPFELLTGDSKVHYRFYVTHNDRCILSEINDRLVKNAPVFPLFFGSAPFTCYIKYIENVEWDWVASEDFQDIYTVIPSDKIEEIDITNTVGHLLKERMPRDFGENRTIKEVTTYVYEDEGRPIKVKVKGEFVKLSNGESIIFM

SEQ ID NO: 1454 - protein, 237 aa, Campylobacter gracilis RM3268
MDIIAFELSGDYAHFSHPATIYSSLTYPVPPKTAIMGLLGAIIGEMNYFKLNDIGYSVILSSQFRKKTMIFNGIKFALSSSMHIEQGYQDSSEKKQFYKELIKDPRYVIFVDLSALNASYKENIIDSLKAHRCVFTPYLGINFCIADFKYIEIKNCELVHEKESFIDTFVLMDDFIFDAQSFDIRLTTARMACGCEEGRIFKDFKDFVIKLSGNSQIKAKNRGNIYQINDYKVYFAK

SEQ ID NO: 1455 - protein, 240 aa, Listeria monocytogenes FSL R2-503; identical to SEQ ID NO: 1277

SEQ ID NO: 1456 - protein, 241 aa, Blautia hansenii DSM 20583
MEKAIRLQCFQNLANYRKPSSFIIKETFPLPPYSTVLGMIHAACEFTEFHPMKLSIQGTNAGTISELYTRYSFSSGSKYEEGRHQICIKDKENYGIFKGIANVELVCNNRMVIHIVPGEEDFQKVYESLKNPPKYLSLGRYEDILDIESVDIVNIFQEEEVTVKRDIYIPVDYETEEGEKLLENQSSTIYTLTKEYEITKQGMRRWKREGGRIRAYYIGAGETLEKAFIDDSGDEAAIIFA

SEQ ID NO: 1457 - protein, 237 aa, Hungateiclostridium thermocellum JW20; identical to SEQ ID NO: 1224

SEQ ID NO: 1458 - protein, 187 aa, Lactobacillus gasseri 224-1; identical to SEQ ID NO: 1446

SEQ ID NO: 1459 - protein, 236 aa, Dethiosulfovibrio peptidovorans DSM 11002
MATVFDVTSPMAMFRKPYTTTSSVSYAFPPPTAVAGLISAISGISNGSDKSGCGAQYWKDLSGTSIAVGIRGKVSWMSQALNMWNVKNPGKNAHIQVKHQFVARPRYRIYVSGGIEDRLDGYLKRGAFVYTPCLGTAYALADLEYVGRFGSASPDGGPLALDTIVPWTDGMTVDVLSSGGAFKERVPLQFDVGRGLVRACSVIYSPAGDGKVVVKERGELDVSLCGEDLVAWFPAW

SEQ ID NO: 1460 - protein, 359 aa, Fusobacterium periodonticum ATCC 33693
MEALRIILKQSSANYRKAGTIDNKMTYPLPIPSTIIGALHNICGYSEYHSMDISIQGKFTSLSRKVYTDYCFLNSALDDRGNLIKVVDPNAFSGAFVKVASAKKSQGNSFKDRITIQVHNEELLQEYCDLKEKSKEIEEIKNSEYKKKLEEFKALKKEIADKKKKEDKKSEVFKQLSDEEKKVKLEEEKYKEEFKKFEYENYTKPYSHFQNLVTSLKSYEVLNDIFLILHIKADEETLKDIENNIFNLQSLGRSEDFVEVIECKIVELQEVEDIIESNFSMYINAKDFYEEKIFTETVDGDHGSGGTKYYLDKNYKITKGKREFKKVPVIYSTRVQAEESSENVKVDFYNGEAILVNFI

SEQ ID NO: 1461 - protein, 240 aa, Listeria monocytogenes FSL J1-194; identical to SEQ ID NO: 1277

SEQ ID NO: 1462 - protein, 359 aa, Fusobacterium periodonticum 1_1_41FAA
MEALRIILKQSSANYRKAGTIDNKMTYPLPIPSTVIGALHNICGYTEYHSMDISIQGKFSSLSRKVYTDYCFLNSALDDRGNLVKVVDPDAFSGAFVKVASAKKSQGNSFKDRITIQVHNEELLQEYCNLKEKSKEIEELKNSEYKKKLEEFKVLKKEIADKKKKEDKKSEVFKKLSEEEKKIKLEEEKYKEEFKKFEYENYTKPYSHFQNLVTSLKSYEILNDIFLILHIKSDEETLKDIENNIFNLQSLGRSEDFVEVIECKIVELQEVEEVIENKLSMYINAKDFYEEKIFTETVDGDHGSGGTKYYLDKNYEIKKGKREFKKVTVIYSTRVQAEESSENVKADIYNEETILVNFI

SEQ ID NO: 1463 - protein, 366 aa, Fusobacterium nucleatum subsp. nucleatum ATCC 23726
MEALRIILKQSSANYRKAGTVDNKMTYPLPIPSTVIGALHNICGYTEYHSMDISIQGKFTSLSRRVYTDYCFLNSALDDRGNLVKVVDPDTFSGAFVKVASAKKSQGNSFKDRITIQVHNEELLQEYCNLKEKSKEIEELKNSEYKKKLEEFKLLKKEITDKKKKEDKKSETFKQLSEEEKKIKLEEEKYKEDFKNFEYESYTKPYSYFQNLVTSLKNYEVLNNIFLILHIKADKQTLKDIEENIYNLQSLGRSEDFVEVVECKMVELQEFLRNIRVSKFSMYLKNEDVSDKKIIPLAVDQDHQAGGTKYYLDKNYKLEKNRRIFKKVPVVYSNFIGAKNSSENVKLDYLEILSQDKKQEILVNFL

SEQ ID NO: 1464 - protein, 233 aa, Clostridioides difficile NAP08; identical to SEQ ID NO: 1381

SEQ ID NO: 1465 - protein, 246 aa, Clostridioides difficile NAP08; identical to SEQ ID NO: 1379

SEQ ID NO: 1466 - protein, 265 aa, Clostridioides difficile NAP08; identical to SEQ ID NO: 1380

SEQ ID NO: 1467 - protein, 246 aa, Clostridioides difficile NAP07; identical to SEQ ID NO: 1379

SEQ ID NO: 1468 - protein, 265 aa, Clostridioides difficile NAP07; identical to SEQ ID NO: 1380

SEQ ID NO: 1469 - protein, 233 aa, Clostridioides difficile NAP07; identical to SEQ ID NO: 1381

SEQ ID NO: 1470 - protein, 361 aa, Finegoldia magna ATCC 53516
MKILRIKIKQAQASYTREETVDNHTTYPLPPFSTIIGALHNACGYTSYRPMDISVQGKYGSMQREYYTNIGLLNNREEDRNFLVYLKNPQLLSKGFIQIGEGLKSQGNSFINRKTVRIDDEEYYSKYVDLMKKKKELDEENKNVVKPKIKELKDKEKEFKTEQKKYDKNSEEYADLKNKIEDIKKQYKLIDSEFKDKYKREYDDLQKHFKTLVKKPSMQEVLYDVELVIHIRTEDDTANDILENIQNFVSLGRSEDFIELIEAKETEICSPKSRVHLENDYKIYANLSEVTKEGNIGKFFIADGDNTREAKGTVYYISKDYLIENNRRVFNKIPCLYSSNIAIQKKSGGIVDDEGYILSLN

SEQ ID NO: 1471 - protein, 244 aa, Lysinibacillus fusiformis ZC1
MKGIRIEAYQNLVNYKKPTSFQLKESYPLPPYSTVIGMVHAACGFTSYVPMQVSIQGKYHAKVNDLWTRYEFAGSSYEQGRHQLKVELSDGKAQGITRGVSTTELLVDVELVLHIVPEDKQYIPIIIDALKSPAEYLSLGRREDLLQINVVTEVELEIQKMDEDKRVDFDIFIPQAMTKNDIYGKVGTSYRLNKTYKLLEIAKGKHIRQWEKVIVSHVPASSTNYLAAYENVLFDKDGYTVFLV

SEQ ID NO: 1472 - protein, 190 aa, Lactobacillus paragasseri JV-V03
MIILAKKRALDRSKVIDQAIAIISDKGLSELTMPALAKALGIRSQSLYHYVANRNDLLVLVCVNRLQVLRQHLTKKIIGHSGLDALFRFADEIRDFLLHDKAISGIYYGLNEYVQNEQIHEEVMKIVELGEKLDVDNKNIVSLHSLLGAVLGYVFLDRYVIDETEKEADDNYHEMLLRLVAPKLQVEGTK

SEQ ID NO: 1473 - protein, 240 aa, Listeria monocytogenes FSL N1-017; identical to SEQ ID NO: 1277

SEQ ID NO: 1474 - protein, 264 aa, Finegoldia magna ACS-171-V-Col3
MKAVKLHLFQDLVNYRKPMSFQIKETYPLPPYSTVIGMVHNMCRYSQYEPMNISVQGKYVSKVNDLYTRYEFKNGYKFEASRHQLNVNGFGVGRGISTTELLSQVELVIHVMPKDEDQVIEIYEAFKKPWEYPSLGRREDLVIIDDVKIVEVKECDVERSVYLDKDMYAYIPLKFSESSKDFDSDKYNYLNNSIYRSKAKSGVPHRGTKYILNKDYESLDYGNKKNPKKFRIWNKIEVLYTSHIYADSDFEILMDDTGDLVFFA

SEQ ID NO: 1475 - protein, 264 aa, Finegoldia magna BVS033A4
MKAVKLHLFQDLVNYRKPMSFQIKETYPLPPYSTVIGMVHNMCRYSQYEPMNISVQGKYVSKVNDLYTRYEFKNGYKFEASRHQLNVDGFGVGRGISTTELLSQVELVIHVMPKDEDQVIEIYEAFKKPWEYPSLGRREDLVIIEDVKIVEVKECDVERSVYLDKDMYAYIPLKFSESSKDFDSDKYNYLNNSIYRSKAKSGVPHRGTKYILNKDYDSVDYGNKKNPKKFRIWNKIEVLYTSHIYADSDFEILMDDMGDLVFFA

SEQ ID NO: 1476 - protein, 236 aa, Aminomonas paucivorans DSM 12260
MAAVFEVRGGLALFRKGYTTTSSVSFPLPPPTALGGLVAAILGIDSGASARGEQALYWDHLAGNRVALRILEPLRYFRGSLNFWNVKDPQKNTHVQVKHQFLKNVGYRIYLEGPLEEPLEEILSRGGFRYTPYLGVAYALGDLRWIGRWPKEDLPTGPVQVSSVVPEAEDLVFDVLASGGAFREILPYRMTRERGLADSLSVYFSPHPDQALVLKERGKADVARCGSDIVAFFPPW

SEQ ID NO: 1477 - protein, 190 aa, Lactobacillus gasseri MV-22; identical to SEQ ID NO: 1222

SEQ ID NO: 1478 - protein, 259 aa, Listeria seeligeri FSL N1-067
MKAIRVKLWQDLVNYKKPTSFQLKETYPLPPYSTVIGMIHTLCGFTSYHEMKISIQGKYFSKVNDLATRYEFKNGMTYDATRHQIKVDNYGVSRGISTVELLVDLELLIHIIPEDPALVPVIEKAFKEPIEYPSLGRREDIATIQAVDVVEVEKRKPKENKSVNICDDYNAYVPISLAESNVVRFKSQESSVGRDKLLGTRYLLTEKYERVNHGTEKAPKFFRKWRKKDVIYSSRIFVSKNDVFFLDKDDCLVFIEEEV

SEQ ID NO: 1479 - protein, 250 aa, Fusobacterium gonidiaformans 3-1-5R
MKAVRVILYQDLVNYRHPMSFQLKESYPLPPYSTVIGMVHNLCRYQEYHPMKISIQGKYISKTNDLYTRYEFKSGAKYDKSRHQMDAGGFGISRGIGTAELLSQVQLILHIRPENEDQIEEIIKAFKAPWEYPSLGRREDLAVIQEVEEVEITQRTHKDAKKKEDLYAYIPLEYLEEGLVEGRNTERGVKARGTKYLLNKRYYLENYGKEKDPKWIRRWEKVKVLYTSKITTKAMKQLWLDEDNYMVFEA

SEQ ID NO: 1480 - protein, 369 aa, Fusobacterium gonidiaformans 3-1-5R
MKALRIVLRQTSANYRKTGCLENKMTYPLPLPSTIIGALHNICDYKEYHPMDVSIQGKFSSLSKRAYTDYCFLNSVMDDRGILVKMANGNCLSNSFLRVASSKKPQGNSFKKRISIQVHDENLFGEYCHLKDISEEIKIKKDTVYKEKLSEFKKKKTELSSQKKLLDKNSEEYKKILEEEKKWKIEEKNYVEEFKKYEEENYTKPIKSYRSLVTSLKFYEILHDIFLILHIRAEEEVLKEIHDNIYRLTSLGRSEDFLEVEDCSVVELQEFQEDIYSKENANTSIYLNRKDVAEEKIFSFEVDSNHSSGGTKYYVNKNYTLEENKRIFTKIPVLYSMNFGAQESSENVKLDFWGTDSEGNKIPVLVNFL

SEQ ID NO: 1481 - protein, 368 aa, Fusobacterium necrophorum D12
MKALRIVLRQTSANYRKAGCLENKMTYPLPIPSTIIGALHNACGYTEYHPMDVSIQGKFSGLSKRAYTDYCFLNSVMDDRGILVKMANADCLSNSFVRVASSKKPQGNSFKKRISIQVHDEKLFEEYCRLKDISMEIKEQKDTVYKEKVAEFKQKKTELGGKKKKLEKIQKNINEYWKKKKDKNRRKKYLDDFKEYEEKNYSIPIKAYRSLVTSLKFYEILHDIFLIIHIRAEEKILHDIHENIYELRSLGRSEDFVEVEDCNFIELQDFQEDIYSKETLNTSMYLNRRDVEEGKIFNLEVDLDHASGGTKYYLDKEYSIQENKRIFTKIPVLYSSHFGAQESSENVKLDFWGKDEEGNKIPVIVNFL

SEQ ID NO: 1482 - protein, 251 aa, Fusobacterium ulcerans ATCC 49185
MEILKFTLSGRTAFFKIPEVNSYVYFSYGHIHKVSLLGLLGAVMGYGGYNSQGEKEYPEFYEKLKDIKISIMPKNTNGSFSKKIQFFNNSVGYASNEEGGNLIVKEQWLEDVEWDIFIKIEDTDIHKELKERMQNYNFEYTVYLGKNDHLATINDVEILQGENFLEDESEINSLFMKKSIEGFSEEEELDFLAPEEDEIKYDYKYEEKLPLSLHNISNQYVVETLIFTNKKCILKDKSNFAKVNNQIIEFY

SEQ ID NO: 1483 - protein, 369 aa, Fusobacterium gonidiaformans ATCC 25563
MKALRIVLRQTSANYRKTGCLENKMTYPLPLPSTIIGALHNICDYKEYHPMDVSIQGKFSSLSKRAYTDYCFLNSVMDDRGILVKMANGDCLSNSFLRVASSKKPQGNSFKKRISIQVHDENLFEEYCHLKDISEEIKIKKDTVYKEKLSEFKKKKTELSSQKKLLDKNSEEYKKILEEEKKWKIEEKNYVEEFKKYEEENYTKPIKSYRSLVTSLKFYEILHDIFLILHIRAEEEVLKEIHDNIYRLTSLGRSEDFLEVEDCSVVELQEFQEDIYSKENANTSIYLNRKDVAEEKIFSFEVDSNHSSGGTKYYVNKNYTLEENKRIFTKIPVLYSMNFGAQESSENVKLDFWGTDSEGNKIPVLVNFL

SEQ ID NO: 1484 - protein, 252 aa, Anaerostipes caccae; identical to SEQ ID NO: 1425

SEQ ID NO: 1485 - protein, 210 aa, Haladaptatus paucihalophilus DX253
MLAAVLGIGRDDYYDLFAPEKSAVAVEPVEPLRTVNMPMNTLSTANEAMQSLNSRGKLSVKLPDPTKLRQQHNYEVLVDPAYRLYVWLENGDRFEELATMLEDGRSHYVPSLGLSEHLAELEYHGIEAVEVGPTDGLVSVDSAVPNAVDRVVPETETRCQVEESPAFMTADSGGRTTTGFTSYAYNPDAGPLTVRDPETAVVGEKTVMFV

SEQ ID NO: 1486 - protein, 195 aa, Daphnia pulex
MGNFTSMTPGLTDMCSVLFLKGPTYEMSQLVSQHNPNAFFYSFEYEGRNSIFNYLFAVNTPPFPPGVSHADEMIYLFIFPFPSIPPGLNRTEEELSKKMLQVWTNFVIYGDPTPDGVTLLDGIPKFLPYNSVDEFYTAIDDVWRSEADYTLTYTITVDELNPPVAGRNFEASKRRSGRFQRPLSTKNNYRFLGYY

SEQ ID NO: 1487 - protein, 231 aa, Lachnospiraceae bacterium 6_1_37FAA
MNTYYYFTYGQIHKVALLGMLGAIAGYNGYAQKKWTVRKKGMDLIEEYPEFYEKLAGLKVSIVPRNERGYIPKKVQIFNNSVGYACEEQGGNLIIKEQWLENPVWDIYILLDCEEAEKISYQLEQYKCVYMPYLGKNDHPADISDVKIVKLETIDAKRSEIFSMFPKRIGEIDSLDDEDEIEEFKYEEKLPVRLNGYTNLYEYDTFCYTNIPVCVKEAGLYKDKMRILVFY

SEQ ID NO: 1488 - protein, 245 aa, Anaerococcus hydrogenalis ACS-025-V-Sch4
MKALRFRLSGKTGFFKQPDVNTYLYYTYGQIHRVALLGFLGAIVGYKGYNDKDRDKYPEFYKKLKDLKISVVSEGNNGVFDRKLQVFNNSTAFASNHQGGNLVIRQVWLENPSWLIYILLDNDQSKLIKEYILDKKTIFTPYLGTNDHMANISDCEIVDIEKSDENIIDSLFWSDDFKLRLKSKIYKYEENLPFFLEEDTERYIRKKTLASNGEVRKKTDKDVIFEDIDNKLKLVFYSEEGIYET

SEQ ID NO: 1489 - protein, 723 aa, Streptococcus sanguinis SK1059
MILFNLSAEQPELNEQEVAVDKLQALHEQFPDSRDIAESFAMILFNLSAEQSELNELEVTVDKLQALHEYFSNSRDIAESFAMILVNLSAEQSELNEQEVAADKLQALHEQFPDSRDIAESFAMILFNLSLKQSELNEREATVDKLQALHEKFPDSRDIAESFAMILFNLSAEKSELNELKATVDKLQALHEHFPNSRDIAESFARILFNLSAEQPELNEQEVAADKLQALHEQFPDSRDIAESFAMILFNLSIKKTEVRESEATVEKVQKLHGDFPKSEIIAFIYGVFLASLYDHQTEVDERLQTTETIKKIYEQFSEFMLQIFDNLFFYNDKVCFSEEYKLFNIILKEGLLRDTKYAILQMWAERYKEDSNELENLLSIYQYVQKIKYQLGLKDEVKKENLKFGHYTKGSVLQSLLEQKEDPNQFFISGKTRLNNANYMNDPEEGIIIEKILGLDRRDILEPSSWFLMSFTIKTDDLAMWSQYGDDSQGVCLVLREDDFSRFTSFNDVSWREGIRSLEFINKMESPISELSSNIKSSQSRSENEESDDTINDEGIEPNSEERRNVSKGNVDYLYRIAYVNDSGGKFSIEKTDLFNDYEIKNLETLLKDLKGKIDKENKGDVFYQKAISDCIEEIRYLFKSVDYKYEDELRILRYVNLVSDNTEIKIDKSSGMGKLYVERENPIRIGEVVFGPKFPNPEYVTPLLKLLDKDIMFKKSMIKFR

SEQ ID NO: 1490 - protein, 238 aa, Caldalkalibacillus thermarum TA2.A1
MRALRLRLFQETACYKKPFAYKVSETYPLPPYSTVKGMLHAVLEATEYIPMLLSIQGKYDTIVTDYQTHYFFKKDKTAEFPITLDGLALERNYTDITTMPIYMHLLYNVQLLIHVYAEEYVLKQLIKGFETQTTYLSLGRWEDLVRIDECELVELQLLKEGEERELAWNAFVPDYLLDDLTYMPYRLNWKYDVVHNVRIWEKVEAGYVQAGQTIEADEDPIYIDQDGELVFFHAKNLT

SEQ ID NO: 1491 - protein, 260 aa, Caldalkalibacillus thermarum TA2.A1
MRTLIFDIWGEWGHFRKYYSTSSPLTFSVLPPTAAYGILGAVLGLSKENNMYLTQLKEAHTRIGVGLIHPVKKIMFGLNLINTKGNVWVPKQRREGARTQIRTEFLKDARFRLFVAMDDEALYNKLVSHIKQHKTYYTVSLGLSELLANFQFVDEIDGHWKKSTGEPAEMHTVVPLSLIRHKGVRLQPGKRYKKERLPLDMNDARIVSAYEECLFDMNGQTIEADVAHYYEGTGNNGTIYRYVFLNERISESVVQQGEVL

SEQ ID NO: 1492 - protein, 256 aa, Lactobacillus ruminis SPM0211; identical to SEQ ID NO: 1324

SEQ ID NO: 1493 - protein, 234 aa, Lachnospiraceae bacterium 3_1_57FAA_CT1
MEILKFNLKGSHAFFKVPEVNTYYYFTYGNIHKVALLGMLGAIMGYKGYQMEDKDYPEFYEKLQYLNVSIVPEQKQGYFQKKIQVFNNSVGYASKEAGGNLIVKEQWLENPEWTIYIQIKDEESRELAERIMARKCTYMPYLGKNDHMADISGMCIVSGEERFPKNETADSLVPEGAVQFDWDDMTYRYEEYLPVGLKESTNLYRTHRFIFTDAEMDQCMQPVYKVEGRNLLFF

SEQ ID NO: 1494 - protein, 256 aa, Fusobacterium nucleatum subsp. animalis 11_3_2
MEALKFTLSGNSAFFKDNVINTVYLTYGNIHRVALLGMFGAILGYGGYSKQNDMLKKKNKKMPDYPEFYEKLKDIKISIVSNGKNGYFNKKLQTFNNSVGYASKEEGGNLIVKQFWLENPSWDIYILLDCDEAKKIADYIQNRKAIYLPYLGSNDHLANIMDVEIIDIEEKMSSEDETIEILSMIKDSDISEKKKTVFSMDKNSARDDIYKYSEYLPVALSKDLNQHEKEKMTITNMSVILKKSYYKVEDKNIVFY

SEQ ID NO: 1495 - protein, 210 aa, Clostridium botulinum C str. Stockholm
MGYKGYNNQCNKIYKHEKEQCIYPEFYEKLKGLKVGIVPINHHGYNLKKVQTFNNSVGYASKEQGGNLIVKEQWLEKPKWEIYILIENEITRELADRLKNYKFKYIPYLGKNDHIADIGFVEVIKNAEKIHSVDKLDGLFMKKYFTLNLDNEDEEEESIWKYEESLPISLEEVTNKYELETFLMTNAIVNIKDYDKVQIYKCNNKNIYFF

SEQ ID NO: 1496 - protein, 723 aa, Streptococcus sanguinis SK340; identical to SEQ ID NO: 1489

SEQ ID NO: 1497 - protein, 195 aa, Fusobacterium nucleatum subsp. animalis ATCC 51191
MLDYPEFYEKLKDIKISIVSNGKNGYFNKKLQTFNNSVGYASKEEGGNLIVKQFWLENPSWDIYILLDCDEAKKIADYIQNRKAIYLPYLGSNDHLANIMDIEIIDIEEKMSSEDETIEILSMVKDSDISEKKKNVFSIDKNSIRDDIYKYSEYLPVALSKELNQYEKEKMTITNMSVILKKSYYKVEDKNIVFY

SEQ ID NO: 1498 - protein, 71 aa, Fusobacterium nucleatum subsp. animalis ATCC 51191
MKALKFTLSGNSAFFKDNVINTVYLTYGNIHRVALLGMLGAILGYGGYSKQNDMLKKKIKKCLIIQNFMRN

SEQ ID NO: 1499 - protein, 238 aa, Thiorhodococcus drewsii AZ1
MRTLVFDICGEYGLFKKPYSPMSPVSYPLPPPPAVLGMLGAVLGLDKADYHNRLGWDRVRIGVGLRAPVRVFRAALNLLQTKDGTDAFFRPRAGQNIHTQVPCELLRAPGFRIHVAGLDVALADELAARLRAGRTAYTVTLGLASCLADLHWVGEWDAEPITGEAWQASTAVPLGAGLQVHYEESRRYHRLRIPAVMDAERTVHRYQEIVLTEDGQPIRGQGGTGVLHAIGPDIIAFL

SEQ ID NO: 1500 - protein, 217 aa, Peptoniphilus indolicus ATCC 29427
MRAIKMVALQDLVNYRKPMSFQIKESYPLPPYSTIIGMVHNLCKYESYIPMKVSVQGKYVSKTNDLYTRYEFNNGTKFEKGRHHINVDGYGVAQGISTVELLSQMELIIHIVPEDQERVQEIYSSLKTPWEYPSLGRREDLLNIKSVEIVDIVERKLEREEYLGENYYAYVPLKYIHFNGENYEESAYTFLDNILIEDSAFSTFQSGTKMLINKDYF

SEQ ID NO: 1501 - protein, 238 aa, Thiorhodospira sibirica ATCC 700588
MRTLVFEVSGEYALFKKPYSPMSPVSYPLPPPPAVLGMLGAILGLDKNAYHHTLQWAQVRVAVSPAAPLRFFRAALNLLQTKDGTDRYFRPRADKNTHTQVPFTFLREPRFRILVAGLASPHADAIATALQNGTSRYTVTLGLANCLADLRWIGEWNAEAISAGDYAVNTVLPLCEGMHLHYEAGRRYHRLRIPASMDPQRVVHRYQEIVLAEDAQPMRVRVPDGVLYHVNTGPVAFL

SEQ ID NO: 1502 - protein, 262 aa, Johnsonella ignava ATCC 51276
MKVMKAIRLCISQQTANYRIPTSFQLKESYPLPPYSTVIGFIHSICGYTEYEPMEISVQGRYYSKANDLFTRYEFKPEFKFDSSRHQLEVGGFGITRGTGNTEMLIDVELLLHIIPVNQDKAADIESACRCPRIYPSLGRYEDLAVINEVKSVDFSKKRLEENKHEEYSAYIPESMLLDDSVQLRDRNTKFGYSVNGTRYMINKNYERYNIGNEKNPKYIRRWNSLNVIYSGNIMAVKRNTFYIDEDGYILYIDPEFNQDKK

SEQ ID NO: 1503 - protein, 241 aa, Hungatella hathewayi WAL-18680
MEILKFTLKGKNAFFKMPEVNTYYYFTYGNIHKVALLGIFGAILGYNGYAQMTEEDQYPEFYERLKDISISIVPQKGSKGYIPKKVQSFNNSVGYASQEQGGNLIVKQQWLENPCWEVYVKIDSSEAEAIKKAIMNHTCVYVPYLGSNDHPADICDAEVLTGEFINDEEIAYIDSLFPAAKVELDYEDDDVTPYKYSEYLPIALDEHSLMYCMEKFYVTNIPVLCHECDVCRVGGKNIVFY

SEQ ID NO: 1504 - protein, 366 aa, Fusobacterium sp. oral taxon 370 str. F0437
MEALRIILKQSSANYRKAGTVDNKMTYPLPIPSTVIGALHNICGYTDYHSMDISIQGKFTSLSKRVYTDYCFLNSALDDRGNLVKVVDPDTFSGAFVKVASAKKSQGNSFKDRITIQVHNEELLQEYCNLKEKSKEIEELKNSEYKKKLEEFKLLKKEITDKKKKEDKKSETFKQLSEEEKKVKLEEEKYKEDFKKFEYESYTKPYSYFQNLVTSLKNYEILNDIFLILHIKANKQTLKDIEENIYNLQSLGRSEDFVEVVECKMVELQEFSRNIRVSKFSMYLKNEDVSDKKIIPLAVDQDHQAGGTKYYLDKNYKLEKNRRIFKKVPVIYSNFIGAKNSSENVKLDYLEILSQDKKQEILVNFL

SEQ ID NO: 1505 - protein, 223 aa, Clostridium sp. DL-VIII
MKALKLKLYQETVCYKKPYAFKVTETYPLPPYSTVIGMLHNIIGAGKDEYHQMEISVQGRYEGIFSTYNTTRFYNGDNITSMPLNVHMLYGVSLIIHVASDEDTLNKIYEGFKTTDTAFTLGRREDLVRLDDIKFVELNKLEKKDEFDEEQDIKLKYSIYVPDKYITSLRGIAYKINKVYKVVNALRKWEKVKVKYVEYDELLDNGEYYIDNDSIEKDIAFLA

SEQ ID NO: 1506 - protein, 265 aa, Clostridioides difficile 002-P50-2011; identical to SEQ ID NO: 1391

SEQ ID NO: 1507 - protein, 265 aa, Clostridioides difficile 050-P50-2011; identical to SEQ ID NO: 1391

SEQ ID NO: 1508 - protein, 265 aa, Clostridioides difficile 70-100-2010; identical to SEQ ID NO: 1409

SEQ ID NO: 1509 - protein, 233 aa, Clostridioides difficile 70-100-2010; identical to SEQ ID NO: 1367

SEQ ID NO: 1510 - protein, 231 aa, Desulfitobacterium hafniense DP7
MKGLAFDVLGTVGHFRRPDTTATQLTYPFITPTAAKGLVGAILGIEDFVTTDRVGIELLRPVRTVAQQMSMLGKDPGSTFNRPTTIELLVNPGYRIYYTGEEYTEQLLDFLTGERAVYTTYLGTAYALTKPILYRVYPEVSYPVAEGKEIEMRTVVPTALIREIVLKADRYYCRAGGYLYEYKGQRTFEKSVDFLYEKDGKPIAFIPKSDDLDSPLDLRVAQFGEDLVCLV

SEQ ID NO: 1511 - protein, 374 aa, Peptoanaerobacter stomatis
MKNSVLRLKLHQNKAHYRKEETVNNKMTYPLPTYSMIIGAIHNACNYKEYRPMDISIQGNYESIKREIYTDYCFLNSVMDDRGILVKLNNPKLLENGYKVIAKALKSQGNSFKKRITIEICDEKELDEYIRISDLRIKFQEENSSINQKISIKKDEIKKIKQEQKTKDKKSDEYKNMSDKINEINDEIKKIKDEFDERRKAEYLKPISYYASLTKSIKSYEVLYGVDLVIHIRSDEETLNDIKKNYHNITSVGRSEDFVDNIEISFVNISDEEDSFKHIKSKYKAYVDKEAVENKAIIKSNLSAHKVNFVPTRGTTYYINKNYVIENNKRVFEKKRVVYLSGYEFGLNINQYNYPNKDKGIYIDIDNKDIVSFL

SEQ ID NO: 1512 - protein, 168 aa, Peptoanaerobacter stomatis
MKNSVLRLKLHQNKAHYRKEETVNNKMTYPLPTYSMIIGAIHNACNYKEYRPMDISIQGSYESIKREIYTDYCFLNSVMDDRGILVKLNNPDLLENGYKVIAKALKSQGNSFKKRITIEICDEKELDEYIRISDLRIKFQEENSSINQKISIKKDRNKKNKTRTKNKR

SEQ ID NO: 1513 - protein, 230 aa, Bacillus smithii 7_3_47FAA
MKALRLKLYQQTACYKKPFAFKVSETYPLPPYSTVKGMLHAVLKANSLIPMKISIQGKYDTLVTDYQTHYFFKKDQTKEFALTFDGLGYEPILVDVTTMPIYMHMLYDVELLIHVQADEDVLLDLERNLKTTTTHLSLGRWEDLVRIDRCEMVELSDCEDEPVLKYNAYVPMKMITDETYFPYKLNWTYRIIQGVRVWNKIPVGYMLAGEPIGEFDSLSLDPYGDLVFFP

SEQ ID NO: 1514 - protein, 89 aa, Lactobacillus parafarraginis F0439
MQLDVQNKLKQLQNRLGNSATKTIEESVSDQSTNDHESKTDDHAESEAEKKPQTNSVVDSYKTDKVLSSDGTSYQAAPRKKKHWWQFGR

SEQ ID NO: 1515 - protein, 233 aa, Coprobacillus sp. 3_3_56FAA
MQALKFTLSGKTAFFRRPEVNTYYYFTFGNIHKVALLGIFGAILGYQGYNNTIELPEFYQKLKDIKLSILPHNKKGYFSKKMQYYNNSVGYASKEQGGNLIIKEQWLEDPCWDIVVLLDNEEANKLAKAIINKKCIFIPYLGKNDHPANITDPVIVDLEKRNIDEESLACLFPKGDFEEADDIDIDFYKYQESLPVGLNEKTGLYEYMTFIHTNLYMDEGSVYSFDEKNIVFY

SEQ ID NO: 1516 - protein, 81 aa, Coprobacillus sp. 3_3_56FAA; identical to SEQ ID NO: 1424

SEQ ID NO: 1517 - protein, 240 aa, Listeria innocua ATCC 33091; identical to SEQ ID NO: 1277

SEQ ID NO: 1518 - protein, 256 aa, Myroides odoratimimus CCUG 10230
MKIVSIDLCSDFGFFRKPDTNNTINLSYNMIHKPAVLGLLGAILGLGGYKKKDVLPDYYLKLKDLKIAIEPLMHDKGNFAKTAIKYTNTVGYANKGNNFLTEELTLVKPAYRIYLLLDESNELESKLLEYLKNANAEFVPYFGKNEFTAWWTKESFKEYSFEIPIEDLEHEVAIKSLFLKSMNVKDNKETPYPVFGSMEMVENTFVYFERLPDGFNEELMQYNLEDFAYTNFLIKNSKVLDNLYCLKELDAYVQFI

SEQ ID NO: 1519 - protein, 263 aa, Caldithrix abyssi DSM 13497
MEKLISIEFKAPMGFLKKPDINEGGGKQLYLTFNMLHKPALLGILGAVLGLEGYGNPGVFPEYLSKLERLLIGIEPLNAVKGNFTKTILQYNNTTGFASHEQGGNLVVAEQILLNPAFRCYLLLNTDNQLLSQLDAQLRQSQAEYIPYLGKNEFHLWWENYREYSFKPYTYDRDYRIQTIIRKGNQLFKEMKKEGGLGLPFLLGQSQNEPEFISFEELPVGFDKDLKQYQREMFAYTNYTFKKEFRLDGLFLVKEENIVIQLF

SEQ ID NO: 1520 - protein, 254 aa, Prevotella maculosa OT 289
MLISFDLCAQMGFLKKPDINDGIYLTYNMLHKPALLGMLGAIIGLRGYCQNGELPEYYQKLKHLKVGIQPLKCDKGNYVKETLCYNNGTGFASNEDGGNLVIKEQVLLRPSYRCFVLLDLSNPFEKTLYDNILSFRAEFLPYLGKNEFSVWWTNVQAYEDAHIFNFEKETHIVSLFRKEEAVSKYIVRFMSISTSNIPPFLYFERLPIGFSEELYQYEYGDFVYSNATFKPDMVNSLSSNDFYDIGNSQIVQLI

SEQ ID NO: 1521 - protein, 256 aa, Fusobacterium nucleatum subsp. animalis F0419
MKALKFTLSGDSAFFKDNVINTVYLTYGNIHRVALLGMFGAILGYGGYSKQNDMLKKKNKKMSDYPEFYEKLKDIKISIVSNGKNGYFNKKLQTFNNSVGYASKEEGGNLIVKQFWLENPSWDIYILLDCDEAKKIADYMQNRKAIYLPYLGSNDHLANIMDVEIIDIEEKMSSEDETIEILSMIKDSDISEKKKNVFSIDKNSIRDDIYKYSEYLPVTLSKELNQYEKEKMTITNMSIILKKSYYKVEDKNIVFY

SEQ ID NO: 1522 - protein, 257 aa, Mucilaginibacter paludis DSM 18603
MSQKLISIDLKANFAFFKKPDYNDGLLLSYNMLHKPALLGVLGAIIGLQGYQKKGELPAYYTRLKSLLINIEPIGSEKGNFQKVSVKYTNTVGYANQDGTLLIEETMLLKPCYRCYLLLDEEQPEHFKLYEYLKEGKAEFIPYLGKNEYQAWWLDEFTGENSFREYPVEEVNPTENFKLKGMFTGEKITPVLENSLDELEYITPYFYFERLPVDFIEKPFIQYNLGDFKHTNAQLSSTYTIGGRLFKIKHDHYIQLY

SEQ ID NO: 1523 - protein, 233 aa, Coprobacillus sp. 8_2_54BFAA; identical to SEQ ID NO: 1515

SEQ ID NO: 1524 - protein, 81 aa, Coprobacillus sp. 8_2_54BFAA; identical to SEQ ID NO: 1424

SEQ ID NO: 1525 - protein, 244 aa, Parageobacillus thermoglucosidasius TNO-09.020; identical to SEQ ID NO: 1314

SEQ ID NO: 1526 - protein, 190 aa, Lactobacillus gasseri CECT 5714; identical to SEQ ID NO: 1222

SEQ ID NO: 1527 - protein, 223 aa, Thermotoga sp. EMP
MVRMKVLVFDVSAPYALFRRPYTTTSSYTLPFPPRTTLLGLVGCVLGYSTPERLDSAKVAVQIKNPLKFLRTGTNFVETKKDKKASKRTRISLQLLKNPAYRVFFSWEDEDFERLKNLLEHSETIFTPYLGVASFIARLNYVGKYEATRVADFPCEVHTVVPNTVKLLPEPSHYLIFERVTRKMDKERNMLESAVYIFKRDLSPVKVEGGEVWRVGEQNIVWM

SEQ ID NO: 1528 - protein, 359 aa, Fusobacterium periodonticum D10; identical to SEQ ID NO: 1442

SEQ ID NO: 1529 - protein, 244 aa, Lysinibacillus fusiformis ZB2; identical to SEQ ID NO: 1471

SEQ ID NO: 1530 - protein, 271 aa, Natronorubrum sulfidifaciens JCM 14089
MEQESLEQWASDDTNGTNDSNAFPDRCLSFTVRGPWGHFRRIEGNIVKQTYRIIPRTTVAGLLAGVLGIERDGYYDLFAPEQSAVAIEPVHEIRTINMPMNTLSTAAGNLQSLNGRGKLSVKLPDPTTLRQQHNYEVLVDPAYRIDVSLRDDGRYRELREALKTGKSHYVPSLGLSEYLAEIEYHGEFDVEVGPNDDSVEIDSAVPNAVEDVVLEPGTRCEVEESPAFMTRDEGGRTTTGFTAYTYNPDADPLTVKNVTPSRVDERTVVFV

SEQ ID NO: 1531 - protein, 270 aa, Natronobacterium gregoryi SP2; identical to SEQ ID NO: 1340

SEQ ID NO: 1532 - protein, 262 aa, Natrinema pallidum DSM 3751
MTEHAPAGSELPDGAETCLSFTVSGPWGHFRRIEGNIVKQTYRVIPRTTVAGLIAAMLGIERDGYYDLFAPGESLVAIEPTSELRTMKLPMNTLSTADEHLASLNPRGKLSIKLPDPSKPRQQHNYEVLVDPAYRIDVWLDDDERYDQLRSLLESGESYYVPSLGLSEYLATVDYHGEFPIEQGPDGNTVAIDSTVPEAVDSIVPDPETRYQIEQTPAFMERDDGGRTTSAFVSYAYNPDGGSLTFTDVATYSVDDRTVVFT

SEQ ID NO: 1533 - protein, 262 aa, Natrinema gari JCM 14663
MTEHAPTGSGLPDGAETCLSFTVSGPWGHFRRIEGNIVKQTYRVIPRTTVAGLIAAMLGIERDGYYDLFAPGESLVAIEPTSELRTMKLPMNTLSTADEHLSSLNPRGKLSIKLPDPSKPRQQHNYEVLVDPAYRIDVWLDNDERYNQLRSLLESGESYYVPSLGLSEYLATVDYHGEFPIEQGPSDDTVAIDSTVPEAVDSIIPDPETRYQIEQTPAFMERDDGGRTTSAFVSYAYNPDGGPLTFTDVSTYSVDDRTVVFT

SEQ ID NO: 1534 - protein, 269 aa, Natrialba hulunbeirensis JCM 10989
MGQQSLETWTTEEDGSSDQPERCLSFTVRGPWGHFRRIEGNIVKQTYRIIPRTTVAGLIAAMLGIERDGYYDLFGPDQSAIAIEPENEVRTINMPMNTLSTADGNLQSLNGRGKISVKLPDPTTLRQQHNYEVLVDPAYRIDVALADDERYHELRSTLEDGRSHYVPSLGLSEYLAEIEYHGEFDVEPESVDGEQAVAVDSAVPDAVEDVVLEAGTRCEVEESPAFMATDSGGRTTTDFTAYTYNPDADPLAVRNVDPATVDDRTVVFV

SEQ ID NO: 1535 - protein, 269 aa, Natrialba chahannaoensis JCM 10990
MGQQSLETWTTGEDGSSDQPERCLSFTVRGPWGHFRRIEGNIVKQTYRIIPRTTVAGLIAAMLGIERDGYYDLFGPGQSAIAIEPENEIRTINMPMNTLSTADGNLQSLNGRGKISVKLPDPTTLRQQHNYEVLVDPAYRIDVALADDERYRELRSILQDGKSHYVPSLGLSEYLAEIEYHGEFDVESESVDGEQAVAVDSAVPDAVEDVVLEEGTRCEVEESPAFMATDSGGRTTTDFTAYTYNPDAEPLDVRNVDPATVDDRTVVFV

SEQ ID NO: 1536 - protein, 262 aa, Haloterrigena thermotolerans DSM 11552
MTEYAPAGSGLPDSAETCLSFTVSGPWGHFRRIEGNIVKQTYRVIPRTTVAGLIAAMLGIERDGYYDLFAPGESLVAIEPTSELRTMKLPMNTLSTADEHMASLNPRGKLSIKLPDPSKPRQQHNYEVLVDPAYRIDVWLDDDERYDQLRSLLESGESYYVPSLGLSEYLATVDYHGEFPIEQGPGGDTVAIDSTVPEAVDSIVPDPETRYQIEQTPAFMERDDGGRTTSAFVSYAYNPDGGSLTFTDVATYSVDDRTVVFT

SEQ ID NO: 1537 - protein, 264 aa, Haloferax sp. ATCC BAA-646
MEQESLDEWVGDDGGRPDRCLSFTVSGPWGHFRRVEGNVVKQTYRIIPRTTVAGLLAAVLGIERDGYYDLFAPDSSEIAIEPVRAVRTLNMPMNTLSTAGGNLQSLNGRGKISVKLPNPTALRQQHNYEVLVEPAYRVDVWLAETARYRELRELLEAGKSHYVPSLGLSEHLAEIDYHGEFDIESGSEAGRVEVDSAVPNAVDDVVLREGTRCQVEESPAFMQADAGGRTTTEFTTYAYNPDAEPLVIDGVDSVEVDGRNVVFV

SEQ ID NO: 1538 - protein, 264 aa, Haloferax sp. ATCC BAA-645; identical to SEQ ID NO: 1537

SEQ ID NO: 1539 - protein, 264 aa, Haloferax lucentense DSM 14919
MEQESLDEWVGDDGGRPDRCLSFTVSGPWGHFRRVEGNVVKQTYRIIPRTTVAGLLAAVLGIERDGYYDLFAPDSSEIAIEPVRAVRTLNMPMNTLSTAGGNLQSLNGRGKISVKLPNPTALRQQHNYEVLVEPAYRVDVWLAETARYRELRELLEAGKSHYVPSLGLSEHLAEIDYHGEFDIESGSEAGRVEVDSAVPNAVDDIVLREGMRCQVEESPAFMQADAGGRTTTEFTTYAYNPDAEPLVIDGVDSVEVDGRNVVFV

SEQ ID NO: 1540 - protein, 264 aa, Haloferax sp. ATCC BAA-644; identical to SEQ ID NO: 1537

SEQ ID NO: 1541 - protein, 264 aa, Haloferax alexandrinus JCM 10717; identical to SEQ ID NO: 1539

SEQ ID NO: 1542 - protein, 268 aa, Haloferax mediterranei ATCC 33500; identical to SEQ ID NO: 1332

SEQ ID NO: 1543 - protein, 265 aa, Haloferax denitrificans ATCC 35960
MEQESLDEWVDGGDDGRPERCLSFTVSGPWGHFRRVEGNVVKQTYRIIPRTTVAGLLAAVLGIERDGYYDLFAPGSSGIAIEPVRAVRTLNMPMNTLSTASGNLQSLNGRGKISVKLPNPTALRQQHNYEVLVEPAYRVDVWLAETARYRELREMLEAGKSHYVPSLGLSEHLAEIDYHGEFDVESASGAGRVEVDSAVPNAVDDVVLREGTRCQVEESPAFMRVDAGGRTTTEFTTYAYNPDAEPLVVDGVDSVEVDGRNVVFV

SEQ ID NO: 1544 - protein, 265 aa, Haloarcula argentinensis DSM 12282
MSQQSLDDWTADGNGGQPDRCLSFTIRGPWGHFRRIEGNIVKQTYRIIPRTTVAGLLAAVLGIERDGYYDLFAPDSSAVAIEPVREIRTVNMPMNTLSTAAGNLQSLNGRGKISVKLPDPTTLRQQHNYEVLVDPGYRIDVALADEQWYTELRETLAAGESHYVPSLGLSEHLADIKYHGEFDVANAPQTDTVEVDSAVPNAVDDVVLDAGTRCQIEESPAFMESDAGGRTTTGFTNYAYNPDADSLEVRDTTAASVDGRTVVFV

SEQ ID NO: 1545 - protein, 270 aa, Halobiforma nitratireducens JCM 10879
MGQQSLDAWEHDERDSAFPERCLSVTVRGPWGHFRRIEGNVVKQTYRIIPRTTVAGLFAAVLGIERDGYYELFGPNRSAIAIEPVREIRTINMPMNTLSTADGDLQSLNGRGKLSVKLPDPTTLRQQHNYEVLVEPAYRIDVALADEERYRELRSMLEDGRSHYVPSLGLSEHLAELEYHGEFDVEPGPKATADDQPVAVDSAVPDGVEDVIFEAGTRCQVEESPAFMATDPGGRTTTEFTTYTYNPDAKPLRIRNVDAATVDGRTVVFV

SEQ ID NO: 1546 - protein, 256 aa, Fusobacterium nucleatum subsp. polymorphum F0401; identical to SEQ ID NO: 1444

SEQ ID NO: 1547 - protein, 187 aa, Lactobacillus gasseri 2016; identical to SEQ ID NO: 1446

SEQ ID NO: 1548 - protein, 233 aa, Clostridioides difficile CD3; identical to SEQ ID NO: 1367

SEQ ID NO: 1549 - protein, 233 aa, Clostridioides difficile CD9; identical to SEQ ID NO: 1367

SEQ ID NO: 1550 - protein, 233 aa, Clostridioides difficile CD8; identical to SEQ ID NO: 1367

SEQ ID NO: 1551 - protein, 265 aa, Clostridioides difficile CD9; identical to SEQ ID NO: 1409

SEQ ID NO: 1552 - protein, 265 aa, Clostridioides difficile CD8; identical to SEQ ID NO: 1409

SEQ ID NO: 1553 - protein, 233 aa, Clostridioides difficile CD13; identical to SEQ ID NO: 1367

SEQ ID NO: 1554 - protein, 233 aa, Clostridioides difficile CD17; identical to SEQ ID NO: 1367

SEQ ID NO: 1555 - protein, 233 aa, Clostridioides difficile CD18; identical to SEQ ID NO: 1367

SEQ ID NO: 1556 - protein, 233 aa, Clostridioides difficile CD21; identical to SEQ ID NO: 1367

SEQ ID NO: 1557 - protein, 233 aa, Clostridioides difficile CD22; identical to SEQ ID NO: 1367

SEQ ID NO: 1558 - protein, 233 aa, Clostridioides difficile CD38; identical to SEQ ID NO: 1367

SEQ ID NO: 1559 - protein, 233 aa, Clostridioides difficile CD40; identical to SEQ ID NO: 1413

SEQ ID NO: 1560 - protein, 233 aa, Clostridioides difficile CD41; identical to SEQ ID NO: 1367

SEQ ID NO: 1561 - protein, 265 aa, Clostridioides difficile CD41; identical to SEQ ID NO: 1409

SEQ ID NO: 1562 - protein, 233 aa, Clostridioides difficile CD39; identical to SEQ ID NO: 1367

SEQ ID NO: 1563 - protein, 233 aa, Clostridioides difficile CD42; identical to SEQ ID NO: 1367

SEQ ID NO: 1564 - protein, 265 aa, Clostridioides difficile CD43
MKVLQCKLKQPTAHYRDPKVFQNEYISTLNLPSKTTIMGMITYLCDRRLNSDIDIGIIGTHHHRELEFSRGENIDFWNEYIKMGKGKDKEKFLLKGNYYDYYKEHKAQNSILNYEVLKEVELTIFISCKDDEELEFIRKKLESPCKYANLGRKEDFVIPSEKGCFVKEVKLKEVIPMNTRDAIKENIKLKNTYVRVDLRDKENVETIINQGVLIALPHKYKDLEANRDDRVYEFCHYIYVDNDGIYPKNIKVNVCIDTKEVFTWL

SEQ ID NO: 1565 - protein, 233 aa, Clostridioides difficile CD44; identical to SEQ ID NO: 1367

SEQ ID NO: 1566 - protein, 233 aa, Clostridioides difficile CD45; identical to SEQ ID NO: 1367

SEQ ID NO: 1567 - protein, 265 aa, Clostridioides difficile CD45; identical to SEQ ID NO: 1564

SEQ ID NO: 1568 - protein, 233 aa, Clostridioides difficile CD46; identical to SEQ ID NO: 1367

SEQ ID NO: 1569 - protein, 233 aa, Clostridioides difficile CD47; identical to SEQ ID NO: 1413

SEQ ID NO: 1570 - protein, 233 aa, Clostridioides difficile CD49; identical to SEQ ID NO: 1367

SEQ ID NO: 1571 - protein, 265 aa, Clostridioides difficile CD51; identical to SEQ ID NO: 1564

SEQ ID NO: 1572 - protein, 265 aa, Clostridioides difficile CD68; identical to SEQ ID NO: 1564

SEQ ID NO: 1573 - protein, 233 aa, Clostridioides difficile CD104; identical to SEQ ID NO: 1367

SEQ ID NO: 1574 - protein, 233 aa, Clostridioides difficile CD70; identical to SEQ ID NO: 1367

SEQ ID NO: 1575 - protein, 265 aa, Clostridioides difficile CD104; identical to SEQ ID NO: 1409

SEQ ID NO: 1576 - protein, 233 aa, Clostridioides difficile CD109; identical to SEQ ID NO: 1367

SEQ ID NO: 1577 - protein, 265 aa, Clostridioides difficile CD131; identical to SEQ ID NO: 1564

SEQ ID NO: 1578 - protein, 233 aa, Clostridioides difficile CD129; identical to SEQ ID NO: 1413

SEQ ID NO: 1579 - protein, 233 aa, Clostridioides difficile CD132; identical to SEQ ID NO: 1367

SEQ ID NO: 1580 - protein, 265 aa, Clostridioides difficile CD133; identical to SEQ ID NO: 1564

SEQ ID NO: 1581 - protein, 233 aa, Clostridioides difficile CD144; identical to SEQ ID NO: 1367

SEQ ID NO: 1582 - protein, 265 aa, Clostridioides difficile CD149; identical to SEQ ID NO: 1564

SEQ ID NO: 1583 - protein, 233 aa, Clostridioides difficile CD159; identical to SEQ ID NO: 1367

SEQ ID NO: 1584 - protein, 233 aa, Clostridioides difficile CD165; identical to SEQ ID NO: 1367

SEQ ID NO: 1585 - protein, 265 aa, Clostridioides difficile CD166; identical to SEQ ID NO: 1564

SEQ ID NO: 1586 - protein, 265 aa, Clostridioides difficile CD169; identical to SEQ ID NO: 1409

SEQ ID NO: 1587 - protein, 265 aa, Clostridioides difficile CD170; identical to SEQ ID NO: 1564

SEQ ID NO: 1588 - protein, 265 aa, Clostridioides difficile CD175; identical to SEQ ID NO: 1391

SEQ ID NO: 1589 - protein, 265 aa, Clostridioides difficile CD178; identical to SEQ ID NO: 1409

SEQ ID NO: 1590 - protein, 233 aa, Clostridioides difficile CD181; identical to SEQ ID NO: 1413

SEQ ID NO: 1591 - protein, 265 aa, Clostridioides difficile CD200; identical to SEQ ID NO: 1564

SEQ ID NO: 1592 - protein, 233 aa, Clostridioides difficile CD196; identical to SEQ ID NO: 1367

SEQ ID NO: 1593 - protein, 233 aa, Clostridioides difficile CD206; identical to SEQ ID NO: 1367

SEQ ID NO: 1594 - protein, 265 aa, Clostridioides difficile CD206; identical to SEQ ID NO: 1409

SEQ ID NO: 1595 - protein, 265 aa, Clostridioides difficile CD201; identical to SEQ ID NO: 1409

SEQ ID NO: 1596 - protein, 233 aa, Clostridioides difficile CD212; identical to SEQ ID NO: 1367

SEQ ID NO: 1597 - protein, 265 aa, Clostridioides difficile CD212; identical to SEQ ID NO: 1409

SEQ ID NO: 1598 - protein, 233 aa, Clostridioides difficile 342; identical to SEQ ID NO: 1413

SEQ ID NO: 1599 - protein, 265 aa, Clostridioides difficile 655; identical to SEQ ID NO: 1564

SEQ ID NO: 1600 - protein, 233 aa, Clostridioides difficile 824; identical to SEQ ID NO: 1367

SEQ ID NO: 1601 - protein, 233 aa, Clostridioides difficile 840; identical to SEQ ID NO: 1367

SEQ ID NO: 1602 - protein, 233 aa, Clostridioides difficile 842; identical to SEQ ID NO: 1367

SEQ ID NO: 1603 - protein, 265 aa, Clostridioides difficile 6042; identical to SEQ ID NO: 1564

SEQ ID NO: 1604 - protein, 233 aa, Clostridioides difficile 6041; identical to SEQ ID NO: 1413

SEQ ID NO: 1605 - protein, 233 aa, Clostridioides difficile DA00044; identical to SEQ ID NO: 1367

SEQ ID NO: 1606 - protein, 265 aa, Clostridioides difficile 6057; identical to SEQ ID NO: 1564

SEQ ID NO: 1607 - protein, 233 aa, Clostridioides difficile DA00062; identical to SEQ ID NO: 1367

SEQ ID NO: 1608 - protein, 265 aa, Clostridioides difficile DA00065; identical to SEQ ID NO: 1391

SEQ ID NO: 1609 - protein, 233 aa, Clostridioides difficile DA00114; identical to SEQ ID NO: 1367

SEQ ID NO: 1610 - protein, 233 aa, Clostridioides difficile DA00126; identical to SEQ ID NO: 1367

SEQ ID NO: 1611 - protein, 233 aa, Clostridioides difficile DA00129; identical to SEQ ID NO: 1367

SEQ ID NO: 1612 - protein, 265 aa, Clostridioides difficile DA00129; identical to SEQ ID NO: 1564

SEQ ID NO: 1613 - protein, 233 aa, Clostridioides difficile DA00128; identical to SEQ ID NO: 1413

SEQ ID NO: 1614 - protein, 233 aa, Clostridioides difficile DA00131; identical to SEQ ID NO: 1367

SEQ ID NO: 1615 - protein, 265 aa, Clostridioides difficile DA00132; identical to SEQ ID NO: 1564

SEQ ID NO: 1616 - protein, 265 aa, Clostridioides difficile DA00134; identical to SEQ ID NO: 1409

SEQ ID NO: 1617 - protein, 265 aa, Clostridioides difficile DA00141; identical to SEQ ID NO: 1409

SEQ ID NO: 1618 - protein, 233 aa, Clostridioides difficile DA00142; identical to SEQ ID NO: 1367

SEQ ID NO: 1619 - protein, 233 aa, Clostridioides difficile DA00149; identical to SEQ ID NO: 1367

SEQ ID NO: 1620 - protein, 233 aa, Clostridioides difficile DA00154; identical to SEQ ID NO: 1367

SEQ ID NO: 1621 - protein, 233 aa, Clostridioides difficile DA00160; identical to SEQ ID NO: 1367

SEQ ID NO: 1622 - protein, 233 aa, Clostridioides difficile DA00165; identical to SEQ ID NO: 1367

SEQ ID NO: 1623 - protein, 233 aa, Clostridioides difficile DA00167; identical to SEQ ID NO: 1413

SEQ ID NO: 1624 - protein, 233 aa, Clostridioides difficile DA00183; identical to SEQ ID NO: 1367

SEQ ID NO: 1625 - protein, 233 aa, Clostridioides difficile DA00174; identical to SEQ ID NO: 1367

SEQ ID NO: 1626 - protein, 233 aa, Clostridioides difficile DA00191; identical to SEQ ID NO: 1367

SEQ ID NO: 1627 - protein, 233 aa, Clostridioides difficile DA00189; identical to SEQ ID NO: 1367

SEQ ID NO: 1628 - protein, 233 aa, Clostridioides difficile DA00193; identical to SEQ ID NO: 1367

SEQ ID NO: 1629 - protein, 233 aa, Clostridioides difficile DA00196; identical to SEQ ID NO: 1367

SEQ ID NO: 1630 - protein, 233 aa, Clostridioides difficile DA00195; identical to SEQ ID NO: 1367

SEQ ID NO: 1631 - protein, 233 aa, Clostridioides difficile DA00197; identical to SEQ ID NO: 1367

SEQ ID NO: 1632 - protein, 233 aa, Clostridioides difficile DA00203; identical to SEQ ID NO: 1367

SEQ ID NO: 1633 - protein, 233 aa, Clostridioides difficile DA00210; identical to SEQ ID NO: 1367

SEQ ID NO: 1634 - protein, 265 aa, Clostridioides difficile DA00212; identical to SEQ ID NO: 1564

SEQ ID NO: 1635 - protein, 265 aa, Clostridioides difficile DA00215; identical to SEQ ID NO: 1409

SEQ ID NO: 1636 - protein, 233 aa, Clostridioides difficile DA00232; identical to SEQ ID NO: 1367

SEQ ID NO: 1637 - protein, 233 aa, Clostridioides difficile DA00238; identical to SEQ ID NO: 1413

SEQ ID NO: 1638 - protein, 233 aa, Clostridioides difficile DA00216; identical to SEQ ID NO: 1367

SEQ ID NO: 1639 - protein, 233 aa, Clostridioides difficile DA00244; identical to SEQ ID NO: 1367

SEQ ID NO: 1640 - protein, 265 aa, Clostridioides difficile DA00246; identical to SEQ ID NO: 1564

SEQ ID NO: 1641 - protein, 233 aa, Clostridioides difficile DA00245; identical to SEQ ID NO: 1367

SEQ ID NO: 1642 - protein, 233 aa, Clostridioides difficile DA00261; identical to SEQ ID NO: 1367

SEQ ID NO: 1643 - protein, 233 aa, Clostridioides difficile DA00273; identical to SEQ ID NO: 1413

SEQ ID NO: 1644 - protein, 233 aa, Clostridioides difficile DA00275; identical to SEQ ID NO: 1367

SEQ ID NO: 1645 - protein, 233 aa, Clostridioides difficile DA00256; identical to SEQ ID NO: 1367

SEQ ID NO: 1646 - protein, 233 aa, Clostridioides difficile DA00305; identical to SEQ ID NO: 1413

SEQ ID NO: 1647 - protein, 233 aa, Clostridioides difficile DA00306; identical to SEQ ID NO: 1367

SEQ ID NO: 1648 - protein, 233 aa, Clostridioides difficile DA00307; identical to SEQ ID NO: 1413

SEQ ID NO: 1649 - protein, 233 aa, Clostridioides difficile DA00310; identical to SEQ ID NO: 1367

SEQ ID NO: 1650 - protein, 233 aa, Clostridioides difficile DA00313; identical to SEQ ID NO: 1367

SEQ ID NO: 1651 - protein, 265 aa, Clostridioides difficile F152; identical to SEQ ID NO: 1564

SEQ ID NO: 1652 - protein, 233 aa, Clostridioides difficile F249; identical to SEQ ID NO: 1367

SEQ ID NO: 1653 - protein, 233 aa, Clostridioides difficile F253; identical to SEQ ID NO: 1367

SEQ ID NO: 1654 - protein, 233 aa, Clostridioides difficile F314; identical to SEQ ID NO: 1367

SEQ ID NO: 1655 - protein, 265 aa, Clostridioides difficile F501; identical to SEQ ID NO: 1564

SEQ ID NO: 1656 - protein, 265 aa, Clostridioides difficile Y10; identical to SEQ ID NO: 1564

SEQ ID NO: 1657 - protein, 233 aa, Clostridioides difficile Y21; identical to SEQ ID NO: 1367

SEQ ID NO: 1658 - protein, 265 aa, Clostridioides difficile Y41; identical to SEQ ID NO: 1564

SEQ ID NO: 1659 - protein, 233 aa, Clostridioides difficile Y165; identical to SEQ ID NO: 1367

SEQ ID NO: 1660 - protein, 265 aa, Clostridioides difficile Y155; identical to SEQ ID NO: 1564

SEQ ID NO: 1661 - protein, 265 aa, Clostridioides difficile Y171; identical to SEQ ID NO: 1564

SEQ ID NO: 1662 - protein, 233 aa, Clostridioides difficile Y215; identical to SEQ ID NO: 1367

SEQ ID NO: 1663 - protein, 233 aa, Clostridioides difficile Y202; identical to SEQ ID NO: 1367

SEQ ID NO: 1664 - protein, 233 aa, Clostridioides difficile Y231; identical to SEQ ID NO: 1367

SEQ ID NO: 1665 - protein, 233 aa, Clostridioides difficile Y247; identical to SEQ ID NO: 1367

SEQ ID NO: 1666 - protein, 233 aa, Clostridioides difficile Y270; identical to SEQ ID NO: 1367

SEQ ID NO: 1667 - protein, 233 aa, Clostridioides difficile Y266; identical to SEQ ID NO: 1367

SEQ ID NO: 1668 - protein, 265 aa, Clostridioides difficile Y312; identical to SEQ ID NO: 1564

SEQ ID NO: 1669 - protein, 265 aa, Clostridioides difficile Y307; identical to SEQ ID NO: 1564

SEQ ID NO: 1670 - protein, 233 aa, Clostridioides difficile Y343; identical to SEQ ID NO: 1367

SEQ ID NO: 1671 - protein, 233 aa, Clostridioides difficile Y358; identical to SEQ ID NO: 1367

SEQ ID NO: 1672 - protein, 265 aa, Clostridioides difficile Y381; identical to SEQ ID NO: 1409

SEQ ID NO: 1673 - protein, 233 aa, Clostridioides difficile Y384; identical to SEQ ID NO: 1367

SEQ ID NO: 1674 - protein, 233 aa, Clostridioides difficile Y401; identical to SEQ ID NO: 1367

SEQ ID NO: 1675 - protein, 233 aa, Clostridioides difficile P1; identical to SEQ ID NO: 1413

SEQ ID NO: 1676 - protein, 233 aa, Clostridioides difficile P2; identical to SEQ ID NO: 1367

SEQ ID NO: 1677 - protein, 233 aa, Clostridioides difficile P3; identical to SEQ ID NO: 1367

SEQ ID NO: 1678 - protein, 233 aa, Clostridioides difficile P5; identical to SEQ ID NO: 1367

SEQ ID NO: 1679 - protein, 265 aa, Clostridioides difficile P5; identical to SEQ ID NO: 1409

SEQ ID NO: 1680 - protein, 233 aa, Clostridioides difficile P6; identical to SEQ ID NO: 1413

SEQ ID NO: 1681 - protein, 233 aa, Clostridioides difficile P7; identical to SEQ ID NO: 1367

SEQ ID NO: 1682 - protein, 265 aa, Clostridioides difficile P7; identical to SEQ ID NO: 1409

SEQ ID NO: 1683 - protein, 265 aa, Clostridioides difficile P8; identical to SEQ ID NO: 1564

SEQ ID NO: 1684 - protein, 233 aa, Clostridioides difficile P9; identical to SEQ ID NO: 1367

SEQ ID NO: 1685 - protein, 233 aa, Clostridioides difficile P11; identical to SEQ ID NO: 1367

SEQ ID NO: 1686 - protein, 233 aa, Clostridioides difficile P13; identical to SEQ ID NO: 1367

SEQ ID NO: 1687 - protein, 265 aa, Clostridioides difficile P15; identical to SEQ ID NO: 1564

SEQ ID NO: 1688 - protein, 233 aa, Clostridioides difficile P19; identical to SEQ ID NO: 1367

SEQ ID NO: 1689 - protein, 233 aa, Clostridioides difficile P21; identical to SEQ ID NO: 1367

SEQ ID NO: 1690 - protein, 233 aa, Clostridioides difficile P20; identical to SEQ ID NO: 1367

SEQ ID NO: 1691 - protein, 233 aa, Clostridioides difficile P23; identical to SEQ ID NO: 1367

SEQ ID NO: 1692 - protein, 233 aa, Clostridioides difficile P25; identical to SEQ ID NO: 1367

SEQ ID NO: 1693 - protein, 233 aa, Clostridioides difficile P24; identical to SEQ ID NO: 1367

SEQ ID NO: 1694 - protein, 233 aa, Clostridioides difficile P29; identical to SEQ ID NO: 1413

SEQ ID NO: 1695 - protein, 265 aa, Clostridioides difficile P29; identical to SEQ ID NO: 1564

SEQ ID NO: 1696 - protein, 233 aa, Clostridioides difficile P32; identical to SEQ ID NO: 1367

SEQ ID NO: 1697 - protein, 233 aa, Clostridioides difficile P38; identical to SEQ ID NO: 1367

SEQ ID NO: 1698 - protein, 265 aa, Clostridioides difficile P42; identical to SEQ ID NO: 1564

SEQ ID NO: 1699 - protein, 233 aa, Clostridioides difficile P46; identical to SEQ ID NO: 1367

SEQ ID NO: 1700 - protein, 233 aa, Clostridioides difficile P45; identical to SEQ ID NO: 1367

SEQ ID NO: 1701 - protein, 233 aa, Clostridioides difficile P48; identical to SEQ ID NO: 1367

SEQ ID NO: 1702 - protein, 265 aa, Clostridioides difficile P48; identical to SEQ ID NO: 1409

SEQ ID NO: 1703 - protein, 233 aa, Clostridioides difficile P50; identical to SEQ ID NO: 1367

SEQ ID NO: 1704 - protein, 233 aa, Clostridioides difficile P49; identical to SEQ ID NO: 1367

SEQ ID NO: 1705 - protein, 265 aa, Clostridioides difficile P49; identical to SEQ ID NO: 1564

SEQ ID NO: 1706 - protein, 233 aa, Clostridioides difficile P51; identical to SEQ ID NO: 1413

SEQ ID NO: 1707 - protein, 265 aa, Clostridioides difficile P61; identical to SEQ ID NO: 1409

SEQ ID NO: 1708 - protein, 233 aa, Clostridioides difficile P59; identical to SEQ ID NO: 1367

SEQ ID NO: 1709 - protein, 233 aa, Clostridioides difficile P78; identical to SEQ ID NO: 1367

SEQ ID NO: 1710 - protein, 265 aa, Clostridioides difficile P69; identical to SEQ ID NO: 1564

SEQ ID NO: 1711 - protein, 233 aa, Clostridioides difficile P70; identical to SEQ ID NO: 1367

SEQ ID NO: 1712 - protein, 265 aa, Clostridioides difficile P70; identical to SEQ ID NO: 1409

SEQ ID NO: 1713 - protein, 233 aa, Clostridioides difficile P72; identical to SEQ ID NO: 1367

SEQ ID NO: 1714 - protein, 265 aa, Clostridioides difficile P71; identical to SEQ ID NO: 1391

SEQ ID NO: 1715 - protein, 233 aa, Clostridioides difficile P73; identical to SEQ ID NO: 1367

SEQ ID NO: 1716 - protein, 265 aa, Clostridioides difficile P73; identical to SEQ ID NO: 1409

SEQ ID NO: 1717 - protein, 265 aa, Clostridioides difficile P74; identical to SEQ ID NO: 1391

SEQ ID NO: 1718 - protein, 233 aa, Clostridioides difficile P75; identical to SEQ ID NO: 1367

SEQ ID NO: 1719 - protein, 265 aa, Clostridioides difficile P75; identical to SEQ ID NO: 1409

SEQ ID NO: 1720 - protein, 233 aa, Clostridioides difficile P77; identical to SEQ ID NO: 1367

SEQ ID NO: 1721 - protein, 233 aa, Clostridioides difficile F601; identical to SEQ ID NO: 1367

SEQ ID NO: 1722 - protein, 233 aa, Clostridioides difficile CD90; identical to SEQ ID NO: 1367

SEQ ID NO: 1723 - protein, 233 aa, Clostridioides difficile CD92; identical to SEQ ID NO: 1413

SEQ ID NO: 1724 - protein, 233 aa, Clostridioides difficile CD111; identical to SEQ ID NO: 1367

SEQ ID NO: 1725 - protein, 233 aa, Clostridioides difficile CD113; identical to SEQ ID NO: 1413

SEQ ID NO: 1726 - protein, 265 aa, Clostridioides difficile CD113; identical to SEQ ID NO: 1564

SEQ ID NO: 1727 - protein, 233 aa, Clostridioides difficile CD127; identical to SEQ ID NO: 1367

SEQ ID NO: 1728 - protein, 233 aa, Clostridioides difficile P30; identical to SEQ ID NO: 1367

SEQ ID NO: 1729 - protein, 233 aa, Clostridioides difficile P31; identical to SEQ ID NO: 1367

SEQ ID NO: 1730 - protein, 265 aa, Clostridioides difficile P30; identical to SEQ ID NO: 1564

SEQ ID NO: 1731 - protein, 265 aa, Clostridioides difficile CD86; identical to SEQ ID NO: 1564

SEQ ID NO: 1732 - protein, 227 aa, Halophilic archaeon J07HX64
  misc_feature (211)..(227): Xaa can be any naturally occurring amino acid
MTMVQESLEQWADEGSETEFPDRCLSLTVRGPWGHFRRVEGNIVKQTYRIIPRTTVAGLLAAVLGIERDGYYDPFAPGESAVAIEPVATLRTVNMPMNTLSTAEGNLQSLNGRGKLSVKLPDPTTLRQQHNYEVLVGPAYRIDVALTDDEWHNNLRKHLEAGKSHYVPSLGLSEHLAEIEYHGEFAVEGGPHEGQVEIDSAVPNAVEDVVXXXXXXXXXXXXXXXXX

SEQ ID NO: 1733 - protein, 267 aa, Halorhabdus tiamatea SARL4B; identical to SEQ ID NO: 1423

SEQ ID NO: 1734 - protein, 233 aa, Clostridioides difficile P33; identical to SEQ ID NO: 1367

SEQ ID NO: 1735 - protein, 233 aa, Clostridioides difficile DA00130; identical to SEQ ID NO: 1367

SEQ ID NO: 1736 - protein, 233 aa, Clostridioides difficile P37; identical to SEQ ID NO: 1367

SEQ ID NO: 1737 - protein, 265 aa, Clostridioides difficile P37; identical to SEQ ID NO: 1409

SEQ ID NO: 1738 - protein, 233 aa, Clostridioides difficile P64; identical to SEQ ID NO: 1367

SEQ ID NO: 1739 - protein, 265 aa, Clostridioides difficile F665; identical to SEQ ID NO: 1409

SEQ ID NO: 1740 - protein, 233 aa, Clostridioides difficile P53; identical to SEQ ID NO: 1367

SEQ ID NO: 1741 - protein, 265 aa, Clostridioides difficile P53; identical to SEQ ID NO: 1564

SEQ ID NO: 1742 - protein, 256 aa, Fusobacterium nucleatum CTI-1; identical to SEQ ID NO: 1444

SEQ ID NO: 1743 - protein, 366 aa, Fusobacterium nucleatum CTI-2; identical to SEQ ID NO: 1463

SEQ ID NO: 1744 - protein, 366 aa, Fusobacterium nucleatum 13_3C
MEALRIILKQSSANYRKAGTVDNKMTYPLPIPSTVIGALHNICGYTEYHSMDISIQGKFTSLSRRVYTDYCFLNSALDDRGNLVKVVDPDTFSGAFIKVASAKKSQGNSFKDRITIQVHNEELLQEYCSLKEKSKEIEELKNSEYKKKLEEFKVLKKEIADKKKKEDKKSETFKQLSEEEKKIKLDEEKYKEEFKNFEYESYTKPYSYFQNLVTSLKNYEVLNDIFLILHIKADKQTLKDIEENIYNLQSLGRSEDFVEVVECKMVELQEFSRNIRVSKFSMYLKNEDVSDKKIIPLAVDQDHQAGGTKYYLDKNYKLEKNRRIFKKVLVVYSNFIGAKNSSENVKLDYLEILSQDKKQEILVNFL

SEQ ID NO: 1745 - protein, 359 aa, Fusobacterium sp. CM22
MEALRIILKQSSANYRKAGTVDNKMTYPLPIPSTVIGALHNICGYTEYHSMDISIQGKFTSLSRRVYTDYCFLNSALDDRGNLVKVVDPDTFSGAFVKVASAKKSQGNSFKDRITIQVHNEELLQEYCSLKEKSKEIEELKNSEYKKKLEEFKALKKEIADKKKKEDKKSETFKQLSEEEKKIKLDEEKYKEDFKKFEYENYTKPYSYFQNLVTSLKSYEVLNEIFLILHIKSNAETLKDIENNIFNLQSLGRSEDFVEVVECKMVELQEVEEIIENSLSMYINAKDFYEKNTFTETVDRDHSSGGTKYYLDKNYEIKKGKREFKKVPVIYSTRVQAEESSENVKVDFYNGEAILVNFI

SEQ ID NO: 1746 - protein, 256 aa, Fusobacterium sp. CM22
MEALKFTLSGNSAFFKDNVINTVYLTYGNIHRVALLGMFGAILGYGGYSKQNDMLKKKNKKMPDYPEFYEKLKDIKISIVSNGKNGCFNKKLQTFNNSVGYASKEEGGNLIVKQFWLENPSWDIYILLDCDEAKKIADYIQNRKAIYLPYLGSNDHLANIMDIEIINIEKKISSEDETIEILSMVKASDISEKKKNVFSMDKNSTRDDIYKYSEYLPFTLSKDLNQHEKEKMIITNMSVVLKKSYYKVEDKNIVFY

SEQ ID NO: 1747 - protein, 366 aa, Fusobacterium sp. OBRC1
MEALRIILKQSSANYRKAGTVDNKMTYPLPIPSTIIGALHNICGYTDYHSMDISIQGKFTSLSRRVYTDYCFLNSALDDRGNLVKVVDPNTFSGAFVKVASAKKSQGNSFKDRITIQVHNEELLQEYCSLKEKSKEIEELKNSEYKKKLEEFKVLKKEIADKKKKEDKKSETFKQLSEEEKKIKLDEEKYKEDFKKFEYENYTKPYSYFQNLVTSLKSYEVLNDIFLILHIKSDEETLKDIEENIYNLQSLGRSEDFVEVVECKIIELQEFSRNIRVSKFSMYLKNKDVSDKKIIPLAVDQDHQAGGTKYYLDKNYRLEKNRRIFKKVPVVYSNFVGAKNSSENVKLDYLEILGQDKKQEILVNFL

SEQ ID NO: 1748 - protein, 256 aa, Fusobacterium sp. CM1
MEALKFTLSGNSAFFKDNVINTVYLTYGNIHRVALLGMFGAILGYGGYSKQNDMLKKKNKKMPDYPEFYEKLKDIKISIVSNGKNGYFNKKLQTFNNSVGYASKEEGGNLIVKQFWLENPSWDIYILLDCDEAKKIADYIQNRKAIYLPYLGSNDHLANIMDIEIIDIEEKISSEDKTIEILSMVKDSDISEKKKNVFSIDKNSIRGDIYKYSEYLPVALSKELNQYEKEKMTITNMSVILKKSYYKVEDKNIVFY

SEQ ID NO: 1749 - protein, 257 aa, Listeria grandensis FSL F6-0971
MKAIRIKLWQDLVNYKKPTSFQLKETYPLPPYSTVIGMVHTMCGFTSYHPMEISIQGKYFSKVNDLYTRYEFKNGMTYDEKRHQLKVGDYGVGRGIATAELLVDVELLLHVIPEDQSLVPTIAEAFETPQEYPSLGRREDIATIQEVKVVSFERVEAEEDLKLDNNYGAYVPISIIEKEDVYFRPHEKSHIGRNELLGTRYLLTDTYELINRGTAKAPKMYRNWHKKDVFYTTSILISEEDYFYVDEDGKLVFLDIK

SEQ ID NO: 1750 - protein, 146 aa, Listeria cornellensis FSL F6-0969
MKAIRIKLWQDLVNYKKPTSFQLKETYPLPPYSTVIGMVHTMCGFTSYHPMEISIQGKYFSKVNDLYTRYEFKNGMRYDEKRHQLKVGDYGVGRGIATAELLVDVELLLHVIPEDQAWWNRLPMRFRLLWNTHRLADVKISRRFKR

SEQ ID NO: 1751 - protein, 257 aa, Listeria weihenstephanensis FSL R9-0317
MKAIRIKLWQDLVNYKKPTSFQLKETYPLPPYSTVIGMVHTMCGFTSYHPMEISIQGKYFSKVNDLYTRYEFKNGMTYDDKRHQLKVGDYGVGRGIATAELLVDVELLLHVIPEDQDLVETIAEAFQTPVEYPSLGRREDIATIEEVKVVSVEKITAEEDLKLDQNYGAYVPISLIENEEVYFRPHAQSNVGRNDMLGTRYLLTDTYELINRGTAKAPKMFRNWLKKDVFYTTSIIISEEDKFFVDEDEKLVFLDIK

SEQ ID NO: 1752 - protein, 258 aa, Listeria riparia FSL S10-1204
MHIMKAIRIKLWQDLVNYKKPTSFQLKETYPLPPYSTVIGMVHTMCGFTSYHPMEISIQGKYFSKVNDLYTRYEFKNGMTFDKNRHQLNVDGYGISRGVATAELLVDVELLLHIVPEDQSLVDEIAQAFEVPQEYPSLGRREDIATIQEVKVVQIREVEAEDDICLDRDYGAYVPSSILGKLTFTPDMHSNIGRNDMLGTRYLLTDKYELVNRGTAKAPKMYRNWSKKDVFYTTSILVSEEDEFFLDEDGKPVFLEFA

SEQ ID NO: 1753 - protein, 227 aa, Pyrococcus horikoshii OT3; identical to SEQ ID NO: 1361

SEQ ID NO: 1754 - protein, 219 aa, Aquifex aeolicus VF5; identical to SEQ ID NO: 1211

SEQ ID NO: 1755 - protein, 220 aa, Thermotoga maritima MSB8; identical to SEQ ID NO: 1212

SEQ ID NO: 1756 - protein, 269 aa, Methanothermobacter thermautotrophicus str. Delta H; identical to SEQ ID NO: 1210

SEQ ID NO: 1757 - protein, 387 aa, Caenorhabditis elegans; identical to SEQ ID NO: 1366

SEQ ID NO: 1758 - protein, 232 aa, Methanosarcina mazei Go1; identical to SEQ ID NO: 1213

SEQ ID NO: 1759 - protein, 256 aa, Clostridium tetani E88; identical to SEQ ID NO: 1214

SEQ ID NO: 1760 - protein, 234 aa, Nanoarchaeum equitans Kin4-M; identical to SEQ ID NO: 1215

SEQ ID NO: 1761 - protein, 184 aa, Leptospira interrogans
MDQTGKEYSKKFYPALIKTEDGEVEIPVFRSDVGLHLRLSKVNAQINKIREEYIGLFAESFQLIDEAYQDYLDNIELINLDKKPDEKKELAIDKIGFATHYTTLADPKFVEKIDKCETASLAKAEEFLNTLLEKFRVLVHDSDSYIDIFNSIPFSGTDFTGLTQFTNSLETEARKYRGEGTLKK

SEQ ID NO: 1762 - protein, 255 aa, Bacillus thuringiensis; identical to SEQ ID NO: 1440

SEQ ID NO: 1763 - protein, 255 aa, Bacillus thuringiensis; identical to SEQ ID NO: 1439

SEQ ID NO: 1764 - protein, 223 aa, Bacillus toyonensis
MSASAALQVKLYQQTACYKKPMAQKAKETYPLPPYSTVKGFLHYVLGANELIPMEISIQGTHEGKLFDLQTHHFYKSKEVTTMPMHVHMLKEISLIFHVRAAQDVLEQLQIALENINEAPSLGRREDLAVIENVKLVTLNERHTKEIIKLKNDFYIPRHCIVDRLDYMNYKGVSYRLNTVYQVKQGIRTWETVQTQLFRKGEGLNSPKYLEDEDGYVVFFHAL

SEQ ID NO: 1765 - protein, 223 aa, Bacillus cereus
MSANTALQVKLYQQTACYKKPMAQKAKETYPLPPYSTVKGFLHYILGANELIPMEISIQGTHEGKLLDLQTHHFYKSKEVSTMPMHVHMLKEISLIFHVRAEQDVLERLQIALENINEAPSLGRREDLAVIEDVKLVTLNERHTKEIITLKNDFYIPRHCIVDRLDYMNYKGVSYRLNTVYQVKQGIRTWETVQTQLFRKGEGLNSPQYMEDEDGYIVFFHAL

SEQ ID NO: 1766 - protein, 143 aa, Bacillus cereus
MKCKEHILTPTKFPLEIHEFQGYIYNDYLELRYYNEGINGIFKITVSPVQNKLGFYVHRGAKFYSLKNNIEALYNPQFDSAYELLFQKNGFQYTIAIGNKRYIQGKYNVKDLIQIAESMNLKNDLFDMGKIVFLLFYTVSFPP

SEQ ID NO: 1767 - protein, 232 aa, Bacillus mycoides
MKTIRLRLFQETACYTKPFANKVGETYPLPPYSTVKGMIHQLLNANELLPLRFSVQGTYETKMIDYRKSYMVKKKSISMPIIFDGLAIEAPVQTNMTSIPLYTHMLFNVELIIHIKGEEDLLQRIYHAFIHSDTHLSLGRHEDLVRVDEVTFVELEECEEIHSKYAIYAPKHYYESDFPTGIPYRLNWTYKIVNGIREWTKIPVLYVDSNYHHGEDGKPLHTDGEYLVLWNE

SEQ ID NO: 1768 - protein, 223 aa, Bacillus cereus
MSASAALRVKLYQQTACYKKPMAQKAKETYPLPPYSTVKGFLHYVLDANELIPMEISIQGTHEGKLFDLQIHHFYKSKEVTTMPMHVHMLKEISLIFHVRAEQSVLEHLQTALENINEAPSLGRREDLAVIESVKLVTLNERQTKEIITLKNDIYIPRHCIVDRLDYMNYKGISYRLNTVYQVKQGIRTWETVQTQFFRKGEGLNSPQYMEDEDGHIVFFHAL

SEQ ID NO: 1769 - protein, 223 aa, Bacillus cereus
MSASAALRVKLYQQTACYKKPMAQKAKETYPLPPYSTVKGFLHYVLGANELIPMEISIQGTHEGKLFDLQTHHFYKSKEVTTMPMHVHMLKEISLIFHVRAEQDVLEQLQIALENINEAPSLGRREDLAVIEDVKLVTLNERHTKEIITLKNDFYIPRHCIVNRLDYMNYKGISYRLNTVYQVKQGIRTWETVQTQLFRKGEGLNSPQYMEDEDGYIVFFHAL

SEQ ID NO: 1770 - protein, 245 aa, Clostridium thermobutyricum
MEKKKAIRLEIYQNLVNYKKPASFQLKESYPLPAPSTVIGMIHFACGFKEYKSMDVSISGEYKSKVYDLYTRYEFAGSTFEKDRHQLKLDSKEKGKSYGVTRGVSTTELLVDVNLIIHVIPEDEELLETILNSFRKPKEYISLGRREDLILIKNAEIVYLEEVHRLDENIKFKGNYYIPIEEDYFENVISTTYNLNKIYEKKKIKKDVEIRTWSKVKVAYCNGQKNNIVKEKILVDELNSPVFFI

SEQ ID NO: 1771 - protein, 257 aa, Saprospira grandis
MTKIISIDLKAQFGFFRKPETNNNISLSYNFLHRPAALGLVGAILGLEGYQKEGELPAYYQQLSHLKMAIAPLDAENCHFAKTNIRYVNKTGFGQKNSTLILVESTLIAPAYRLYFLIEEGDELAQKLDQRLAQQQAYYLPYFGKNEHAAYWENYQSYDWEQKIADKQYRIRSLFRKEGQRLLGQAGALAPNRRSRFGANFSSGGSLYFERLPVDFDQELQQYILEDFSYTSHLLKPDFQPPQLYFLKEEQQYVQLY

SEQ ID NO: 1772 - protein, 250 aa, Microscilla marina
MPSKTILIFDIESEYGHFRKFNTTTSPLTYPIPPRPALVGLLGAIVGIEREASAGKFNEGVTPVAELFAKPDTELAVQLINPVKKVPMAFNLLDTEKSGASFFNIKQRTQIEFELLKHPCFRVFVACANDALMQPLVDNIQHNQAHFTPYLGLSQFTATFNFVAVTKAHLLASNEAQEVATAINISVHPDIEFEYSRQMKYTSDTLPLELNAQRVVQSYAEVLVEANGKPVKVNSEHIYTTEKYGNLLFL

SEQ ID NO: 1773 - protein, 386 aa, Leptospira borgpetersenii
MRPALTSDTRVDTGTKQNPYVLNVRRANIKKIWNTSSWGNYTLGFGIQELPHTYTQWSNYWRWRYIDRGPLESLGFASQPADIGLNAVGNWSIISSQFMVSNGEGYRETQNTNSAGMDVSSRFSVEPQLGESGKAGFHLFYRRENAFGSGGNECFEGKTTCLPNDLNPITALSKQIKSLQSDTTGLETNLIWNGPIKWNLGLGGFFKKQNSGEIRDRLQPFAAPVAFGKDGFGKALYAWLSIGAGNFHLLGRIERGTGNNGVVGVTDTIQREFFPGLSTSNVNLPAQVRNILPETRTNGYSSKSSFRRISVFFEWVVNPRFRMAIGYIENKNYDTNGVGQKVYIDQLGNERTEKEYLGQWNGSSNLGIVSYSSLDRQVLLRTTIEF

SEQ ID NO: 1774 - protein, 497 aa, Leptospira borgpetersenii
MNSFPLSKRFRENMRIFRIYVILLLTFLSVWTTHAEQVVTTKKDEPDSYYGLDVKAVISPSYGARIRDGASGISNSNPNDRTGFSTPWTLLMISKTFEEVRIQTELWGELIRNNQLTSDTRVDTGTKQNPYVLNVRRANIKKIWNTSSWGNYTLGFGIQELPHTYTQWSNYWRWRYIDRGPLESLGFASQPADIGLNAVGNWSIISSQFMVSNGEGYRETQNTNSAGMDVSSRFSVEPQLGESGKAGFHLFYRRENAFGSGGNECFEGKTTCLPNDLNPITALSKQIKSLQSDTTGLETNLIWNGPIKWNLGLGGFFKKQNSGEIRDRLQPFAAPVAFGKDGFGKALYAWLSIGAGNFHLLGRIERGTGNNGVVGVTDTIQREFFPGLSTSNVNLPAQVRNILPETRTNGYSSKSSFRRISVFFEWVVNPRFRMAIGYIENKNYDTNGVGQKVYIDQLGNERTEKEYLGQWNGSSNLGIVSYSSLDRQVLLRTTIEF

SEQ ID NO: 1775 - protein, 497 aa, Leptospira borgpetersenii
MNSFPLSKRFRENMRIFRIYVILLLTFLSVWTTHAEQVVTTKKDEPDSYYGLDVKAVISPSYGARIRDGASGISNSNPNDRTGFSTPWTLLMISKTFEEVRIQTELWGELIRNNQLTSDTRVDTGTKQNPYVLNVRRANIKKIWNTSSWGNYTLGFGIQELPHTYTQWSNYWRWRYIDRGPLESLGFASQPADIGLNAVGNWSIISSQFMVSNGEGYRETQNTNSAGMDVSSRFSVEPQLGESGKAGFHLFYRRENAFGSGGNECFEGKTTCLPNDLNPITALSKQIKSLQSDTTGLETNLIWNGPIKWNLGLGGFFKKQNSGEIRDRLQPFAAPVAFGKDGFGKALYAWLSIGAGNFHLLGRIERGTGNNGVVGVTDTIQREFFPGLSTSNVNLPAQVRNILPETRTNGYSSKSSFQRISVFFEWVVNPRFRMAIGYIENKNYDTNGVGQKVYIDQLGNERTEKEYLGQWNGSSNLGIVSYSSLDRQVLLRTTIEF

SEQ ID NO: 1776 - protein, 361 aa, Finegoldia magna; identical to SEQ ID NO: 1470

SEQ ID NO: 1777 - protein, 264 aa, Finegoldia magna; identical to SEQ ID NO: 1474

SEQ ID NO: 1778 - protein, 264 aa, Finegoldia magna; identical to SEQ ID NO: 1475

SEQ ID NO: 1779 - protein, 723 aa, Streptococcus sanguinis; identical to SEQ ID NO: 1489

SEQ ID NO: 1780 - protein, 241 aa, Blautia hansenii; identical to SEQ ID NO: 1456

SEQ ID NO: 1781 - protein, 244 aa, Bacillaceae; identical to SEQ ID NO: 1314

SEQ ID NO: 1782 - protein, 230 aa, Bacillus smithii; identical to SEQ ID NO: 1513

SEQ ID NO: 1783 - protein, 247 aa, Clostridium botulinum; identical to SEQ ID NO: 1447

SEQ ID NO: 1784 - protein, 253 aa, Clostridium botulinum; identical to SEQ ID NO: 1451

SEQ ID NO: 1785 - protein, 237 aa, Clostridium phage D-1873; identical to SEQ ID NO: 1450

SEQ ID NO: 1786 - protein, 210 aa, Clostridium botulinum; identical to SEQ ID NO: 1495

SEQ ID NO: 1787 - protein, 114 aa, Clostridium botulinum
MEFNKLILTSTMAHFKSGINGKNQNTFRVPPISTIVGILKNIYGKEVKNFIFGYTCQYEDVFKDVNTIYKEVNLNITSAKGDRFQHDIAFIEYLINPTITIYTNLDVPIQINDI

SEQ ID NO: 1788 - protein, 235 aa, Anoxybacillus flavithermus
MKALRLKLFQETACYKKPFASKVAETYPLPPYSTVKGMIHALLNANEFIPMRLSVQGTYEAKLLDYQRYYFFKKKELSCFPLVLDGLARVEFSYDKNEITTMPMYTHLLHNVHLLIHVEAEQRTLEQLIHAIEHSTTHYSLGRWEDLVRIDEYKLVEVQELEEEREETLQRDAYVPAQLLAREIKSIPYQLNWKYEIVNGIRQWEKINVGYVQKGIEAPEGVSIDEDGELVFYHL

SEQ ID NO: 1789 - protein, 262 aa, Clostridium butyricum; identical to SEQ ID NO: 1445

SEQ ID NO: 1790 - protein, 265 aa, Clostridioides difficile; identical to SEQ ID NO: 1380

SEQ ID NO: 1791 - protein, 233 aa, Clostridioides difficile; identical to SEQ ID NO: 1381

SEQ ID NO: 1792 - protein, 246 aa, Clostridioides difficile; identical to SEQ ID NO: 1379

SEQ ID NO: 1793 - protein, 265 aa, Clostridioides difficile; identical to SEQ ID NO: 1391

SEQ ID NO: 1794 - protein, 233 aa, Clostridioides difficile; identical to SEQ ID NO: 1367

SEQ ID NO: 1795 - protein, 245 aa, Clostridium pasteurianum
MQVIRFKLSGKTAFFKKPDVNTYYYFTYGTIHKIAVLGIMGSILGLGGYNKQSENSKNEVYPEFYEKLKESKIAIITCNDKGYITKKVQSFNNSVGYASLEQGGNLIVKEQWLQEPKWIIYVKIDEATEKFAEMLENKKAMFIPYLGKNDHFADITEPKRLNLKKSDNSNTVDSLFITKNFQVGNATINRKILSWKYQEYLPVSLDEELNQYQFEDFTATNKKVLSNSNVDLYRDDELDKVVYFF

SEQ ID NO: 1796 - protein, 271 aa, Clostridium perfringens
MKALKFTLEGKTGFFKRPDVNSNLYFTYGHIHKVALLGIFGAILGYGGYNQKNSKYKGQKSSKEESKLPEFYEKLKGLKISIVPKNKNGVIGKKLNIFNNSVGYASQEQGGNLIVKEQWLENPSWEIYILLDNEEAEKLSKAMINKNYVYMPYLGKNDHMADILNCEICDCEESLEVNYIDSFFKKDTYKLSNKPKEDDFDDFSEFDETSENNKEVTKEEPLYKYEEFLPLSLDEETSMYKTESLVYTNSYLEKEKDSLIYKIKDKTIQFI

SEQ ID NO: 1797 - protein, 253 aa, Clostridium; identical to SEQ ID NO: 1431

SEQ ID NO: 1798 - protein, 237 aa, Hungateiclostridium thermocellum; identical to SEQ ID NO: 1224

SEQ ID NO: 1799 - protein, 81 aa, Erysipelatoclostridium ramosum
MACMVIYGDFSNIADTYLSLVNWLQKMLSIRFQYPIALSVVEVIVIDYQTEIVSIPYIDINPYTPNLEESAYFAWADEFDF

SEQ ID NO: 1800 - protein, 232 aa, Erysipelatoclostridium ramosum
MQALKFTLSGKTAFFKRPEVNTYYFTFGNIHRVALLGIFGAILGYQGYNNTIELPEFYQKLKDIKLSILPQNEKGYFSKKIQYYNNSVGYASKQQGGNLIIKEQWLENVCWDIVVLLDNEEANKLAKAIINKKCIFIPYLGKNDHPANITDPVIVDLQKRDIDKETLDCLFPSGNFKKAEDVYVNFYKYQESLPIGLNEKTGLYEYMTFIHTNFYVDKGAVYSFNDKNIVFY

SEQ ID NO: 1801 - protein, 190 aa, Lactobacillus gasseri; identical to SEQ ID NO: 1222

SEQ ID NO: 1802 - protein, 190 aa, Lactobacillus; identical to SEQ ID NO: 1472

SEQ ID NO: 1803 - protein, 187 aa, Lactobacillus gasseri; identical to SEQ ID NO: 1446

SEQ ID NO: 1804 - protein, 256 aa, Lactobacillus ruminis; identical to SEQ ID NO: 1324

SEQ ID NO: 1805 - protein, 240 aa, Bacteria; identical to SEQ ID NO: 1277

SEQ ID NO: 1806 - protein, 259 aa, Listeria seeligeri; identical to SEQ ID NO: 1478

SEQ ID NO: 1807 - protein, 236 aa, Thermoanaerobacter ethanolicus; identical to SEQ ID NO: 1453

SEQ ID NO: 1808 - protein, 237 aa, Thermoanaerobacter; identical to SEQ ID NO: 1235

SEQ ID NO: 1809 - protein, 213 aa, Methanobrevibacter smithii
MKVYLKDGQIATKNLTPGISVYGEELIQEKEEYRIWNPRRSKLAAALLNGLENLDISEDAKVLYLGASTGTTVSHISDIVTDGRIYAVEFSPTTAKKLVRLARQRTNIAPILGDATKPKNYLNITEKTDIVYCDVAQPTQSQLFMKNMNLIGKDDAIGALMIKARSIDVVQKPKKIFKEEERKLREKGFKIIEKVKLEPYEKDHIAFVVEKNF

SEQ ID NO: 1810 - protein, 217 aa, Haloferax volcanii
MLAAIVGADRDSYYDVFGADNSAIAITPLSDLRTVNIPTTGLGTDPKQDVTETAGSWRTYKLTYQNTTGDRQLHSYEVLADPAYRIDVALENEEFYDSLREHLVNGTSIYPPSLGKSEYLAVIEDVEVDREPEVQDIDETLDIDSVVPISLSEAVPQGKVTYGVERSPAVMVRESGGRRTTRFDDYVYAQQASNPVRIGEQTDVAPVQVGDRTVVFR

SEQ ID NO: 1811 - protein, 264 aa, Halorubrum saccharovorum
MTQHSLGDWDDDNFGTESAECLSFELRGQWGHFRRVEGNIVKQTYRIPPRTTIAGIIAAILGLDRDSYYDAFASERSGIAVQPTEELRTMNLPQNTLSTAKEDMKRVPSRGHARISMPDSTELRQQHNYEVLVDPAYRIDVQLDDSELFGDLRTRLEEGTSHYPPSLGLSEHLAEVEYLGTFEAESCEAEDTDIDSVVVEAIDDVELAPGNPVRVERSPGFMAADAGGRTTTKFLSLAYSPDAEPVHVHDVETSRVDGRRVMFS

SEQ ID NO: 1812 - protein, 259 aa, Eubacterium plexicaudatum
MERAIRVECFQDLVNYRKPSSFLIKESYPLPPYSTVLGMIHVVCGYPRGEFHPMKISIQGMNTGSVSELYTRYSFNLNQKYEEGRHQICIQEPNQTYGMFKGIAYAELICCNDMVLHIVPQEHDFETVFESLQRPCIYPALGRHEDLLDIRKVEIVKLREAETAITNYDIYIPVPNQPAEERLMVNDSDSNADNPEIPVADIGRNSFTVFTLTKEYEITKQGMRRWKKNGGKVKAYYFPHGETIDNVLVDTYDDVVALA

SEQ ID NO: 1813 - protein, 268 aa, Haloferax mediterranei; identical to SEQ ID NO: 1332

SEQ ID NO: 1814 - protein, 264 aa, Haloferax; identical to SEQ ID NO: 1539

SEQ ID NO: 1815 - protein, 220 aa, Thermotoga; identical to SEQ ID NO: 1212

SEQ ID NO: 1816 - protein, 244 aa, Lysinibacillus fusiformis; identical to SEQ ID NO: 1471

SEQ ID NO: 1817 - protein, 253 aa, Thermoanaerobacter thermohydrosulfuricus
MRLLTFHLQGKAAHFRRYHSNSSALTYSIPPRTTIIGMIAGLLGFERDSYYELFSLDKCNITVAIKSPIKKLVQKMNLLKIEGINDFNGSKGVHTQTPTEIIFPQNLRNGYIDYQVWFYHKDKSIMEDFRKLIAGGNDFYITKGISLSLGGAQYLGWLRYEGEIEGEEKNYEASIPISSVIPIKYINDIEIGRDSYNKYFFVKEDIPLEFDKDRRLTETGKGNMLINLFSHPIKATVTKYVELSNNEYITWME

SEQ ID NO: 1818 - protein, 265 aa, Clostridioides difficile; identical to SEQ ID NO: 1409

SEQ ID NO: 1819 - protein, 250 aa, Ruminiclostridium cellobioparum
MRGIRLKLSQDMVNYKKPASFQLKETYPLPPYSTVIGMIHNICGYTEYHPMKISVQGKYFSKVNDLFTRYEFKNGMTYDEKRHQLNVNGYGISRGVATAELLVDVELLLHIVPEAEEDVQEIYDWLLRPLEYPSLGRREDLTVLEEVRIVEINEDVAGYDLELEKGYGAYIPVSYLMNDYVETRAVDGLEYSGTCYKLNKNYRLSNFGSDKAPKVFRRWETVDVLYGRDIQMKRKKPFYVDELGTCVFLA

SEQ ID NO: 1820 - protein, 367 aa, Eggerthia catenaformis
MKALRIKLTQNKASYSCEGTVNNRMTYPLPNYSTVIGALHNACGYTEYHPMEISIQGKYSALQKEIYVNHGLLNRTEDDRGILIWLKDPNRLNTGYIEVAKSLNATGNSFSEERTIEVKSRELLDLYKLLKKKGKELEDFNKNTIKSAEEKWKLEKKELKNKQKAFEKNSEQWNDVKAIVDEGEKKIKKLKSDFEDKKKKEYDDPYNHFKILVKGPQYQEVLYDVELVIHIKSDEKVLNDIMYHKYDFVSLGRSEDFIELIEMEYCEVVDSVKEEHMLPNNYSMFINADRVNETQFYQHLEIDRREINADGSNVDGTIYYIAKDYSIKDDARVFNRIPCLYSSSFMIDSDSINIGFDQDGGYLVDFN

SEQ ID NO: 1821 - protein, 245 aa, Anaerococcus hydrogenalis; identical to SEQ ID NO: 1433

SEQ ID NO: 1822 - protein, 245 aa, Anaerococcus hydrogenalis; identical to SEQ ID NO: 1488

SEQ ID NO: 1823 - protein, 217 aa, Peptoniphilus indolicus; identical to SEQ ID NO: 1500

SEQ ID NO: 1824 - protein, 245 aa, Anaerococcus vaginalis; identical to SEQ ID NO: 1452

SEQ ID NO: 1825 - protein, 217 aa, Haloarcula sinaiiensis
MLAAIVGAERNSYYETFGEDNAAIAITPESDLRTINIPTTGLGTDPDQDVTTTAKKRRNYSLTYQETTGDRQLHAYEVLADPSYRIDVALEDEEFYQKLHDHLEAGTSVYPPSLGKSEYLATIENVQAGQEPEPASSSGPYDIDSIVPIELADAIPQGGVAYESERSPAVMERHQGGRRTTRFDDYVFTRRSDGTVKTDAGTDVKPVSVGNRIVVFR

SEQ ID NO: 1826 - protein, 265 aa, Haloferax denitrificans; identical to SEQ ID NO: 1543

SEQ ID NO: 1827 - protein, 272 aa, Haloferax gibbonsii
MSESCLVFDVSGDFAHFRKPETTSPAQTFGIPPRTTVAGMTAAILGLDRDSYYDTFSRESSRIAVQLRSPIRRISLGINILTTEGSSSKTKGIAVQLRSPIRRISLGINILTTEGSSSKTKGARPGRFVTSQRQQNVFETLCDPEYRLYVSLDDERLMDKLEQYLVAGKSHYALSLGLSEHLATHDFQGRYEIQRGQGDAVVDSVIPGESLGIVPDSESRYVTERVPGFMRSTADGRVSDGFQTVTYERNGQSIEIRDINYAQVGGETVVFG

SEQ ID NO: 1828 - protein, 249 aa, Halococcus salifodinae
MGTVDAIPEECIVLEISGEFAHFRKPSTTSPAQTFGIPPRTTVAGMLAGMLGMERDSYYELFSRETSSVAVSLESSLRRLSVGINVLTTDGPNTSPTSGRPGKHITGHRQQTVFEVLCDPIYRVYVGLDDETVMDRMEEMFAAGKSVYTLSLGLSEYLATFEFIGRFDVSTHTGRATVRTAVPGEEVDLIPATDARYVTERSPAFMTTHGEGGRKADGSQTLTYDRNGGPIELRETPYAIVDGDPIVFS

SEQ ID NO: 1829 - protein, 249 aa, Anaerobutyricum hallii; identical to SEQ ID NO: 1438

SEQ ID NO: 1830 - protein, 363 aa, Anaerobutyricum hallii; identical to SEQ ID NO: 1437

SEQ ID NO: 1831 - protein, 265 aa, Haloarcula argentinensis; identical to SEQ ID NO: 1544

SEQ ID NO: 1832 - protein, 262 aa, Johnsonella ignava; identical to SEQ ID NO: 1502

SEQ ID NO: 1833 - protein, 266 aa, Paenibacillus alvei
MRALRFELSGETAFFKKPDVNVHAYFTYSHIHKVALYGLLGAIIGLSGYARQHERNRMRSTGSKADESEIAIFPEFYEVLRDTRVSIVPHGDRGYFSKKIQIFNNTVGYASQEAGGVLNVREQWIERPHWTVYIADCKGLSDQVFEKLADYILNSKAEFMPYLGKNDHPATISKPCLIELEQLDEAPYYIDSLRAAHIGCDARGTIKNRGLQSYFQEHMPVGLNAANNGYVTQPLVYTNQEIDPDTLKESDWSRLYADGDQTLYFL

SEQ ID NO: 1834 - protein, 182 aa, Natronococcus amylolyticus
MEKDAVEKEQAFREEFETETAIGIRVIEDPVSKRDLRTRKKVARNSDNKKYISYPVEEETLLFPTFRIYITGSAERCSAIADAFRNPERLLYLGRSDNLVDIRDVTETRFTIHHDEQVLEDVMVPNGDGDDPVMLPVRTERLGSYSARPAEVQLVTYGGTVGSYNTLENELDKDGPFVFIDE

SEQ ID NO: 1835 - protein, 270 aa, Natronobacterium gregoryi; identical to SEQ ID NO: 1340

SEQ ID NO: 1836 - protein, 231 aa, Clostridium ultunense
MEILTFDLRGSLAHFRKPDTTATHVTFPFITRTALRGLIGSILGLEEYHGNILAGVQLLSPVRRVSQELSLLGKAFLGDGGNQFNRPTAIELLVNPHYRIYCLGDEVEELAERIGKRQSVYHTYLGSAFALTVPEFISLSRGEEIDPGKDWVTSVTVIPTHFIESLSMEEGNQYGRAGGFHYEHLGNRRFQGSVHLLYEVNGRPVRFIPKANPSPAVKMVRLENGEVITLW

SEQ ID NO: 1837 - protein, 236 aa, Dethiosulfovibrio peptidovorans; identical to SEQ ID NO: 1459

SEQ ID NO: 1838 - protein, 231 aa, Desulfitobacterium hafniense
MKGLAFDVLGTVGHFRRPDTTATQMTYPFITPTAAKGLVGAILGIEDFVTSDRIGIELLRPVCTVAQQMSMLGKDPGNSFNRPTTLELLVNPGYRLYYTGEEHTEELLDFLLEEKAAYTTYLGAAYALTKPVLHRVYAEVSYPAPEEKEIESRTVVPTALIREIVLKGERYYCRAGGYLYEYKGQRRFEKSVDFLYEKDGKPIAFIPKSHQEEGALDLRLARFGEDWVCLV

SEQ ID NO: 1839 - protein, 231 aa, Desulfitobacterium hafniense; identical to SEQ ID NO: 1510

SEQ ID NO: 1840 - protein, 237 aa, Campylobacter gracilis; identical to SEQ ID NO: 1454

SEQ ID NO: 1841 - protein, 366 aa, Fusobacterium nucleatum; identical to SEQ ID NO: 1463

SEQ ID NO: 1842 - protein, 256 aa, Fusobacterium nucleatum; identical to SEQ ID NO: 1521

SEQ ID NO: 1843 - protein, 366 aa, Fusobacterium hwasookii
MEALRIILKQSSANYRKAGTVDNKMTYPLPVPSTVIGALHNICGYTEYHSMDISIQGKFTSLSRRVYTDYCFLNSALDDRGNLVKVVDPDTFSGAFVKVASAKKSQGNSFKDRITIQVHNEELLQEYCNLKEKSKEIEELKNSEYKKKLEEFKVLKKEIADKKKKEDKKSETFKQLSEEEKKIKLDEEKYKEDFKKFEYENYTKPYSYFQNLVTSLKSYEVLNDIFLILHIKSDEETLKDIENNIFNLQSLGRSEDFVEVVECKMVELHEFSKNKRLYNFSMYLKNDDVTTKKILPLSVDEDHKAGGTKYYLDKNYKLEKNKRIFIKIPTVYCNAVGAKNSSENVKLDYLEILGQNKKQEILVNFL

SEQ ID NO: 1844 - protein, 1015 aa, Bacteroidales
MNIPKYSLENQKVVYFFLAILLIGGVISFFKLPKKEDAPFVIKTAVLVTQYPGANPHEVEKLITEPIEREIQSMTDVYQIKSESYFGLSKISIELQPTIDPDYMPVKWDELRRKVANIQPKLPSGASTITVNDDFGDVYGIYYALTADEGFSYKDLRDWAQHIRTQLTPIEGVQKVMLYGEQTEVINVKISTSKLSSLGIDPTSIMGILQKQNVQVNTGDIATDIYQLRLRTEGTYTSLEDIENQLIVSKDGREVRLGDIATVERGYYDPPSTLMRVNGKRAIGIGVASGAKDNVVAVGEAVDKSLAEIEQLLPIGIELSSLYPEDKIADEANNGFILNLIESLVIVILIIFVVMGSRAGMLIGSSLLFSVGGTLLIMLMWGVGLNRTSLAAFIIAMGMLVDNAIVVTDNAQIGIKRGKSRYLSLIEGAIKPQWALLGATFIAICSFLPLYLAPASVAEIVKPLFIVLAVSLGLSWILALCQTTTFGNFILQEATPGSEGKDPYDTKIYHKFEKLLTLLIKRRFITLTTVVVTLVLSLVIMAVMPQSFFPKMNKPYFRADLVFPEGFSIHAVDEDVMKVEEYLEKNEKVKSYSVTLGGTPLRYYLASSSFGPKSNYANVMVETKDPEDAAEVEQQFYEHMTQNFPNIITRSALFALSPVPEAAIEIGFIGENPDTLTALVERAKKIAHECDMVTDIRSNWGDKVPVWKPMFSQQKGLRLGITRQQVANSFRTATNGLPLGEYREGDISLPILLKDEDAENMNLNDVKSVPVFSTKGNSVKVEQVIDNFSLGYDYNVVRRFNRERCMMMQCEPKRGANTMAAFKQVLTAVQEQMQLPEGYKMKYFGEQETQDVSNAALAKNIPLTFLLIYVVLLFLFPSNYRKPVLIMLMLPLVFIGVVWGLLLFGKSLDFFAILGLLGLIGMNIKNAIVLVDEIGLQLKDGKGAVPAVVEATKTRIVPVTMASGTTILGMLPLLGDAMFAGMAATIMGGLFVSTILTIFVLPVTYCIFFKIRADR

SEQ ID NO: 1845 - protein, 250 aa, Fusobacterium varium; identical to SEQ ID NO: 1448

SEQ ID NO: 1846 - protein, 369 aa, Fusobacterium necrophorum
MKALRIVLRQTSANYRKAGCLENKMTYPLPIPSTIIGALHNACGYTEYHPMDVSIQGKFSGLSKRAYTDYCFLNSVMDDRGILVKMANADCLSNSFVRVASSKKPQGNSFKKRISIQVHDEKLFEEYCRLKDISMEIKEQKDTVYKEKVAEFKQKKTELGNRKKKLEKNSEEYKRILEEEKKIKTEEKKYLDDFKEYEEKNYSIPIKAYRSLVTSLKFYEILHDIFLIIHIRAEEKILHDIHENIYELRSLGRSEDFVEVEDCNFIELQDFQEDIYSKETLNTSMYLNRRDVEEGKIFNLEVDLDHASGGTKYYLDKEYSIQENKRIFTKIPVLYSSHFGAQESSENVKLDFWGKDEEGNKIPVIVNFL

SEQ ID NO: 1847 - protein, 359 aa, Fusobacterium periodonticum; identical to SEQ ID NO: 1442

SEQ ID NO: 1848 - protein, 359 aa, Fusobacterium periodonticum; identical to SEQ ID NO: 1460

SEQ ID NO: 1849 - protein, 251 aa, Fusobacterium ulcerans; identical to SEQ ID NO: 1482

SEQ ID NO: 1850 - protein, 284 aa, Halorubrum coriense
MTQQDLTDYASDSDDSSTAQYIPDTCIGFDVTADFAHFRKVGNNSAKPSYRVPPRTTVAGLLAGIMGMSRDSYYDLFSPSSSAVAVVPKQLPHTYTMGITTVNTNEAAIQYLPLEKDWWDGAEMLTPESYLEHWDKPGRQDLMETPRQRDTYEMLVDPVYRVYVSLADEDVHDDLRERLENSRYHYSPVLGLSECIADIRNVDTHTVESATTNAVDSAAYDDSAVVPSPGVTVKRERAPLYMEATDGGRKTTAFGNITYATGDDRLPVDASRAHAAGDHEVILY

SEQ ID NO: 1851 - protein, 269 aa, Natrialba chahannaoensis; identical to SEQ ID NO: 1535

SEQ ID NO: 1852 - protein, 252 aa, Natrialba chahannaoensis
MTSASPPEAISFTISGEWAHFRRIDTTTAKQTYRVIPRTTVIGLLAGILGYDRDSYYDDFHPDKCDIAVSLETEVSTMAVPQTELTTEGAYRSSRGGHDVEAAFLKVEKTLEDRQRNFYEYLTDMSYRIDVCHSDAEIRADLHDMLSAGESVYTPSLGKSECLASISYHGKSETVSVESDVAHSVVPLDAAVPTGQHIATERSPRHMVRDGRSRRTTDFGAYAYRKDGTTNSLEVRDEATVFEIHDRPVTFM

SEQ ID NO: 1853 - protein, 262 aa, Natrinema pallidum; identical to SEQ ID NO: 1532

SEQ ID NO: 1854 - protein, 256 aa, Myroides odoratimimus; identical to SEQ ID NO: 1518

SEQ ID NO: 1855 - protein, 236 aa, Aminomonas paucivorans; identical to SEQ ID NO: 1476

SEQ ID NO: 1856 - protein, 219 aa, Caldisalinibacter kiritimatiensis
MKVLKLTLFQETACYKKPFAFKVWETYPLPPYSTVKGMLHNILKADEFIPMSISIQGDYESKFVDYQSMYFYKSKEITNMPLNVHLLHNVKLIIHVKAEDAILQRIIDGIRNLEEHLSLGRREDLVRIDDIKFVKIQEIDIDDLEDGKKIEHPIYIPVEQLPEDVWGINYRLNWKYEVVNDLRQWERIDVKYVESGEEITDDNFLQDEEGDIVYFNTPQ

SEQ ID NO: 1857 - protein, 244 aa, Anoxybacillus
MNMLIFDLVGKMGHFRKIDTNSSSLSYFFPPRTTVIGIIAGILGMERDSYYEQFSENQCDIALSVRTPVRKMVQTVNYMLVTSKSHLNNSKGHTQIPLEFVLPRKEEVHLRYRIYFSHDDSFIYESVKKRIQENRYIYPPYLGLSELIGQLEWITEVEGVQNEAGRLVPIHSVARVSQLRERSIQLSNEIRIVKEFMTRHFTKERMIQETDYYLLEQSRQLVATPEVPYVTVMYGGEKENVLFM

SEQ ID NO: 1858 - protein, 249 aa, Peptacetobacter hiranonis; identical to SEQ ID NO: 1432

SEQ ID NO: 1859 - protein, 242 aa, Desulfallas gibsoniae; identical to SEQ ID NO: 1351

SEQ ID NO: 1860 - protein, 246 aa, Desulfallas gibsoniae; identical to SEQ ID NO: 1350

SEQ ID NO: 1861 - protein, 252 aa, Anaerostipes caccae
MEVCKVTLKGRTAFFKKPDVNSYYYFTYGQIHKVVLLGIFGAILGYSGYESIKTEKRKKDSAEGPGFPEFYERLKDCRFSIVPKNEKGWIPKKIQYFNNSVGYASREQGGNLIIKEQWLESPEWDIFILLDGEESRKLSEALMDRCCVYSPYLGKNDHPADLLNPDIIEAEEVSPEGRQLDCLLPKGKVTFAYLDEDDDEEEDFYKYEEGLPYALNPFTNLYVTEPFVYTNQYVKECELPLYRAGKNIIVFY

SEQ ID NO: 1862 - protein, 359 aa, Anaerostipes caccae
MNGVKALRIKIRQASANYRKEETTENKMTYPLPPLSTVSGALHSICGYTEYKKMDISIQGKFSSMRKKVYRDYCFLNSTMDDRGTLVKMKNESMLSNAFTQVASAKKSQGNSFFNGTTIQVHDESLLQEYRDLKVLGNKIAEWKSTEYKERIQNYKQEKNRLAEQKKTAEKGSNEYDEIVQKEKQIKAEEKEWKKKVSDYETSNYKVPISKFRSLTTSIKYYEILDNVQLILHIRAEEEVLNDIYHHIYDLKSLGRSEDFVEVTDAELVELLETDETVRSPYSAYLHYDDVKNRRIYTGMGPERLMFGTKYYLGKKYEIQDGKRIFIEKIPVVYTSDFKIRKTSENIWIDDQKNIVNFL

SEQ ID NO: 1863 - protein, 237 aa, Thermoanaerobacter siderophilus
MKTLVFDVFGDYGHFRKYYTTSSPLTFSFPPPPTVKGMLGAIAGIDKKEYLKVFSEENCKVAIRILNPIKKIRVGLNLINTKGNYWIPYKAKNHEARTQVKTEFVKDAAYRIYFMHKDNDLFEDIVEKIKNRRNVYTLSLGLSEMIADYKFIGVYEAEEIENAEVDILSVLPFQSIVEDKIYFENGKKYFKEKIPAGMNEDRVVLSYEDVLYEVNGQSIKCHVKKCWEVKGEHVIFF

SEQ ID NO: 1864 - protein, 262 aa, Haloterrigena thermotolerans; identical to SEQ ID NO: 1536

SEQ ID NO: 1865 - protein, 269 aa, Natrialba hulunbeirensis; identical to SEQ ID NO: 1534

SEQ ID NO: 1866 - protein, 270 aa, Halobiforma nitratireducens; identical to SEQ ID NO: 1545

SEQ ID NO: 1867 - protein, 241 aa, Hungatella hathewayi; identical to SEQ ID NO: 1503

SEQ ID NO: 1868 - protein, 238 aa, Thiorhodospira sibirica; identical to SEQ ID NO: 1501

SEQ ID NO: 1869 - protein, 102 aa, Halosimplex carlsbadense
MRAVTKHLDEKARSIFADLGYTVTDSGGEYLAERKWRSVHVTPAEEFDETPESGEYRCFVAWSEDVPDLERRLEAADPEYEWAIMGVDEDGDYEVACHRNAA

SEQ ID NO: 1870 - protein, 263 aa, Caldithrix abyssi; identical to SEQ ID NO: 1519

SEQ ID NO: 1871 - protein, 238 aa, Thiorhodococcus drewsii; identical to SEQ ID NO: 1499

SEQ ID NO: 1872 - protein, 258 aa, Methanotorris formicicus
MWGLKFRCEGIYFVSFRKPVTTSLSLTYKLPPFTAIRGMIGNTLGMPRDSFEIQNWFKIGMRVEGKIEIGREMAKFLKMISRKSCYRCESCGFEKISDSKPKKCPNCGKENIIKVEKVIYERSFPSSPMHREFLIMPKYWIYLVGEEKKIKKIYNALKNPERPLYLGTSDDLVDVEVFEPVRVREVEENQINSILDGIHENCILEKLPYKFIPIKDKKGNLKEVYSEYKLVSIPTKFPYLSEKSLKVWDFGDEFIRVF

SEQ ID NO: 1873 - protein, 238 aa, Methanotorris formicicus
MKVLVFDIWGDYGHFKKIYTTTSPLTYDIIPKTTIYGILGAVLGFDKEKYLKHINADTTNIALRILSPIKKVNFALNLINTKGNYFIPIKKKGHEPRTQIRFEMLKNPKYRIYVNLRDDELHNKLKELLKEHKTIYTPYMGISEMIANFKYIGEFEVVKLKSDDFVEVNSVIRRDNIKDINFEDNKEYLFAKIPNEMNGGRITTEYVDIFYEKNGKPIKCKVGGYWKITEINENITFI

SEQ ID NO: 1874 - protein, 273 aa, Haloarcula californiae
MTQQDLTDYASEGGDSSSSRYIPDTCIGFDVTADFAHFRKVGNNSAKPSYRIPPRTTVAGLLAGILGMPRDSYYDLFSPARSAIAIVPKGLPHTYTMGITTVNTKADDAIQYLPQEKHYTKSAEMLTPESYVKYDRQRDTYEMLVDPEYRVYVALSDQNSYNELRERLETSRYHYSPALGLSECIADIRNVEIHTVGPGIEDAVDSAAYDDSEVVPKPGVTIKRERAPLYMESTDGGRRTTEFGNITYAAGDDRLPVDESRTHTVGEHQVAFY

SEQ ID NO: 1875 - protein, 207 aa, Candidatus Jettenia caeni
MGFVGSVLGIEKDDFSLYQKIQCGVEISSEYHTTSIPYLTRQGFPGSAANKKSSRTSVEVIVKPSYRVYIAEENIKEDSILSNIQKLIKQQEPVFTPYLGLAQFIASTDFQISEVVEGKLVKNMDTDVNGAFIRGFHGELDFDKINTLSKEENKLRITEFEGLKGIKSPRDFEHAVFTVNLDGGAVPLKNVKNILNIPAWNKYVPIF

SEQ ID NO: 1876 - protein, 229 aa, Intestinibacter bartlettii
MELINMKCLVFKVRGDYARFRKSYTTTSALTYLLIHPVAVRGLIGAMLGIDREKLYEKTKDIEVAIQVVNQVRKDMQSFNLVNMKANDKIFRFPSNVEFLRNVEYRIFIKAEDKTLYEIDNCIKQGEYIFTPYLGSSEHIAKIEYEGIYNCEKLNAGNYKVISAVSLEENKIYFGDSDIILMTDNIPTRRDIDREYIEYKKVIFATNENTINVGTENCYKVGGYNVIFI

SEQ ID NO: 1877 - protein, 585 aa, Crocosphaera watsonii
MKKLLFLFLFIVGLWVALANFKGLATQGDYESIIVNFREDVSTTTLSEQIEAIASNYNQSLSLNSVYAIDEHIYTLTGDKELLKNLKKSPLNEYVDYIEPNYIYSALETPNDPDYSKQWNLHNIHVERAWEETKGEGITVAVIDSGVSRVPDLRQTEFVPGYDFVNDRKDARDDNGHGTHVAGTIAQSTNNNYGVAGVAYQAKIMPLKVLSAQGGGSVSDIADAIRFAADNEADIINMSLGGGGESQVMKDAIDYAYNKGVVIIAAAGNSNQNAASYPARYPKVISVSALDATGKKAPYSNYGAGVDISAPGGSEEGKILQETIDPSTGQAVFSGFQGTSMAAPHVAGVAALIKATGVKEPEEVFAVLTQSSRKVEEDKFNYYGSGQLDAGEAVKLAVKGQITFRDFFRWLRDSGYLNPRFWIDGGMVALLPKLLMVLGSYLLAFLLRNYFPFAFTSPFNWGLVLGSSGLFFLQGIYVFDLPQWPFRVMGSSIPELANSIEGTSLLNPFLASVLIPFALVAILLGHNSWKWFAIGTSLGVAACLTVHAIMSPAVMAMPSLDVARAFLGANAFLCVGLACLASKKS

SEQ ID NO: 1878 - protein, 266 aa, Paenibacillus sp. Aloe-11
MQALCFELSGETAFFKKPDVNVYAYFTYSHIHKVALYGLLGAVLGLGGYTQQYERNMALGGKAKQDNPAMPYPEFYEVFRHASVSIVPHGDRGYFSKKIQIFNNTVGYASQEEGGVLNVREQWLERPRWTIYVADDGGLDREIFDRLADYVQHSKAEYIPYLGKNDHPATISKARLVELEPASEPEYIDSLRAAHVLVDTGGYVKDDQMQSYLQEYLPVGLNTANNGYILEPLVFSNQEIDTDELKAEDLQKMYRDADNDRTLYFI

SEQ ID NO: 1879 - protein, 233 aa, Caminibacter mediatlanticus
MKAISFNLSGKFAHFKKPDVNSNVYFTYSHIHKIALLGIFGAILGLDGYNKDIKDYPEFYKRLKHLKVSIIPKEVMFSKKIITFNNSVGYASKEQGGNLVVKEQWLENPAWEILVKDDGSDKFNKLREKLFNKECVYIPYLGKNDHFANISDIKEIELKKATKPMVCKSLIPKSKIKSLKQPMFGRVYFYEEYLPTGMKEKFLMYEMDKMVLSSGIVDSDEMWEYEKIGIWFG

SEQ ID NO: 1880 - protein, 260 aa, Caldalkalibacillus thermarum; identical to SEQ ID NO: 1491

SEQ ID NO: 1881 - protein, 238 aa, Caldalkalibacillus thermarum; identical to SEQ ID NO: 1490

SEQ ID NO: 1882 - protein, 280 aa, Halococcus thailandensis
MTQQDITDHVPDGGKSSDDQSSTSGSQFVPNSCIGFDVTADFAHFRKVGNNSAKPSYRIPPRTTVAGLLAGIMGMPRDSYYDLFSPDSSAIAVVPKELPHTYTMGITTVNTKADDAIQYLPHERSWQQGAEMLTPKSYVKYDRQRDTYEMLVDPIYRIYVALDDRDVHDELRERLEDSRYHYSPALGLSECIADIRNVDVHSVESASTDVVDSAAYDASTVIPRPGITIKRERAPLYMEATDNGRKTTAFDNITYATGDDRLPVNESRAYTVGEHRIVFC

SEQ ID NO: 1883 - protein, 210 aa, Haladaptatus paucihalophilus; identical to SEQ ID NO: 1485

SEQ ID NO: 1884 - protein, 272 aa, Haloferax prahovense
MTDLPARELPDDEAVSLTVSGRWAHFRNIEGTLYRTYTMFPRTTVAGFLAAIVGRGRDTYYDVFHPDRTRVSVTLDEYEGTHTMSRLYLGTRNSSDEKELTLSGTDDPAAKALTEAVGGLPNANAIYGSRQRPVIHMVRRPTYTIDVVFDRTDDRASSFREELVEHLSNGTSVFTPYLGTAECLASVEYNGELPIDPVTDDAPEVESALPLSVVNPVASGPFTVEKHPYNMTRTANGRRLNGTVSVGFSTDEQLVATEACGFDVGGRTVAFY

SEQ ID NO: 1885 - protein, 241 aa, Bacteroides pectinophilus; identical to SEQ ID NO: 1436

SEQ ID NO: 1886 - protein, 271 aa, Natronorubrum sulfidifaciens; identical to SEQ ID NO: 1530

SEQ ID NO: 1887 - protein, 223 aa, Thermotoga sp. EMP; identical to SEQ ID NO: 1527

SEQ ID NO: 1888 - protein, 89 aa, Lactobacillus parafarraginis; identical to SEQ ID NO: 1514

SEQ ID NO: 1889 - protein, 212 aa, Hydrogenivirga sp. 128-5-R1-1
MECLKFELYSPCATFKTPFSLKGIETYPLPPYSTVIGLLYTALGRKWGGEEFSISVQGDYEAIFRDYIRFRKYNRKDKEIAVLPLEVPRLYNLRCVVHLLGEGEIIGSFIKALQKPKVYLFLGGGEYPVWIKNPRRVEVEEREVELETTYLAFVPESKYRLFDQTGVPFRLPSFYEVGEEKTYRWERVYFLPKSSIVEGRLLVDREGDVVWV

SEQ ID NO: 1890 - protein, 253 aa, Hydrogenivirga sp. 128-5-R1-1
MKVLSFSLFGDFAHFRKFYTTSSPLSFPFPPPPTIRGIIGAIMGFSKEEYLDKTKGISVGVSLKAPLKKVRMGLNLIFTKGSSGKFDPTLVPWRKGDVNKTLRTQIKAEFIKDPIYRIYLSADEDFIEELAELLKEHRSYYTVSLGLSELIADFSFEGIYEGNKINISARVDSVVSTKFVQEIDLERPQRIGKERIPADMCTDRKVLRYEDVIFNMEGGSLFGKFKDLVELENGEVVYLCKQSQNYTPTQVSS

SEQ ID NO: 1891 - protein, 210 aa, Haloferax mucosum
MLAAVLGIERDGYYELFGPGHSAVAIEPVEPLRTLNLPVNTLSTANESMKSMNAKGKISIKIPDPTKPRQQHNYEVLVDPAYRLYVWLRDSDWFDMLHEMLDEGKSHYVPSLGLSEYLAEIEYHGQFTVETGPADSVVAVDSAVPNAIDRIVPDAETRCQIEESPGFMTSDTGGRTTTGFTSYAYNPDAGPVNVRNPDTHIIDGNTVMFV

SEQ ID NO: 1892 - protein, 206 aa, Haloferax elongans
MLGIERDGYYGLFAPGESAIAIEPVEPLRTMNMPVNTLSTAAESMKSLNSRGKISIKLPDPTKPRQQHNYEVLVDPAYRLYVWVSDSDQFDALHQMLSQGKSQYVPSLGLSEYLADIRYHGQFEVENDPTTGVVAVDSAVPNAVDRVIPDTETRCQIEESPAFMQADGSGRTTTGFTSYAYNPDAGPIHVRDPDTNIVDGHTVMFV

SEQ ID NO: 1893 - protein, 263 aa, Halorubrum californiense
MAQESLESWTDEGDGLPETCLSFELRGEWGHFRRVEGNIVKQTYRIIPRTTVAGLVAAMLGLDRDSYYEAFSQNVSAVAVEPIDELRAINMPMNTLSTAKEHMTTMPSRGHARISMPDPSELRQQHNYEVLVEPAYRVDLQLANDDLRGRLQDRLCDGTSYYPPSLGLSEHLAEVTYLGEFEVTPHESETTNVDSAVLEAVDSVELTPETEVKVERSPAFMAADEGGRTTTAFQSIAYATGAEPLRAHDVKTHEVDGRRGMFS

SEQ ID NO: 1894 - protein, 262 aa, Natrinema gari; identical to SEQ ID NO: 1533

SEQ ID NO: 1895 - protein, 257 aa, Mucilaginibacter paludis; identical to SEQ ID NO: 1522

SEQ ID NO: 1896 - protein, 267 aa, Halorhabdus tiamatea; identical to SEQ ID NO: 1423

SEQ ID NO: 1897 - protein, 276 aa, Megamonas
MEILKFKLSGKSAFFKKPEVNTYCYFTYGNIHRVALLGILGAILGYKGYSQMQDILSNKKKKGKLEPSYPEFYEKLKDLKIAILPLNPKGVITKKIQIFNNSVGYASKEQGGNLIVKEQWLENPKWEICILLDCEEAIKIKEAIQNYKCEFYPYLGTNDHFADIEYLGVEEAQTVIQDDYRIDSFMAKDNIEFIEKNSRQLRKILSEDEIESYSRFKYEEALPKSIDAEVNNYKLERFVYTNGFVKFLDSKQVYSISNQDNKEAIEAKKRKNIVFY

SEQ ID NO: 1898 - protein, 254 aa, Prevotella maculosa; identical to SEQ ID NO: 1520

SEQ ID NO: 1899 - protein, 264 aa, Haloferax; identical to SEQ ID NO: 1537

SEQ ID NO: 1900 - protein, 254 aa, Haloferax
MVTTDIDVSGRECLSFTVEGPWAHFRRIDTTTEKLTYRVMPRTTVAGLIAAILGEPRDSYYETFAQDSSAIAISPECALETQSIPQLTLPTKAGNIMTAEGVSGKSVIDPEVIATERKRRTFEYVVDAAYRIDVVLDDTETFEQLRDFLESGRSTYTPALGKTECLASITDVSQSTVSEGGDSEAISSTVPEQYVVPEPGTPLRMERTPAYMSADETGRKTTGFVSYGYAPADETLTAPDAPVMNIGDRSVCFL

SEQ ID NO: 1901 - protein, 256 aa, Fusobacterium nucleatum; identical to SEQ ID NO: 1494

SEQ ID NO: 1902 - protein, 256 aa, Fusobacterium nucleatum; identical to SEQ ID NO: 1444

SEQ ID NO: 1903 - protein, 245 aa, Clostridiales; identical to SEQ ID NO: 1449

SEQ ID NO: 1904 - protein, 81 aa, Erysipelotrichaceae; identical to SEQ ID NO: 1424

SEQ ID NO: 1905 - protein, 233 aa, Erysipelotrichaceae; identical to SEQ ID NO: 1515

SEQ ID NO: 1906 - protein, 340 aa, Fusobacterium periodonticum; identical to SEQ ID NO: 1443

SEQ ID NO: 1907 - protein, 250 aa, Fusobacterium gonidiaformans; identical to SEQ ID NO: 1479

SEQ ID NO: 1908 - protein, 369 aa, Fusobacterium gonidiaformans; identical to SEQ ID NO: 1480

SEQ ID NO: 1909 - protein, 359 aa, Fusobacterium periodonticum; identical to SEQ ID NO: 1462

SEQ ID NO: 1910 - protein, 263 aa, Halorubrum kocurii
MAQESLESWTDEGEALPETCLSFELRGEWGHFRRVEGNIVKQTYRIIPRTTVAGLVAAMLGLDRDSYYEAFSQNVSAVAVEPIDELRAINMPMNTLSTAKEHMTTMPSRGHARISMPDPSELRQQHNYEVLVEPAYRVDLQLANDDLRGRLQDRLRDGTSYYPPSLGLSEHLAEVTYLGEFEVTPHERETTNVDSAVLEAVDSVELTPETEVKVERSPAFMAADEGGRTTTAFQSIAYATGAEPLRVHDVKTHEVDGRRVMFS

SEQ ID NO: 1911 - protein, 238 aa, Caloramator australicus
MDFLVFDLKGKFAHFRKFYTNSSSLSYSVPPRTTIEGLIAAILGYERDSYYEILDSQKLNIGLKKLTPTRKIVQSLNYIKATSISHVIKPKEHTQVPFEIVTSEGNLGYRVYVNHIDERLMEDLEDRLKNNRFHYVPYLGVASFNLSIEFIGRFHGERKFDEDFVEISSIIRKSLIKEGGLDVNIEGIIVKEKMPRDFLKDRIVKEIEDYIFEENGGPLRVKLNSNYYEINDEKIVLM

SEQ ID NO: 1912 - protein, 224 aa, Caloramator australicus
MKALKLKLFQETACYKKPFALKVAETYPLPPYSTVKGFLHYVLEAEDFVDMAISVQGDYEDKFINLQTFYFYKQNEITKGPLNVHYLHNVELLIHVYAKEAILNKIIENMKNSKEFFSLGRREDLVRIDDIKMVEFREIDLDEEDDIYGLKYSAYIPKFYNYEALTGINYNLNFKYNIKNEIREWEKVKVVYVEKDSNVITNGKIYLDNEGDIIFFNKKVGEIV

SEQ ID NO: 1913 - protein, 231 aa, Lachnospiraceae bacterium 4_1_37FAA; identical to SEQ ID NO: 1487

SEQ ID NO: 1914 - protein, 368 aa, Fusobacterium necrophorum; identical to SEQ ID NO: 1481

SEQ ID NO: 1915 - protein, 239 aa, Nitritalea halalkaliphila
MAERVIVFDIWGQFAHFKKIYVTTSALSYAVPFKTSIYGMVGAILGMENSENQYLTSFKEGKCQIGIQLINPVQFQRININLSPTPGPIKDNRKPTLMEFVVRPHYRIYFSHTDKKLVDELKDSLKRKASVFTPVLGLAFCLANFRYIGEGSVEKKEGISLIQTAILKSNLKSFDQDYWIENNIHIQEQDMYPLEMNPSREVTKRDSLIYDLNGKAIKVNSKGHYELKLNGNVSDVMMM

SEQ ID NO: 1916 - protein, 223 aa, Clostridium sp. DL-VIII; identical to SEQ ID NO: 1505

SEQ ID NO: 1917 - protein, 264 aa, Cecembia lonarensis
MDVLSFDICGKFAHFRKFHANNTALSYSIPPRTTIIGIIAGIMGRDKNSYYEEFSSENMRIGIRIVSDIRKSFHRLNYLMIKGKDDFTGKNGRVQTPFEVITGNSIREGKVVYRVYISDREGSKFKNTDNLKEFLLNQKAAFNASLGPANFNASIENIRIWQNVNSIHVNNEFVNIHSACNSKDVSELEFIEDAAFKFNFVEEELLPADFKANNDRELKAMNRVLYSTRSFPLRVKLKGTYHELKEGNEVQRIQFLENVGILTQ

SEQ ID NO: 1918 - protein, 234 aa, Eisenbergiella tayi; identical to SEQ ID NO: 1493

SEQ ID NO: 1919 - protein, 159 aa, Lachnospiraceae bacterium 5_1_63FAA
MKALRIKLHQTSANYRKEETIDNKMTYPLPPISTVTGALHSICGYTEYHKMLVSIQGNYQSMQNKIYTHHCFLNSTMDDRGLLVKMKNENLLSTAYDKVAEAKKSQGNSFLKGITIQVYNQGLLDEYRNLKEMGNKIALWKKSEEYTDKVAMYKTKNNN

SEQ ID NO: 1920 - protein, 252 aa, Anaerostipes caccae; identical to SEQ ID NO: 1425

SEQ ID NO: 1921 - protein, 235 aa, Anoxybacillus gonensis
MKALRLKLFQETACYKKPFASKVAETYPLPPYSTVKGMIHALLDANQFIPMRLSVQGTYEAKLLDYQRYYFFKRRELSSFPLVLDGLARMEFSYDKNEITTMPMYTHLLHNVHLLIHVEAEEHILTQIIHAIEHSTTHYSLGRWEDLVRIDEYKLVEVRELEEDETLTLQRDAYISRHLLDRETKSIPYQLNWKYEIVNGIRQWEKIHVGYVQKGIEAPEGVWMDEDGELVFYHL

SEQ ID NO: 1922 - protein, 366 aa, Fusobacterium sp. oral taxon 370; identical to SEQ ID NO: 1504

SEQ ID NO: 1923 - protein, 152 aa, Parvimonas sp. oral taxon 393
MKDKLLRIKLHQNKANYKKEETSENKMTYPLPPYSTIIGAIHNACNYKEYKDMDISIQGRFQSLGKEMYKDQTFLNNVMDDRGILVKLKNPDTFNEGYKIIAKALKPQENSFKNRTTIDIYDEEELKEYIRICNLREFYQKKSDDFKILKKV

SEQ ID NO: 1924 - protein, 374 aa, Peptoanaerobacter stomatis; identical to SEQ ID NO: 1511

SEQ ID NO: 1925 - protein, 374 aa, Peptoanaerobacter stomatis
MKNSVLRLKLHQNKAHYRKEETVNNKMTYPLPTYSMIIGAIHNACNYKEYRPMDISIQGSYESIKREIYTDYCFLNSVMDDRGILVKLNNPDLLENGYKVIAKALKSQGNSFKKRITIEICDEKELDEYIRISDLRIKFQEENSSINQKISTKKNEIKKIKQEQKTKDKKSDEYKNMSDKINEINDEIKKIKDEFDERRKVEYLKPISYYASLTKSIKSYEVLYGVDLVIHIRSDEETLNNIKKNYHNITSVGRSEDFVDNIEISFVNISDEEDSFKHIKSKYKAYVDKEAVENKAIIKSNLSAHKVNFVPTRGTTYYINKNYVIENNKRVFEKKRVVYLSGYEFGLNISQYNYQNKAKGIYIDIDNKDIVSFL

SEQ ID NO: 1926 - protein, 168 aa, Peptoanaerobacter stomatis; identical to SEQ ID NO: 1512

SEQ ID NO: 1927 - protein, 348 aa, Peptoanaerobacter stomatis
MTYPLPTYSMIIGAIHNACNYKEYRPMDISIQGSYESIKREIYTDYCFLNSVMDDRGILVKLNNPDLLENVYKVIAKALKSQGNSFKKRITIEICDEKELDEYIRISDLRIKFQEENSSINQKISTKKNEIKKIKQEQKTKDKKSDEYKNMSDKINEINDEIKKIKDEFDERRKVEYLKPISYYASLTKSIKSYEVLYGVDLVIHIRSDEETLNNIKKNYHNITSVGRSEDFVDNIEISFVNISDEEDNFKHIKSKYKAYVDKEAVENKAIIKSNLSAHKVNSVPTRGTTYYINKNYVIENNKRVFEKKRVVYLSGYEFGLNINQYNYQNKDKGIYIDIDNKDIVSFL

SEQ ID NO: 1928 - protein, 266 aa, Caldanaerobacter subterraneus; identical to SEQ ID NO: 1435

SEQ ID NO: 1929 - protein, 283 aa, Mogibacterium sp. CM50
MNIMQADRESIKPVDFDGKEAVRIRIEQDLVNYKKPMSFQLKESYPLPPYSTVIGMIHNMCRYEEYVNMQISIQGQYKSKVNDLYTRYEFKNGTNFEAGRHQLNVNGLGVGRGVATIELLSQVELVIHICPEEQSKTEEICRAFKNPWEYPSLGRREDLVTIKEVGKTKIMLKEIDDDKSMEIGRYAYIPLKYYKNTGEEELIVGYDYLGNSVLRRKAGKGLTQRGTRLLLNKEYDKLNYGNSKKTKYIRAWNRVEALYTSHIYADMDEKFLCDEDEEFVFFA

SEQ ID NO: 1930 - protein, 236 aa, Campylobacter
MDIVAFRLTGDYAHFSHPATIYSSLTYPVPPKTAIMGFLGAVIGEEQYHKLSDIKYSIKIDGQISKKSFVFNGIKFALSSSMHLKEGYQDASEKKQFYRELIKNPSYIIFLNLENLKDGYRKTIIKNLKEHKSAFTPYLGINFCIADFEWIDVKNCFLIEENESEIDTFTLLDDFIFDTASCDIKLTTARMACECEEARIFKDFNDFIIKVSGPNKIRSKNRKNIYQIDEDKVYFV

SEQ ID NO: 1931 - protein, 268 aa, Clostridioides difficile; identical to SEQ ID NO: 1402

SEQ ID NO: 1932 - protein, 233 aa, Clostridioides difficile; identical to SEQ ID NO: 1413

SEQ ID NO: 1933 - protein, 265 aa, Clostridioides difficile; identical to SEQ ID NO: 1564

SEQ ID NO: 1934 - protein, 237 aa, Clostridium senegalense
MKIIKFSVEGVFNSFRVPFFRTYHKSFLAPPKTTIIGLITNIMGKSEAYYYKILNEEKIQVSVVINSIKGKAKDLWSYKSFESKSNMHGRSIIRRDKLFNAKYTIYLMIQDEDLRQKVLNCLKAPKSIPSLGLDDELIKIYDVKSDIELKDNDTNIINSVFMDKGYNYKVKVKDLSNDIEFPTANMVPLNYKIKVNNESRTARESCDEYKQIEYINCEVELKDMKSFICSTDKVVFY

SEQ ID NO: 1935 - protein, 266 aa, Paenibacillus peoriae
MQALCFELSGETAFFKKPDVNVYAYFTYSHIHKVALYGLLGAVLGLGGYTQQYERNMALGGKAKQDNPAMPYPEFYEVFRHASVSIVPHGDRGYFSKKIQIFNNTVGYASQEEGGVLNVREQWLERPRWTIYVADDGGVDREVFDRLADYVQHSKAEYIPYLGKNDHPATISKARLVELEPASEPEYIDSLRAAHVLVDTGGYVKDDQMQSYLQEYLPVGLNTANNGYILEPLVFSNQEIDTDELKAEDLQKMYRDADNDRTLYFI

SEQ ID NO: 1936 - protein, 269 aa, Anaerophaga thermohalophila
MKKQLLSFDIKADFGMLKKPDTNEPLYLTFNMLHKPALLGILGAIGGFPGFSKNGELPEYYQLLKNVQVGIMPLPNKTGENYHENGNFTKTIIKYNNTTGLASEETGGNLMVAEQTLIAPAFRCFVLLNSVNQDEQLLTKNLLAYHAEYVPYLGKNECSLWWENAQEICYSEFVPEGTFKISSLFLKSEPLKDSKAEEPLFDILMESSEGNTFTYFENLPIAYSGAPLFQYEYGNFAYTDWDLSLKQKSSGNFIKLKTGEDEGKIIQLF

SEQ ID NO: 1937 - protein, 227 aa, Thermococcus zilligii
MLGLVVEVKPIQAHFRIPYNSLLMDSYPFPPRTTAIGMLAGAMGLPEEGFRGLLNELRYGVIVEEAGSRVEETAVIFKKEDSPIYPITKVLYHKPHYRLFFAGEDRLIERAYEALLDPVFTPYLGDSESLLYPARKDYVRLVGVEEGRETTLRSVIPEEAYSSGARFFVLRGSNLTPRDYRMPVGFTYSGKKRRAVFRRVVAFAGGYVELASPVEVFLFDGEPVFTF

SEQ ID NO: 1938 - protein, 466 aa, Bacteroides faecis
MNTIRNTLFLGIICAVTTVSSTAHEFEFNKIYPKKSVKTQVRKEIVTFFSEYLSGKTTTFDAGKSLKLSEVEQYRDAVWQLWKEANAGFEEEKLIALDTLSSNSSGYWKLPENLEPNAVMPYCWGMKGAVETGAELPLFLYLHGSGPKEREWSTGLKICRNFDDAPSVYFIPQIPNEGDYYRWWQKAKQFAWEKLLRQALLLGEIDPNRVYVFGISEGGYGSQRLASFYADYWAAAGPMAGGEPLKNAPAENCSNIAFSLRTGDKDTGFYRNTLTGYALEAFDSLAHQRPGHFIHKIELIPGMGHSIDYRPTTPWLKQYVRNPYPRYVSWENFEMDGIYRTGFYNLYVKERSDEEGKSRTYYEMNISGNDISLKVNEVVYEVIEKDPRWGIEMKFAKKYMQAHKGKVIIYLCDKLVDLNEKVTLTVNGKKVFEGKMKADLKNIVNSCAAFFDPLRLYPASIEVELD

SEQ ID NO: 1939 - protein, 369 aa, Fusobacterium gonidiaformans; identical to SEQ ID NO: 1483

SEQ ID NO: 1940 - protein, 250 aa, Enterococcus raffinosus
MKGIKLTVHQDMVNYRRPTSFQLRETYPLPPLSTVIGMVHNLCGYKQYEPMDISIQGNYFSKANDLYTRYEFKNGMKFEKARHQVKVNEFGVSRGIGYTELLVDVHLMLHIVPKNQDKVEEIYQFLKYPAEFPSLGRREDQANFEKVSIVEIEKKELEEDIEFQDRWSAYMPIEKVDEGSISIEGKGTLLSGTRFILPKVYELYNFGTKNKPKFKRNWIERKEVLYSSIFTIAEEESIEVDEEGDIVFLL

SEQ ID NO: 1941 - protein, 269 aa, Methanothermobacter thermautotrophicus; identical to SEQ ID NO: 1210

SEQ ID NO: 1942 - protein, 219 aa, Aquifex aeolicus; identical to SEQ ID NO: 1211

SEQ ID NO: 1943 - protein, 227 aa, Pyrococcus horikoshii; identical to SEQ ID NO: 1361

SEQ ID NO: 1944 - protein, 232 aa, Methanosarcina mazei; identical to SEQ ID NO: 1213

SEQ ID NO: 1945 - protein, 256 aa, Clostridium tetani; identical to SEQ ID NO: 1214

SEQ ID NO: 1946 - protein, 234 aa, Nanoarchaeum equitans; identical to SEQ ID NO: 1215

SEQ ID NO: 1947 - protein, 265 aa, Haloarcula marismortui; identical to SEQ ID NO: 1216

SEQ ID NO: 1948 - protein, 248 aa, Carboxydothermus hydrogenoformans; identical to SEQ ID NO: 1217

SEQ ID NO: 1949 - protein, 235 aa, Methanosphaera
MNLIVFDIWGDYAYFRRGYTTTSTLTYPFPSRTTIAGFIAGILGYPRNSYYDLFQKENSKIGLKIINPIKKTRINLNYINTKNSMLLSEIKGNGKRTQVPAEFLKNVKYRIYLSLDDEEIMNKLYNTLKEHKSVYTPYLGITECLANFSLVGKGIYSTESIKGNNVDINSVVLKESGNIKIEPKKRYGVIKSPGFMEDDRSVTSFLEYYYESMGNTIKLESCEYYKVGEDNVILY

SEQ ID NO: 1950 - protein, 282 aa, Methanosphaera
MYNKLIEFNIESSFGCFNKPFSNKGGLLSYNIPPKTSIIGMVCSILGIEFDDYIEKDDVRVYAIEKFYDIKVSVQMMSKVRSSRIIFNNTSDGDIANIHQDLLIKPKYKIFISFPDTLVEYEKDFINKLKKHETVYNLYMGRNEFPISYEFISEYPIESKEYTCDDSNELRNLKVIGILKRSKIDNLKIETTNEDDDEEFDFFNFSDNTVTLNNNMEYLLREYPIKRSNFTNFSYEFISYYQDTEDLSSYFCNIELKNNETITLTKIYLDNKVGEERWIQMI

SEQ ID NO: 1951 - protein, 231 aa, Desulfitobacterium hafniense
MKGLAFDVLGTVGHFRRPDTTATQLTYPFITPTAAKGLVGAILGIEDFVTTDRVGIELLRPVRTVAQQMSMLGKDPGSTFNRPTTIELLVNPGYRIYYTGEEYTEQLLDFLTGERAVYTTYLGTAYALTKPILYRVYPEVSYPVAEGKEIEMRTVVPTALIREIVLKADRYYCRAGGYLYEYKGQRTFEKSVDFLYEKDGKPIAFIPKSDGPDSPLDLRVAQFGEDLVCLV

SEQ ID NO: 1952 - protein, 264 aa, Methanococcoides burtonii; identical to SEQ ID NO: 1218

SEQ ID NO: 1953 - protein, 258 aa, Rubrobacter xylanophilus; identical to SEQ ID NO: 1219

SEQ ID NO: 1954 - protein, 314 aa, Clostridium perfringens
MDISIQGTYESMGLEPYTDYCFLNTVMDDRGILVKLRNGKYLSNSFDKVAKALKSQGNSFREGKTIQVYNEKLLEEYRNLKGLKDKIDEFSRGKLKEVLNLIKLRKKTLSSKKKELKDNKEKLELIKKREIQIKNLEKRLKSEFDDYKEKNYNEPYSKFASLTTSLKYYETLYNVKLIIHVRCEDENTLLDIKENIYNLKSIGRSEDFVDIKEVKIVDLVEEGKELKRRIVNINSAYVDYNLVKGKIIRSRNLSDSKECNGTKYLLNKNYEILDKKRVFKKKKVVYLSNYVVRKKVDNVYYDLGEEESYIVNFI

SEQ ID NO: 1955 - protein, 246 aa, Syntrophomonas wolfei; identical to SEQ ID NO: 1220

SEQ ID NO: 1956 - protein, 231 aa, Syntrophomonas wolfei; identical to SEQ ID NO: 1221

SEQ ID NO: 1957 - protein, 233 aa, Methanothrix thermoacetophila; identical to SEQ ID NO: 1223

SEQ ID NO: 1958 - protein, 212 aa, Clostridium novyi
MGYKGYNSQCNKFYKHNIKERVYPEFYEKLKDIKIGIVPINEHGYNLKKVQTFNNSVGYASQEKGGNLIVKEQWLEKPKWEIYILIENEITEQLADRLKNYRFKYIPYLGKNDHLADISFVEIINDTKKVLNIDKLNSLFISNYFSVNLDEDDDLDCDETIWKYEEDLPIALEETTNKYELERFMLTNASLDAKHSQEFNIYKCNDKNIFFF

SEQ ID NO: 1959 - protein, 253 aa, Campylobacter fetus
MRAVSFKLSGKFAHFKKPDVNEYAYFTYNNIPKPTLLGLLGAIIGLKGYAQKTYKDKKDKKSLFNNENSSNEPEFYERLKHLKICIIPLVKYGRFSKKIQIFNNGVGYASGEDGGNLIVREQWLENPSWQILIEDDGSAEFETVSRYLFDKKAKFIPYLGKNDHFADISEVEKIDLAESKKDRISIKSLFLDDLAEQVDDPDDEISYLFNEFYPISFNELMFYELKKVAFTNQICRAIDGKWYEFKDGTICFF

SEQ ID NO: 1960 - protein, 233 aa, Methanococcus maripaludis; identical to SEQ ID NO: 1225

SEQ ID NO: 1961 - protein, 242 aa, Desulfotomaculum reducens
MMKLIAFRLSGRFGHFLRAEAGTSALSYPVPPRTVLLGILGAVLGLEKDLPQELLEPLHIALAGPVPQSHWHKAKLRKDPPEALPQVVKNNQKQEKTTKPEMATLITQEWLFNPAYTIWVALPEPYHQQLEQRLKERCWHFQPCLGLSEMMADIEYLGTLMAEKLPRGSYPVTSIIPQEQAKLDLTQVYDQELALQPLRMPRTVTSSRVFGHSSYFIETKGHPVMVETEQAYQVGDRVLMFI

SEQ ID NO: 1962 - protein, 250 aa, Caldicellulosiruptor; identical to SEQ ID NO: 1226

SEQ ID NO: 1963 - protein, 275 aa, Caldicellulosiruptor; identical to SEQ ID NO: 1227

SEQ ID NO: 1964 - protein, 225 aa, Methanococcus vannielii; identical to SEQ ID NO: 1229

SEQ ID NO: 1965 - protein, 256 aa, Methanococcus aeolicus; identical to SEQ ID NO: 1230

SEQ ID NO: 1966 - protein, 201 aa, Campylobacter curvus; identical to SEQ ID NO: 1430

SEQ ID NO: 1967 - protein, 230 aa, Pseudothermotoga; identical to SEQ ID NO: 1233

SEQ ID NO: 1968 - protein, 253 aa, Thermosipho melanesiensis; identical to SEQ ID NO: 1228

SEQ ID NO: 1969 - protein, 232 aa, Bacillus cytotoxicus; identical to SEQ ID NO: 1231

SEQ ID NO: 1970 - protein, 237 aa, Campylobacter hominis; identical to SEQ ID NO: 1232

SEQ ID NO: 1971 - protein, 242 aa, Petrotoga mobilis; identical to SEQ ID NO: 1234

SEQ ID NO: 1972 - protein, 220 aa, Thermotoga sp. RQ2; identical to SEQ ID NO: 1236

SEQ ID NO: 1973 - protein, 250 aa, Dictyoglomus thermophilum; identical to SEQ ID NO: 1237

SEQ ID NO: 1974 - protein, 233 aa, Anoxybacillus flavithermus; identical to SEQ ID NO: 1238

SEQ ID NO: 1975 - protein, 236 aa, Thermosipho africanus; identical to SEQ ID NO: 1239

SEQ ID NO: 1976 - protein, 257 aa, Thermosipho africanus; identical to SEQ ID NO: 1240

SEQ ID NO: 1977 - protein, 238 aa, Dictyoglomus turgidum; identical to SEQ ID NO: 1241

SEQ ID NO: 1978 - protein, 238 aa, Halothermothrix orenii; identical to SEQ ID NO: 1243

SEQ ID NO: 1979 - protein, 265 aa, Halorubrum lacusprofundi
MTPSINASGVPDTCLSLTVRSTWGHFKRVGRSVTKQTYRIPPRTTVAGMLAAIVGSDRDSYYDVFGADTSAIAITPLFDIRTVNVPTTGLGTDPKQAVTKTAGSRRSYALTYQDTEGDRQIHAYELLTDPVYRIDVAVEDEAYYEKLERRLDNEESYYPPSLGKSEYLCTVEDVETDVSPTELAEAEQYDVDSVVPGSLSEVIPQQGVTYDIERSPAVMEATLGGRKTTRFDDYVYTRSADTPVRVGSTADVTPVSVGDRTVVFR

SEQ ID NO: 1980 - protein, 280 aa, Desulfobacterium autotrophicum; identical to SEQ ID NO: 1246

SEQ ID NO: 1981 - protein, 229 aa, Sulfurihydrogenibium azorense; identical to SEQ ID NO: 1247

SEQ ID NO: 1982 - protein, 253 aa, Persephonella marina; identical to SEQ ID NO: 1248

SEQ ID NO: 1983 - protein, 245 aa, Geobacillus sp. WCH70; identical to SEQ ID NO: 1250

SEQ ID NO: 1984 - protein, 264 aa, Thermobaculum terrenum; identical to SEQ ID NO: 1262

SEQ ID NO: 1985 - protein, 266 aa, Spirosoma linguale; identical to SEQ ID NO: 1263

SEQ ID NO: 1986 - protein, 287 aa, Methanobrevibacter ruminantium; identical to SEQ ID NO: 1264

SEQ ID NO: 1987 - protein, 253 aa, Hydrogenobacter thermophilus; identical to SEQ ID NO: 1283

SEQ ID NO: 1988 - protein, 56 aa, Hydrogenobacter thermophilus; identical to SEQ ID NO: 1363

SEQ ID NO: 1989 - protein, 258 aa, Methanocaldococcus sp. FS406-22; identical to SEQ ID NO: 1265

SEQ ID NO: 1990 - protein, 262 aa, Listeria seeligeri; identical to SEQ ID NO: 1370

SEQ ID NO: 1991 - protein, 237 aa, Thermoanaerobacter italicus; identical to SEQ ID NO: 1266

SEQ ID NO: 1992 - protein, 230 aa, Deferribacter desulfuricans; identical to SEQ ID NO: 1364

SEQ ID NO: 1993 - protein, 231 aa, Deferribacter desulfuricans; identical to SEQ ID NO: 1365

SEQ ID NO: 1994 - protein, 265 aa, Haloferax volcanii; identical to SEQ ID NO: 1267

SEQ ID NO: 1995 - protein, 266 aa, Zunongwangia profunda; identical to SEQ ID NO: 1268

SEQ ID NO: 1996 - protein, 251 aa, Kyrpidia tusciae; identical to SEQ ID NO: 1269

SEQ ID NO: 1997 - protein, 234 aa, Kyrpidia tusciae; identical to SEQ ID NO: 1270

SEQ ID NO: 1998 - protein, 239 aa, Methanocaldococcus infernus; identical to SEQ ID NO: 1271

SEQ ID NO: 1999 - protein, 238 aa, Thermincola potens; identical to SEQ ID NO: 1272

SEQ ID NO: 2000 - protein, 235 aa, Geobacillus sp. C56-T3; identical to SEQ ID NO: 1275

SEQ ID NO: 2001 - protein, 248 aa, Thermoanaerobacter; identical to SEQ ID NO: 1273

SEQ ID NO: 2002 - protein, 237 aa, Thermoanaerobacter mathranii; identical to SEQ ID NO: 1274

SEQ ID NO: 2003 - protein, 241 aa, Methanococcus voltae; identical to SEQ ID NO: 1276

SEQ ID NO: 2004 - protein, 232 aa, Thermosediminibacter oceani; identical to SEQ ID NO: 1278

SEQ ID NO: 2005 - protein, 248 aa, Caldicellulosiruptor obsidiansis; identical to SEQ ID NO: 1279

SEQ ID NO: 2006 - protein, 243 aa, Caldicellulosiruptor obsidiansis; identical to SEQ ID NO: 1280

SEQ ID NO: 2007 - protein, 237 aa, Thermoanaerobacterium thermosaccharolyticum; identical to SEQ ID NO: 1281

SEQ ID NO: 2008 - protein, 246 aa, Clostridiales; identical to SEQ ID NO: 1282

SEQ ID NO: 2009 - protein, 233 aa, Bacillaceae; identical to SEQ ID NO: 1284

SEQ ID NO: 2010 - protein, 244 aa, Bacillaceae; identical to SEQ ID NO: 1285

SEQ ID NO: 2011 - protein, 248 aa, Caldicellulosiruptor hydrothermalis; identical to SEQ ID NO: 1286

SEQ ID NO: 2012 - protein, 250 aa, Caldicellulosiruptor hydrothermalis; identical to SEQ ID NO: 1287

SEQ ID NO: 2013 - protein, 239 aa, Halanaerobium hydrogeniformans; identical to SEQ ID NO: 1288

SEQ ID NO: 2014 - protein, 275 aa, Caldicellulosiruptor kronotskyensis; identical to SEQ ID NO: 1292

SEQ ID NO: 2015 - protein, 250 aa, Caldicellulosiruptor kronotskyensis; identical to SEQ ID NO: 1293

SEQ ID NO: 2016 - protein, 248 aa, Caldicellulosiruptor kristjanssonii; identical to SEQ ID NO: 1289

SEQ ID NO: 2017 - protein, 250 aa, Caldicellulosiruptor kristjanssonii; identical to SEQ ID NO: 1290

SEQ ID NO: 2018 - protein, 243 aa, Caldicellulosiruptor kristjanssonii; identical to SEQ ID NO: 1291

SEQ ID NO: 2019 - protein, 224 aa, Calditerrivibrio nitroreducens; identical to SEQ ID NO: 1294

SEQ ID NO: 2020 - protein, 253 aa, Thermaerobacter marianensis; identical to SEQ ID NO: 1295

SEQ ID NO: 2021 - protein, 247 aa, Geobacillus; identical to SEQ ID NO: 1261

SEQ ID NO: 2022 - protein, 245 aa, Thermovibrio ammonificans; identical to SEQ ID NO: 1297

SEQ ID NO: 2023 - protein, 259 aa, Odoribacter splanchnicus; identical to SEQ ID NO: 1299

SEQ ID NO: 2024 - protein, 252 aa, Syntrophobotulus glycolicus; identical to SEQ ID NO: 1300

SEQ ID NO: 2025 - protein, 237 aa, Methanothrix soehngenii; identical to SEQ ID NO: 1301

SEQ ID NO: 2026 - protein, 237 aa, Clostridium botulinum; identical to SEQ ID NO: 1302

SEQ ID NO: 2027 - protein, 238 aa, Thermodesulfobium narugense; identical to SEQ ID NO: 1303

SEQ ID NO: 2028 - protein, 254 aa, Tepidanaerobacter acetatoxydans; identical to SEQ ID NO: 1304

SEQ ID NO: 2029 - protein, 255 aa, Mahella australiensis; identical to SEQ ID NO: 1305

SEQ ID NO: 2030 - protein, 237 aa, Thermoanaerobacterium xylanolyticum; identical to SEQ ID NO: 1306

SEQ ID NO: 2031 - protein, 255 aa, Desulfofundulus kuznetsovii; identical to SEQ ID NO: 1308

SEQ ID NO: 2032 - protein, 281 aa, Desulfofundulus kuznetsovii; identical to SEQ ID NO: 1309

SEQ ID NO: 2033 - protein, 242 aa, Desulfotomaculum ruminis; identical to SEQ ID NO: 1311

SEQ ID NO: 2034 - protein, 249 aa, Bacillus coagulans; identical to SEQ ID NO: 1316

SEQ ID NO: 2035 - protein, 239 aa, Flexistipes sinusarabici; identical to SEQ ID NO: 1317

SEQ ID NO: 2036 - protein, 227 aa, Pyrococcus yayanosii; identical to SEQ ID NO: 1312

SEQ ID NO: 2037 - protein, 235 aa, Pseudothermotoga thermarum; identical to SEQ ID NO: 1315

SEQ ID NO: 2038 - protein, 232 aa, Sulfobacillus acidophilus; identical to SEQ ID NO: 1318

SEQ ID NO: 2039 - protein, 221 aa, Methanococcus maripaludis; identical to SEQ ID NO: 1319

SEQ ID NO: 2040 - protein, 228 aa, Thermococcus sp. 4557; identical to SEQ ID NO: 1320

SEQ ID NO: 2041 - protein, 265 aa, Haloarcula hispanica; identical to SEQ ID NO: 1321

SEQ ID NO: 2042 - protein, 250 aa, Caldicellulosiruptor lactoaceticus; identical to SEQ ID NO: 1322

SEQ ID NO: 2043 - protein, 243 aa, Caldicellulosiruptor lactoaceticus; identical to SEQ ID NO: 1323

SEQ ID NO: 2044 - protein, 229 aa, Bacillus coagulans; identical to SEQ ID NO: 1325

SEQ ID NO: 2045 - protein, 275 aa, Thermococcus sp. AM4; identical to SEQ ID NO: 1434

SEQ ID NO: 2046 - protein, 234 aa, Thermovirga lienii; identical to SEQ ID NO: 1326

SEQ ID NO: 2047 - protein, 258 aa, Niastella koreensis; identical to SEQ ID NO: 1329

SEQ ID NO: 2048 - protein, 237 aa, Hungateiclostridium clariflavum; identical to SEQ ID NO: 1327

SEQ ID NO: 2049 - protein, 249 aa, Hungateiclostridium clariflavum; identical to SEQ ID NO: 1328

SEQ ID NO: 2050 - protein, 361 aa, Acetobacterium woodii
MKALRIKLYQSSANYRKEESDTNKMTYPLPPFSTVIGALHEASGYQTYHPMDLSIQGKYESMHREPYTDYCFLNSTMDDRGILVKMRNPELLSSAFDKVAAAQKSQGNSFRKRITIKVFDEILYQEFIALKELNDEIENFKNTRYKRIMDLIKTRKKTIKIKKTEVSKGEIQYEKLCRREKQIKEIEKQIKDEFEKYKEVQYTKPYSKFRSLTTSLKFYEILNNVELVIHVKAEETVLMTILDNIYHLKSIGRSEDFVEVTEAKIVELIQDDNCDVTSSFSAYLDFRDVKNERIFPVAVGGGVNEKGGTRYGLNKTYQIIDDKRIFDKKSVIYLSQYGIDETSETIWLDRDDDQEYIVNFI

SEQ ID NO: 2051 - protein, 276 aa, Haloquadratum walsbyi; identical to SEQ ID NO: 1378

SEQ ID NO: 2052 - protein, 241 aa, Mesotoga prima; identical to SEQ ID NO: 1331

SEQ ID NO: 2053 - protein, 224 aa, Pyrococcus sp. ST04; identical to SEQ ID NO: 1333

SEQ ID NO: 2054 - protein, 237 aa, Thermoanaerobacterium aotearoense; identical to SEQ ID NO: 1334

SEQ ID NO: 2055 - protein, 227 aa, Thermococcus cleftensis; identical to SEQ ID NO: 1335

SEQ ID NO: 2056 - protein, 236 aa, Acetomicrobium; identical to SEQ ID NO: 1336

SEQ ID NO: 2057 - protein, 225 aa, Natrinema sp. J7-2; identical to SEQ ID NO: 1337

SEQ ID NO: 2058 - protein, 236 aa, Desulfobacula toluolica
MTKVLVFKLWGDYGHFKKFYTTTSPLTFEFPPPVTVLGIVSAIIGLDKDSYLENFIDPTRCHLAIGLERPVKKVRWTQNLIDTKRNFWKIHNRTQIRTEFLKDPGFKFFFSHKNPEIYDQLKENLMAHKSYYTISLGLSELLADFEFCGEQTITPSTTDEWQSIQSVVPCSALQDDQSIDFEEGKEIFKISYPVEMIPNRVVTRREDVIFERRGLPVTCRVKEVFKTEEGEKIVFF

SEQ ID NO: 2059 - protein, 253 aa, Gottschalkia acidurici
MKETKKAVRLKLRQDMVNYKKPTSFQLKETYPLPPYSTVIGMVHSLCDYKDYEKMEISIQGKYHSKVNDLYTRYEFKNGMRFEESRHQLKVGDFGISRGVSTIELLVDVELLIHIIPEDQALVEEIGRAFLYPREYPSLGRREDLVVIKEAKVVDIFEEELGKSLRMRDDYSAYIPMHLFEEVKLKDKVQGIDTSGTIYKLNKNYELVDYGTKKSPKIFRKWDKKQVVYGSNISAIRKRIITLDMDKNIVFSV

SEQ ID NO: 2060 - protein, 225 aa, Candidatus Nitrososphaera gargensis; identical to SEQ ID NO: 715

SEQ ID NO: 2061 - protein, 240 aa, Thermacetogenium phaeum; identical to SEQ ID NO: 1339

SEQ ID NO: 2062 - protein, 229 aa, Thermobacillus composti; identical to SEQ ID NO: 1341

SEQ ID NO: 2063 - protein, 237 aa, Thermoanaerobacterium thermosaccharolyticum; identical to SEQ ID NO: 1342

SEQ ID NO: 2064 - protein, 250 aa, Thermoclostridium stercorarium; identical to SEQ ID NO: 1343

SEQ ID NO: 2065 - protein, 236 aa, Thermoclostridium stercorarium; identical to SEQ ID NO: 1344

SEQ ID NO: 2066 - protein, 218 aa, Clostridium saccharoperbutylacetonicum; identical to SEQ ID NO: 1345

SEQ ID NO: 2067 - protein, 49 aa, Methanosarcina mazei
MPIFTPYLGVSEYIAKLDYEKRVNAELLTKSSSIDSLVPSRFIDLQHSE

SEQ ID NO: 2068 - protein, 223 aa, Hydrogenobaculum; identical to SEQ ID NO: 1307

SEQ ID NO: 2069 - protein, 259 aa, Candidatus Cloacimonas acidaminovorans
MNIPENSNRILELKLSGKFAHFRKFYTNASSLTYLIPPRTAICGLLASILQIERDCYYNLMSSDKLGIAISLVPNIYYHKVFQTLNYAQDKSKNIPINDLSAHKQCRLELLKAQGSKNLEWILYLCFNSAEENNFAELEHKIKEKNFGYGLYLGQRQFIAYLELIRTYSQGEFKPISESDYLDSAIERELIDSIISQDCDLIMERMPLEQELKTDTKKSYRQTKRFGNIVIETNGKRIHGKFRNLVELNNDLKARVSFL

SEQ ID NO: 2070 - protein, 237 aa, Ruminococcus sp. SR1/5; identical to SEQ ID NO: 1372

SEQ ID NO: 2071 - protein, 241 aa, Fretibacterium fastidiosum; identical to SEQ ID NO: 1373

SEQ ID NO: 2072 - protein, 147 aa, Megamonas hypermegale; identical to SEQ ID NO: 1371

SEQ ID NO: 2073 - protein, 266 aa, Ammonifex degensii; identical to SEQ ID NO: 1260

SEQ ID NO: 2074 - protein, 250 aa, Desulfofarcimen acetoxidans; identical to SEQ ID NO: 1257

SEQ ID NO: 2075 - protein, 246 aa, Desulfofarcimen acetoxidans; identical to SEQ ID NO: 1258

SEQ ID NO: 2076 - protein, 253 aa, Desulfofarcimen acetoxidans; identical to SEQ ID NO: 1259

SEQ ID NO: 2077 - protein, 262 aa, Halomicrobium mukohataei; identical to SEQ ID NO: 1256

SEQ ID NO: 2078 - protein, 254 aa, Leptotrichia buccalis; identical to SEQ ID NO: 1255

SEQ ID NO: 2079 - protein, 264 aa, Halorhabdus utahensis; identical to SEQ ID NO: 1253

SEQ ID NO: 2080 - protein, 258 aa, Methanocaldococcus fervens; identical to SEQ ID NO: 1254

SEQ ID NO: 2081 - protein, 218 aa, Thermococcus sibiricus; identical to SEQ ID NO: 1252

SEQ ID NO: 2082 - protein, 233 aa, Geobacillus; identical to SEQ ID NO: 1251

SEQ ID NO: 2083 - protein, 236 aa, Kosmotoga olearia; identical to SEQ ID NO: 1249

SEQ ID NO: 2084 - protein, 250 aa, Caldicellulosiruptor bescii; identical to SEQ ID NO: 1245

SEQ ID NO: 2085 - protein, 260 aa, Thermotoga; identical to SEQ ID NO: 26

SEQ ID NO: 2086 - protein, 231 aa, Desulfitobacterium hafniense; identical to SEQ ID NO: 1242

SEQ ID NO: 2087 - protein, 274 aa, Methanobrevibacter sp. AbM4
MEIIELDVWSKFGCFTKPFSNSGGMLTYFIPPKTSIIGMIGAILGYKFDDYVTNDEGTNTYCIEKLNDIKVSIQPLFPLKTKRVTFNQVSNKGISNIRQDVLINPYYKLFIVFPNSLESEKNIFLERIKSQKSVFNLYMGKNEFMLNYKLINVYKYKTFKLDNSNKNDFFSSRNVIYGSLNRKDIKDATLKSDKINTKKVLFSGGNSKKLESFYEYFIHDYPIKRENFVEFEFSPISFYSINKDEKCYFSDIELKDNCFLELCNIGDKKWISLI

SEQ ID NO: 2088 - protein, 246 aa, Campylobacter ureolyticus
MFAFKIWSKFGAFKDPMTISQNITLNFPPKTAVAGMMAAILGIDEYLKDDGFNSFKYSVVINSGTSKKSFSQNYINDYTKKTNSHLANLQMLNFKAIKDGLRDTKAPQKPINRELLINPAFTIFIDGFEFEDEIVKSLKSRLLKYNLYMGNSEFSANFSFLPLKSFLMKKFDFVSLDSFLEQSLVESIEFDDNVFYKNTLITTKLNHKRSPIKSINLVHSNSKITAKNIEAYEILTSEGKYFCRFV

SEQ ID NO: 2089 - protein, 484 aa, Leptospira borgpetersenii
MRIFRIYVILLLTFLSVWTTHAEQVVTTKKDEPDSYYGLDVKAVISPSYGARIRDGASGISNSNPNDRTGFSTPWTLLMISKTFEEVRIQTELWGELIRNNQLTSDTRVDTGTKQNPYVLNVRRANIKKIWNTSSWGNYTLGFGIQELPHTYTQWSNYWRWRYIDRGPLESLGFASQPADIGLNAVGNWSIISSQFMVSNGEGYRETQNTNSAGMDVSSRFSVEPQLGESGKAGFHLFYRRENAFGSGGNECFEGKTTCLPNDLNPITALSKQIKSLQSDTTGLETNLIWNGPIKWNLGLGGFFKKQNSGEIRDRLQPFAAPVAFGKDGFGKALYAWLSIGAGNFHLLGRIERGTGNNGVVGVTDTIQREFFPGLSTSNVNLPAQVRNILPETRTNGYSSKSSFRRISVFFEWVVNPRFRMAIGYIENKNYDTNGVGQKVYIDQLGNERTEKEYLGQWNGSSNLGIVSYSSLDRQVLLRTTIEF

SEQ ID NO: 2090 - protein, 484 aa, Leptospira borgpetersenii
MRIFRIYVILLLTFLSVWTTHAEQVVTTKKDEPDSYYGLDVKAVISPSYGARIRDGASGISNSNPNDRTGFSTPWTLLMISKTFEEVRIQTELWGELIRNNQLTSDTRVDTGTKQNPYVLNVRRANIKKIWNTSSWGNYTLGFGIQELPHTYTQWSNYWRWRYIDRGPLESLGFASQPADIGLNAVGNWSIISSQFMVSNGEGYKETQNTNSAGMDVSSRFSVEPQLGESGKAGFHLFYRRENAFGSGGNECFEGKTTCLPNDLNPITALSKQIKSLQSDTTGLETNLIWNGPIKWNLGLGGFFKKQNSGEIRDRLQPFAAPVAFGKDGFGKALYAWLSIGAGNFHLLGRIERGTGNNGVVGVTDTIQREFFPGLSTSNVNIPAQVRNILPETRTNGYSSKSSFRRISVFFEWVVNPRFRMAIGYIENKNYDTNGVGQKVYIDQLGNERTEKEYLGQWNGSSNLGIVSYSSLDRQVLLRTTIEF

SEQ ID NO: 2091 - protein, 268 aa, Anaerophaga thermohalophila
MKNLLSFDIKADFGMLKKPDTNEPVYLTFNMLHKPALLGILGAIGGFPGFSKNGELPGYYQILKNVQVGIMPLPNNTGESHHENGNFTKTIIKYNNTTGLASEEAGGNLMIAEQTLIAPAFRCFVLLDKENAEEHSLIKNLLNYHAEFVPYLGKNECSLWWENARMVDYLNFVPEGTFKISSLFLKSEPLKNSKVEEPLFDILMESSEGNTFTYFENLPIAYLGAPLFQYEFGNFAYTDWDLSLKQKSSGNFIKLRTGEDAGKIIQLF

SEQ ID NO: 2092 - protein, 236 aa, Anaerophaga thermohalophila
MKGFQLIIEGNWGHFKKPETNNNPISHDLITKSALIGLIGAVLGIEREDMKSKFPQLSEDLLYGVQLRSPVKKISWGFTSRRAINPTAKGTPKYFEFLKDPKFLVSIALNNERSIPVFDEFKRSIKEEKAVYQPVLGWHNCPANLKWESEGDFTIIERGIFETKGFVLAGEHSPKDIPSNFRVGFDRMPTYQTDDFWNLPEKYKNVIYPDYPHSIQVEGVYFEYHSSKGTEKWCLI

SEQ ID NO: 2093 - protein, 244 aa, Lysinibacillus boronitolerans
MKGIRIEAYQNLVNYKKPTSFQLKESYPLPPYSTVIGMVHAACGFTSYVPMQVSIQGKYHAKVNDLWTRYEFAGSSYEQGRHQLKVELSDGKAHGITRGVSTTELLVDVELVLHIVPEDKQYIPIIIDALKSPAEYLSLGRREDLLQINVVTEVELEIQEMEEDKRVDFDIFIPQSMTKNDIYGKIGTSYRLNKTYKLLEIAKGKHIRQWEKVIVSHVPASSTNYLAAYENVLFDQDGYTVFLV

SEQ ID NO: 2094 - protein, 345 aa, Vibrio harveyi
MSKKFDVVVIGAGAAGLMCAAEAGKRGRSVLVLDHAKKPGRKILISGGGRCNFTNYDVSASNYLCQNPHFVKSALSQYTNWDFISMVSKHGIEFEERDHGQLFCVDAFTAKDIVKMLLAECDMPNIQQRYQCDVHSIKKTDAGFRLHAGTENIECESLVVATGGLSMPKLGATPFGYKIAEQFEIPVITTTAGLVPFTLHKKDKEDFAELSGIAIPAEITAQDGTMFKEALLFTHRGLSGPSVLQISSFWKAGQKVTINLVPNDDIAELLERSREKHPNQSLKNTLAKVLPKRLVEVLIERKELADKPLKQFNQKEMATIVERLESWAVAPNGTEGYRTSSFLTH

SEQ ID NO: 2095 - protein, 245 aa, Bacillaceae
MNVLVFDIRADFGHFRKIYSTSSPLTYSIIPPTSFFGILGAIIGLGKEENAYLRYVNHETVNMAIRIMSPVRKIRMGLNHVNTKGNIWVPKQRREGARTQIRTEFLRFPHFRCYVHVKEQSLFQQLIDYIQQHRSVYTVCMGLSECIADVQYVSLEEFRLVNNHAEAVSIASVIPEKYVTSLCIESGKEYRKERFAFQINEERIVSDYEEILFEASGEAIRAVVSHYWENKTGERIVFLYDHGKE

SEQ ID NO: 2096 - protein, 229 aa, Bacillus coagulans
MEAVVFDLKSDLAHFRRPDTTSTQLTYPFISPTAAKGIAGAILGIEDFTTHDKIGIRLLHPARTVAQQMSMLGKDSGSTFNRPTTVELVVKPFYRIYYAGDEYVRDLYRFLSEGRAVYPTYLGSAYALTKPVLQAYYEHVEPLREWSEPLRTRCVVPTRLVKEMKFEPERYYSRAGGFMLMYKGSREFEKSIDFVYERNGDAITFLPDKSQITGELQIAQIGDETVCLF

SEQ ID NO: 2097 - protein, 249 aa, Bacillus coagulans
MRAIAFELRGRTAFFKKPDVNANIYFTYSHIHKIALLGMLGAILGLKGYEAQSRDIKANGDNEANRYPEFYEKLKDLKVSIVPHGDRGYFSKKIQVFNNSVGYASFEQGQNLIIKEQWLENPHWTVYLLDDGTEICMELFNRLKSHQSVYLPYLGKNDHPASITKVREVELENAWAPGSCIDSLFCSKGVDLGRSRTEPYLYQEFLPIIMDDILNSYVFEQMFFTNQVVNKIQNSNVIYCAEEKNLFFF

SEQ ID NO: 2098 - protein, 223 aa, Clostridium saccharoperbutylacetonicum
MKALKLKLYQETVCYKKPYAFKVTETYPLPPYSTVIGMLHGIIGAGKDDYHEMEVSVQGKYEGIFTAYNTTRFYNGDDITSMPLNVHMLYGVSLVIHVVSDEDTLNKIYEGFRTTDTAFTLGRREDLARLDDIKFVELNKLLKEDEFDDEKDIKLKYSMYVPDKYQTSLRGIGYKINKVYRIVNDLRQWGKINVKYVECDESLDNGEYYIDDDSIEKDIAFLA

SEQ ID NO: 2099 - protein, 254 aa, Clostridium botulinum
MRILSFNLKGDTAFFRTNSVNDADITYSYGHIHKVALLGMLGAILGLQGHNIAYMLYEDKYKYPEFYKVLKDIKIAIKPNAKKGSFTRKKQNMTNGCGCIKKGDTLMYTEQWLYKVNWDIFIDLDSIDKEISKILEDYILNSKAVYMPYLGKTNHPAVITNAKVVMGENQNEREINIDSLFLLEDKSIKINNTINPFDMNNMNRYEYRELLPLAYTENICIYKKSVFTLTNKTCYLDKNIKNVVKIDKMNVYMF

SEQ ID NO: 2100 - protein, 497 aa, Leptospira borgpetersenii
MNSFPLSKRFRENMRIFRIYVILLLTFLSVWTTHAEQVVTTKKDEPDSYYGLDVKAVISPSYGARIRDGASGISNSNPNDRTGFSTPWTLLMISKTFEEVGIQTELWGELIRNNQLTSNTRVDTGTKQNPYVLNVRRANIKKIWNTSSWGNYTLGFGIQELPHTYTQWSNYWRWRYIDRGPLESLGFASQPADIGLNAVGNWSIISSQFMVSNGEGYRETQNTNSAGMDVSSRFSVEPQLGESGKAGFHLFYRRENAFGSGGNECFEEKTTCLPNDLNPITALSKQIKSLQSDTTGLETNLIWNGPIKWNLGLGGFFKKQNSGEIRDRLQPFAAPVAFGKDGFGKALYAWLSIGAGNFHLLGRIERGTGNNGVVGVTDTIQREFFPGLSTSNVNLPAQVRNILPETRTNGYSSKSSFRRISVFFEWVVNPRFRMAIGYIENKNYDTNGVGQKVYIDQLGNERTEKEYLGQWNGSSNLGIVSYSSLDRQVLLRTTIEF

SEQ ID NO: 2101 - protein, 267 aa, Candidatus Caldatribacterium saccharofermentans
MVNVAVFDLIGPFAHFRKYYTNSSSLSYAFPPRTVLMGVVAAILGWERDSYYEKLGLSEARFAVVIKVPVRRLIQTVNYIRTKEEDLARLRKLGVMKGTQVPLELLLPGGAASSLCFRVYFAHRDENVTRELRERLATGRSCYPLYLGLSEFIAQARLVYYGPPDEVIPAGREVVLHSVLVADYLRRPALRGDVVLGRERAPQSFGAGRKLMPPGNYIYETQARPWQAELSVPVYSFSLSSGKETVAFMEGELWPSSPTVRESASIA

SEQ ID NO: 2102 - protein, 267 aa, Candidatus Caldatribacterium californiense
MVNVAVFDLIGPFAHFRKYYTNSSSLSYAFPPRTVLMGVVAAILGWERDSYYEKLGLSEARFAVVIKVPVRRLIQTVNYIRTKEEDLARLRKLGVMKGTQVPLELLLPGGTASSLCFRVYFAHRDENVTRELGERLAAGRSCYPLYLGLSEFIAQAHLVYYGPPDEVIPAGREVALHSVLVADYLRRPAFRGDVVLGRERAPQSFGVGRKLMPPGNYIYETQARPWQAELSVPVYSFSLPSGKETVAFMEGELWPSSPTARENASIA

SEQ ID NO: 2103 - protein, 246 aa, Clostridium tyrobutyricum
MRVVRFKLSGKTAFFKKPDVNTYYYFTYGNIHKIAILGIMGSIIGFHGYNWQSMDFKNNIYPEFYNKLKSSRIAIVTLNSQGYITKKVQTFNNSVGYASTEEGRNLIVKEQWLQNPEWMIYVKLDEITEQFADMILHKRAIFLPYLGKNDHFADITKVKSIDIEKIDNFNKIHSLFETECFKVDRYQEEDDDIAWKYTEYLPVELDMELNQYKYKHFTATNMNVKSNNQNIEVYKDLETKSNLYFF

SEQ ID NO: 2104 - protein, 235 aa, Candidatus Marinimicrobia
MQYLVFDVRADLAQFKKPFTTMSPQTFSIPSGTAIIGMLAAIIGLDKKEYWQYFPANSYRLAIGVRKPIKKVVIPINTLKTTQLEHFSRFEEHKRTTMEFIKDGIFRIWFNWDDEELFHRMITMVKNHRTHYTISLGLAWNLANYEYQGIFDSYQTTDEANFSEINSIIRKDKLIEIDFKDRIIYSCRLPVRMKPDNSRVVEQYSDYLFENNGHPVLAKVTQYLALSNGERIVPI

SEQ ID NO: 2105 - protein, 239 aa, Methanocaldococcus villosus
MNVLIFDIWGDYGHFKRIYTTTSPLTYDIIPKTSIYGLIGAILGFSRDEYLKYINKETTKIALKIINPIKKTYFGLNLINTKDKYFIPIKKKGHEPRTQIRFELLKNPKYRIYININDDKLYNKLKELLEEHKTIYTPYLGISELIANFKFIGEFEVIKQKSDDFIEIHSVIRRDYIEKIDFNFEREYMFDKIPNDINEERITTEYVDIFYEKNGYPINCKLNCEYYHIYKLNENITFI

SEQ ID NO: 2106 - protein, 260 aa, Sulfurovum sp. SCGC AAA036-F05
MKIDKIISFDIKSEFGFFKKPDVNNPIYFTFNIIPKPTLLGILGAIIGLGGYSEQKDKDYPEFYEKLKDILVGIKPYGNKGVFQKRLIKYNNTVGYANKDGGTLNITEQTLIEPQYKIYLGLDLTNEFHKRIKEFINKTKVQYEYIPYMGKNEFRLEIDDVKHFENIEPFIPTDDFSIATIFPNVSKEALKVNEALEDPFDTSMSETYFYYFERLPIGFDELNQYIYQDFAYINAKMIRDIDLIAKVKLYKVEDKVVCLY

SEQ ID NO: 2107 - protein, 234 aa, Effusibacillus pohliae
MEVLRLKLFQETACYKKPAAFKVGETYPLPPYSTVKGMLHQILQADHYIPMQICIQGSYESRIVDYQKHYFFKKSKTTDFPLITDGLALDFVYSDITAMPIYVHLLLNVQLVIHVKAEQEILLRLQQGIENGVSFSLGRWEDLVRVDECRMVEVRKTDREWMMTLLPIYWPVSDDQELSGVPYRLNWKYEIIQGIRQWKKIKVRYVQAGEWIEDPDNFFDPDGYPVIFPKEMEE

SEQ ID NO: 2108 - protein, 244 aa, Methanothermococcus thermolithotrophicus
MTLDEYLNRTAVNHDTSKNTKNALYGFKFKIEGLYFNTFRKPLSNSLILTYSIPSFTVIRGLISNALGLERDDLTVQDWGIKIGIIPIDFKNKSKELAKILKLKGDGKSYFKNYSSSPMFKEFLVNPSYEIYIIGEKEKIECINNALLNPQRPLYLGSSDELCDLEVSEIVEVEISESSELNCVVEGLYENCTVERIPYKLIKKDKSGKKWDSIFKTVSIPLSNIKLNDKLQCFKIGNKCILAY

SEQ ID NO: 2109 - protein, 241 aa, Methanothermococcus thermolithotrophicus
MKLIVFDIWGDYGHFKKIYTTTSPLSYDFPPKTSIYGILGAFLGLDKEDYLKHINKNTVKIALRIKNPIQKTNIALNLIDTKKGRVKGPGFNLINGRTQIRFEMLKNPKYRLYVHLTDEGLYSKLKKLLEQHKTVYIISLGLSELIANFEYIGEFEVEKKVSYNEYTLINSLIRRDNIINDDINLEIDREYLFSKIPNEMDENRITTEYIDIFYERNGEPISCKVKEYYPIPELKENITFI

SEQ ID NO: 2110 - protein, 245 aa, Candidatus Cloacimonetes
MKILQIPLKAKIGHFKVNYTTASKLSYDIPTFTVIEGIIGAIMGWNRSEYRYKIKRDSAKFGIIIRSPIQKAIYAINAPNELITPISLFSDKKKSAAIKDRTQLYTELLIDPAYSILFSHNDEKLYNEVKQQVLAHKSVYNIYFGSAFCIAEYDNEPDEIETEKVKITKSEVISVIDLNYVKEDINWDANTKMITDNIPYLKDPDLTIREYKQVIYNPLAEPINCSGDFYSFKDNKFVYLFEGTD

SEQ ID NO: 2111 - protein, 253 aa, Atribacteria
MDKMLVFDVWGDYAHFRRFYTTTSPLSFPIPPRTALCGLIGAIIGLEKEGNDYLKYFPTESAHIALKILNPIKKTVIAENLINTKNARGPGMNLIKHVGGRTPIRFEFLKNQKYRIYFYYTDEEDGLYQKLKYNLTNHKTKYTPCLGLSENIANFKFVGEFEINILAYKNDYVSIDTVLPLQKTLEKEGIMFEREGEYFSIRMPIELNTERVVIKYGDIIFDRNGRPIKAKLIEPINIIKYADGRSENIVFIE

SEQ ID NO: 2112 - protein, 231 aa, Desulfitobacterium
MKGLAFDVLGTVGHFRRPDTTATQLTYPFITPTAAKGLVGAILGIEDFVTTDQVGIELLRPVRTVAQQMSMLGKDPGSTFNRPTTIELLVNPGYRIYYTGEEYTEQLLDFLTGERAVYTTYLGTAYALTKPILYRVYPEVSYPVAEGKEIEMRTVVPTALIREIVLKADRYYCRAGGYLYEYKGQRTFEKSVDFLYEKDGKPIAFIPKSDGLDSPLDLRVAQFGEDLVCLV

SEQ ID NO: 2113 - protein, 262 aa, Halomicrobium katesii
MSEHAPTASGLPDGAETCLSFTVSGPWGHFRRIEGNIVKQTYRVIPRTTVAGLIAAMLGIERDGYYDLFAPGESLVAIEPTSELRTMKLPMNTLSTADEHMASLNPRGKLSIKLPDPSKPRQQHNYEVLVEPAYRIDVWLADDERYDRLRSLLESGESYYVPSLGLSEHLATIDYHGEFPIEHGPDGETVAIDSTVPEAVDSIVPDPETRYQIEQTPAFMERDDGGRTTSAFVSYAYNPDGGSLRVADVSTYSVDDRAVVFT

SEQ ID NO: 2114 - protein, 264 aa, Butyricimonas synergistica
MDKLISFDIYADFGFLRKPFSNSQLDLCMTFNMLHKPALLGIIGAILGLKGFDGVGKVPEYYKKLLNLKVGIEPIEGFHERGIFPKASIKYNNSVGYANTQRGVPCNWVLNEQVIIKPAYRCYVLIDNSIDDVLQEKLYHYITNCYAEYIPYLGKNEYTLWWNKEEVCEYSYARELPGSVTGRLSSIINLSKLTLSGIKNRDERASGFSCFEKLPVGFEKRGNSYQYKLEDFVYTDCILELSMEISNIFKIELTNRIIKYVQLF

SEQ ID NO: 2115 - protein, 250 aa, Leptotrichia shahii
MKAIKLRLYQNMANYKVATSFQLKETYPLPPYSTVIGMVHSLCDFKEYHPMKISISGNYFSKVNDLYTRYEFKNGNSFEKGRHQIDVNGLGVNRGVATAELLVDVNLIIHIIPENQSEEFLNLIFEAFKYPREYPSLGRREDIVVIDEVKIVEIKKKELEEDIELKKDTFAYIPVNFISDSSVEVGNSRIFGTRYELTKNYVSENIGNKKSSKMVRIWNKEEVIYSSNITALEGEIVPIDEENDVVFCEM

SEQ ID NO: 2116 - protein, 358 aa, Terrisporobacter glycolicus
MKALRIELTQNSANYRKEECLDNKMTYPIPPISTIIGGIHNACNYREYHPMDISVQGNFESMHREPYTDYCFLNSTMDDRGILVKMKNESFLSKAFDKVAKANKSQGSSFRKGITIDVYNQKLLDEYNALRDLGDKIKNYKSTEQKQQLEAIKSEKKSLAQQKKELDKKSKEYELLVQKEKEIKDKEKQLKDGLKGYEQENYIKPISKFRSLTTSIKYYEILNNINLVIHVRSDEETLNDILDNIYNLKSIGRSEDFVDIKEAKIVDLYEGDCDVDSNYSTYVNYDDIKNDNIGVKSKGAKDVNGTVYYLNKNYTIVDGKREFIKKRVLYTSYCAIEETSENIFIDNNDGKEYIVNFI

SEQ ID NO: 2117 - protein, 256 aa, Spirosoma luteum
MEVLQIDVGGKLAHFRKYYANNTAMSFSIPPRTTLMGMLAGMLGRPRDSYYDELASERIRIGVRVMQPIKKTFHRLNLLKIVGKGDFDGSNGRIQTPFEIVSGLSISRGLVVYRIYVAAHEGGNETFQALKQALLKREFQYALTFGTANFTASLLSATLITDAKLVDSNGWVLVHSAMPSDAVEQLDFDRQRTEDTLQSIEEELLPGDFVGNFDRELRRMDRVLFSTTASGVKVKLNKPYYALTQATETQHILFME

SEQ ID NO: 2118 - protein, 257 aa, Riemerella columbina
MMKLVSFDIQSDFAFFRKPETNNTLNVSYNMIHKPAILGILGAILGLRGYEEKGILPEYYEKLSDIKVGIAPLEHQKGSFSKTPIKYTNTVGYANKGTNFLTEELTLIAPKYRIFILLDEQKPEQKTLLERLQIGQSEYIPYLGKNEFTAWWSNFKEWQYREGAPEKNASFASLFKKNQVVKDHSEASSGGWDFFDLDMENVEDAFMYFERLPTGFNLDLMQYHLDELVFTNYQIHNANKMPDVYQLVENETYVQLL

SEQ ID NO: 2119 - protein, 96 aa, Campylobacter ureolyticus
MFAFKIWSKFGAFKDPMTISQNITLNFPPKTAVAGMMAAILGVDEYLKDDGFNSFKYSVVTNSNTLKKSFSQNYINDYTKKTNSHLANLQILNLKR

SEQ ID NO: 2120 - protein, 237 aa, Coprothermobacter platensis
MDTAVVFDLWGPLAVYRKFYTNSSVLSYAFPPPTAVRGLVGAIVGIDKSKYAAELKDMEVAVSLKHVKKTLHMTLNYIKTIDGENALGKGRTQIPVEIIKDPYYCIYVRKLPQQIKEQLVTMLSEHRTVFTPYLGMSEMIANFKFIGEYEIEENNGSAVVDSIVPAKTIDVEKIRENGNKLGKERIPFYLDANKKPLSYMDIAYDVNAKPIPMKGSYSIVGKVPVKFLTSENIVKST

SEQ ID NO: 2121 - protein, 245 aa, Anaerococcus vaginalis
MKALRFRLSGKTGFFKQPDVNTYLYYTYGQIHRVALLGLLGAIVGYKGYNEKDREKYPEFYKKLKDLKISVVSEENDGIFDRKLQAFNNSTAFASNEEGGNLIVKQVWLENPSWLIYILLDNDQSELIKEYILNNKTIFTPYLGTNDHMANISNCKIVNIEKSDENIINSLFWDEDFKLRLGSKLYKYEENLPFFLEEDTERYIRKKTIASNGEVRKKSNKNVIFKDLDNNLKLAFYSEEGIYEA

SEQ ID NO: 2122 - protein, 245 aa, Anaerococcus obesiensis
MKALRFRLSGKTGFFKQPDVNTYLYYTYGQIHRVALLGLLGAIVGYKGYNEKGREKYPEFYKKLKDLKISIVSEGNDGIFDKKLQIFNNSTAFASNEEGGNLIVKQVWLENPSWLIYILLDSDQSEMIKEYILNKKTIFTPYLGTNDHMANISDCEIVDIEKSDKNIINSIFWDEDFKLRLKSKIYKYEENLPFFLEEDTERYIRKKTLASNGEVRKKSDKNVIFKDLDNNLKLVFYSEEGIYET

SEQ ID NO: 2123 - protein, 245 aa, Clostridium botulinum
MVKLHFFKRPDVNTYLYFTYGNIHKVALLGILGAIMGYKGYNNQCNKIYKHEQEQSVYPEFYEKLKGLKVGIVPINHHGYNLKKVQTFNNSVGYASQEKGGNLIVKEQWLEKPKWEIYILIENEITRELADRLKNYRFKYIPYLGKNDHIADINHVEVIKTAENIQSVDKLDGLFIGKDFTLNLDNEDEEEDILWKYEESLPVALEEVTNKYELETFLMTNAAINIKDHDKVQMYKCNDKNIYFF

SEQ ID NO: 2124 - protein, 235 aa, Anoxybacillus
MKALRLKLFQETACYKKPFASKVAETYPLPPYSTVKGMIHALLDANQFIPMRLSVQGTYEAKLLDYQRYYFFKRRELSSFPLVLDGLARMEFSYDKNEITTMPMYTHLLHNVHLLIHVEAEEHILTQIIHAIEHSTTHYSLGRWEDLVRIDEYKLVEVRELEEDETLTLQRDAYIPRHLLDRETKSIPYQLNWKYEIVNGIRQWEKIHVGYVQKGIEAPEGVWMDEDGELVFYHL

SEQ ID NO: 2125 - protein, 227 aa, Paenibacillus sp. OSY-SE
MKAVIFDVKGSIAHFRRPDTTATHLTYPFITPTAVKGMVGAMIGITDFVTSDRVGIQLLHPVRTSAQQLSMLGKDAGNTFNRPTTMELLVNPAYRVYYAGDEYVDRLEDKLKQGHSVYPTYLGVAFAMTFPRLVAIEPQVERFDEDMVTTHTAVPTTLIQDLMLTETRSTYSRAGGFMKEYLGNRTFEKSISYIYEKDGGPIVFRQQSDADEDCGVFVIKGEAVCLV

SEQ ID NO: 2126 - protein, 236 aa, Proteiniphilum acetatigenes
MKGFQLIIEGNWGHFKKPETNNNPLSHDLITKTALIGMIGAVLGIGREDMKSKFPQLSDNLLYGVQLLNPVKKISWGFTSKTAINPTAPGSPKYFEFLRDPKFLVSIALFKEESRDDFESFKTAIKNGTAEYTPVLGWHNCPANLEWKSEGLFSEEKDGDFETTGFVLAGEHTPKNLTGNFRIGFDKMPTFQNDDFWNIPERYRNVIYPDCPNSITVNGKYYEYHFSDKIEKWCLI

SEQ ID NO: 2127 - protein, 237 aa, Propionispira raffinosivorans
MRKVIRLECSQQLANYRKPTSFQIKESYPLPPYSTVIGMIHTVCGFTEYHAMDISIQGKYHSAISEMYTKYAFGIAYDKDRHQAAVKNGDKQDGINIGPGNIELLTDIKLLIHIRPEKEEDLETIKQGLLNPIVYPALGRHEDLLSIDDVDIVEMKESNRVELKYDAYVPIEGIHAKMIQKLGSKYRLNKIFGVNPNTGLRQWIEKIEVSHVAKDTVLARGTWYMENSKAADGIFLA

SEQ ID NO: 2128 - protein, 250 aa, Rudanella lutea
MSNRLIVFEVSGEYGHFRKFNTTTSPLTYPIPTRTALTGLLGAVLGIERETAPGRFPGNVTPVQELFSSAVCGVAIQLLSPVKKVNIGFNLLDTGNSFFEIKKSGRTQIEFELLKNPAFRVFVQHQDETVIDKLSERLTNNAHHFTPYLGLSQFTAVLSNTVVCSASLKTSAGSTVPIRSAVNLSALTDSSPIEFNQTAHYYVETMPIELSKERVVTRYGEVLVDADGSTVAVRTSTWIETSDFGNILYL

SEQ ID NO: 2129 - protein, 245 aa, Brachyspira innocens
MSNKTKSIKFKCYQNMPNYRRPASFDFKETFKLPPYSSVIGMIHKICNCQNGEYMPMKVSIQGTSESINTDLYTRYFFTPDKCEGDRYYFAILNKDEKKQTGLIRGTGITELLIDVTLLIHIVPESDDLFDTILNGLKRPYVYPALGRHEDILRIDADTIKIIDIEETNTANINYDAYIPLEYFREEDNITGTVYLLNKIFDTSSGIREWKEKVKVKYIKKRTEKIRFAKNVYKDTEENTGIFLA

SEQ ID NO: 2130 - protein, 324 aa, Halarchaeum acidiphilum
MTMQEDLDEWFDEGGDAATAETTESVESNDTGANEADANESGATDAGANEAASDAGANESGATDAGANEAASDAFVPDRCLSFTVRGPWGHFRRVEGNVVKQTYRVLPRTTAAGLIAAVLGIERDGYYDLFAPDASALAVEPVRPLRTLNMPMNTLSTSNADLASLNPRGKISVKLPNPAKPRQQHNYEVLVDPAYRLDVALDDAAVYADLRETLEAGESHYVPSLGLSEHLAEIEYHGEFAVEDGPTDDVVSVDSAVPDAVDDVVPDPDARCQVEESPGFMTTDAGGRTTTRFTTYVYNPDAGPLRVRDVSAARVDGRTVVFV

SEQ ID NO: 2131 - protein, 246 aa, Cloacimonetes bacterium SCGC AAA255-B16
MQKSLCNEGKMDKILKFKIWGDYAHFKKFYTTTSPLTFEFPPPPTIIGIISAIIGLDKNEYLEHFQNPDEFKIALSIQNPIKKVRWTQNLIDTKHHFWRIKNRTQIRIEFLKDSAYVIYFSHKDDNIFNLLKSNLENHKSVYSVSLGLSELLANFKLIDKIEIEDSKSDDWIMIDSVLPCSYLKDDDSVDFEVSREIFKVNFPILMQPNRVVNKREDILFERNGKPIKCKVTQFWKTEEGKNIVFF

SEQ ID NO: 2132 - protein, 242 aa, Candidatus Methanomassiliicoccus intestinalis
MVKAIKLHITQQMPNYRKPASFMIKESYPLPPYSSVIGMVHAACGWTSEGSYHPMKISIQGTYASTVSDYATNYVFGIAYDPTRHQKKVDSGDGKYDGISVIPRSYELLTDVELIIHIVPEDAMDLNTIANSLINPPVYLSLGRYEDLAIISDVSIVDLEKCTEGILTHDEYIPDSYIDLDENTDLIGTVYRINKVFKITGSGKKKTRSWVETVRVHHACRGTLVTSENMYIDQSKDLVFLS

SEQ ID NO: 2133 - protein, 237 aa, Lewinella cohaerens
MKYCIVELYSQTATFRNPEFQNYHKTFALPPPTTLVGLAGAAMGLSPNAAQAFFSSSPFQMGIYGQHQGKTTDLWKYDAFKNRSIVLREMLIGNHFVLVYGSEEEEKIELLASGFAAPVYALTMGSSDSLAKVIHCEVDEVPLVKSTTVAYCLLAGDIIKEVMQNASAQPEFSIYATTDPIALDVPTHFQYESDYGARSVSQRQLLSFVGREMELNVKKEGIQYQDKFIPLFDYNSN

SEQ ID NO: 2134 - protein, 237 aa, Spirosoma panaciterrae
MNRQLLIFDIWGDYAHFKKIYATTSAISYAIPPKTSLYGYMGAILGLPKADNAYLNTFANKQCLLGLSVLNPIVMKRLGANLRSTLKRVDDSPKPSLVEYVYKPRYRLFVWHQDEAVRQALKKAIKAHSCVYSPSLGLAGLPSNFEWVGEAVTKAQRSSEALPVHSVIPRKYLLSLEETALLEGQNELIEQSLFAIEMNTDREVTERDDILLDRKGRAIRARVTEYYLVKEANVVLF

SEQ ID NO: 2135 - protein, 497 aa, Leptospira sp. serovar Kenya
MNSFPLSKRFRENMRIFRIYVILLLTFLSVWTTHAEQVVTTKKDEPDSYYGLDVKAVISPSYGARIRDGASGISNSNPNDRTGFSTPWTLLMISKTFEEVRIQTELWGELIRNNQLTSDTRVDTGTKQNPYVLNVRRANIKKIWNTSSWGNYTLGFGIQELPHTYTQWSNYWRWRYIDRGPLESLGFASQPADIGLNAVGNWSIISSQFMVSNGEGYKETQNTNSAGMDVSSRFSVEPQLGESGKAGFHLFYRRENAFGSGGNECFEGKTTCLPNDLNPITALSKQIKSLQSDTTGLETNLIWNGPIKWNLGLGGFFKKQNSGEIRDRLQPFAAPVAFGKDGFGKALYAWLSIGAGNFHLLGRIERGTGNNGVVGVTDTIQREFFPGLSTSNVNIPAQVRNILPETRTNGYSSKSSFRRISVFFEWVVNPRFRMAIGYIENKNYDTNGVGQKVYIDQLGNERTEKEYLGQWNGSSNLGIVSYSSLDRQVLLRTTIEF

SEQ ID NO: 2136 - protein, 238 aa, Leptospira kirschneri
MVNNVSSFFMRLKAPFAAFRYFQAGVYRSTMPTIPHSAVWGLIYNLLGIEIRINLNHLTTQIANNIPALNLAIGNVSLPETNSLYQQLHVIPVGSSGKENAERTKGSKYFIRPVRREILTSLDVLVGIRSDDSELKQKVISGLNGEFNPSRYGLPFAGDNNLLFDSIDIFEESSIPAFWYFKVGADGAIDTETVRLTVGIDRLDNSETISPLFAISKEKSMQPPPNAWVWTPKEPESI

SEQ ID NO: 2137 - protein, 236 aa, Leptospira alstonii
MKANNMSLFFMRLKAPFAAFRYFQAGVYRSTMPTLPHSAAWGLINNILGIEIRTNTNHLTTQISKDIPSLNLAIGNISLAETNSLYQQLHVIPVGSSGKENLERTKGSKYFIRPVRREILTNLDVLIGIQSDDPELKQKITSGLNGEWNDTRYGLPFAGNNNLLFDSIDIFEESSIPAFWHCKVGDNDQIETETARLTVGIDRLDNSNTVSPLFAISKEKSLQPPPNAWVWTPKEP

SEQ ID NO: 2138 - protein, 187 aa, Lactobacillus
MAKKRALDRSKVIDQAIAIISDKGLSELTMPALAKALGIRSQSLYHYVANRNDLLVLVCVNRLQVLRQHLTKKIIGHSGLDALFRFADEIRDFLLHDKAISGIYYGLNEYVQNEQIHEEVMKIVELGEKLDVDNKNIVSLHSLLGAVLGYVFLDRYVIDETEKEADDNYHEMLLRLVAPKLQVEGTK

SEQ ID NO: 2139 - protein, 253 aa, Clostridium botulinum
MEAIKFNLSGPTAFFKKPDVNSYAYFTYNNIHKIALLGILGSIIGLKGYNQQKSIDTYPEFYDKLKTLKISIVPKSKTGYFTKKFQTFTNNTGFYNIDINKRPCTLVYREQWLENVSWDIYILLDENSVDKKILNKLKDYLLNKKCHFIPYLGKNDHTADITNVELINLKAIQAYEKLIRIQSLFLTDNFNITGEKHSPNERLIILKEMLPTELDEFDNSYRFSNLSFTNLIVQPNTSKTLIYQDSLSNLYFF

SEQ ID NO: 2140 - protein, 266 aa, Paenibacillus alvei
MRALRFELSGETAFFKKPDVNVHAYFTYSHIHKVALCGLLGAIIGLSGYARQHERNRMRSTGSKADESEIAIFPEFYEVLRDIRISIVPHGDRGYFPKKIQIFNNTVGYASQEAGGVLNVREQWLERPHWTVYVADCKGLSDQVFEKLADYMLNSKAEFMPYLGKNDHPATIVKPCLIELQHLDEAPYYIDSLRAAHIGCDARGTIKNRGLQSYFKEHMPVGLNADNNGYVTQPLVYTNQEIDPDTLEEPDWSRLYADGDQTLYFL

SEQ ID NO: 2141 - protein, 237 aa, Bacteriovorax sp. BSW11_IV
MKLLCIFALVLTMNSFAAKECNDNAFYGQDTVCANSVEKYPSSRLVNYNNIEATLVSKSDANKIFDNLKKYSKIPFQFNYAGCEERAYEMARQLDLDGIKVLKTFATVDTNKPERLYPPNYWRYHVAIGVLVKEGKDYVPYVIDPSLMSGPVKASEWVGKMKKHNKKMEVSFHVSEQKVYDPESRIVVSFDDEDFRKSIAEDLEKHEMWSHEPDGGISSYQYEREMIEMQMNRWGMY

SEQ ID NO: 2142 - protein, 265 aa, Clostridium sp. BL8
MDVLKFTLSGRTAFFKKPDVNSYYYFTYGNIHKVALLGILGAIMGFEGYNQKAMGETYKEVYEECNTKIETGPYPEFYEKLRNIKVAIVPENEKGYIEKKIQVFNNSVGYASHEKGGNLIVKEQWLENPKWSIYLLVQGKIEEEIANRLSSFSFKYLPYLGKNDHVANIDNVEIIRTVERVENVDKIHSLYIEDYFQLNVCEEDNIFDSVDDYESIWKYEELLPVALEENTNKYEFERFIFTNSSLSTKKEALVYNCDGKFIFFF

SEQ ID NO: 2143 - protein, 268 aa, Clostridioides difficile
MKVLQCKLKQPTAHYRDPKVFQNEYISTLNLPSKTTIMGMITYLCDRRLKSDIDIGIIGTHHHRELEFSRGENIDFWNEYTNMRKGKDKEKFLLQGNYYDYYKEHKAQNSILNYEVLKEVELTIFISCKDDEELEFIRKKLESPCKYANLGRKEDFVIPSEKGCFVKEVELKEVIPMNTRDAIKENIKLKNTYVRVDLRDKENVETIINQGVLIALPHKYKDLEANRDDRVYEFCHYIYVDNDGIYPKNIKVNVCNVCIDTKEVFTWL

SEQ ID NO: 2144 - protein, 265 aa, Clostridioides difficile; identical to SEQ ID NO: 1416

SEQ ID NO: 2145 - protein, 265 aa, Clostridioides difficile
MKVLQCKLKQPTAHYRDPKVFQNEYISTLNLPSKTTIMGMITYLCDRRLKSDIDIGIIGTHHHRELEFSRGENIDFWNEYTNMRKGKDKEKFLLQGNYYDYYKEHKAQNSILNYEVLKEVELTIFISCKDDEELEFIRKKLESPCKYANLGRKEDFAIPSEKGCFVKEVELKEVIPMNTRDAIKENIKLKNTYVRVDLRDKENVETIINQGVLIALPHKYKDLEANRDDRVYEFCHYIYVDNDGIYPKNIKVNVCIDTKEVFTWL

SEQ ID NO: 2146 - protein, 265 aa, Clostridioides difficile
MKVLQCKLKQPTAHYRDPKVFQNEYISTLNLPSKTTIMGMITYLCDRRLKSDIDIGIIGTHHHRELEFSRGENIDFWNEYIKMGKGKDKEKFLLKGNYYDYYKEHKAQNSILNYEVLKEVELTIFISCKDDEELEFIRKKLESPCKYANLGRKEDFVIPSEKGCFVKEVALKEVIPMNTRDAIKENIKLKNTYVRVDLRDKENVETIINQGVLIALPHKYKDLEANRDDRVYEFCHYIYVDNDGIYPKNIKVNVCIDTKEVFTWL

SEQ ID NO: 2147 - protein, 265 aa, Clostridioides difficile
MKVLQCKLKQPTAHYRDPKVFQNEYISTLNLPSKTTIMGMITYLCDRRLNSDIDIGIIGTHHHRELEFSRGENIDFWNEYTNMRKGKDKEKFLLQGNYYDYYKEHKAQNSILNYEVLKEVELTIFISCKDDEELEFIRKKLESPCKYANLGRKEDFAIPSEKGCFVKEVELKEVIPMNTRDAIKENIKLKNTYVRVDLRDKENVETIINQGVLIALPHKYKDLEANRDDRVYEFCHYIYVDNDGIYPKNIKVNVCIDTKEVFTWL

SEQ ID NO: 2148 - protein, 230 aa, Clostridioides difficile
MKLDLFQETACYKKPFAMKITETYPLPPYSTINGLIHKILNATEYIPFNISVQGTYESIFNNYQTTYFYKKDSITSMPMNSHMLLNVNLIIHIGGDFDLLEEIYDSLLNYDEHLSLGRKEDLVRINDIRFVEVNKFEVDEDIQLDDYENYKLSECNIRMTIYIPKTSLQDTDIDGISYRLNNYYDNNAVEDKKRVWNKVDSYYVEDGNTISIGDILLDNEGDLLYFNNIN

SEQ ID NO: 2149 - protein, 265 aa, Clostridioides difficile
MKVLQCKLKQPTAHYRDPKVFQNEYISTLNLPSKTIIMGMITYLCDRRLKSDIDIGIIGTHHHRELEFSRGENIDFWNEYIKMGKGKDKEKFLLKGNYYDYYKEHKAQNSILNYEVLKEVELTIFISCKDDEELEFIRKKLESPCKYANLGRKEDFVIPSEKGCFVKEVALKEVIPMNTRDAIKENIKLKNTYVRVDLRDKENVETIINQGVLIALPHKYKDLEANRDDRVYEFCHYIYVDNDGIYPKNIKVNVCIDTKEVFTWL

SEQ ID NO: 2150 - protein, 246 aa, Clostridioides difficile
MEVLKFNLSGKTAFFKKPDVNSIIYFTYGNIHKIALMGILGACLGLGGYNQQSKEDEYPEFYSLLKDIKMSIVPKHEFGYINKKVHIFNNSVGYASKEEGGNLIIKEQWLENVSWDIYIQLEDSTTSRELKRRFLSNKFVYIPYLGKNDHIANISEIEIITDFYKTEDINRVDSFFIREDFEFEKSYFDDNDDYKEPFKYQEKLPYRLHRMTNQYILETIIFTNMSVKLINKKEVYQVKGLNLIFI

SEQ ID NO: 2151 - protein, 265 aa, Clostridioides difficile
MKVLQCKLKQPTAHYRDPKVFQNEYISTLNLPSKTTIMGMITYLCDRRLNSDIDIGIIGTHHHRELEFSRGENINFWNEYTNMRKGKDKEKFLLQGNYYDYYKEHKAQNSILNYEVLKEVELTIFISCKDDEELEFIKKKLESPCKYANLGRKEDFVIPSEKGCFVKEVELKEVIPMNTRDAIKENIKLKNTYVRVDLRDKENVETIINQGVLIALPHKYKDLEANRDDRVYEFCHYIYVDNDGIYPKNIKVNVCIDTKEVFTWL

SEQ ID NO: 2152 - protein, 233 aa, Clostridioides difficile
MKVLKLDLFQETACYKKPFAMKITETYPLPPYSTINGLIHKILNATEYIPFNISVQGTYESIFNNYQTTYFYKKDSITSMPMNSHMLLNVNLIIHIGGDFDLLKKLYGSLLNCNEYLSLGRKEDLVRINDIRFVEVNKFEVDEDIQLDDYENYRLSKYNIRMPIYIPKSSLQDEYIEGISYRLNNYYDNNAKEDKKRVWNKVDSYYVDDGIPISVGNILLDDEGDLLYFNNIN

SEQ ID NO: 2153 - protein, 233 aa, Clostridioides difficile
MKVLKLDLFQETACYKKPFAMKITETYPLPPYSTINGLIHKILNATEYIPFNISVQGTYESIFNNYQTTYFYKKDSITSMPMNSHMLLNVNLIIHIGGDFDLLEEIYDSLLNYDEHLSLGRKEDLVRINDIRFVEVNKFEVDEDIQLDDYENYKLSECNIRMTIYIPKTSLQDTDIDGISYRLNNYYDNNAVEDKKRVWNKVDSYYVEDGNTISIGDILLDNEGDLLYFNNIN

SEQ ID NO: 2154 - protein, 230 aa, Clostridioides difficile
MKLDLFQETACYKKPFAMKITETYPLPPYSTINGLIHKILNATEYIPFNISVQGTYESIFNNYQTTYFYKKDSITSMPMNSHMLLNVNLIIHIGGDFDLLEEIYDSLLNYDEHLSLGRKEDLVRINDIRFVEVNKFEVDEDIQLDDYENYKLSECNIRMPIYIPKTSLQDTDIDGISYRLNNYYDNNAVEDKKRVWNKVDSYYVEDGNTISIGDILLDNEGDLLYFNNIN

SEQ ID NO: 2155 - protein, 244 aa, Clostridioides difficile
MKVLKLDLFQETACYKKPFAMKITETYPLPPYSTVNGLIHKILNATEYIPFNISVQGTYESIFNNYQTTYFYKKDSITSMPMNSHMLLNVNLIIHIGGDFELLKKLYNSLLNCGEHLSLGRKEDLVRINDIRFVEVNKFEVNAMKVEVDDYENYKLSKYKIRRPIYIPKLSLKDERLNGISYRLNNYYENNSKKDKKRIWNKIDSYYIEKGNKIRRGYILLDIEGDLLYFNKQKGDESIAICKI

SEQ ID NO: 2156 - protein, 265 aa, Clostridioides difficile; identical to SEQ ID NO: 1398

SEQ ID NO: 2157 - protein, 265 aa, Clostridioides difficile
MKVLQCKLKQPTAHYRDPKVFQNEYIGTLNLPSKTTIMGMITYLCDRRLNSDIDIGIIGTHHHRELEFSRGENIDFWNEYTNMRKGKDKEKFLLQGNYYDYYKEHKAQNSILNYEVLKEVELTIFISCKDDEELEFIRKKLESPCKYANLGRKEDFVIPSEKGCFVKEVALKEVIPMNTRDAIKENIKLKNTYVRVDLRDKENVETIINQGVLIALPHKYKDLEANRDDRVYEFCHYIYVDNDGIYPKNIKVNVCIDTKEVFTWL

SEQ ID NO: 2158 - protein, 268 aa, Clostridioides difficile; identical to SEQ ID NO: 1400

SEQ ID NO: 2159 - protein, 150 aa, Clostridioides difficile
MKVLKLDLFQETACYKKPFAMKITETYPLPPYSTINGLIHKILNATEYIPFNISVQGTYESIFNNYQTTYFYKKDSITSMPMNSHMLLNVNLIIHIGGDFDLLEEIYDSLLNYDEHLSLGRKEDLVRINDIRFVEVNKFEVMRDMEQMNI

SEQ ID NO: 2160 - protein, 100 aa, Clostridioides difficile
VEVNKFEVDEDIQLDDYENYKLSECNIRMPIYIPKTSLQDTDIDGISYRLNNYYDNNAVEDKKRVWNKVDSYYVEDGNTISIGDILLDNEGDLLYFNNIN

SEQ ID NO: 2161 - protein, 265 aa, Clostridioides difficile
MKVLQCKLKQPTAHYRDPKVFQNEYISTLNLPSKTTIMGMITYLCDRRLNSDIDIGIIGTHHHRELEFSRGENIDFWNEYTNMRKGKDKEKFLLQGNYYDYYKEHKAQNSILNYEVLKEVELTIFISCKDDEELEFIKKKLESPCKYANLGRKEDFVIPSEKGCFVKEVELKEVIPMNTRDAIKENIKLKNTYVRVDLRDKENVETIINQGVLIALPHKYKDLEANRDDRVYEFCHYIYVDNDGIYPKNIKVNVCIDTKEVFTWI

SEQ ID NO: 2162 - protein, 111 aa, Clostridioides difficile
MKVLQCKLKQPTAHYRDPKVFQNEYISTLNLPSKTTIMGMITYLCDRRLNSDIDIGIIGTHHHRELEFSRGENIDFWNEYIKMGKGKDKEKFLLKGNYYDYYKEHKLKIAY

SEQ ID NO: 2163 - protein, 478 aa, Halarchaeum acidiphilum
MGRTRTSRRRTSSASTRSAGARSRTRRSRARRSDRSRGSTAASSTPTRASTSRSRQGSRARRGGVEGRRGTARRPRSRRRGRRLRRATRSRGRGRPDRTRSRRRERRPLGIARRRGGRPGRPLRRAPRHGRRGRRRRHRRLRRVRRDARDGRRGVTMQEDLDEWFDEGGDAATAETTESVESNDTGANEADANESGATDAGANEAASDAGANESGATDAGANEAASDAFVPDRCLSFTVRGPWGHFRRVEGNVVKQTYRVLPRTTAAGLIAAVLGIERDGYYDLFAPDASALAVEPVRPLRTLNMPMNTLSTSNADLASLNPRGKISVKLPNPAKPRQQHNYEVLVDPAYRLDVALDDAAVYADLRETLEAGESHYVPSLGLSEHLAEIEYHGEFAVEDGPTDDVVSVDSAVPDAVDDVVPDPDARCQVEESPGFMTTDAGGRTTTRFTTYVYNPDAGPLRVRDVSAARVDGRTVVFV

SEQ ID NO: 2164 - protein, 570 aa, Crocosphaera watsonii
MALANFKGLATQGDYESIIVNFREDVSTTTLSEQIEAIASNYNQSLSLNSVYAIDEHIYTLTGDKELLKNLKKSPLNEYVDYIEPNYIYSALETPNDPDYSKQWNLHNIHVERAWEETKGEGITVAVIDSGVSRVPDLRQTEFVPGYDFVNDRKDARDDNGHGTHVAGTIAQSTNNNYGVAGVAYQAKIMPLKVLSAQGGGSVSDIADAIRFAADNEADIINMSLGGGGESQVMKDAIDYAYNKGVVIIAAAGNSNQNAASYPARYPKVISVSALDATGKKAPYSNYGAGVDISAPGGSEEGKILQETIDPSTGQAVFSGFQGTSMAAPHVAGVAALIKATGVKEPEEVFAVLTQSSRKVEEDKFNYYGSGQLDAGEAVKLAVKGQITFRDFFRWLRDSGYLNPRFWIDGGMVALLPKLLMVLGSYLLAFLLRNYFPFAFTSPFNWGLVLGSSGLFFLQGIYVFDLPQWPFRVMGSSIPELANSIEGTSLLNPFLASVLIPFALVAILLGHNSWKWFAIGTSLGVAACLTVHAIMSPAVMVMPSLDVARAFLGANAFLCVGLACLASKKS

SEQ ID NO: 2165 - protein, 259 aa, Clostridium chauvoei
MEAIKFTLRGRTAFFKKPEVNSYLYFTYGHIHKVALVGIFGAILGYKGYNQMKKDDQYPEFYQKLKDIKISIVPNNKNGIIDKKINIFNNSVGYASQEKGGNLIIKEQWLENPSWEIYLLLNDDESQKIANALMDRTYIYLPYLGKNDHLAEITNIKRINNIKTIDRFIKIDSFFKKNEFKYKELDLDDLDDLDDLDDLDDDNVTDEELIFKYEEMLPVGLDLQTNRYKLEGLVYTNKPIEKRLNCEVYEIEGKILTFI

SEQ ID NO: 2166 - protein, 235 aa, Firmicutes bacterium CAG:24
MQALKFRLKGKHAFFKIPAVNSYYYFTYAQIHKVALLGIFGAILGYDGYQQMQKEDRFPEFYERLQALKVSVIPCVKNGIFLKKVQTFNNSIGSLEQGGNLIVQEQWLEKPEWLIYVLLDCEESEKLAEMLEKKQSIYIPYLGKNDHSADILEVERVEVETTDPAGQRIDSLFPEESFLMDELEAYSFKYRETLPVGLKEETNQYEYRKFAFSDEIVEEAKQTVFQVQGKNIIFY

SEQ ID NO: 2167 - protein, 358 aa, Clostridium sp. CAG:632
MKALRICLKQSLANYRREETVDNKMTYPLPPYSTVIGALHKACGYTSYHPMQMSIQGEYGGMKKEVYLDHCILNSLQNDRGILIKMSNDKTISKGYVKVAAAKKSQGNDFRQGITIDVIHPEYLEEYRRLKNLNDEIGEFKKKRFQPFLDRIKATKKLLADRKKDSTISQEELRKISDRETRLKELEKQAKKRLATYEMENYKKPIAAFKTLTTAPKYYETLYDIELIIHIVSDDETMACIYENIDRLTSIGRSEDFVDVTECEYTELEEIDGEYMSTHHAYIPATLDTEGIFMNEKKGINAVGTRYLLNKDYRLSEDGKKRIFNKRLVTYTSKYTVFEPIDSIYVDKGKETYIVGLV

SEQ ID NO: 2168 - protein, 261 aa, Odoribacter sp. CAG:788
MSGQRLISFDLQADFGFFKKPDYNDGMLLTYNMLHKPALLGLLGAVIGLQGYRRKGELPEYYQHLEELSVGIEPLEKRHEKGNFRKSVVKYTNTVGYANQDGNLLIEESMLIRPGYRCYLLLDLDNQDHHKLYDYLKNGWSEYIPYLGKNEYPCWFGDTFREYEFSVFQPAAIFRISSLFIKEGVIRGKKVEASFSLSAMGMENESSFAYFERLPIGFHPELMQYELADFAYTDWLMQADSQITGLFYLVVEGEKKVIQLF

SEQ ID NO: 2169 - protein, 261 aa, Odoribacter laneus CAG:561
MSNRHLISFDLQADFGFFKKPDYNDGVLLTYNMLHKPALLGILGAIIGLEGYRQKGEWPEYYRRLKNLPVGIEPLEGRHEKGSFRKSVVKYTNTVGYANQDGNLLVEESMLIRPAYRCYLLLEEENADHRKLYDYIRQGWAEYVPYFGKNEYAAWFGGTLREYRFEDFIPETNFRISSLFIKEGVLSEKQVTASFSLSLMEMINESSFVYFERLPIGFHPLLMQYELADFAYTDWMIQAGTQIGNLYKLKEGEKTKIIQLF

SEQ ID NO: 2170 - protein, 256 aa, Fusobacterium sp. CAG:649
MKALKFTLSGNSAFFKDNVINTVYLTYGNIHRVALLGMFGAILGYGGYSKQNDMLKKKNKKMSDYPEFYEKLKDIKISIVSNGKNGYFNKKLQTFNNSVGYASKEEGGNLIVKQFWLENPSWDIYILLDCDEAKKIADYIQNRKAIYLPYLGSNDHLANIMDVEIIDIEEKMSSEDETIEILSMIKDSDISEKKKNVFSIDKNSIRGDIYKYSEYLPFALSKELNQYEKEKMTITNMSVILKKSYYKVEDKNIVFY

SEQ ID NO: 2171 - protein, 224 aa, Clostridium bartlettii CAG:1329
MKCLVFKVRGDYARFRKSYTTTSALTYLLIHPVAVRGLIGAMLGIDREKLYEKTKDIEVAIQVVNQVRKDMQSFNLVNMKPNDKIFRFPSNIEFLRNVEYRIFIKAEDKTLYEIDNCIKQGEYIFTPYLGSSEHIAKIEYEGIYNCEKLNAGNYKVISAVSLEENKIYFGDSDIILMTDNIPTRRDIDREYIEYKKVIFATNENTINVGTENCYKVGGYNVIFI

SEQ ID NO: 2172 - protein, 222 aa, Clostridium sp. CAG:221
MKALIFKATGDFARFRCSYTTTSALTYSVIHPIAVKGLIGAIMGIDYAELFEYTKGMKIAIEVLNPLKKDTQSFNLVPQSGGNGAATFPSRVEFLRDVSYRITVIDDEDKLFQIRDVITTKNFTFTPYLGASEHIAKITFEDIIEAKRLEGTKGKVNSIIPKDKVLIEENSDIKLCIDRIPVKNEKSREYIKYEKIAFAEGTSIIAELSDIYKVGDYNVYFF

SEQ ID NO: 2173 - protein, 237 aa, Blautia sp. CAG:52
MEKAIRVQCFQNLVNYRKPSSFIIKETFPLPPYSTVLGMIHAACGYREFHPMKLCIQGTNSGMVSELYTRYSFSSGTKYEEGRHQLCVDGKYGVFKGIANVELVCDNHMVIHIIPAEEDFAHVYQSLLYPGRYLSLGRYEDLLDIERVDIVKIHQEEEVDLKRDMYIPVAMAETLGIEKSRMTVYHLTKEYEITKQGLRRWKKENGRVNAFYYPAGNTLGQGAYVDDFEEDAALVFC

SEQ ID NO: 2174 - protein, 256 aa, Clostridium sp. CAG:265
MELLAFNIKGDTAFFNTNSFDESDMHFSFAHLHRVALLGILGAKIGLNGHNKLALNKEKESRHPEFYEKLKDLGVAIAPKSGATGFVRKEYSFTNGAGYSKVSGKYAQNLIYTEQWLHNVSWDVYLDLSKVDTDIAEKLKDFIINNKTVYPIYLGKTNHFAEITNGRLVEAIELANTNELVIDSMFKEDFIEEMVADLFAGGESYVDTRETLPSGYKDEFCEYVLDIYCLTDKEINLRKDFDYKLAEVDGINICLA

SEQ ID NO: 2175 - protein, 283 aa, Megamonas funiformis CAG:377
MEILKFKLSGKSAFFKKPEVNTYCYFTYGNIHRIALLGILGAILGYKGYSQMKDILSIKEEIDLKPAYPEFYEKLKELKIAILPLNPKGVITKKIQIFNNSTGAGSKELDKKNKIEYGVNLIVKEQWLENPKWEICILLDCEEAKKIKEAIQNRKCKFYPYLGTNDHFADIEYLGVEEAQPIKQDDYRIDSFMVKDNIEFIEKNSRQLRKILSEDEIESYSRFKYEEALPKSIDAEVNNYKLERFVYTNGFVKFLDSKQVYSISNQDNKEVIEAKKRKNIVFY

SEQ ID NO: 2176 - protein, 354 aa, Eubacterium sp. CAG:202
MKAIRLHIKQNSANYKKEETVQNRMTFPLPPYSTVIGALHKACGYTSYHPMQVSVQGKYGSLKTKMYKDDCFLNSLNDDRNLLVKMKNPDMLSSAYQVVATAQKAQGNSFEKGITINVINEKLLEEYRFLKRTKRRIDKHKKIINKMKTRLKEMKADENVSAEEVKEFDKRIKHIKAVYDEYEKVKYTIPYSHFRTLAKGPKYYELLCDIELIIHIVADENTMNDIMDNIGNLTAIGRGEDFVEVLECAQTELFDVDEDVDYGEADFDVYMPVEYLEINKDDMDIISKTEGGYTGGTKYLMPKDYKTVQLKGGMRKRVFNRVPIIFCQLNYIENGCKGIMLDKTENGIYSVFLA

SEQ ID NO: 2177 - protein, 354 aa, Clostridium sp. CAG:964
MKAIRVHIRQNSANYRREETVNCRTTYPMPPYSTVIGAFHKACGYTSYHPMKLSIQGKYGSLKTKMFKEDCFLNSLQDDRNTLVKMKNPDMLSSAYQVVAIAQKSQGNSFEKGITINVVNEKLIREYRLLKRTKKRIDKHKKRISQMNSTLKEMKANSNISPEEVKAFESRYKRLKEIYSEYERVKYTIPYSHFRTLAKGPKYYELLCDIEMVIHIVSDEQTMRDIMDNICNLTAIGRGEDFVEVLECEETELSEVDTFIDFNNDVYDVYMPIEYIEQNKENLDIDSDTTGGYRGGTKYLMPKDYTTQKIKGGMRKREFNRIPVIYNKFSYLDKGCSGILIDKTDDTIYPVLLA

SEQ ID NO: 2178 - protein, 266 aa, Firmicutes bacterium CAG:227
MERAIRLQCFQNLVNYRKPSSFIIKETFPLPPYSTVLGMIHAACGYTEFHPMKLCIQGTNSGMISELYTRYAFSAGAKFEEGRHNICIEDNGTKYGAFKGIANVELICENHLVIHIVPNEEDFMTVYHALKNPPQYLSLGRYEDLLDIERVDIVEIHREDEVDLKRDMYIPVEREWKNNEDKIELPNKQMTVYSLTREYEITKQGLRRWKKEGGRVKAYYCPKGTTLETGAYTDNYAEIREAEIEKDGNKKNKDLENEKDAAIVLY

SEQ ID NO: 2179 - protein, 223 aa, Clostridium sp. CAG:356
MKILKLKLYQETACYKKPFATKVAETYPLPPYSTIIGMFHKILQAGAGEYFPMNISVQGSYKGIFSNYQNLRMYKGKDKVTSMPRNVHQLLDVNLIIHVQAEDEIIDKIYKNIINGTETFTLGRNEDIVRIDSIKILGDVNEVEESEIKENAYVPEWIDNEIAGINYRLNTTYKIQDDIRKWNKVNVKYVEKHTNKSLYGTEVLQDEDGDNIYFYSERIQNEL

SEQ ID NO: 2180 - protein, 249 aa, Eubacterium sp. CAG:38
MKVLRFTLSGKQAFFKKPEVNRYYYFTYGHIHRVALLGLLGTVMGYSGYAHIVQKKKMEAPEYPEFYEQLKELKMAVIPCCEKGSFPQKIIAFNNSVGYASMEKGGNLIVRQQWLENPKWYVYIMLDSKAAEAVADNIIGRKCVYMPYLGSNDHPADITEASMIDATEVETPEKIDSFFVRGDAVVDLDDFEQDNPYKYEEALPVRLDLAFNMYEYERFVLTNLTVSEIQKKIYAVDDIDGRTYHIAFY

SEQ ID NO: 2181 - protein, 216 aa, Clostridium sp. CAG:273
MKILKLNLFQETACYKKPLALKVAETYPLPPYSTVIGMFHKILQAKNGEYFDMNISVQGEYESIFSNYQNLRMYKGKDKVTSMPRNVHQLLNINLVIHVQAEDEVIDKIYKNIVNGNETFSLGRHEDMVRIDGIKYVQNVEQVKRTQANRNTYVPLDKLGEDMPGINYNINTVYHVTPDNLRIYEKVKVKYIEEDSNILLKNVLKDEDGDYIIFYK

SEQ ID NO: 2182 - protein, 248 aa, Caldanaerobacter subterraneus
MLNSLLKIKIYQPFANFRKPFSYGIVDSYPLPPPSTVKGWLHNILGAREGKYYKMAVSICGKFNSVVYDIQRIIKFDRLRGENDNAPVVNEVSARVVNGIIYVTNLVDVQLCIHVNAERDVLEKIYKNIFDSYWGLGRKEDLMRIDEIKFFEPRKVEYRKYIKKRPPEIGMYLKSSTAETLMIDGIRFRLNNRYEKTKDGLRIFTDKKDVAFIETLEQLNPMVIVDKEVMVDDENIIIDLIGDKEYEN

SEQ ID NO: 2183 - protein, 242 aa, Hippea alviniae
MKILVFDIWADYGHFRVPYTTSSPLTLSVPSKTVLYGIISAILGYDKDSYLEHFQDNQWRFAVGIKKPIKTVYIPENFIDTKSAKMFGRMPKNKPRRTQINLEFLKEPYFRIYATSENDKLVRLKNLLENHKSTYTVSLGLSECLANFKYIGLFGLEKRQANDKPVEIVSIIPLNKLTEPSQVDFLSENSKFLKIHIPLEMKPDRELIKSGYFLIEANGNPIKLKSGEYYHVKELDENIFLF

SEQ ID NO: 2184 - protein, 1165 aa, Pseudochrobactrum sp. AO18b
MRINRLDLTRYGRFTDHVLDFGAADQGKPDLHIIYGPNEAGKSTTFSALLDLLFGIEHKSRYDFLHSYSAMKIGASLQLQGATQELVRTKARNNSLSDPAGRVLPETLISDELGDIDRNAYRMMFSLDDDTLEEGGDAILASKGNLGELLFSASAGLAGISQNLNLLRSRADQFYRSGARTGGLVDLNAQLKELETAKAELDAKSSAQSYGKLSDSFRQAEAEYQQALTAHGQIRGRIAEIEAMLNALPHYHRLHRLREDLTAFADIPAVPAGFADEQPRLMIDDAELRVRVENQSAEIARLEREIAEIHPDENALNLATSAGHLQDLQARFVTAEKDLPEREAALRAEQHKIEALLFRLGRDIKTDPRALLINIQTETALRSLIEQRSGIMAALQMTGKELAVAEERLKLAQDKLKQSGITQAHCDPASMRYLHDMLNRLRSEDLSNSLQLADQAAREEEAQLHEIWQALPYHQDDFETDLKLLATMAVPDVAEVEAAGRELQALQNRWQQTQDNQAKNTDEMVQLRAQLQAVQQNSLVITQEQAAELRQNRNAAWQQHRKSLSSESADAFERYLMQDDQAVHNRLTQAAEFARAMQLRERLAVLEAQNLYLQNSGTAAQTELQAVEARLAIWQQQLVPVCKENLTAGSLLRWMEKREALLQKRQLWLRACRSRDEKLVQIRQAETDLTTALQQVGVAVAETGLSALQTQAVTLHDSFQLYAGLQTELAEREQELRRRCKDADEIQAQDVQWQQDWASTCQATWLGPADAVPALDEVREILNLMAELAPALERSHDLAQRIHAMHDDQAAYSRETQALAKRLGLPVQTSAGVGIPVAELALHSAQRIRKAEEEHKKLQELKGRLAEAEQHRLQLNQKASELNARKQAMLTQLQADTLEDAGFKIQAGAKKAQLEQMLTDEEQTIIHLLKLANSAEAEDLLAQADSAELKEQLLGLREQDEAQDRHKQEQYRLKMQAEQLLREAQAGDDSAAKLDEQRRTLLLEIEEKSKQYLRLRFGISAAEQALRLYRDQHRSSMMAQASEAFAAISQGSYRQLTTQTDKDSEILIAVAADGSSKTADQLSKGTRFQLYLALRIAGYYEFVSRRPMPFIADDIMETFDDDRARETFRLFTQMAGQGQVIYLTHHQHLCEIAQDVYPDVRLHQL

SEQ ID NO: 2185 - protein, 260 aa, Clostridium saccharobutylicum
MDVVKINIYGKTAFFKKPEVNTYRYLTYGQLHKVALMGIFGCILGLNGYGQQGDKVYPEFYEKLKDIKVSIVPISPAKTGGFSKKIQQFNNSVGYASKEEGGNLIVTEQWLENVSWEVYILCNNDISNKLKDALLGKNTVYIPYLGKNDHVANISSIEVYKGVETQDVSYISTLDSLFLKDCVNIKKLIKPNGFRPVKAAPSCGLEKMREYVYQEFLPYALEPKFNTYDTRKFICTNKSIEVNDKESIIYSINDKNLFFY

SEQ ID NO: 2186 - protein, 266 aa, Clostridium saccharobutylicum
MKILKFTLSGKTAFFKKPDVNTYLYFTYGNIHRVSLLGMFGAILGYGGYNQMKKTDISKKAKKKDDENSIFPEFYEKLRDIKISIAPNNKKGFIPKKVQTFNNSVGYASKEQGGNLIVKEQWLENPSWDIYVLIDSEESEKVSEYILNHKAIYQPYLGKNDHYANITNIVVIENSEIVEINKLNIINSLFPKKLFEVDLEDEDEEEDELADDVYIEAFKYEEQLPIALDKKTNMYISEGFLYTNMKVSSHNNVNVYKVGERNIVFY

SEQ ID NO: 2187 - protein, 326 aa, Lachnobacterium bovis
MKTLRIILYQSQANYRREETIDNKMTYPLPPMSTVIGAVHAACGYEKYHPMDISIQGYYGSKQKRIYRYNEYLNSTMDDRGILVKMKNSSMLSQAHEIVSEALKQGASHEKEVKTVVHNRELLEEYKKLRKNRKDIDDEIKSHKNADKETLNNLKNKKKNCQAKLDNFATLNRSIKSYEVLYDVKLIIHIRADDAVVEDILKNVYNIKSIGRSEDFVDIQEAKIVELFDEIDCDEIANNSNEKKLTGYVSSKAVSEDVIIPNERSEGIRVGGTKFYLNKNYNIKNGKRIFEKKWVVYSSNYKIDDESELGDDTNVYYDGTYIVSFL

SEQ ID NO: 2188 - protein, 256 aa, Fusobacterium russii
MIIMKAIKFKIYQDMVNYKYPTSFQLKETYPLPPYSTVIGMIHNLCKYTSYVPMKVSIQGKYNSRVNDLSKRYEFAAGMTFDPTRHQLEIKNVDDKSYGVTTGISTAELLTNVELLVHIIPEDESRIEEIKKALENPWEYPSLGRREDIVILKEIRVVEIKEVELEEKKKLPENYAIYIPIKSLSDSIDFKSINQRSSGTIYKLTKNYILENYGTEKKPKYFRKWNKIEVIYSSKITALDEEYFYLDDEDNIVMPI

SEQ ID NO: 2189 - protein, 262 aa, Desulfurobacterium sp. TC5-1
MACRIIAFDIWGELAHFRRFFTTSSPLTFSFPPPTTVRGIIGAILGLQKNEYIEITNRLSIGIYITSPIRKLRTGLNIIFTKGSGGKFEPTLFKDKKGDVKKTVRTQIQVEFLKDPGYRIFVAGDEKLLDSLLNYLPYHKTEYTVSLGLSECLADFKFAGEFTAEEVEETSEIHSAIPTRKIKNISLSNQIKLAKERIPIYMNAERIVQEYDNIVFETSGKPIKGAFKNVFHIKETGENVHLFTVPSQQMSKRSFEKDAKSG

SEQ ID NO: 2190 - protein, 264 aa, Thermodesulfatator atlanticus
MMEIPNLYKGLVFTVKGPFAHFRKFYGQTSALSYPFPPRTALCGMVGAILGIPRTEVYEIMQPPNGFFVLQILTPIRKITSSMNLLSTKGEYLSPLIGNRKRGKIEFFDSTKNRTQIPMEILLPRPPEKTLKFRVAFWHKDIKLLEKLKEYLTNTKTFFPVYLGISEFLAVAEFEGETDSLSELQHYKGEVHSVVTSENVEGHLIKPGNRFSIEHMLIYMNSDFSAKAHTNVVYSENSSPLFLKVKYVLNWKENIWVPYELITS

SEQ ID NO: 2191 - protein, 248 aa, Thermodesulfobacterium thermophilum
MENNIKIIKINIWGQTAHFRIYGNQNFCDSYPLPPPSTVLGILREALGERPPEPLTLAIKGWFKGVFFDYQTFLHGAIELDSKKGWWVRRKINRYSDAKKGDDVQLNPLYVKILFKPQYTIYLFTPEHHNYYLSKLKDPQGFISLGRSEDIAMFKTVSVSAEKKKAEKKDKIKIENSYLPRELYGSTPLFLPVSHLKDRNLKMEKIYYIQQSVSYYEGEYWKTSDGDCFLWLLEYKDTINGNLPILLG

SEQ ID NO: 2192 - protein, 245 aa, Thermodesulfobacterium thermophilum
MKVLVFDIWADYAHFRKFYTTSSPLTFSFPPPPTISGILGAIYGTDKNTNKYLEIFGCKECRVSIRILNPIKKVRMGLNFINTKDNCWQPVLKITSKSKHEPRTQIRTEFLKDPKFRIYVVHENKNIFEELVKRIRDRQIFYTISLGLSELIANFSFVGVFICEEKFGDTLVDIHSVFPITNLSENGLVIEEGKKYFKEKIPIIMKQNRVVEKYEDVIFEPDGKTIRAKLKNYFKLENGENIVFF

SEQ ID NO: 2193 - protein, 366 aa, Fusobacterium nucleatum
MEALRIILKQSSANYRKAGTVDNKMTYPLPIPSTIIGALHNICGYTDYHSMDISIQGKFTSLSRRVYTDYCFLNSALDDRGNLVKVVDPNTFSGAFVKVASAKKSQGNSFKDRITIQVHNEELLQEYCSLKEKSKEIEELKNSEYKKKLEEFKVLKKEIADKKKKEDKKSETFKQLSEEEKKIKLDEEKYKEDFKKFEYENYTKPYSYFQNLVTSLKSYEVLNDIFLILHIKSDEETLKDIEENIYNLQSLGRSEDFVEVVECKIIELQEFSRNIRVSKFSMYLKNKDMSDKKIIPLAVDQDHQAGGTKYYLDKNYRLEKNRRIFKKVPVVYSNFVGAKNSSENVKLDYLEILGQDKKQEILVNFL

SEQ ID NO: 2194 - protein, 256 aa, Fusobacterium nucleatum
MKALKFTLSGDSAFFKDNVINTVYLTYGNIHRVALLGMFGAILGYGGYSKQNDMLKKKNKKMSDYPEFYEKLKDIKISIVSNGKNGYFNKKLQTFNNSVGYASKEEGGNLIVKQFWLENPSWDIYILLDCDEAKKIADYIQNRKAIYLPYLGSNDHLANIMDVEIIDIEEKMSSEDETIEILSMIKDSDISEKKKNVFSIDKNSIRDDIYKYSEYLPVALSKDLNQHEKEKMTITNMSVILKKSYYKVEDKNIVFY

SEQ ID NO: 2195 - protein, 256 aa, Fusobacterium nucleatum
MKALKFTLSGNSAFFKDNVINTVYLTYGNIHRVALLGMFGAILGYGGYSKQNDMLKKKNKKMSDYPEFYEKLKDIKISIVSNGKNGYFNKKLQTFNNSVGYASKEEGGNLIVKQFWLENPSWDIYVLLDCDEAKKIADYIQNRKAIYLPYLGSNDHLANIMNVEIIDIEEKMSSEDETIEILSMIKDSDISEKKKNVFSIDKNSIRDDIYKYSEYLPVTLSKELNQYEKEKMTITNMSVILKKSYYKVEDKNIVFY

SEQ ID NO: 2196 - protein, 253 aa, Clostridium tetani; identical to SEQ ID NO: 1428

SEQ ID NO: 2197 - protein, 266 aa, Paenibacillus larvae
MRALRFELKGETAFFKKPDVNVYAYFTYSHIHKVALYGLFGAIIGLGGYSQQYERNHPLTSNRRKNSEIKAVFPEFYEVFRDTSVCIVPHGDRGYFAKKIQIFNNTVGYASQEVGGVLNVREQWLEHPHWTIYVAEDEGIPQPVFDRLADYILHSKAEYCPYLGKNDHPASLTQPALVELEKPTNPPLYIDSLHRSESIRYDQEGGVKGGLQSFFKEFMPVGLNDANNGYMLEPLVFTNHEIDADTLQETDWERLYLDGERTLYFI

SEQ ID NO: 2198 - protein, 238 aa, Methanolobus tindarius
MDKVLAFDVWGEYAHFRKYYTTTSPLTFSIPPRTAICGLIAAIIGIDKTEYLSYFSKDKADIAVKLLSPVKKVRLSENLIDTKTALVMGKIKNRTQIRFELLKDARFRIYFSHKEAELYEKLHSYLTQHQSFYTPCLGLSEHIANFVFVGEFSVELKNGTEDFVVIDSAIPVKQNSNLKIRFDENGGEYFHETLPIEMAEDRTVLEYSKVAFERNGQPIIAKFDTYWELDNGERIVFL

SEQ ID NO: 2199 - protein, 216 aa, Methanobacterium sp. MB1
MFGFKFRIETLYFTTFRKATSTSLISSYSIPPFTTIRGLISNALGLKRDDLRIQNWIKIGIKPLNNINRSTEIVKVLKLKGTGKKYQKTFPSSPIFKEFLVNPIYDIYIAGEQEKIDAIYNSLKNPKRPLYIGGSDELVDITIFEPTTINKITSNKISCVMEGINENCVIEKIPYKFILNGKTFSLEYKTVSIPKEEKISAETDVFDFSGEGVILL

SEQ ID NO: 2200 - protein, 670 aa, Meleagris gallopavo
MMADTFDHSVISVGEEEGEDNFQRSLPTRDSLRSPRGSVVSFHNIQYSVKQSSGFLCKRKTVEKKILHNVYGIMKPGLNAILGPTGSGKSSLLDVLAARKDPAGLSGEVLIDGIPQPPNFKCISGYVVQDDVVMGTMTVRENLHFSAALRLPSSISFQEKEERVTQIIGELGLSKVADAKVGTELIRGVSGGERKRTNIGMELITEPPVLFLDEPTTGLDASTANAVLILLKKLSRRGRTIIFSIHQPRYSIFKLFDSLTLLALGKVLYHGPAKQALEYFSSIGYECEPFNNPADFFLDIINGDSTAVAASKEDHKPADTEKGIEENMSISVVDTLHQKYLNSSLYESTKEALGKVELKQGRKKKVSKKGHEITYANGFFTQLYWVSKRSLKNLIRNPQASIAQIAVTVILALVVGAIFFGVKLDESGIQNRVGSLFFVTTNQCFSSVSAIELFIRDKKLFVHQYTSGYYRVSAYFLALMLGDLLPMRTAPAIIFSCITYWMIGFQAIAGRFFFFMLALVMVSYTATAMSLAISAGMEVVAVANLLITICFVLMLIFSGLLVNLPSVMGWLNWLKYFSIPRYGLTALQVNEFRDLYFCGDKSNVTVPVGNASTCPPVTSGARCSGEDYLISQGIAPTNMAMWENIVALLCMTVIFLLIAYLKLRFMRKFT

SEQ ID NO: 2201 - protein, 1205 aa, Cucumis sativus
MFTPQKVWSGWPLTPKTGAQKTGAGSASNPNSVTPNLSRKGDGIKGKTVAFGETTTPLSGALVENGGEMFVGSAEAAALDQEGLAEKISRLENELFEYQYNMGLLLIEKKDWTLKYEELKQALAETKDTLKREQMAHMIAISDAEKQEENLKKALGVEKECVLDLEKALREMRAENAEIKFTGDSKLAEANALVTSIEEKSLEVEARLRAADAKLAEVSRKNSEVERKLQDLEAREGALRRDRLSFNAERESHEATLSKQRDDLREWERKLQDAEERLAKGQTILNQREERANESDRMVKQKEKDLEELQKKIDSSNLALKRKEEDIGSRLANIALKEQAKIKEKELLVLEEKLSAREKVEIQKLLDEHNAILDAKKIEFELEIDQKRKSLDEELKSKVSEVEKKEAEIKHMEEKVGKREQALEKRTEKFKEKEGDYDAKFKALKQREKSLKLEEKNLEAEKKQLLADTEELISLKAEVEKIRAENEAQLLKLHEERESLKVSETERSDFLRLQSELKQEIEKYRQQKELLLKEAEDLKQQKETFEREWEELDEKRAQVEKEQKTLLLQKEEFEKRIFSEEERLKSERLETEAYIHREQENLKLAQESFAASMEHEKSAIAEKAQSDRSQMMHDFDLQKRELESAMQNRVEEMERGFREKDKLFKEEKERELENIKFLRDVARREMDELKLERLKTEKERQEAEANKEHLERQRIEIRKDIEELLELSNKLKDQRERLVAERDRFISYVDKHVTCKNCGEIASEFVLSDLQYLDGFENADVLNLPGLPDKYMEIQGLQVSVSPGGNLGISDVKNGELTPGGAGQKSPISAGTISWLRKCTSKIFKFSPGKKIVSPAFEKQDDEAPVSDEHDDLAEPSKRMSVGEDEVELSLAIASDSLDDRRIQSDVSGRDVEPSQNLSIDNQSNIVSKVPEVAVDSQPSDVRENKKRPKRGKPKINRTRSVKAVVEDAKAIIGELQPTQQAEYPNGNAEDSSQLNNESRDESSLAGKGTQRNLRKRTRANSSQIMGENDHDDSEVRSGSVVEGQPRKRRQRAAPAVRAPEKRYNLRRKVVGASKEPSNISKEHEEVGTVNRREEDVHYSRVRPTPSMGVASDNAGSAHLVRCGTVQDNQDDGVAGTSKISIDMVSQSEEVNGSPENAGKYEDHGEYRSESCEEVGNEDDDDDEEESAHPGEVSIGKKLWTFFTT

SEQ ID NO: 2202 - protein, 237 aa, Ruminiclostridium thermocellum ATCC 27405; identical to SEQ ID NO: 1224

SEQ ID NO: 2203 - protein, 233 aa, Clostridioides difficile 630; identical to SEQ ID NO: 1367

SEQ ID NO: 2204 - protein, 233 aa, Methanococcus maripaludis C5; identical to SEQ ID NO: 1225

SEQ ID NO: 2205 - protein, 242 aa, Desulfotomaculum reducens MI-1; identical to SEQ ID NO: 1961

SEQ ID NO: 2206 - protein, 250 aa, Caldicellulosiruptor saccharolyticus DSM 8903; identical to SEQ ID NO: 1226

SEQ ID NO: 2207 - protein, 275 aa, Caldicellulosiruptor saccharolyticus DSM 8903; identical to SEQ ID NO: 1227

SEQ ID NO: 2208 - protein, 253 aa, Thermosipho melanesiensis BI429; identical to SEQ ID NO: 1228

SEQ ID NO: 2209 - protein, 225 aa, Methanococcus vannielii SB; identical to SEQ ID NO: 1229

SEQ ID NO: 2210 - protein, 256 aa, Methanococcus aeolicus Nankai-3; identical to SEQ ID NO: 1230

SEQ ID NO: 2211 - protein, 232 aa, Bacillus cytotoxicus NVH 391-98; identical to SEQ ID NO: 1231

SEQ ID NO: 2212 - protein, 237 aa, Campylobacter hominis ATCC BAA-381; identical to SEQ ID NO: 1232

SEQ ID NO: 2213 - protein, 201 aa, Campylobacter curvus 525.92; identical to SEQ ID NO: 1430

SEQ ID NO: 2214 - protein, 230 aa, Thermotoga lettingae TMO; identical to SEQ ID NO: 1233

SEQ ID NO: 2215 - protein, 242 aa, Petrotoga mobilis SJ95; identical to SEQ ID NO: 1234

SEQ ID NO: 2216 - protein, 237 aa, Thermoanaerobacter pseudethanolicus ATCC 33223; identical to SEQ ID NO: 1235

SEQ ID NO: 2217 - protein, 220 aa, Thermotoga sp. RQ2; identical to SEQ ID NO: 1236

SEQ ID NO: 2218 - protein, 250 aa, Dictyoglomus thermophilum H-6-12; identical to SEQ ID NO: 1237

SEQ ID NO: 2219 - protein, 233 aa, Anoxybacillus flavithermus WK1; identical to SEQ ID NO: 1238

SEQ ID NO: 2220 - protein, 236 aa, Thermosipho africanus TCF52B; identical to SEQ ID NO: 1239

SEQ ID NO: 2221 - protein, 257 aa, Thermosipho africanus TCF52B; identical to SEQ ID NO: 1240

SEQ ID NO: 2222 - protein, 238 aa, Dictyoglomus turgidum DSM 6724; identical to SEQ ID NO: 1241

SEQ ID NO: 2223 - protein, 231 aa, Desulfitobacterium hafniense DCB-2; identical to SEQ ID NO: 1242

SEQ ID NO: 2224 - protein, 238 aa, Halothermothrix orenii H 168; identical to SEQ ID NO: 1243

SEQ ID NO: 2225 - protein, 260 aa, Thermotoga neapolitana DSM 4359; identical to SEQ ID NO: 26

SEQ ID NO: 2226 - protein, 250 aa, Caldicellulosiruptor bescii DSM 6725; identical to SEQ ID NO: 1245

SEQ ID NO: 2227 - protein, 275 aa, Thermococcus sp. AM4; identical to SEQ ID NO: 1434

SEQ ID NO: 2228 - protein, 280 aa, Desulfobacterium autotrophicum HRM2; identical to SEQ ID NO: 1246

SEQ ID NO: 2229 - protein, 229 aa, Sulfurihydrogenibium azorense Az-Fu1; identical to SEQ ID NO: 1247

SEQ ID NO: 2230 - protein, 253 aa, Persephonella marina EX-H1; identical to SEQ ID NO: 1248

SEQ ID NO: 2231 - protein, 236 aa, Kosmotoga olearia TBF 19.5.1; identical to SEQ ID NO: 1249

SEQ ID NO: 2232 - protein, 245 aa, Geobacillus sp. WCH70; identical to SEQ ID NO: 1250

SEQ ID NO: 2233 - protein, 233 aa, Geobacillus sp. WCH70; identical to SEQ ID NO: 1251

SEQ ID NO: 2234 - protein, 218 aa, Thermococcus sibiricus MM 739; identical to SEQ ID NO: 1252

SEQ ID NO: 2235 - protein, 258 aa, Methanocaldococcus fervens AG86; identical to SEQ ID NO: 1254

SEQ ID NO: 2236 - protein, 264 aa, Halorhabdus utahensis DSM 12940; identical to SEQ ID NO: 1253

SEQ ID NO: 2237 - protein, 254 aa, Leptotrichia buccalis C-1013-b; identical to SEQ ID NO: 1255

SEQ ID NO: 2238 - protein, 262 aa, Halomicrobium mukohataei DSM 12286; identical to SEQ ID NO: 1256

SEQ ID NO: 2239 - protein, 250 aa, Desulfotomaculum acetoxidans DSM 771; identical to SEQ ID NO: 1257

SEQ ID NO: 2240 - protein, 246 aa, Desulfotomaculum acetoxidans DSM 771; identical to SEQ ID NO: 1258

SEQ ID NO: 2241 - protein, 253 aa, Desulfotomaculum acetoxidans DSM 771; identical to SEQ ID NO: 1259

SEQ ID NO: 2242 - protein, 268 aa, Peptoclostridium difficile CD196; identical to SEQ ID NO: 1402

SEQ ID NO: 2243 - protein, 233 aa, Peptoclostridium difficile CD196; identical to SEQ ID NO: 1367

SEQ ID NO: 2244 - protein, 233 aa, Clostridioides difficile R20291; identical to SEQ ID NO: 1367

SEQ ID NO: 2245 - protein, 266 aa, Ammonifex degensii KC4; identical to SEQ ID NO: 1260

SEQ ID NO: 2246 - protein, 247 aa, Geobacillus sp. Y412MC61; identical to SEQ ID NO: 1261

SEQ ID NO: 2247 - protein, 264 aa, Thermobaculum terrenum ATCC BAA-798; identical to SEQ ID NO: 1262

SEQ ID NO: 2248 - protein, 266 aa, Spirosoma linguale DSM 74; identical to SEQ ID NO: 1263

SEQ ID NO: 2249 - protein, 287 aa, Methanobrevibacter ruminantium M1; identical to SEQ ID NO: 1264

SEQ ID NO: 2250 - protein, 253 aa, Hydrogenobacter thermophilus TK-6; identical to SEQ ID NO: 1283

SEQ ID NO: 2251 - protein, 56 aa, Hydrogenobacter thermophilus TK-6; identical to SEQ ID NO: 1363

SEQ ID NO: 2252 - protein, 258 aa, Methanocaldococcus sp. FS406-22; identical to SEQ ID NO: 1265

SEQ ID NO: 2253 - protein, 262 aa, Listeria seeligeri serovar 1/2b str. SLCC3954; identical to SEQ ID NO: 1370

SEQ ID NO: 2254 - protein, 237 aa, Thermoanaerobacter italicus Ab9; identical to SEQ ID NO: 1266

SEQ ID NO: 2255 - protein, 230 aa, Deferribacter desulfuricans SSM1; identical to SEQ ID NO: 1364

SEQ ID NO: 2256 - protein, 231 aa, Deferribacter desulfuricans SSM1; identical to SEQ ID NO: 1365

SEQ ID NO: 2257 - protein, 265 aa, Haloferax volcanii DS2; identical to SEQ ID NO: 1267

SEQ ID NO: 2258 - protein, 266 aa, Zunongwangia profunda SM-A87; identical to SEQ ID NO: 1268

SEQ ID NO: 2259 - protein, 251 aa, Kyrpidia tusciae DSM 2912; identical to SEQ ID NO: 1269

SEQ ID NO: 2260 - protein, 234 aa, Kyrpidia tusciae DSM 2912; identical to SEQ ID NO: 1270

SEQ ID NO: 2261 - protein, 239 aa, Methanocaldococcus infernus ME; identical to SEQ ID NO: 1271

SEQ ID NO: 2262 - protein, 238 aa, Thermincola potens JR; identical to SEQ ID NO: 1272

SEQ ID NO: 2263 - protein, 235 aa, Geobacillus sp. C56-T3; identical to SEQ ID NO: 1275

SEQ ID NO: 2264 - protein, 248 aa, Thermoanaerobacter mathranii subsp. mathranii str. A3; identical to SEQ ID NO: 1273

SEQ ID NO: 2265 - protein, 237 aa, Thermoanaerobacter mathranii subsp. mathranii str. A3; identical to SEQ ID NO: 1274

SEQ ID NO: 2266 - protein, 241 aa, Methanococcus voltae A3; identical to SEQ ID NO: 1276

SEQ ID NO: 2267 - protein, 240 aa, Listeria monocytogenes; identical to SEQ ID NO: 1277

SEQ ID NO: 2268 - protein, 232 aa, Thermosediminibacter oceani DSM 16646; identical to SEQ ID NO: 1278

SEQ ID NO: 2269 - protein, 248 aa, Caldicellulosiruptor obsidiansis OB47; identical to SEQ ID NO: 1279

SEQ ID NO: 2270 - protein, 243 aa, Caldicellulosiruptor obsidiansis OB47; identical to SEQ ID NO: 1280

SEQ ID NO: 2271 - protein, 237 aa, Thermoanaerobacterium thermosaccharolyticum DSM 571; identical to SEQ ID NO: 1281

SEQ ID NO: 2272 - protein, 240 aa, Listeria monocytogenes SLCC2755; identical to SEQ ID NO: 1277

SEQ ID NO: 2273 - protein, 246 aa, Eubacterium limosum KIST612; identical to SEQ ID NO: 1282

SEQ ID NO: 2274 - protein, 233 aa, Geobacillus sp. Y4.1MC1; identical to SEQ ID NO: 1284

SEQ ID NO: 2275 - protein, 244 aa, Geobacillus sp. Y4.1MC1; identical to SEQ ID NO: 1285

SEQ ID NO: 2276 - protein, 248 aa, Caldicellulosiruptor hydrothermalis 108; identical to SEQ ID NO: 1286

SEQ ID NO: 2277 - protein, 250 aa, Caldicellulosiruptor hydrothermalis 108; identical to SEQ ID NO: 1287

SEQ ID NO: 2278 - protein, 239 aa, Halanaerobium hydrogeniformans; identical to SEQ ID NO: 1288

SEQ ID NO: 2279 - protein, 275 aa, Caldicellulosiruptor kronotskyensis 2002; identical to SEQ ID NO: 1292

SEQ ID NO: 2280 - protein, 250 aa, Caldicellulosiruptor kronotskyensis 2002; identical to SEQ ID NO: 1293

SEQ ID NO: 2281 - protein, 248 aa, Caldicellulosiruptor kristjanssonii I77R1B; identical to SEQ ID NO: 1289

SEQ ID NO: 2282 - protein, 250 aa, Caldicellulosiruptor kristjanssonii I77R1B; identical to SEQ ID NO: 1290

SEQ ID NO: 2283 - protein, 243 aa, Caldicellulosiruptor kristjanssonii I77R1B; identical to SEQ ID NO: 1291

SEQ ID NO: 2284 - protein, 224 aa, Calditerrivibrio nitroreducens DSM 19672; identical to SEQ ID NO: 1294

SEQ ID NO: 2285 - protein, 253 aa, Thermaerobacter marianensis DSM 12885; identical to SEQ ID NO: 1295

SEQ ID NO: 2286 - protein, 247 aa, Geobacillus sp. Y412MC52; identical to SEQ ID NO: 1261

SEQ ID NO: 2287 - protein, 245 aa, Thermovibrio ammonificans HB-1; identical to SEQ ID NO: 1297

SEQ ID NO: 2288 - protein, 237 aa, Thermoanaerobacter brockii subsp. finnii Ako-1; identical to SEQ ID NO: 1235

SEQ ID NO: 2289 - protein, 259 aa, Odoribacter splanchnicus DSM 20712; identical to SEQ ID NO: 1299

SEQ ID NO: 2290 - protein, 252 aa, Syntrophobotulus glycolicus DSM 8271; identical to SEQ ID NO: 1300

SEQ ID NO: 2291 - protein, 237 aa, Methanosaeta concilii GP6; identical to SEQ ID NO: 1301

SEQ ID NO: 2292 - protein, 237 aa, Clostridium botulinum BKT015925; identical to SEQ ID NO: 1302

SEQ ID NO: 2293 - protein, 238 aa, Thermodesulfobium narugense DSM 14796; identical to SEQ ID NO: 1303

SEQ ID NO: 2294 - protein, 254 aa, Tepidanaerobacter acetatoxydans Re1; identical to SEQ ID NO: 1304

SEQ ID NO: 2295 - protein, 255 aa, Mahella australiensis 50-1 BON; identical to SEQ ID NO: 1305

SEQ ID NO: 2296 - protein, 237 aa, Thermoanaerobacterium xylanolyticum LX-11; identical to SEQ ID NO: 1306

SEQ ID NO: 2297 - protein, 255 aa, Desulfotomaculum kuznetsovii DSM 6115; identical to SEQ ID NO: 1308

SEQ ID NO: 2298 - protein, 281 aa, Desulfotomaculum kuznetsovii DSM 6115; identical to SEQ ID NO: 1309

SEQ ID NO: 2299 - protein, 242 aa, Desulfotomaculum ruminis DSM 2154; identical to SEQ ID NO: 1311

SEQ ID NO: 2300 - protein, 249 aa, Bacillus coagulans 2-6; identical to SEQ ID NO: 1316

SEQ ID NO: 2301 - protein, 233 aa, Geobacillus thermoglucosidasius C56-YS93; identical to SEQ ID NO: 1284

SEQ ID NO: 2302 - protein, 244 aa, Geobacillus thermoglucosidasius C56-YS93; identical to SEQ ID NO: 1314

SEQ ID NO: 2303 - protein, 239 aa, Flexistipes sinusarabici DSM 4947; identical to SEQ ID NO: 1317

SEQ ID NO: 2304 - protein, 227 aa, Pyrococcus yayanosii CH1; identical to SEQ ID NO: 1312

SEQ ID NO: 2305 - protein, 235 aa, Thermotoga thermarum DSM 5069; identical to SEQ ID NO: 1315

SEQ ID NO: 2306 - protein, 232 aa, Sulfobacillus acidophilus TPY; identical to SEQ ID NO: 1318

SEQ ID NO: 2307 - protein, 221 aa, Methanococcus maripaludis X1; identical to SEQ ID NO: 1319

SEQ ID NO: 2308 - protein, 228 aa, Thermococcus sp. 4557; identical to SEQ ID NO: 1320

SEQ ID NO: 2309 - protein, 265 aa, Haloarcula hispanica ATCC 33960; identical to SEQ ID NO: 1321

SEQ ID NO: 2310 - protein, 250 aa, Caldicellulosiruptor lactoaceticus 6A; identical to SEQ ID NO: 1322

SEQ ID NO: 2311 - protein, 243 aa, Caldicellulosiruptor lactoaceticus 6A; identical to SEQ ID NO: 1323

SEQ ID NO: 2312 - protein, 256 aa, Lactobacillus ruminis ATCC 27782; identical to SEQ ID NO: 1324

SEQ ID NO: 2313 - protein, 229 aa, Bacillus coagulans 36D1; identical to SEQ ID NO: 1325

SEQ ID NO: 2314 - protein, 234 aa, Thermovirga lienii DSM 17291; identical to SEQ ID NO: 1326

SEQ ID NO: 2315 - protein, 258 aa, Niastella koreensis GR20-10; identical to SEQ ID NO: 1329

SEQ ID NO: 2316 - protein, 237 aa, Clostridium clariflavum DSM 19732; identical to SEQ ID NO: 1327

SEQ ID NO: 2317 - protein, 249 aa, Clostridium clariflavum DSM 19732; identical to SEQ ID NO: 1328

SEQ ID NO: 2318 - protein, 232 aa, Sulfobacillus acidophilus DSM 10332; identical to SEQ ID NO: 1318

SEQ ID NO: 2319 - protein, 361 aa, Acetobacterium woodii DSM 1030; identical to SEQ ID NO: 2050

SEQ ID NO: 2320 - protein, 253 aa, Hydrogenobacter thermophilus TK-6; identical to SEQ ID NO: 1283

SEQ ID NO: 2321 - protein, 276 aa, Haloquadratum walsbyi C23; identical to SEQ ID NO: 1378

SEQ ID NO: 2322 - protein, 268 aa, Clostridioides difficile BI1; identical to SEQ ID NO: 1402

SEQ ID NO: 2323 - protein, 233 aa, Clostridioides difficile BI1; identical to SEQ ID NO: 1367

SEQ ID NO: 2324 - protein, 241 aa, Mesotoga prima MesG1.Ag.4.2; identical to SEQ ID NO: 1331

SEQ ID NO: 2325 - protein, 268 aa, Haloferax mediterranei ATCC 33500; identical to SEQ ID NO: 1332

SEQ ID NO: 2326 - protein, 224 aa, Pyrococcus sp. ST04; identical to SEQ ID NO: 1333

SEQ ID NO: 2327 - protein, 237 aa, Thermoanaerobacterium saccharolyticum JW/SL-YS485; identical to SEQ ID NO: 1334

SEQ ID NO: 2328 - protein, 227 aa, Thermococcus cleftensis; identical to SEQ ID NO: 1335

SEQ ID NO: 2329 - protein, 236 aa, Anaerobaculum mobile DSM 13181; identical to SEQ ID NO: 1336

SEQ ID NO: 2330 - protein, 225 aa, Natrinema sp. J7-2; identical to SEQ ID NO: 1337

SEQ ID NO: 2331 - protein, 236 aa, Desulfobacula toluolica Tol2; identical to SEQ ID NO: 2058

SEQ ID NO: 2332 - protein, 225 aa, Candidatus Nitrososphaera gargensis Ga9.2; identical to SEQ ID NO: 715

SEQ ID NO: 2333 - protein, 240 aa, Thermacetogenium phaeum DSM 12270; identical to SEQ ID NO: 1339

SEQ ID NO: 2334 - protein, 240 aa, Listeria monocytogenes SLCC2372; identical to SEQ ID NO: 1277

SEQ ID NO: 2335 - protein, 240 aa, Listeria monocytogenes serotype 7 str. SLCC2482; identical to SEQ ID NO: 1277

SEQ ID NO: 2336 - protein, 270 aa, Natronobacterium gregoryi SP2; identical to SEQ ID NO: 1340

SEQ ID NO: 2337 - protein, 229 aa, Thermobacillus composti KWC4; identical to SEQ ID NO: 1341

SEQ ID NO: 2338 - protein, 254 aa, Tepidanaerobacter acetatoxydans Re1; identical to SEQ ID NO: 1304

SEQ ID NO: 2339 - protein, 237 aa, Thermoanaerobacterium thermosaccharolyticum M0795; identical to SEQ ID NO: 1342

SEQ ID NO: 2340 - protein, 250 aa, Clostridium stercorarium subsp. stercorarium DSM 8532; identical to SEQ ID NO: 1343

SEQ ID NO: 2341 - protein, 236 aa, Clostridium stercorarium subsp. stercorarium DSM 8532; identical to SEQ ID NO: 1344

SEQ ID NO: 2342 - protein, 218 aa, Clostridium saccharoperbutylacetonicum N1-4(HMT); identical to SEQ ID NO: 1345

SEQ ID NO: 2343 - protein, 49 aa, Methanosarcina mazei Tuc01; identical to SEQ ID NO: 2067

SEQ ID NO: 2344 - protein, 223 aa, Hydrogenobaculum sp. HO; identical to SEQ ID NO: 1307

SEQ ID NO: 2345 - protein, 223 aa, Hydrogenobaculum sp. SN; identical to SEQ ID NO: 1307

SEQ ID NO: 2346 - protein, 250 aa, Clostridium stercorarium subsp. stercorarium DSM 8532; identical to SEQ ID NO: 1343

SEQ ID NO: 2347 - protein, 236 aa, Clostridium stercorarium subsp. stercorarium DSM 8532; identical to SEQ ID NO: 1344

SEQ ID NO: 2348 - protein, 237 aa, Ruminococcus sp. SR1/5; identical to SEQ ID NO: 1372

SEQ ID NO: 2349 - protein, 241 aa, Fretibacterium fastidiosum; identical to SEQ ID NO: 1373

SEQ ID NO: 2350 - protein, 147 aa, Megamonas hypermegale ART12/1; identical to SEQ ID NO: 1371

SEQ ID NO: 2351 - protein, 246 aa, Desulfotomaculum gibsoniae DSM 7213; identical to SEQ ID NO: 1350

SEQ ID NO: 2352 - protein, 242 aa, Desulfotomaculum gibsoniae DSM 7213; identical to SEQ ID NO: 1351

SEQ ID NO: 2353 - protein, 220 aa, Thermotoga maritima MSB8; identical to SEQ ID NO: 1212

SEQ ID NO: 2354 - protein, 240 aa, Listeria monocytogenes; identical to SEQ ID NO: 1277

SEQ ID NO: 2355 - protein, 267 aa, Halorhabdus tiamatea SARL4B; identical to SEQ ID NO: 1423

SEQ ID NO: 2356 - protein, 240 aa, Listeria monocytogenes; identical to SEQ ID NO: 1277

SEQ ID NO: 2357 - protein, 248 aa, Clostridium autoethanogenum DSM 10061; identical to SEQ ID NO: 1355

SEQ ID NO: 2358 - protein, 253 aa, Clostridium tetani 12124569; identical to SEQ ID NO: 1428

SEQ ID NO: 2359 - protein, 265 aa, Haloarcula hispanica N601; identical to SEQ ID NO: 1321

SEQ ID NO: 2360 - protein, 216 aa, Methanobacterium sp. MB1; identical to SEQ ID NO: 2199

SEQ ID NO: 2361 - protein, 220 aa, Thermotoga maritima MSB8; identical to SEQ ID NO: 1212

SEQ ID NO: 2362 - protein, 265 aa, Haloarcula marismortui ATCC 43049; identical to SEQ ID NO: 1216

SEQ ID NO: 2363 - protein, 248 aa, Carboxydothermus hydrogenoformans Z-2901; identical to SEQ ID NO: 1217

SEQ ID NO: 2364 - protein, 214 aa, Clostridium phage c-st
MEFNKLILTSTMAHFKSGINGKNQNTFRVPPISTIVGILKNIYGKEVKNFIFGYTCQYEDVFKDVNTIYKEVNLNITSAKGDRFQHDIAFIEYLINPTITIYTNLDVPIQINDILNLGKTNCLAKCKFEKENITLKECTGYNQWTPKNIGNGKIKRINKETIYNKNKGYYDYYTDLFRLNEEFITKHMLEDTEEGIQLWQYKRVGDIECYQGKV

SEQ ID NO: 2365 - protein, 231 aa, Desulfitobacterium hafniense Y51; identical to SEQ ID NO: 1951

SEQ ID NO: 2366 - protein, 231 aa, Desulfitobacterium hafniense Y51; identical to SEQ ID NO: 1838

SEQ ID NO: 2367 - protein, 264 aa, Methanococcoides burtonii DSM 6242; identical to SEQ ID NO: 1218

SEQ ID NO: 2368 - protein, 258 aa, Rubrobacter xylanophilus DSM 9941; identical to SEQ ID NO: 1219

SEQ ID NO: 2369 - protein, 246 aa, Syntrophomonas wolfei subsp. wolfei str. Goettingen G311; identical to SEQ ID NO: 1220

SEQ ID NO: 2370 - protein, 231 aa, Syntrophomonas wolfei subsp. wolfei str. Goettingen G311; identical to SEQ ID NO: 1221

SEQ ID NO: 2371 - protein, 190 aa, Lactobacillus gasseri ATCC 33323 = JCM 1131; identical to SEQ ID NO: 1222

SEQ ID NO: 2372 - protein, 212 aa, Clostridium novyi NT; identical to SEQ ID NO: 1958

SEQ ID NO: 2373 - protein, 234 aa, Leptospira interrogans serovar Lai str. 56601
METKSMKESQIFQLKVSGENACFTRPEMKAERVSYDVITPSAARAIFDAILWKPAILWIIHKIDILKPILWESIRRNELGSKIAPQNIMQTMEAGTGNLALYIEEERQQRAGLFLKDVSYILHASFKLTKRARDGDSITKFEEMFKRRAEKGQCHHQPYFGSREFAAYFSLNDQTEKPIKIEQQDLGWMLYDLDFEDYNFDTKSYKDANPKFFRAVIQNGSIVIPDLNTNGARL

SEQ ID NO: 2374 - protein, 234 aa, Leptospira interrogans serovar Copenhageni str. Fiocruz L1-130; identical to SEQ ID NO: 2373

SEQ ID NO: 2375 - protein, 222 aa, Methylococcus capsulatus str. Bath
MKDICLKVFGDYACFTRPEMKVERVSYDIITPSAARAIFEAILWKPAIRWRVTKIEVLKPIRWISVRRNEVGAVASVRTAQTAMQAGRGDLGLYIEEERQQRAGLFLREVAYRLHARCEPTDRKGEQESPDKFLAMFHRRATNGQCFNQPYLGCREFAAHFEPVTNLDAAMADEPPITETRDLGWMLHDIDFANGIQPKFFRAHMQQGVIRVPEWNSEGVKG

SEQ ID NO: 2376 - protein, 224 aa, Xanthomonas oryzae pv. oryzae KACC 10331
MSYGVRLHVWGERALFTRPEMKVERVSYDIITPSAARGILEAIHWKPAIRWVVDSIQVLKPICFESIRRNEVGSKLSAASISKAIKAGRTDELVKYVEEDRQQRAATVLREVGYIIAAHFEMTDKAGPDDNVGKHLDIFNRRARRGQCFQAPCLGTREFPASFALLGDDDTPPASDPALSGERDLGWMLHDIDFADGMTPRFFRARMVDGLVAVPPPQDGGVRA

SEQ ID NO: 2377 - protein, 230 aa, Nitrobacter winogradskyi Nb-255
MTYGIRLKVWGDYACFTRPEMKVERVSYDVITPSAARGILEAIHWKPAIRWVIDAIHVLERPRFQSIRRNEVGSKAPAGKIKSAMKRGDLEGLQLLVDEGRQQRASTVLVKPAYVIVARFELTGRGEEGDNEGKHLDIFNRRARRGQCFHQPCLGTREFAASFTLLDAGEPTPEPREQVGDLGFGNPRDLGFMLWDIDHEAGGKPSMFFRAELRDGVMKVPQPGSPEIRR

SEQ ID NO: 2378 - protein, 237 aa, Pelodictyon luteolum DSM 273
MEHFNKTFCLEVKGDYACFTRPEMKVERVSYDVITPSSARGIFEAIFWKPAIRWRIRKIEILNPIKWISVRRNEVGQTASDRSEGIFIETARQQRAGLFLRDVAYRLYAELEFIPHPNRTETKRSVPEPLLDTWEKEEFRKDENPGKYYGIFERRARKGQCFNQPYLGCREFSCEFRLIDGHTTETVPISETRDLGFMLYDLDFEKNVKESSPAFFRCCMEQGVINVPAWDSEEVRK

SEQ ID NO: 2379 - protein, 238 aa, Chlorobium chlorochromatii CaD3
MKNSIEFKVYGREAMFTDPVSRIGGEKCSYHIPTYEALKGIVKSIYWKPTIIWVVDKVRVMKPIRTKTKCLKPLKYHEKGNSLAIYNYLCDVEYQVLAHFEWNLHRPELAQDCINGKHYSVALRALDKGGRQDIFLGTRECQGYVEPCKFGEGKGEYDNISELAFGFTFHGFDYPDETGQKMFRSRFWNPKMVKGVIDFIRPEECLPEHCKPIHEMSMKPFGIDTNQRSVIKEEEVWQ

SEQ ID NO: 2380 - protein, 227 aa, Geobacter metallireducens GS-15
MDMASTKSRMLRLKVWGDNACFTRPEMKVERVSYDVMTPSAARGVLEAILWKPAIRWQVDRIDVLKPIRWESVRRNEVGSVMSPRTNGLFIEEQRQQRAGLFLRDVAYTIHAWFEMTVPPDERNNVIKFQEMFICRASKGKCFNQPYLGTREFSAGFELIPHDQSLPEPIVETRDLGFMLYDLCHDTSRDEGHVHTCTDGCRPSFFRAALKDGRMMVPARDSEEVRR

SEQ ID NO: 2381 - protein, 221 aa, Rhodospirillum rubrum ATCC 11170
MSHGIKLLVSGDHACFTRPEMKAERVSYDVMTPSAARGILEAIHWKPAITWVIDAIHVLKPIRFQTLRRNEVGGKVPAGKVKSAMTKGTLDGLALLADEDRQQRATTLLVDVAYVIEAHFTLTDKAGPEDNPGKHLDIFTRRARKGQCFHQPCLGTREFPARFELIDGDRPIPAAVNRSEDLGFMLWDIDHAGDRSSMFFRARMDRGVVRVPAPSSAEIRR

SEQ ID NO: 2382 - protein, 221 aa, Frankia casuarinae
MTLTLPRSPSGDPPVAVQVWAEGALFTRPEFRVERVSYPVMTPTAAVGVLESIFWKPEFRWAPVAIEVLRPLHQFTLRRNETYDLPLLSDAASGVRRIDTVANRDQRSAVCLKDVAYRIHAHVELQDHATKDVAAYREQFRRRVSRGACFQQPYLGAREFPASFAPPDGTPVWKQDEDLGVMLHRIHHGPPVAFDWFTARLDAGVLYVPRAGIRGDVPAVA

SEQ ID NO: 2383 - protein, 225 aa, Methylobacillus flagellatus KT
MAYGVRLHVWGDYACFTRPEMKVERVSYDVMTPSAARGILTAIHWKPAIRWVVDSIHVLKPIRFESIRRNEVGSKASASKASGGMARGSVEGIYTLIEEDRQQRASTVLRDVAYVIEAHFELTELAGEGDNPGKHLDIFNRRARRGQCHHQPCMGVREFPAFFSLIEPEMALPASILSDEQKSRDLGWMLHDIDFDHGATPRFFRAALVNGVMSVPPFHSEEAKS

SEQ ID NO: 2384 - protein, 242 aa, Streptococcus pyogenes MGAS9429
MYRSRDFYVRVSGQRALFTNPATKGGSERSSYSVPTRQALNGIVDAIYYKPTFTNIVTEVKVINQIQTELQGVRALLHDYSADLSYVSYLSDVVYLIKFHFVWNEDRKDLNSDRLPAKHEAIMERSIRKGGRRDVFLGTRECLGLLDDISQEEYETTVSYYNGVNIDLGIMFHSFAYPKDKKTPLKSYFTKTVMKNGVITFKAQSECDIVNTLSSYAFKAPEEIKSVNDECMEYDAMEKGEN

SEQ ID NO: 2385 - protein, 250 aa, Streptococcus pyogenes MGAS10270
MYRSRDFYVRVSGQRALFTNPATKGGSERASYSVPTRQALNGIVDAIYYKPTFTNIVTEVKVINQIQTELQGVRALLHDYSADLSYVSYLSDVVYLIKFHFVWNEDRKDLNSDRLPAKHEAIMERSIRKGGRRDVFLGTRECLGLVDDISQEEYETTVSYYNGVNIDLGIMFHSFAYPKDKKTPLKSYFTKTVMKNGVITFKAQSECDIVNTLSSYAFKAPEEIKSVNDECMEYDAMEKGENRWIFLLLS

SEQ ID NO: 2386 - protein, 242 aa, Streptococcus pyogenes MGAS2096; identical to SEQ ID NO: 2384

SEQ ID NO: 2387 - protein, 242 aa, Streptococcus pyogenes MGAS10750
MYRSRDFYVRVSGQRALFTNPASKGGSERSSYSVPTRQALNGIVDAIYYKPTFTNIVTEVKVINQIQTELQGVRALLHDYSADLSYVSYLSDVVYLIKFHFVWNEDRKDLNSDRLPAKHEAIMERSIRKGGRRDVFLGTRECLGLVDDISQEEYETTVSYYNGVNIDLGIMFHSFAYPKDKKTPLKSYFTKTVMKNGVITFKAQSECDIVNTLSSYAFKAPEEIKSVNDECMEYDAMEKGEN

SEQ ID NO: 2388 - protein, 221 aa, Myxococcus xanthus DK 1622
MWMTSTPGRSFRVRARGPVACFTRPEMKAERVSYEVMTPSAARGVLEAILWKPAIRWHVHEIAVLAPVRWTSFRRNEVNSRATVGKFDYAADEDRAQRNTVALRDVDYVITASFALVPGKAGPDDNVRKFEDMFERRLERGQFFHAPYLGCREFAARVEPAEDVLLPHESGQGRRPLGLMFYDFVFDIPGEPVRPEFFQAFLEDGVLRVPPRAQVLGGGVP

SEQ ID NO: 2389 - protein, 227 aa, Desulfovibrio vulgaris DP4
MTHGAVKTYGIRLRVWGDYACFTRPEMKVERVSYDVMTPSAARGILEAIHWKPAIRWIVDRIHVLRPIVFDNVRRNEVSSKIPKPNPATAMRDRKPLYFLVDDGSNRQQRAATLLRNVDYVIEAHFELTDKAGAEDNAGKHLDIFRRRARAGQSFQQPCLGCREFPASFELLEGDVPLSCYAGEKRDLGYMLLDIDFERDMTPLFFKAVMEDGVITPPSRTSPEVRA

SEQ ID NO: 2390 - protein, 237 aa, Methanocorpusculum labreanum Z
MIFRNTVEFQVYGKLALFSDPLTRVGGEKFTYQIPTYQALKGILESVYWKPTFVWYIDSVRVMNQIQTQSKGIRPIKYTSSENELAIYTYLTDVRYQVRAHFDWNYDRPELEKDRDENKHHSIAKRMIEKGGRRDIFLGTRECQGYVEPCTFGGDPGAYDDCSELAFGTMFHGFTYPDEGGNGKLIARFWNPVMKRGVIDFIPPGECTFTREIKNYSLKRFTIGDNLQSVQELAEEI

SEQ ID NO: 2391 - protein, 221 aa, Desulfotomaculum reducens MI-1
MGYGIRLLVWGEFACFTRPEMKVERVSYDVMTPSAARGILESIHWKPSIVWKIDKIHVLNEIRFDNVRRNEVGSKIPTGNVRKAMKGEPTLLCQYASEDRQQRATLLLRNVAYVIVAHFEMTSKAGPQDSPEKHYAIFSRRARQGQCFQQPYFGCREFPAKFRLIEEDEPTPHSLHKGDKDLGWMLLDIDHEDGMNPRFFRATMKDGLIEVPPMERGLTVL

SEQ ID NO: 2392 - protein, 224 aa, Pseudomonas stutzeri A1501
MAYGIRLKVWGERACFTRPEMKVERVSYDVITPSAARGVLEAIHWKPAIRWVVDRIHVLKPIRFESLRRNEVGGKLSAASVGRAMKAGRTEDLISLIEDDRQQRATTLLRDVAYVIEAHFELTEKAGADDSIGKHLDIFNRRARKGQCFHAPCLGVREFPASFQLLEADQELPSTDASLLGEHDLGWLLHDIDFANDMTPHFFRARMNSGVIDVPPFLGEGSKA

SEQ ID NO: 2393 - protein, 242 aa, Roseiflexus sp. RS-1
MDHRNSVTFKVWGRYALFTDPLTRIGGEKYSYQVPTYEALKGILSSVYWKPTIVWIIDKVRVMKPIRTQPRSVKPLKYHASGNDLAIYTYLADVEYQVQAHFEWNKNRPDLEHDRNEHKHHSVARRMIDRGGRRDVFLGTRECQGYVEPCKFGEGEGFYDNYGELSLGVMFHGFDYPDEYKPGEFWARFWRATMKDGIITFPRPDDQNKILRRFVRPMNAKPPATVGLQEKNLLEGDEEGRQ

SEQ ID NO: 2394 - protein, 250 aa, Alkaliphilus metalliredigens QYMF
MKKENSVEFKVSGRYALFSDPINRIGGEKFSYQVPTYQALKGILESVYWKPTLIWIIDEVRVMNLIKTQSQNIRPVNFSGTSKGTGTPLNTLSIYTYLTNVEYQVKAHFEWNYNRPNLEKDRNENKHYIVAKRMINRGGRRDVFLGTRECQAYVEPCKFGEGEGAYDHYGSLSFGLMFHGFDYPDETGEDKLTARLWSPVMNNGYIKFLRPDECTIKRELSSMKPKVFDENNFSGLEEFEEEGDIIELDS

SEQ ID NO: 2395 - protein, 247 aa, Actinobacillus succinogenes 130Z
MNNKNTFRSKPFCFRVWGRQALFTDPVTKIGGEKFSYQVPTYEALKGILKSIYWKPTLIWHIDRVRVMKPIRTQSKSTKPLDWNGGNTLAIYTFLQDVEYQVEAHFTWNENWEELKGDRNEGKHTAIAERMLHRGGRQDIFLGTRDCQGYVEPCEFGSGKGFYDEIDNLDFGLMFHSFGYPEETGKHELISRFWNAGMQRGKIEFPSVNDVSGSLKTRFIRKMKPEKPFKRGENVKPVEDEAKELGL

SEQ ID NO: 2396 - protein, 218 aa, Methylobacterium sp. 4-46
MWGERALFTRPETKVERVSYDVPTPSAARGILEAIHWKPAIVWRIDRIHVLKPIRFASVRRNEVGAKASTALALRAMRSGTLAGLGLSAEIERQQRAATMLVDVGYVIEAHLEMTARAGDDAPVKHICMFNRRAAAGQCFHRPCLGTRECPAEFALIPDGAPLPASSLPAEERERELGWMLYDIDFRPDRNEARFFRARLSKGILDVRACLAANEVVS

SEQ ID NO: 2397 - protein, 204 aa, Xanthomonas oryzae pv. oryzae PXO99A
MKVERVSYDIITPSAARGILEAIHWKPAIRWVVDSIQVLKPICFESIRRNEVGSKLSAASISKAIKAGRTDELVKYVEEDRQQRAATVLREVGYIIAAHFEMTDKAGPDDNVGKHLDIFNRRARRGQCFQAPCLGTREFPASFALLGDDDTPPASDPALSGERDLGWMLHDIDFADGMTPRFFRARMVDGLVAVPPPQDGGVRA

SEQ ID NO: 2398 - protein, 218 aa, Ruminiclostridium cellulolyticum H10
MGFGIKLEVWGEYALFTRPEMKVERVSYDVITPSAARGIIEAIYWKRAIKWVIDKIHVCNKIQFTNIRRNEVSIKIAKSNAKALMDGTKTNDYINTNEQRQQRASLVLKDVRYVIEAHFELTDKAGGDDTVEKHYNIALRRMRQGQCYHTPCFGCREFPAKFRLVEDDSIKTHYSGEQDLGFMLYDMNFSDSDNIHPIFFRAKMADGVIDLKNIAKVG

SEQ ID NO: 2399 - protein, 234 aa, Geobacter daltonii FRC-32
MKSRIDFKVTGRFALFTDPLTKIGGEKCSYHIPTYEALKGVAKSIYWKPTFVWVIDKVRVMKRIRTQSKSMKPLNYHKEGNTLAIYTYLADVEYQVQAHFEWNVHREDLADDRDPDKHWHVAKRMVAKGGRQDVFLGTRECQGYVEPCTFGEEKGEYDGYGNLEYGLMFHGFDYPDETGTKELHSRFWRPVMKDGVVEFTTPEDCTVRKFVREMIPNPPSSNGLREEGLLDELD

SEQ ID NO: 2400 - protein, 224 aa, Azotobacter vinelandii DJ
MAYGIRLLVWGERACFTRPEMKVERVSYDVITPSAARGILEAIHWKPAICWVVDRIHVLKPIRFESIRRNEVGGKLSAASVGKAMKAGRTDGLIALADEDRQQRAATVLRDVSYVIEAHFELTARADASDSEGKHLDIFNRRARKGQYFHAPCLGVREFPASFELIEPDDVLPAVPADLRGERELGWMLHDIDFANDMTPHFFRAVMRDGVIEVPALRSEGVKA

SEQ ID NO: 2401 - protein, 236 aa, Teredinibacter turnerae T7901
MEKNNSISFRLWGRYALFTDPVTKLGGEKLSYHLPTYEAIKGVLKSIYWKPTLIWHVDRVRVLKQFRTEAKSMKPLDWGGGNTLSIYTYLRDVEYQVEAHFEWNLHRPELEKDRIDGKHFSIAKRMLERGGRQDIFLGVRDCQAYVEPCEFGAGPGCFDELEQLDFGLMFHGFDYPDESGEPALYKRFWRPVMRHGVVEFPRPEVCEHREYVRPMSVKAFAEGNNLKGVVAEEALL

SEQ ID NO: 2402 - protein, 247 aa, Meiothermus ruber DSM 1279
MRSFQLEVWGELACFTRPEFKVERFSYPIITPSAARGIFDAIYLDFDPQHKTPLMYWQVRRIEVLSPVRYISLMRNEVKEKASVRNIQAWMKDPGSFEPLYADATKDDTGQDTKGRTQRQTMALKNVRYRLTAQAVLYREDPALRQKIEQSFQRRARAGQCIYQPYLGCREFTGYFRLVEDEGAAPVPYNEKIGWMLYDVFDLSHPGRPLRTDRGEKPSISLFEAEVVQGVLEVPPYESPQVRKGGG

SEQ ID NO: 2403 - protein, 219 aa, Desulfarculus baarsii DSM 2075
MSKGVALRVGGDYACFTRPEMKVERVSYEVMTPSAARGILEAIHWKPSIRWIVERIHVLRDIRFTNLRRNELGCKMSVSGAAIKRAVSEGEAMGVFIEEERQQRAAAILRDVEYVIEARFEFTSEADNNEGKHLDIFNRRLEKGQCFHRPYLGCREFAAWFAPLDGDIPPSPLRGEKDLGLMLWDIDFGGHEPMPRFFRAVLNDGVLAVPPPEAMEGRP

SEQ ID NO: 2404 - protein, 227 aa, Desulfovibrio vulgaris RCH1
MTHGAVKTYGIRLRVWGDYACFTRPEMKVERVSYDVMPPSAARGILEAIHWKPAIRWIVDRIHVLRPIVFDNVRRNEVSSKIPKPNPATAMRDRKPLYFLVDDGSNRQQRAATLLRNVDYVIEAHFELTDKAGAEDNAGKHLDIFRRRARAGQSFQQPCLGCREFPASFELLEGDVPLSCYAGEKRDLGYMLLDIDFERDMTPLFFKAVMEDGVITPPSRTSPEVRA

SEQ ID NO: 2405 - protein, 224 aa, Acidovorax avenae subsp. avenae ATCC 19860
MAYGVRLRIWGERACFTRPEMKVERVSYDTLTPSAARGILEAIHWKPAIRWSIDRIHVLNPIRFESIRRNEVGGKISPASVTKAMKAGTPDGLATYVDEDRQQRAATILRDVAYVIEAHFDLTAKAGPDDSVGKHLDIFNRRARKGQCFQQPCMGVREFPASFELLEDGAPIPPVHESLIAPRDLGWTLHDIDFDRGMAPRFFRAQMVGGVIEVPPWQSEGVKS

SEQ ID NO: 2406 - protein, 239 aa, Syntrophobotulus glycolicus DSM 8271
MENKVEFKVYGKYALFTDPLTKIGGEKCSYQIPTYQALKGIMESVYWKPTLIWFIDKIRVIKQIKTQTRSAKPIEYGGGNSLSIYTYLSDVEYQVQAHFEWNLHREDLAKDRNDNKHFFVAKRMIERGGRRDIFLGTRECQGYVEPCRFGEEESFYDNYGELSFDLMFHGFDYPDEIGKDELQARFWRPKMIDGVVEFIRPEQCEIRKFIRPMSARNIESIGLEEEGLLEGYSEEVVKR

SEQ ID NO: 2407 - protein, 220 aa, Rubinisphaera brasiliensis DSM 5305
MPDLTIAIRVFGEYALFTRPEMKVERVSYDVITPSAARGVLEAIYWKPQIRWVIDRLHVLRPIRTMNIRRNEVANKIATNGLKKIMQSGSGRLGSYVDEDRQQRASVVLRNVEYVIEAHFDILDPAEHPKKHFEMMKRRAEKGQHFHQPYLGCREFPCHYEWLEADEIPRCPESLRGEKDLGYMLHDIDFENDCTARFFRAVMNDGVIDVPPFHGKEVHA

SEQ ID NO: 2408 - protein, 220 aa, Rubinisphaera brasiliensis DSM 5305; identical to SEQ ID NO: 2407

SEQ ID NO: 2409 - protein, 227 aa, Nitrosomonas sp. AL212
MAYGIKLHIWGDYACFTRPEMKVERVSYDVITPSAARGILDAIHWKPAIRWVIDKIHVLRPVRFESIRRNEVGSKISANKIKTAMRNQSTQDLYLVADDSKERQQRASTVLRNVAYIIEAHFELTDLASEEDSEGKHLDIFNRRARKGQCFQQPCMGVREFPAYFSLIEPEESLPESELTLEQLNRDLGWMLHDIDFANEMMPRFFKAELKNGVITVPDFYSDEVKA

SEQ ID NO: 2410 - protein, 229 aa, Marinithermus hydrothermalis DSM 14884
MERVGRVSIRVWGEYALFSRPEFKVERVSYPVITPSAARGVLEAIFWKPEIRYQIRRIGVLKPGRQVAILRNEIASRQGRTPIIVEHDRQQRTSLVLKDVAYLIEAEIHLRSHATEPVFKYTDQFRRRVERGQYHHTPYLGTREFTAFFAPMNGEAPPALDLEIGTMLFDIAFVEDNKRKELSFKRPGKTKPVKGYAQPLFFEARVENGWLEVPQALYRELRRLEGEDV

SEQ ID NO: 2411 - protein, 218 aa, Selenomonas sputigena ATCC 35185
MAYGVRLEVWGEAACFTRPELKAERFSYAVMTPSAARGVLEAVFWHPGLHWVVDRIYVLAKTQFTNVRRNELKAKIPARTVKAFAEKERGELYQSTKEDIQQRAATILKEPHYIIEAHFEMTEKASASDNEGKFREMFCRRARKGQCYHAPYLGCREFPARFRLYEEAELPPTNGETKDLGFMLYDIDYSDPKNLQPMFFQAQLVDGVLDLRDCGVYR

SEQ ID NO: 2412 - protein, 238 aa, Porphyromonas asaccharolytica DSM 20707
MEEYIDKEYCLRVRGPFACFTRPEMKVERVSYDVITPSAARAIFQAIYWKPAIRWEITKIEVLAPIKRFTIKRNEVASIMSKGSTGINISEDRRQRASYILRDVDYRIYAKMVYIPVRNRSASCQKHYNEEYSEAERKAENPRKYQEIFERRAKAGQCFTMPYLGCREFTCSFEYVDLEHGETSLEPKPIPESRDLSIMLYDMDFERDRKNPPAMFYHAQMTEGVILVPPMDSNEILR

SEQ ID NO: 2413 - protein, 227 aa, Treponema brennaborense DSM 12168
MENSIEYCVEGRYALFTDPVTRIGGEKSSYLVPTYEALKGVTGSIYWKPTFTWIIDSVRIMNKIRTESKSIKPLKYNGGNDLAIYTYLKDVSYQVKAHFEWNMNRPDLKQDRNEDKHFQVAHRMLKKGGRRDIFLGARECQGYVEPCRFGSGESVYDTDESFSYGMMFHGFDYPDEQEKAMLSARFWLAQMKNGIITFPRPEACTIRRDIRPMQMNSLNVNTAEVIE

SEQ ID NO: 2414 - protein, 218 aa, Desulfotomaculum nigrificans CO-1-SRB
MGYGIKLKVWGDYACFSRPEMKVERVSYDVMTPSAARGILEAIHWKPAIRWVVDRIHILNAFKFENIRRNEVGTKIPAGTVKTAMKGQPVMLCQYASNERQQRATLLLKDVAYVIEAHFEMTDKAGPTDTEEKHYNMFLRRARTGQCFHRPYLGCREFPAHFELLEGENPISVHRGEKDLGWMLLDIDYKNNMEPHFFRAVMQDGVVTVPPLKGGGSL

SEQ ID NO: 2415 - protein, 227 aa, Methylomonas methanica MC09
MAYGIKLHIWGDYACFTRPEMKVERVSYDVITPSAARGILEAIHWKPAIRWVIDKIHVLQPVRFESIRRNEVGSKISAAKIKTAMRNQSTQDLYLVADDAKERQQRASTVLRNVAYIIEAHFELTDLATDEDNEGKHLDIFNRRARKGQCFQQPCMGVREFPAYFALIEPEQSLPESELTPEQLNRDLGWMLHDIDFANGMMPHFFKAELKGGIITVPDFYSEGVKA

SEQ ID NO: 2416 - protein, 229 aa, Thermus thermophilus SG0.5JP17-16
MARLRVKVWGEYACFSRPEFKVERVSYPVPTPSAARGLLEAIFWKPEFRYEVRRIGVLRLGTPFALLRNEVGNRMGAKPFFVEDARQQRTSLVLKDVAYLVEADMVLRPHATDPLPKYLEQFERRLKKGQYHHTPYLGTREFPAYFSPPDGEVPDGGLNLDLGPMLFDLAFVEAPGRPELTFKRPGRGEVQGYALPLFFHARIREGWLEVPPEKYQELYRLEEGHAKGA

SEQ ID NO: 2417 - protein, 242 aa, Streptococcus parasanguinis ATCC 15912
MYRSRNFYARIRGDRALFTNPATKGGSERSSYSVPTRQALQGIVDGIYHKPTFTNVITEVKVVNQIQTELHGIRALLHDYSADLSYVSYLSDVEYLVKFYFVWNENREDLIQDRQANKHEAIMERSIRKGGRRDVFLGTRECFALVDEISQEEYENCPSYYDGFSIDLGIMFHSFAYPTDKKTPLKSYFAKTVMENGIIKFKSQKECEIVNTLSSYAFKLPSQIKSVDDEFNEYEEMEKGES

SEQ ID NO: 2418 - protein, 222 aa, Zymomonas mobilis subsp. pomaceae ATCC 29192
MSYGIRLSVWGNNACFTRPEFKVERVSYDVMTPSAARGILEAIHWKPAIRWIIDAIHVLKPIRFQNIRRNEVGSKISPNKVKSAIKRGHLEGLNLLVDKDRQQRASAILVAPAYVIEAHFVLTNKAGKEDNEGKHLDIFKRRAVRGQCFHQPCLGVREFAAYFKLLDDSEQIPTAIPVDQDLGFMLFDIDHAKAGHPPMFFRAIMEQGIVKIPSPNSPEVRR

SEQ ID NO: 2419 - protein, 221 aa, Rhodospirillum rubrum F11; identical to SEQ ID NO: 2381

SEQ ID NO: 2420 - protein, 234 aa, Leptospira interrogans serovar Lai str. IPAV; identical to SEQ ID NO: 2373

SEQ ID NO: 2421 - protein, 224 aa, Pseudoxanthomonas spadix BD-a59
MSYGVKLHVWGERALFTRPEMKVERVSYDVITPSAARGILEAIHWKPAIRWVVDGIQVLRPVRFESIRRNEVGGKLSAASVGRAIRAGRTDGLVNYVEEDRQQRAATLLRDVGYVIAAHFELTARAGPEDSVGKHLDIFNRRARRGQCFQAPCLGTREFPASFALVENGYDLPIADASLQGERDLGWMLHDIDFADGMTPRFFRARMVDGLIQVPPPGDEGVHG

SEQ ID NO: 2422 - protein, 246 aa, Clostridium sp. BNL1100
MMERANSVEFKVSGRYALFSDPINRIGGEKISYQIPTYQAIKGILESVYWKPTFIWYIDELRVMKYIKTQSQGIRPINYTGGNTLSIYSYLTDVEYQVKAHFEWNYNRKDLGKDRNENKHFIVANRMIERGGRRDIFLGTRECQGYVEPCKFGEGKGDYDNYGEISFGIMFHGFDYPDEAYDESGRDKLVARLWYTKMEDGYIKFIRPENCEIKREIKTMKMKEFKNSNFSGLKEFEEGGEILGLD

SEQ ID NO: 2423 - protein, 247 aa, Desulfomonile tiedjei DSM 6799
MRPNDQVLEVWGEFACFSRPEFKVERFSYPIITPSAARGIFDAIYCKPNKDPTRAEFRWQVTKIEILNPPKYIALRRNEVKEKVSVKPAWITGKENPKPILADATKDAVGGNDEKGRTQRQTMALKDVRYRLHAQIRPWKGFESSLPALEAQFRRRSRNGKCIYQPYFGCREFPAYFELVEVLSDAAKPVSIDIDIGLMLYDVFDLSKPGTSDDQPNISLFQCKVRQGIVEIPDYDNDEVLKPHLGG

SEQ ID NO: 2424 - protein, 247 aa, Desulfosporosinus acidiphilus SJ4
MEVKRNTVEFMVSGDRALFSDPVTRVGGEKTSYYVPTYESLKGILTSVYWKPTIIWIIDAVRVMNMIQTLSEGIRTKNYNGGNDLSIYTYLKDVRYQVRAHFIWNENRPELAADRNENKHHNIARRMIERGGRRDIFLGTRECQGMVEPCVFGEGSGTYDPVDELNFGYMFHGFTYADEALRDAEKGHMSVRFHHVVMKKGVIEFPNPEEIPDKDRRILHKMPVKPFGEAIGNFSRLGEFAAEEVNQ

SEQ ID NO: 2425 - protein, 228 aa, Pseudanabaena sp. PCC 7367
METDSSLVVKVWGDFACFTRPEFGAERVSYEVMTPSAARGVLEAIFWKPEFSWQVQEIQVLKPIKRFSILRNEINSWQSDRSAKDPAYHYYADGDRAQRHTLCLREVAYMIKAKINLKPHASAHPAKYRDQFRRRVAKGQCHHQPYLGTREFSAFFSKPEEGDRPIKGSEGNKELGLMLMDLEFAIDSKGAITYLSHDPNGAKAVKGNASPRFFGARLENGVLRVPES

SEQ ID NO: 2426 - protein, 221 aa, Methanoregula formicica SMSP
MDIGFGVKLKVWGDYACFTRPEMKVERVSYDVMTPSAARGILEAIYWKPAIVWEIDRIHVMKPVKFDNIRRNEVLGKIPLAPVKSAFSGKEAVLFKDANDERVQRASMVLRDVEYYIEAHFNMTDKAGPEDTVEKHYNVALRRMRKGQCFHHPYFGCREFPVQFEFMEGEIPKSDLAGKKDLGLMLWDIDFAKDMTPVFFRAEMNDGVIDVKRCLNGGVFS

SEQ ID NO: 2427 - protein, 221 aa, Myxococcus stipitatus DSM 14675
MKTAASKRFRVRARGPVACFTRPEMKAERVSYEVMTPSAARGVLEAILWKPAIRWQVHEIAVIAPVRWMSFRRNEVNSRATVRKFDYAADEDRAQRNTVALRDVDYVITASFSLVPGKAGAEENLRKFEEMFERRLEKGQYFHAPYLGCREFAARVEVPPDVLTPSDATVGRRPLGLMFYDFAFGDSGRATRPLFFDAYLDRGVLQVPPWAQVLERNGGTP

SEQ ID NO: 2428 - protein, 246 aa, Desulfocapsa sulfexigens DSM 10523
MGKNEKTFCLEVWGDYACFTRPEMKVERVSYDVITPSSARAIFEAIFWKPAIRWHIRKIEVLNPINWISVRRNEVGALASRSKKEIFIESNRQQRAGLFLRDVHYRIHAWLEYIPVDKRKKIACQVPVQLWDDGEKDQIQESLDAWQNGKDENPGKYLAMFERRARKGQCFTQPYLGCREFSAFFRLVDRPDQEKARPIQDNRDLGFMLYDLDFTNPENPIPAFYRPEMVNGRIDVPAWQSEEVRK

SEQ ID NO: 2429 - protein, 246 aa, Bibersteinia trehalosi USDA-ARS-USMARC-192
MSNENTFRSRLFSFRVWGRQALFTDPITKIGGEKFTYPVPTYEALKGILRSIYWKPTLIWHISRIRVMKPIQTQAKSTKPLDWNGGNTLAIYTFLHNVEYQVEAYFTWNMHWEELAGDRNVGKHTAIIERMLERGGRQDIFLGTRDCQGYIAPCQFGEGEGFYDKVDEPIDFGLMFHSFGYPEETGNHELISRFWQANMQKGVIKFPAVSDGELKTRFIKKMKPFKPFKRGENVKAVEEEAKELEL

SEQ ID NO: 2430 - protein, 224 aa, Azotobacter vinelandii CA; identical to SEQ ID NO: 2400

SEQ ID NO: 2431 - protein, 224 aa, Azotobacter vinelandii CA6; identical to SEQ ID NO: 2400

SEQ ID NO: 2432 - protein, 222 aa, Salinispira pacifica
MEHYYKTFCLEVEGDYACFTRPEMKVERVSYDVITPSAARGIFEAILWKPSVSWQVKKIEVLKPIRWTSIRRNEVGAYITRTDGVYIEDVRQQRAGLILRDVAYRLYAELRFHPEKGEPRKDENPAKYNAMFERRAGKGQCFNQPYLGCREYSCRFALIDHEKGEREKQPIHEDSDLGFMLYDMQFPKPDDEDQEIRPAFYRPLMKNGVIEVPDWDSGEVYL

SEQ ID NO: 2433 - protein, 239 aa, Paenibacillus polymyxa CR1
MRNAIEFKVYGDYALFTDPLTKLGGEKLTYSVPTYQALKGIVESIYWKPTIMMVIDKVRVLHAIRMESKGVRPIEYGGGNTLANYTYLKDPCYEVQAHFVFNPHRPEMEYDRNENKHHNILKRSLLAGGRRDIFLGTRECQAYVEPCEFGIEAGFYDNYGDIHLGNMVHGINYPDETGRDQMEVRLWNPVMKDGVIDFIRPEECTQVRTIANMQPKRFNENNVQSADELLAQWEGWEIK

SEQ ID NO: 2434 - protein, 246 aa, Bibersteinia trehalosi USDA-ARS-USMARC-189; identical to SEQ ID NO: 2429

SEQ ID NO: 2435 - protein, 246 aa, Bibersteinia trehalosi USDA-ARS-USMARC-190; identical to SEQ ID NO: 2429

SEQ ID NO: 2436 - protein, 224 aa, Xanthomonas oryzae pv. oryzae MAFF 311018; identical to SEQ ID NO: 2376

SEQ ID NO: 2437 - protein, 240 aa, Bifidobacterium adolescentis ATCC 15703
MERHRNSIEYEVWGRYALFSEVATRVGGEKYSYQVPTYQALKGITESIYWKPTFKWVIDAVRVMNKIQTESRGVRTIVYQPKKKNVKNDLSYYTYLKDVRYQVLAHFEWNDLREELADDRDENKHHNIAMRSVRQGGRRDIFLGARECQAYVEPCEFGGGEGFYDSYGEWNMGYMFHGFSYPDENPDHNLISRFWMPIMKDGVIRFESPDSPLLDRHIVRHGLNVKEFNLGKNVTSVEEE

SEQ ID NO: 2438 - protein, 238 aa, Pelotomaculum thermopropionicum SI
MFPSCDVKVKVWGEYACFTRPEFKVERVSYPVITPSAARGVLEAIFWKPEFRWEVREIWVLNEVREEVIVRNEIESRQSPRAKCIIEEQHQQRATLFIKNPSYLLFADIALKEFVDSPKKKYIEQFNRRVEKGKCFHQPYLGTRECTAFFGPPDGTEKPATLNIATGNMLFDIAFCENTEKRELTFLKKKDGSSSVEVGGFVKPLVFAAEVRDGILKIPPQKYDELYRQEGVHVKRAG

SEQ ID NO: 2439 - protein, 247 aa, Candidatus Endomicrobium trichonymphae
MFNIPKNAIEFKVYGKYALFTDPITKLGGEKCSYQIPTYEAIKGITESIYWKPTFIWIIDKVRVMKSIEMEAKGVRTLKYHGGVGLYYYTYLRDVEYQVQAHFEWNVNESNLIQDRIDGKHFAIANRSLENGGRRDIFIGTRECQGYVEPCKFGEGDSDYDNNNLLSFGSMFYNFGYPNETGKKELITRIWLDANMKKGTVDFNDKKNNIKERIVKPMQQENQYVLDKNILKVNTEYENIFGNMEVK

SEQ ID NO: 2440 - protein, 242 aa, Streptococcus mutans LJ23
MYRSRNFYAKVRGQRALFTNPATKGGSERSSYSTPTRQALQGIIDAVYHKPTFTNVVTEVKVMNQIQTELHGVRALLHDYSADLSYVSYLSDVEYLVKFHFIWNKNREDLMQDRLPKKHEAIMERSIRKGGRRNVFLGTSECFGLVDEISQEEYENTPSYYDGVTIDLGIMFHSFAYPKDETTPLKSFFTKTVMENGLIKFKPQSDCEIVNTLSSYTFKTPGQVKSVDDELKEYDAMEKGEE

SEQ ID NO: 2441 - protein, 229 aa, Phycisphaera mikurensis NBRC 102666
MSIYLQVSGDLACFTRPEMKVERVSYDVITPSAARGVLEAIYWKPEIRWVIERIRVLKPIRWTTLRRNEVGAKASATNARSAMKAGRGTLGITVEDERQQRAATLLRDVAYVIQARFDILSGPRTPGKHLDQFNRRAKKGQCFQHPYLGCREFLADFEPADPAAPPACPEELQGEIDLGWTMLDFDYTRDRAARFFRAKMVDGVIDVPPMHPAAAVDTGGEGSLPEVVA

SEQ ID NO: 2442 - protein, 242 aa, Aromatoleum aromaticum EbN1
MTRSTRNSIEFKVWGRHALFTDPLTKVGGEKCSYHVPTYEALKGIAKSIYWKPTLIWVIDEVRVMKRVRTQTKGTKPLEFGGGNSLAIYTFLADVEYQVRAHFEWNEHRPELQADRIDGKHYAIARRMLERGGRQDIFLGTRDCQGYIEPCEFGGGAGAHDEGSELAFGLMFHGFDYPDETGDQKLHARFWRPVMRNGFIRFDRPEDCPVRKFVRSMSVKPFGFGQNLQSADEAAAELEGLA

SEQ ID NO: 2443 - protein, 223 aa, Gluconacetobacter diazotrophicus PA1 5
MGIRLHVWGERACFTRPELKSERVSYDVLTPSAARGIVEAIHWKPAIRWHIDRIHVLKPIRFQSIRRNEVGAKVSAVLAARAMTAGHTSGLGLAVDENRQQRAATILVDVAYVIEAHFTLTARAGAGDTAAKHLSMFNRRATQGQCFHRPCLGTREFPADFALIAEEAPLPASAFPPDLQAVDLGWMLHDIDFADQRTPRFFRACIESGVIAVPAADSPDLIA

SEQ ID NO: 2444 - protein, 224 aa, Xanthomonas albilineans GPE PC73
MSYGVRLHIWGERALFTRPEMKVERMSYDIITPSAARGILEAIHWKPSIRWVVDSIQVLKPIRFESIRRNEVGGKLSAASVSKAIKAGRTDGLVSYVDEDRQQRAATLLRDVGYVIAAHFELTDKAGPDDNVGKHLDIFNRRARRGQCFQAPCLGTREFPASFSLLEADDAPPPSDPSLGGERDLGWMLHDIDFADGMTPRFFRAHMVDGRVVVPPSHDDEVHT

SEQ ID NO: 2445 - protein, 227 aa, Brevibacillus laterosporus GI-9
MVHGVQLHVWGEYACFTRQELKPERGSYDVITPTAARGILEAILWKPSMNWIVDRIHVLNEIKFATIRRNELSNKISSGHIRNAIQNDNPIKRQDITKDKERQQRSSMILKNPAYVIEAHVELTPLAYKSDTTQKFLNMFVSRAKKGQCFHNPYLGCREFAANFSYVEKDDDIFLQSFYRETPDRDLGLMLWYLNYQRNREPFHFHAKMCRGVIDLSTSVKKEGKSL

SEQ ID NO: 2446 - protein, 204 aa, Xanthomonas citri pv. punicae str. LMG 859
MKVERVSYDIITPSAARGILEAIHWKPAIRWMVDSIQVLKPIRFESIRRNEVGGKLSAASVSKAIKAGRTDTLVSYVEEDRQQRAATLLRDVGYVIAAHFELTDKAGADDNVGKHLDIFNRRARRGQCFQAPCLGTREFPASFALIEDDAAMPAADATLAGERDLGWMLHDIDFADGMTPRFFRARMVDGQVEVPAPENGGVRA

SEQ ID NO: 2447 - protein, 221 aa, Phaeospirillum molischianum DSM 120
MSLGVKLRVSGAHACFTRPEMKAERVSYDVMTPSAARGILEAIHWKPAILWVVDAIHVLKPIRFHTLRRNEVGSKIPVAKVKTAINRGSLDGLHLRVEDDRQQRATTLLVDVEYVIEAHFEMTSRAGDEDNPGKHLDIFNRRARRGQCFHQPCLGTREFPARFDLIEADTEVRSPIDDSRDLGFMLWDIDHGGDRASMFFRARMERGVVRVPPPGSLEIRR

SEQ ID NO: 2448 - protein, 242 aa, Streptococcus dysgalactiae subsp. equisimilis AC-2713
MYRSRDFYVRVSGQRALFTNPATKGGSERSSYSVPTRQALNGIVDAIYYKPTFTNIVTEVKVINQIQTELQGVRALLHDYSADLSYVSYLSDVVYLIKFHFVWNEDRKDLNSDRLPAKHEAIMERSIRKGGRRDVFLGTRECLGLVDDISQEEYEAAVSYYNGVNIDLGIMFHSFAYPKDKKTPLKSYFTKTVMKNGVITFKAQSECDIVNTLSSYAFKAPEEIKSVNDECMEYDAMEKGEN

SEQ ID NO: 2449 - protein, 245 aa, Lactobacillus equicursoris 66c
MDNSTTFCFKVWGDYALFTDPIMKIGGEKFTYPVPTYQALKGITESIYWKPTIQIYIDKVRVMNPILTEAKSILVPKFNDMSSEDLSRYTYLKDVEYQVQAHFEFNLNRPDLAKDRNTKKHYAIMKRCIEKGGRRDIFLGTRECQAYVGPCKFGVGVGYYDDEPEHLFGTMVHGIDYPDETGKKELGIRLWNVNMKKGIIDFPRPDDQSQITYRKLHDFSAKHFDFTNIKSVDKEYEEITGGDLE

SEQ ID NO: 2450 - protein, 242 aa, Streptococcus agalactiae
MYRSRDFYVRVSGQRALFTNPATKGGSERASYSVPTRQALNGIVDAIYYKPTFTNIVTEVKIINQIQTELQGVRALLHDYSADLSYVSYLSDVVYLIKFHFIWNEDRKDLNSDRLPAKHEAIMERSIRKGGRRDVFLGTRESVGLVDDISQEEYEAAVSYYNGVNIDLGIMFHSFAYPKDKKTPLKSYFTKTVMENGVITFKTQSDCDIVNTLSSYAFKVPGEIKSVNDEYMEYDAMEKGEN

SEQ ID NO: 2451 - protein, 224 aa, Xanthomonas translucens pv. translucens DSM 18974
MSYGIRLHIWGERALFTRPEMKVERVSYDIITPSAARGILEAIHWKPAIRWVVDGIQVLKPIRFESIRRNEVGGKLSAASVSKAIKAGRTDTLVSYVEEDRQQRAATLLRDVGYVITAHFELTDKAGADDNVGKHLDIFNRRAQRGQCFQAPCLGTREFPASFALIEHDAAVPATDPALAGERDLGWMLHDIDFADGMTPRFFRARMVDGRVEVPAPEDGRVRA

SEQ ID NO: 2452 - protein, 218 aa, Thalassolituus oleivorans MIL-1
MGFCIEVSGDYACFTRPEMKVERVSYDVITPSAARAIFEAILWKPAIQWNIHKIEVLKPIRWVNIRRNEVGSVLPVGNVNKGMKGGELPVQYIEEQRQQRAGLILKDVAYRLHASFDMTSKADAGDNPGKFAEMFKRRAKKGQCFNQPYLGCREFSCEFRLIEEGAEELAAIPDSKPLGWMLYDMDYQAKETIPLFFNADMQNGVIQVPAKNSEEVRG

SEQ ID NO: 2453 - protein, 223 aa, Halanaerobium saccharolyticum subsp. saccharolyticum DSM 6643
MEDFKFDPVKVKVWGEFACFTRPDMKVERVSYQVMTPSAARGILSSIFWKPEFDWVIQKIHVLNPIRHISIRRNEVKSKISPGSVKHWMKNDGHDRYYADKDRTQRNTLALRDVSYIIEANVSLKEHAKNEHPAKYRDQFRRRVNNGSCYKRPFLGNREFAAFFAPVDGSETAIDYTDQLGRMLFDLNYNIDEERAKPVFFNAEINNGVLNVPVEKYKEVWRN

SEQ ID NO: 2454 - protein, 242 aa, Streptococcus agalactiae ILRI005
MYRSRDFYVRVSGQRALFTNPATKGGSERASYSVPTRQALNGIVDAIYYKPTFTNIVTEVKVINQIQTELQGVRALLHDYSADLSYVSYLSDVVYLIKFHFIWNEDRKDLNSDRLPAKHEAIMERSIRKGGRRDVFLGTRESVGLVDDISQEEYEAAVSYYNGVNIDLGIMFHSFAYPKDKKTPLKSYFTKTVMENGVITFNTQSDCDIVNTLSSYAFKVPEEIKSVNDEYMEYDAMEKGEN

SEQ ID NO: 2455 - protein, 232 aa, Bacteroides sp. CAG:927
MEYTDKEYCLEVWGDYACFTRPELKVERMSYDVITPSSARAIFEAILFKRYAMRWQVTKIEVLNPIKWASIRRNEVGATASHKNTSIYIEDKRQQKNSLLLKDVRYRIWAKLVFIPVGERPKEAFAKHKPGPDENPMKYYQMFERRAEQGQCFTQPYLGTREFSASFRLVNPETDELLPALTAEKGGDKDLGIMLYDMDFSNPKDIKAMFYKAEMKEGVIKVPSLSSKEILR

SEQ ID NO: 2456 - protein, 244 aa, Firmicutes bacterium CAG:83
MKTEHPNIVEFEVYGDYALFSDPLMRLGGEKCSYQVPTYEALKGILSSVYWKPTFIWRILDVRVMNPIQTEVKGIRPIKYGDGKNDLAYYTYLKNCRYQVQACFDWNDNRPELCGDRNENKHHCIARRMIEKGGRRDIFLGTRECQGYVEPCVFGNGAGAYDDLPELGFGLMYHGITYPDEAYSEETRGRMTARFWYPVMKNGVIHFLPPEDCPGQKPLREMPMKSFSADEGNFIGLREFGEVE

SEQ ID NO: 2457 - protein, 219 aa, Clostridium bolteae CAG:59
MSRGVRVRLWGDYALFSRPEMKVERCSYDVMTPSAARGMLEAIYWHPGMRWVIDKIYVRKPIQFTSIRRNEVKSKVLAGNALTAVNGGGKPLYISSKEEIVQRASILLRDVEYVVEAHFEMTPKAVPGDNEGKFKDIIMRRLRRGECYHQPYFGCREFPARFALYEEEEVDTAYDGTERDLGYMLYDLDYSDTEDIKPMFFRAVMKDGVLDVRNCEVVR

SEQ ID NO: 2458 - protein, 226 aa, Prevotella sp. CAG:924
MEYTDKEYCLEVWGDWACFTRPELKVERVSYDVMTPSAARAIFEAILFKRYAMRWQVTRIEVINPIKWTTIRRNEVGALAGKSPIYIEDKRQQKNSLLLKDVRYRIYAKLVFIPVKDRPKEAFAKHEPTNDENPMKYYQMFERRASQGQCFTQPYLGCREFAANWRYVDSKDSLVPPLQEDRDLGIMLYDMDFDKNPKKPDAMFYRAVMKQGVIVVPEKDSEEVLR

SEQ ID NO: 2459 - protein, 220 aa, Ruminococcus sp. CAG:60
MGIGVKVKVWGDYALFSRPELKVERCSYDVMTPSAARGILEAIYWHPGMRWIIDKIYVKNPIRFTSVRRNEVKSKVSRSNALQAYNGDERPFYISTKEDIVQRASLILCDVCYVIEAHFELTNKANESDNAGKFKDIIMRRLKRGECYHMPYFGCREFPAQFCLCEENDITTIYSEVPEKDLGFMLYDMDYSNLENIQPMFFRAVMKKGVLDLTDCEVFR

SEQ ID NO: 2460 - protein, 220 aa, Firmicutes bacterium CAG:646
MGMGVKVRVWGDYALFSRPEMKVERCSYDVITPSAARGLLEAIYWHPGLRWVIDRIYVKNPIQFTSVRRNEVKSKVLASSVLQAYNGGDKPLYMNTKAEIVQRASVLLTNVEYVIEAHFEMTDKANATDNPGKFKDIIMRRLRRGECYHMPYFGCREFPANFALYEEEEVETAYDEVPEKDLGFMLYDLDYTDREHIQPMFFRAVMRYGVLDLRNCEVMR

SEQ ID NO: 2461 - protein, 219 aa, Clostridium hathewayi CAG:224
MSRGVRVRVWGDLALFSRPEMKVERCSYDVITPSAARGILEAVYWHPGMKWVIDKIYVRKPIQFTSIRRNEVKSKVLASSVLNVMNGGNKPLLIGSRQEIVQRAAILLRDVDYVIEAHFDMTDHASDCDNPGKFKDIIMRRLRRGECYHTPYFGCREFPAKIELYEGDDVTTEYKGMERELGYMFYDFDYSDPEDIQPLFFRAVLKDGVLDVRDQEVVR

SEQ ID NO: 2462 - protein, 244 aa, Clostridium hathewayi CAG:224
MKYRNTVEFQISGDYALFSDPVTRVGGEKCSYHIPTYEALKGILQSVYWKPTLIWIIDGVRIMKPVQTETKSIRPVNFNGGNDLSYYTYLKDVSYQVRAHFEWNENRPELAGDRNENKHHNIAKRMILRGGRRDIFLGTRECQGYVEPCVFGEGKGFYDEMEGEVSYGFMYHGITYADEAVLPEDKGRMTVRFWRPVMEKGGLIEFVRPEGCTQKRHIHEMKIKQFNDNEFSGLMEFVGEEAEA

SEQ ID NO: 2463 - protein, 250 aa, Ruminococcus sp. CAG:254
MSKPTHENIVEFKVYGEDALFSDVLTRTGMEKYSYPIPTYEALKGIMHSIYWKPTIVWYIDAVRVMNRIQTQRRGIRPIHYSGGNDLSYCTYLRDVCYHVRAHFEWNDNRPELEHDRNENKHHNIAKRMIERGGRRDIFLGTRECMGYVEPCAFEEGTGFYDHSGELPYGLFYHGITYADEAVLSEDKGQMTVRFWNPIMRNGVISFVRPEECTIKRHVREMEIKPFGEEHGNFKGLSEFLGGDDVALGG

SEQ ID NO: 2464 - protein, 247 aa, Firmicutes bacterium CAG:212
MKRYRNTIEFEVYGTYALFSDPVMRVGGEKTSYHIPTYEALKGITESIYWKPTIIWIIDAVRVMNPIQTETKGIRPIAYNGGNELAYYTYLKDVRYQVRAHFEMNLNHPELEQDRNENKHHNIAKRMVKRGGRRDIFLGTRECQAFVEPCVFGEGESYYDTMPGEVGYGFMYHGITYAEEAILEEDKDQMTVRFWRPVMKKGGIIEFTRPEDCTEKRHIRPMERKVFGKEVNNFIGLEEFTDEEVED

SEQ ID NO: 2465 - protein, 220 aa, Clostridium sp. CAG:138
MPICIEVSGDYACFSRPEMKVERVSYDVITPSAARGILEAVMWHPGMRYVIDRIHVCAPIRFTNIRRNEVKDVISARNVKTEMKTRSGELYIAASESIQQRAAMVLRDVHYVIEAHFEMTENAAPSDNPGKFCDMLRRRVEKGKCYHQPYLGTREFPAKVVKCVEMPPCPPELAGERDLGWMLLDLDYSDKENIKPVFFRAKLIDGVLTVPAMDSAEVTE

SEQ ID NO: 2466 - protein, 241 aa, Ruminococcus sp. CAG:563
MQYPNIVEFQVTGDYGLFTDPMTKVGGEKCTYQVPTYEALKGVLSSIYWKPTLIWFIDKVRIMNPIQTEVKGIRPIKYNGGNDLAYYTYLKNCRYQVQAHFEWNMNRPELEQDRNENKHHNIAKRMIEKGGRRDIFLGARECQGYVEPCVFGEDEGHYDNISELSFGLMYHGITYPDEAYNDETQGKLTVNLWKPKMENGIITFLRPEECPYHKTLHDMQMKVFDAAENNFSGLKEFGEVY

SEQ ID NO: 2467 - protein, 220 aa, Oscillibacter sp. CAG:241
MAIQVEVWGDYALFSRPEFKVEHVSYDTMTPSAARGLLESIYWHPGLRWRIDRIHVCSPIRFTNIRRNEVKDTISARKVKTVMEKGQGELYLATPESIQQRAAMVLRDVHYVIDAHFDLTENAAPGDNAGKFQDIIRRRLERGQCYSMPYFGTREFPAHFRRCTELPPCPKELEGVRDLGWILLDMDYTDPRNITPRFFRASLTDGVMVVPPWNSEEVRE

SEQ ID NO: 2468 - protein, 219 aa, Clostridium clostridioforme CAG:132
MSRGVRVRMWGDYALFSRPEMKVERCSYDVMTPSAARGMLEAVYWHPGMRWVIDKIYVRKPIQFTSIRRNEVKSKVLAGNVLSAINGGGKPLYISSREEIVQRAAILLRDVEYVVEAHFEMTPKAVPGDNEGKFKDIIMRRLRRGECYHRPYFGCREFPAQFALYEEEEVDTAYAGTERDLGYMLFDFDYSDTEDIKPMFFRAVMKDGVLDVRNCEVVR

SEQ ID NO: 2469 - protein, 245 aa, Clostridium sp. CAG:413
MQYKNEISFEVWGDYGLFTDPIMRVGGEKFTYQVPTYEALKGVISSSYWKPTLTWYIKKVRIMSPIQTEVKGVRPIKYNNGSNDLSYYTYLKKCRYQVVAYFEWNENRPELAHDRNEHKHYQIAKRMLERGGRRDIFLGTRECQGYIAPCEFGSGEGAYDDIPELSFGMMYHGMTYADEAWSEETKGRMTANFWFPTMKRGVIEFPRPEECPLHKTLREMEIKPFGKEYDNFSGLEEFEGVTEWD

SEQ ID NO: 2470 - protein, 243 aa, Clostridium sp. CAG:58
MQHNNSISFYLSGRFALFSDPITRVGGEKFSYPVPTYQALKGIFESVYWKPTFIWYPDAIRVMNPIETQSKGIRPIRYNDGTNDLSIYTYLVDVCYQVRGHFEWNLNRPDLAADRNENKHYFIAKRMLERGGRRDIFLGTRECQGYVEPCEFGEGKGAYDDNPALPLGLMLHGITYADEDGSGVMSERLWRPVMERGIIQFIRPEECPIIRPIHKQKEKSFVIKKNIQPCEELYREVKTDELD

SEQ ID NO: 2471 - protein, 242 aa, Clostridium sp. CAG:448
MRYPNMVAFSIVGDYALFSDPITRVGGEKCTYQIPTYEALKGILSSVYWKPTIIWYIDKVRVMNPIRMEVKGIRTVKYNDGKSDLSYYTYLKDCRYQVSAHFEWNRNRPELIGDRNENKHYEMAKRMIEKGGRRDIFLGTRECQGYVEPCVFGEEKGAYDETPMISFGHMYHGITYPDESFSDATKGRMTLNFWYPKMENGVIVFPKPQDCPHHKPLHEVKMKTFGEDRANFTGLLEFGEVN

SEQ ID NO: 2472 - protein, 241 aa, Ruminococcus sp. CAG:382
MRYPNIVEFSVVGDYALFSDPVTRVGGEKCTYQIPTYEALKGILSSVYWKPTIIWYIDKVRVMNPIRMETKGIRTMMYNGGNDLSYYTYLKDCRYQVSAHFEWNENRPELIGDRKENKHHEIAKRMIVKGGRRDIFLGTRECQGYVEPCVFGEGSGAYDETPMISFGHMYHGITYPDESFSGETKCRMTLNFWYPKMENGVIVFPKPQDCSNHKYLHEMKMKAFGADNANFTGLKEFGEVH

SEQ ID NO: 2473 - protein, 220 aa, Bacteroides pectinophilus CAG:437
MGMGVKVHVWGDYALFSRPEMKVERCSYDVMTPSAARGILEAIYWHPGLRWIVDKIYVKNPIRFTSVRRNEVKSKISANNILQVYNGADKPFYISTKEDIVQRASLMLCDVSYVIEAHFEMTDNANESDNPGKFKDIMMRRLKKGECYHMPYFGCREFPAHFCLCEEDKVHTIYDEVPEKDLGFMLYDMDYSDKDNIQPMFFRAVMKRGVLDLRNCEVIR

SEQ ID NO: 2474 - protein, 228 aa, Eggerthella sp. CAG:298
MAYGIKVEVWGDRALFTRPELSVERMTYDVITPSAARGILESIYWHPGMRYKIDRIYVLNPIKFTSVRRNEVKSKALSSAVRTTITKGGQLPYIDTHADIQQRASVMLTDVRYVIEAHFDMTDRASKQDNPGKFKDILMRRLRRGQFYSAPYLGTRECSCYVQEWSGGDPRKESYYVLEECRDLGLMLYDMDYSDVDAQGIAQNITPMFYRAIMRHGAIDVAGSEVFR

SEQ ID NO: 2475 - protein, 246 aa, Roseburia sp. CAG:471
MKKYRNTIEFEVYGPYALFSNPVMRVGGEKTSYHIPTYEALKGIVESIYWKPTIMWIIDGVRVMNPIQTETKGIRPISYNGGNELAYYTYLKDVRYQVRAHFEQNRNHPELYEDWNENKHHNIAKRMVQRGGRRDIFLGTRECQAFVEPCEFGQGESYYDTMPGEVDYGFMYHGITYADEAILEEDKNKMTVRFWRPVMQKGGIIVFDRPEECTQKRYIRDMERKVFGKNKNFTGLGEFTDEEVGE

SEQ ID NO: 2476 - protein, 252 aa, Ruminococcus sp. CAG:330
MVQKMVHRNTIEFHVWGDYALFSDVLTRASGEKCSYDIPTYEALKGITHSIYYKPTIVWKIDAVRIMNRIQTERKGIRPLKYGEGGNDLAYYTYLRQVSYQVRAHFEWNENHPELACDRNENKHHNIAKRMVERGGRRDIFLGTRECQGYVEPCVFGSGEGYYDNSGEIPYSFMYHGITYADEAVLPEDKDQMTVRFWKPVMQDGVIQFLPPEECTFKRHIKPMAIKKFGRDEGNFIGLDEFAGGEADELGE

SEQ ID NO: 2477 - protein, 214 aa, Faecalibacterium sp. CAG:74
MSIKMEVWGEYACFTRPEMKVERVSYDVPTPSAARGMVESVYYHPGLKWHVDKIYVCKPIRFTNILRNEVASKISVRNVLTEANGKKRSYIDRNADIQQRATTMLRNVHYVIEAHFEMTDKANPSDNPGKFQDIVKRRLRSGQAYMQPYLGCRECTAHFRLWEGGDIPTIDETRDLGYMLYDMEYSDPENIQPMFFRAQMVHGVIDLTDCEVVK

SEQ ID NO: 2478 - protein, 227 aa, Prevotella sp. CAG:873
MDYFDKEYGLEVWGDYACFTRPELKVERVSYDVITPSAARNIFQAIFWKPAFQWQITRIEVLNPIKWIGVRRNEVGAVGAAKPNAQPIIATEKRQQRNTLMLRDVRYRIYAKMIYIRPNERKGESRHAPGLDENPGKYQGIFERRASQGQCFTTPYLGTRECSAYFKLLDENAKSGADLLQEDRDFGIMLYDIDFSDPKNLTPMFFRAKMTNGIIDVPSPDSPNILK

SEQ ID NO: 2479 - protein, 233 aa, Bacteroides sp. CAG:98
MNNMEYTDKEYCLEIWGDWACFTRPELKVERVSYDVITPSAARAVFEAILFKRYAMRWQVTKIEVLNPIKWTTIRRNEVGAVVNSSMKPIYIDDGKTRQQKNSLLLQDVRYRIYAKLIFIPVKDRPKEAFAKHQPSNDENPMKYYQMFERRALQGQCFTQPYLGCREFAANWKYIDNTDYLEPPLFEDRDLGIMLYDMDFEGNAQKPDAMFYRARMKQGVIVVPSKDSEEVLR

SEQ ID NO: 2480 - protein, 247 aa, Lactobacillus helveticus CIRM-BIA 953
MLNEIIKSPSFSYKVFGDWALFTDPIMRLGGEKFTYSIPTYQALKGIAESVYWKPTIVIHIDKVRVMKPILVEAKDMRLFKYNNSRSSDLARYTYLKDVEYQVLAHFEFNMNRLDLAKDRNIKKHLAIMKRCIKRGGRRDVFLGTRECQGYVEPCKFGEGEGYYDNSDDRLFGTMFHGFDYPDETGNSMLKARLWNVVMKKGVVDFIRPEDCPVHKPLHELQVKKFKKGENLESVDQLYSQMLEGDS

SEQ ID NO: 2481 - protein, 202 aa, Nitrobacter sp. Nb-311A
MKVERVSYDVMTPSAARGILEAIHWKPTIRWVVDRIHVLKPIRFQSIRRNEVGSKASASKIKTAMNRGTLKGLHLLADKDRQQRASTVLADVAYVIEANFQLTVKSDANEKEGKHLDIFNRRAARGQCFHQPCLGTREFAAKFELIPADAPLPVAIDETRDLGFMLWDIDHAAKGKPSLLFRAHLDRGVVNVPAPASSEIRR

SEQ ID NO: 2482 - protein, 233 aa, delta proteobacterium MLMS-1
MRNRIDFKVTGRFALFTDPLTKIGGEKCSYHIPTYEALKGVAKSVYWKPTFVWIIDKVRVMRRIRTQSKSMKPLVFSGGNSLAIYTYLADVEYQVQAHFEWNRHREDMAQDRIDGKHFQVAQRMVDKGGRQDIFLGTRECQGYVEPCTFGEGPGEYDDCGELAYGLMFHGFDYPDETGINELHSRFWRPVLKDGVVTFPKPEDCTVRKFVREMTPKLPKSVGLQEEGLLDELD

SEQ ID NO: 2483 - protein, 206 aa, Lyngbya sp. PCC 8106
MNQLILQVEVPMASFRNSRAREYSESYPVPPHSTVYGMLLSLVGETNRYKHCGVKLAIAMLSIPYKSVNLRTLHRFETFTSRIPKPELYELLTNIEFIVAISGQEEENPTLLERIVEAIHRPEELDRFDPLYLGESDHLVNQIFICSEFPKDKSLYWLIQNPDGDLTLPYWVDHVGSCGTRWRRYLIEEFQVLEPPEQSWTLIESS

SEQ ID NO: 2484 - protein, 220 aa, Marinobacter sp. ELB17
MGFCLEISGEFACFTRPEMKVERVSYDVITPSAARAIFEAILWKPAIQWHITRIEVLNPIKWMNLRRNEVESIISARTAQTAMKNGSGHLGIYVDEERQQRASLLLKDVRYRLHGEFTMTEKAGPQDSAAKFADMFRRRAEKGQCFNQPYLGCREFTCDFALVDGDTANPDPINDTRDLGFMLYDLDYSNPASPTPLFFRAHIENGSLDVPARHSPEVRG

SEQ ID NO: 2485 - protein, 220 aa, Pseudoflavonifractor capillosus ATCC 29799
MSIKLEVWGDYALFTRPEMKVERVSYDVMTPSAARGLIEAIYWHPGMRWRIDRIHVCAPIRFTNLRRNEVKSTVSATTARTVMERGTGELYLSTSQEIQQRAALLLRDVRYVIEAHFEMTENAAPGDNPGKFQDIMKRRIQKGQFYHQPCFGCREFPAHFRLCEEIPPCPDELKGERDLGWMLYDMDYTNPENITPLFFRGVLRNGVLDVPAWDSEEVRR

SEQ ID NO: 2486 - protein, 225 aa, Mannheimia haemolytica PHL213
MPNKIRLHIWGDYACFTRPEMKVERVSYDVITPSAARGILAAVHWKPAIRWVIDKIYVLQPIQFESVRRNELGSKISASKISGAMKRKTVADLYTVIEDDRQQRAATVLKNVGYVIEAHAVLTKMAGEAETVTKHIEMFKRRAKKGQCFQQPCMGVREFAANFALIDDDEPLPECFLAENERDRDLGWMLHDIDFEHGNQPRFFRAEMKNGVIDVPPFYAEEVKS

SEQ ID NO: 2487 - protein, 220 aa, Ruminococcus gnavus ATCC 29149
MGMGVKVKVWGDYALFSRPELKVERYSYDVMTPSAARGILEAIYWHPGMRWIIDKIYVKNPIHFTSVRRNEVKSKVLASNVLSAYNGGKKPLYISSKEEIVQRASMILTNVEYVIEAHFEMTEKANETDNPGKFKDIMMRRLRRGECYHMPYFGCREFPANFALCEEEEIKTAFDDVPEKDFGLMLFDMDYSDKENISPMFFRAVMKRGVIDLQNCEVIR

SEQ ID NO: 2488 - protein, 226 aa, Parabacteroides merdae ATCC 43184
MIYTNKEYCLEVKGSMACFTRPEMKVERVSYDIITPSAARAIFESIFWKPAIQWNITRIEVLNPIRWFSMKRNEIGSLMSPRSSGLFIEDNRQQKSSLLLKDVCYRIFAELEFIPIRNRAKEDMLKVPSKSSDENPGKYNAMFERRAKKGQCFNQPYLGCREFSADFTYIENPVKGNGIPEDRDFGYMLYDMDFTNEKDPKPMFFRAIMKQGVLIVPSINSEEVRR

SEQ ID NO: 2489 - protein, 226 aa, Clostridium bolteae ATCC BAA-613
MPERSEVMSRGVRVRLWGDYALFSRPEMKVERCSYDVMTPSAARGMLEAIYWHPGMRWVIDKIYVRKPIQFTSIRRNEVKSKVLAGNALTAVNGGGKPLYISSKEEIVQRASILLRDVEYVVEAHFEMTPKAVPGDNEGKFKDIIMRRLRRGECYHQPYFGCREFPARFALYEEEEVDTAYDGTERDLGYMLYDLDYSDTEDIKPMFFRAVMKDGVLDVRNCEVVR

SEQ ID NO: 2490 - protein, 220 aa, Coprococcus eutactus ATCC 27759
MGKGVKVKVWGDYALFSRPEMKVERCSYDVITPSAARGILEAIYWHPGMKWVIDKIYVKNPIRFTSVRRNEVKSKISANNVLQAYNGADKPLYISTKEDIVQRASLILRDVCYVIEAHFEITENANDSDNPGKFKDIIMRRLKRGECYHMPYFGCREFPVNFCICDEEEVHTIYDEVPEKDLGFMLYDLDYSDRNNIQPMFYRAIMKRGVLDLRDCEVIR

SEQ ID NO: 2491 - protein, 285 aa, Eubacterium siraeum DSM 15702
MTCLLEQADINFKMQNTGKSESTSPKIKEVRILSKTEHDNIVEFKVSGDLALFADVLTRPGGEKFSYPIPTYEALKGILMSVYWKPTIIWVIDECRVMNKVSMERKGIRPIKYGGGNDLSYYTYLKDVEYRVRAHFEWNDNRPELEKDRNENKHHNIAKRMIQRGGRRDIFLGTRECMGYVEPCSYDEGVSYYQGTEIPYGFMYHGITYADEAEREEDKGKLTVRFWRPVMKDGVIKFDHPNDIPESQKRHIRDMKIKPFDKDLDNFSGLEEFDFIGGGDDIELD

SEQ ID NO: 2492 - protein, 246 aa, Clostridium scindens ATCC 35704
MKYRNTVEFEVYGDYALFSDPVTRVGGEKCSYHVPTYEALKGILQSVYWKPTLIWIIDAVRIMKPIQTETKAIRPISYNGGNDLSYYTYLKDVSYQVRAHFEWNRNRPELESDRNENKHHNIARRMISRGGRRDIFLGTRECQGYVVPCEFEEGEGYYDSQEGDLSYGLMYHGITYADEAVLPEDEGKMTVRFWHPVMKKGIIEFTRPEECAEKRHIREMAVKPFGEGNFTGIREFDGEEEDIELV

SEQ ID NO: 2493 - protein, 236 aa, Bifidobacterium dentium ATCC 27678
MKKYKNSIEYEVSGAYALFSEAVTRIGGEKYSYQVPTYQALKGMTESIYWKPTITWVIDAVRVMNKIQTEGKGIRPIKMSGGNDLSYYTYLKDVRYQVLAHFEWNEQRPDLTDDRDENKHYQIAQRSVNQGGRRDVFLGTRECQGYVEPCAFGENIGFYDDYGQWNLGYMFHGFTYPDENPKHDLVARFWAPTMRNGVIEFDRPDSANLDCRIIRENQTVKSFKSGENFRILEGDE

SEQ ID NO: 2494 - protein, 220 aa, Ruminococcus lactaris ATCC 29176
MGIGVKVKVWGDYALFSRPEMKVERCSYDVMTPSAARGILEAIYWHPGLKWVIDKIYVKNPIRFTSVRRNEVKSKISASNVLQVYNGADKPLYLSTKEDIVQRASLILCDVCYIIEAHFEMTNKANASDNPGKFKDIIMRRLKRGECYHMPYFGCREFPAQFCLCEEKEIHTSYDTVPEKDLGFMLYDMDYSNLDEIQPMFFRAVMRKGVLDLRNCEVIR

SEQ ID NO: 2495 - protein, 223 aa, Bacteroides plebeius DSM 17135
MEYYDKEYGLEVWGDMACFTRPELKVERVSYDVITPSAARAIFEAIFWKPAIRWEVTRIEVLSPIQWASVRRNEVGAVGSIRAQQIYIEEKRQQRNTLLLKNVRYRIYAKLVYIPVNQRTNGQLRDTKDENPGKYQAMFERRASKGQCFNQPYLGVREFSAYFRLLEEGETLSPPLAQDRDLGIMLYDMDFSDPDNVNAMFFRAKMQDGVINVPPRNSEEILR

SEQ ID NO: 2496 - protein, 220 aa, Tyzzerella nexilis DSM 1787; identical to SEQ ID NO: 2487

SEQ ID NO: 2497 - protein, 219 aa, Holdemania filiformis DSM 12042
MLYDNKICFRVWGNEALFTDPLTKVGGEKFSYPVPTYQALKGITESIYWKPTLIWVIDRCRVMKIIQTQSKGIRPIRYYSNQNDLSLYTYLHDVEYQVEAHFIWNAKRADLAQDRNEHKHYDIAKRMVARGGRRDIFLGTRECQGYVEPCNFGEETSPYDEAGEVVFGVMFHSFIYPSESQDENLKSCFWMPIMKKGVIEFISPQSCTMIRELGKMSEK

SEQ ID NO: 2498 - protein, 226 aa, Bacteroides coprophilus DSM 18228 = JCM 13818
MEYTDKEYCLEVWGDWACFTRPELNVERVSYDVITPSAARAIFEAILFKRYAMRWQITKIEVINPIKWTTIRRNEVGAVAGKSPIYIEDKRQQKNSLLLKDVRYRIYAKLVFIPVKNRSKEAFGKHQPGNDENPMKYYQMFERRASQGQCFTQPYLGCREFSASWKYIDTTEDLTSPLNEDRDLGIMLYDMDFDKNPKNPDAMFYRAKMEQGVIVVPNKDSEEVLR

SEQ ID NO: 2499 - protein, 242 aa, Clostridium methylpentosum DSM 5476
MIYRNTVEFEVTGDNALFSDPVMRVGGEKCSLQVPTYEALKGILSSVYWKPTLIWFIDAVRVMNPIQTEVKGIRPIKYSGGNDLSFYTYLRNCRYQVRAHFEWNENRPELANDRNEHKHHNIARRMIERGGRRDIFLGTRECQGYVSPCAFGEGKGHYDDTPELAFGLMYHGVTYADEAYSQETRDHMTVRFWRPVMRRGVIEFLRPEQCELVRRVREMKFKPFGEELGNFQSADELAREVE

SEQ ID NO: 2500 - protein, 235 aa, Neisseria flavescens NRL30031/H210
MKGRVYKKENQMNQIRLHIWGDYACFTRPEMKVERVSYDVITPSAARGILAAVHWKPAIRWVIDRIYVLKPIRFESVRRNELGGKISAGKVSGAMKRKSVADLYTLIEDDRQQRAATVLKDVAYVIEAHAVLTAKAGADETVTKHIEMFKRRAKKGQCFQQPCLGVREFPADFALIDEGEPLPPSALSASEASRDLGWMLHDIDFDHGNTPHFFRAQMKDGVIDVPPFYAEEVKA

SEQ ID NO: 2501 - protein, 218 aa, Clostridium asparagiforme DSM 15981
MGWGVRVHVWGDYALFARPEMKVERCSYDVMPPSAARGILEAIYWHPGMRWVIDRIQVRKPIQFTSIRRNEVKSKVLVGNVLRAVNGSSKPLYIASKEEIVQRAAILLKDVDYLIEAHFEMTERASAGDNPGKFKDIVMRRLRRGECFHMPYFGCREFPANFELYEADDLQDGDGREQDLGYMLYDFDYSDPEDIKPMFFRAVLRNGILDVRDCEVVR

SEQ ID NO: 2502 - protein, 235 aa, Bifidobacterium pseudocatenulatum DSM 20438 = JCM 1200 = LMG 10505
MQRHRNSIEYEVSGRYALFSEAATRVGGEKFSYQVPTYQALKGITESIYWKPTFMWVIDAVRVMNRVQTEGKGIRPIKMSGGNDLSYYTYLKDVRYQVLAHFEWNDQREDLVADRDENKHHNIALRSVQKGGRRDIFLGTRECQGYVEPCEFGSGEGFYDGYGEWNMGYMFHGFTYPDENEDHDFIARFWSPVMSDGIIEFERPESTKLDGRIIRKNQSVKEFALGSNLQPVGEE

SEQ ID NO: 2503 - protein, 249 aa, Clostridium hylemonae DSM 15053
MKYRNTVEFQVEGAYALFADPITRVGGEKCSYHIPTYEALKGILHSIYWKPTLIWVIDAVRVLNPIQTETKGRKPINYNGGNDLSYYTYLKEVKYQVRAHFEWNENRPELTNDRNEHKHHNIAKRMIERGGRRDVFLGVRECQGYVSTCVFGEGKGYYDDVPGEIGYGFMYHGITYADEAVCEEDKGKMTARFWYPVMKQGVIEFVRPEECAEKRHLKEMEMKSFGEDMHNFTGLKEFEGEEGACELDK

SEQ ID NO: 2504 - protein, 247 aa, Roseburia inulinivorans DSM 16841
MERENAIEYKVYGKYALFTDPLTKTGGEKLSYQVPTYQALKGITESIYWKPTFTWVIDECRVMHPIRTESKGMRPIKYQGGNDLASYTYLKDVEYRVKAHFVWNENRLDLVNDRNENKHYQIAKRMLERGGRRDIFLGTRECQGYVEPCTVMEGEGFYDNDGNISFGIMVHGITYSDEAVRENEKKHMTIRLWNAYMKDGVIRFPEPEECQIRKVVAEMEMKTFDEKNFCGIREFERGNLFGLDTNA

SEQ ID NO: 2505 - protein, 238 aa, Porphyromonas uenonis 60-3
MEEYIDKEYCLRVRGPFACFTRPEMKVERVSYDVITPSAARAIFQAIYWKPAIRWEITKIEVLAPIKRFTIKRNEVASIMSKGSTGINVSEDRRQRASYILRDVDYRIYAKMVYIPVRNRSASCQKHYNEEYSEAERKAENPRKYQEIFERRAKAGQCFTMPYLGCREFTCAFEYVDLEHGETSLEPKPIPESRDLSIMLYDMDFERDRKNPPAMFYHAQMTDGVILVPPMDSNEILR

SEQ ID NO: 2506 - protein, 226 aa, Porphyromonas endodontalis ATCC 35406
MEYTDKEYCLELRGDFACFTRPEMKVERVSYDVITPSAARNIFQAIFWKPAIRWEITRIEVLNPIKRFSIRRNEVASAMSPRASHLLIEEHRTQKTAYILRDVAYRVFAKLVFIPIRDRTDEEKARVTDPQHENPMKYQQIFERRAEQGQCFTQPYLGCREFSCSFEWIPNAPYGQGIPESRNLGYMLYDLDFAGNPRSPQPMFFEAIMEHGVISIPKPLSDKILR

SEQ ID NO: 2507 - protein, 230 aa, Bacteroides dorei 5_1_36/D4
MEYTDKEYCLEVWGDWACFTRPELKVERVSYDVITPSAARAIFEAILFKRYAMRWQVTKIEVLRPIKWATIRRNEVGAVVNSSMKPIYIDDGKTRQQKNTLLLLDVRYRIYAKLVFIPVKDRPKEAFAKHQPSADENPMKYYQMFERRASQGQCFTQPYLGCREFSANWKYIESTDNLDNPLAEDRDFGIMLYDMDFEENPQKPNAMFYRVQMKKGVIVVPDKDSEEVLR

SEQ ID NO: 2508 - protein, 230 aa, Bacteroides sp. 9_1_42FAA; identical to SEQ ID NO: 2507

SEQ ID NO: 2509 - protein, 238 aa, Shuttleworthia satelles DSM 14600
MKITHANVVEFEVYGRYALFSDPVMRVGGEKCSYQIPTYEALKGIVSSIYWKPTFIWYIDEVRVMNPIQTETKGIRPIKMNGGNTLSFYTYLKNVRYQVRAHFEWNGNRPELMKDRNENKHHNIARRMVERGGRRDIFLGTRECQGYVEPRKFGEGSSVYDDINEWDFGVMYHGITYPDEAYSKDTQGRITVNLWRPVMKKGIIEFLRPENCPQHKMIRKAEMKTFSDSRGNILIEEG

SEQ ID NO: 2510 - protein, 224 aa, Kingella oralis ATCC 51147
MNQIRLHVWGDYACFTRPEMKVERVSYDVITPSAARGILAAVHWKPAIRWVIDRIYVLKPIRFESVRRNELGGKISAGKVSGAMKRKSVAGLYTLIEDDRQQRAATVLKDVAYVIEAHAVLTPKAGADETVTKHIEMFKRRAKKGQCFQQPCLGVREFPADFALIDEGEPLPPSALSESEANRDLGWMLHDIDFDHGNTPHFFRAQMKDGVIDVPPFYAEEVKA

SEQ ID NO: 2511 - protein, 239 aa, Selenomonas flueggei ATCC 43531
MRNTIEFQVYGRMALFTDPITKIGGERSSYSVPTYQVLKGITESIYWKPTIYWVVDEVRVMNRITTQSRGVKPMKYSGGRNELSIYTYLSDVCYQVRAHFEFNLHRKELAADRDEHKHHNIAKRMVERGGRRDIFLGTRECQGYVEPVNYGEGVGYYDKAGEMPLGTMFHGFNYVDETGGNMLQVRLWQPVMEDGVIRFPRPEECRLVRDIRKVKSKLFDKNSVTFAADEWEELEGGRL

SEQ ID NO: 2512 - protein, 242 aa, Clostridiales bacterium 1_7_47FAA
MSYGFKIMVTGDYACFTRPELKVERVSYDVPTPGAMEGMLKSIYWKPAIRYVIDKIIVFQPIDFINIRRNEVKDKVLYSAVKSQMNGTGGNPCIYTSESRSQRAAMILKNVMYGVEFHFELTGLKNDKETDTESKHFNIIKRRLERGQHYRTPCLGCSEFPVRDIRLVEDFDLNLISSSILTQEDVDLGFMSYRVQFQDGGVPTNGDWDNPKFSDKAVTIYYRPHMIRGVIDVAKYREGLKC

SEQ ID NO: 2513 - protein, 224 aa, Neisseria flavescens SK114
MNQIRLHVWGDYACFTRPEMKVERVSYDVITPSAARGILAAVHWKPAIRWVIDRIYVLKPIRFESVRRNELGGKISAGKVSGAMKRKSVADLYTLIEDDRQQRAATVLKNVAYVIEAHAVLTAKAGADETVTKHIEMFKRRAKKGQCFQQPCLGVREFPADFALIDEGELLPLSALSESEANRDLGWMLHDIDFDHGNTPHFFRAQMKDGVIDVPPFYAEEVKA

SEQ ID NO: 2514 - protein, 237 aa, Paenibacillus sp. oral taxon 786 str. D14
MRNEVQFEVFGDYALFTDPLTKIGGEKLSYSVPTYQAIKGILESVYWKPTIMYIIDELRVMKPIQMESKGVRPIDYGGGNTLANYTYLKDVHYQVKAHFVFNEHRPDLAFDRNEGKHYSILQRSLKAGGRRDIFLGTRECQGYVQPCEFGSGAGYYDTDERTHYLGTMVHGFNYPDETGRNELSVRLWSVEMNKGYIRFPKPEECSIVRSVREMEPKSFHSDSIESAEQLLRNLGGE

SEQ ID NO: 2515 - protein, 226 aa, Bacteroides sp. 4_3_47FAA
MEYTDKEYCLEVWGDWACFTRPELKVERVSYDVITPSAARAIFEAILFKRYAMRWQITKIEVLRPIKWATIRRNEVGAVASKSPIIIEDKRQQKNTLLLLDVRYRIYAKLVFIPVKDRPKEAFAKHQPSADENPMKYYQMFERRASQGQCFTQPYLGCREFSANWKYIESTDNLDYPLAEDRDFGIMLYDMDFEENPQKPDAMFYRAQMKKGVIVVPDKDSEEVLR

SEQ ID NO: 2516 - protein, 236 aa, Neisseria sicca ATCC 29256
MKGRVYNQKENQMNQIRLHIWGDYACFTRPEMKVERVSYDVITPSAARGILAAVHWKPAIRWVIDRIYVLKPIRFESVRRNELGGKISAGKVSGAMKRKSVADLYTLIEDDRQQRAATVLKDVAYVIEAHAVLTAKAGADETVTKHIEMFKRRAKKGQCFQQPCLGVREFPADFALIDEGEPLPPSALSESEANRDLGWMLHDIDFDHGNTPHFFRAQMKDGVIDVPPFYAEEVKA

SEQ ID NO: 2517 - protein, 220 aa, Marvinbryantia formatexigens DSM 14469
MAKGVKVRVWGDYALFTRPEMKVERCSYDVITPSAARGILEAIYWHPGMRWVIDRIYVKKPIQFTSVRRNEVKSKILASNVLPVYNGKPEQLCISSKAEIVQRASLLLRNVEYVIEAHFEMTEKANESDNPGKFKDIIMRRLRKGECFHTPYFGCREFPVKFCLCEEEEVLTAYENEDERDLGFMLYDMDYSDRNNIQPMFFRAIMKKGIIDVQNCEVVR

SEQ ID NO: 2518 - protein, 231 aa, Cardiobacterium hominis ATCC 15826
MAMGIKLHIWGKYACFTRPEMKVERVSYDVITPSAARGILTAIHWKPAMLWEIKKIHVLKPIRFESVRRNELGGKISASNVTSAMKRKSVQDLYTLIEDDRQQRAATVLKDVAYIIEAHIQLNHAFIAQSDRAEEESVNKHLEMFKRRARNGQCFQQPCMGVREFPANFALIEDSESLPACELPENERNRELGWMLHDMDFAHGNTPHFFRAEMKNGIIEVPLFRAKEVKS

SEQ ID NO: 2519 - protein, 238 aa, Jonquetella anthropi E3_33 E1
MDFFNKSFCLEVAGDFACFTRPEMKVERVSYDVITPSAARGIFTAIFWKPAIRWIIREIHVLEPIRWLSFRRNEVGALMKLSSGGLCIEDHRQQKASILLRDVRYRLVAELEYIPPHKRPRTFLQVPDCLGDENEREIIRSGENPGKYYGIFERRARKGQHFMAPYLGCREFSCSEVRLIDHPETEKRQPIDETRDLGIMLYDLDFSRPEDPQPAFFRAKMDRGIIKVPDWESEAVLR

SEQ ID NO: 2520 - protein, 218 aa, Selenomonas sputigena ATCC 35185; identical to SEQ ID NO: 2411

SEQ ID NO: 2521 - protein, 225 aa, Mannheimia haemolytica serotype A2 str. OVINE; identical to SEQ ID NO: 2486

SEQ ID NO: 2522 - protein, 230 aa, Bacteroides sp. 3_1_33FAA; identical to SEQ ID NO: 2507

SEQ ID NO: 2523 - protein, 260 aa, Neisseria lactamica ATCC 23970
MQKLQIYKNIIQSAVNFPNVFKTSSETALSNQKENQMNQIRLHIWGDYACFTRPEMKVERVSYDVITPSAARGILAAVHWKPAIRWVIDKIYVLKPIQFESVRRNELGGKISAGKVSGAMKRKSVADLYTLIEDDRQQRAATVLKDVAYVIEAHAVLTAKAGADETVTKHIEMFKRRAKKGQCFQQPCWGVREFPADFALIDEGEPLPPSALSESEASRDLGWMLHDIDFDHGNTPHFFRAQMKDGVIDVPPFYAEEVKA

SEQ ID NO: 2524 - protein, 214 aa, Neisseria lactamica ATCC 23970
MRFILEISGDLACFTRSELKVERVSYPVITPSAARNILMAILWKPAIRWKVLKIEILKPIQWTNIRRNEVGTKMSERSGSLYIEDNRQQRASMLLKDVAYRIHADFDMTSEAGESDNYVKFAEMFKRRAKKGQYFHQPYLGCREFPCDFRLLEKAEDGLPLEDITQDFGFMLYDMDFSKSDPRDSNNAEPMFYQCKAVNGVITVPPADSEEVKR

SEQ ID NO: 2525 - protein, 234 aa, Peptoniphilus lacrimalis 315-B
MVNSKYFYGKIYGDKALITTPESKSGGEKISYNVPTREMLRGILDANYFKPTIVNVVDEIRVMNKIESYTQGTRLLLKDYSSDLSAYTYLTNVCYYIKFHFEWNENREDLKGDRNFNKHEAITERSLKRGGRRPIFLGTSECSGYIDEITEEEYENDKGFYDETNLGFGLMFNGFVYPEESGGMLKSAYAPINMINGRIKYPRPEECNIINEVTNYSFKIPELTKSADEELEDY

SEQ ID NO: 2526 - protein, 244 aa, Pyramidobacter piscolens W5455
MQKANRVAYQVWGEYALFSDPLTRVGGEKSTYPIPTYQALVGITESIYWKPTFIWYIDRVRVMNPIRMQTKGVKPILYAHGPNAAANTLSYYTYLYKVRYQVEAHFEWNPNMPDLAPDRNEDKHFQIAQRMIKRGGRRDIFLGTRECQGYVEPCTFGEGRGAYDQTPELGFGMMYHGLNYPSDTGREKLELRLWRPVMAYGIINFMLPYQCTEVRELCDWEKESFMLRRNCQPVEELCREAIQA

SEQ ID NO: 2527 - protein, 224 aa, Neisseria subflava NJ9703
MNQIRLHVWGDYACFTRPEMKVERVSYDVITPSAARGILAAVHWKPAIRWVIDRIYVLKPIQFESVRRNELGGKISAGKVSGAIKRKSVADLYTLIEDDRQQRAATVLKDVAYVIEAHAVLTAKAGADETVTKHIEMFKRRAKKGQCFQQPCLGVREFPADFALIDEGEPLPLSALSESEANRDLGWMLHDIDFDHGNTPHFFRAEMKEGVILVPPFYAEEVKA

SEQ ID NO: 2528 - protein, 224 aa, Neisseria mucosa ATCC 25996
MNQIRLHVWGDYACFTRPEMKVERVSYDVITPSAARGILAAVHWKPAIRWVIDRIYVLKPIRFESVRRNELGGKISAGKVSGAMKRKSVADLYTLIEDDRQQRAATVLKDVAYVIEAHAVLTAKAGADETVTKHIEMFKRRAKKGQCFQQPCLGVREFPADFALIDEGEPLPPSALSESEANRDLGWMLHDIDFDHGNTPHFFRAQMKDGVIDVPPFYAEEVKA

SEQ ID NO: 2529 - protein, 220 aa, Clostridium sp. M62/1
MAKGIKVRVWGDYALFSRPEMKVERCTYDVMTPSAARGILEAIYWHPGLRWKIDRIYVKKPIRFTSVRRNEVKSKLSASNALSVYNGAKKDLYISTKADIVQRASLILKDVEYVIEAHFEMTQDANETDNPGKFKDIVTRRLNRGECFHMPYFGCREFPAYFAPCEEEVISTAYEGEEERDLGYMLYDMDYSDLKNIQPMFFRAVLRRGVLDVKDCEVVR

SEQ ID NO: 2530 - protein, 247 aa, Filifactor alocis ATCC 35896
MSKKLEMEKSKHFYMRITGDYALWADPATKGGGERISYQVPTAQAIQGICDAVYFKPTIRNVVDAIKVVNPVRFHSMGYRALYGDLSAGLNYVTVLENVEYLVQYHFEWNLYRQDLSRDRIMKKHETITERSLRKGGRRDVFLGAREFLGYVEQITEQEYLTEKTFYYGSDFDLGNIFHSFIYSNDETEPLKSLFTHTIMRDGIIQIKPQEECEITNILSSYTIKAHKGVVSVDEELKEYGEGGESI

SEQ ID NO: 2531 - protein, 239 aa, Selenomonas noxia ATCC 43541
MRNSIEFQVYGRMALFTDPITKIGGEKASYSVPTYQALKGITESIYWKPTIIWFIDEVRVMKRITTQVRGVKPLKYGDSGNDLSYYKYLSDVCYQVRAHFEFNMHREELKEDRDEHKHHNIAKRMVERGGRRDIFLGTRECQGYVEPVKYGVGKGYYDNVDELPLGIMLHGFNYPDETGEDKLQVRFWKPTMKKGIIHFRRPEKCEMVRDIREVRTKQFDADNVFFAEEEEKQLEGGHL

SEQ ID NO: 2532 - protein, 197 aa, Neisseria polysaccharea ATCC 43768
MSFILEISGDLACFTRPELKVERVSYPVITPSAARNILMAILWKPAIRWRVLKIEILKPIQWTNIRRNEVGTKMSERSTSLYIEDNRQQRASMMLKDVAYRIHADFDMTSEAGESDNYVKFAEMFKRRAKKGNISTSLIWVAASFPAISGYLKSLKTVCHAKTLPKISVLCCTTWISANPIRAIPIMLSQCFTNAKR

SEQ ID NO: 2533 - protein, 246 aa, Erysipelotrichaceae bacterium 3_1_53
MEKRNEIIFCVKAKYALFSDPLNRVSGEKFSYQIPTYEALKGVVKSIYFKPTISWYIDEVRIMNPIQFTTQGIRPIDYHGGNTLSYYTYLTDVSYQVKAHFEWNLHHDELEQDRNENKHWLIAKRMVKRGGRRDVFLGTSECKAYVEPCEFGEGKSFYEDQDILPFSTMVHGFIYPDEWVYEEEKDKLIATFWNPVMRNGVITFIRPEQCEIRRVVGNGGIKRFVKDVNFKPIDNEEEGGATLELG

SEQ ID NO: 2534 - protein, 234 aa, Peptoniphilus harei ACS-146-V-Sch2b
MNKSKYFYAKVYGDRALFTSPESKSGGEKVSYEVPTLASLQGIIDANYFKPTITNVIDEVRIMNKIESYTQGMRLLLRDYSADLSAYTYLSSPCYYVKFHFEWNEDREDLKNDRNFLKHEAITERSLKRGGRRPIFLGVSECQGFIEYLTEEEYENDKGYYDDTNLGFGLMLVGLIYPKKSGEMLRSAYGPINMKNGRITFPRPEDCPIINEVSNYSFKEPDLTRTVDQELEDY

SEQ ID NO: 2535 - protein, 248 aa, Porphyromonas asaccharolytica PR426713P-I
MEEYIDKEYCLRVRGPFACFTRPEMKVERVSYDVITPSAARAIFQAIYWKPAIRWEITKIEVLAPIKRFTIKRNEVEAIMSYNEKKTKDSSYGTNWFDVSDKRQQRASYILRDVDYRIYAKMVYIPVRDRSASCQKHYNEEYSEAERKAENPRKYQEIFERRAKAGQCFTMPYLGCREFTCSFEYVDLEHGETSLEPKPIPASRDLSIMLYDMDFERDRKNPPAMFYYAQMTEGVILVPPMDSNEILR

SEQ ID NO: 2536 - protein, 246 aa, Clostridium sp. HGF2
MEKKNEITFCVKSKYALYSDPLNRVSGEKFSYQIPTYEALKGVVKSIYFKPTISWFIDEVRIMNEIQFTTQGIRPINYHGGNTLSYYTYLTDVEYQVKAHFEWNLHHEELEQDRNENKHWLIAKRMVNRGGRRDIFLGTRECQAYVEPCEFGEGKGFYDDHTIVPFSTMVHGFIYPDEWVCEEEKGKLIATFWTPVMKKGIITFIRPEQCAIRRIVGTGDIKRFEKDINFKSVEHEEGGELYELGE

SEQ ID NO: 2537 - protein, 240 aa, Selenomonas sp. oral taxon 137 str. F0430
MMRNGIEFQVYGRMALFTDPITKIGGERSSYSVPTYQALKGITESIYWKPTIFWVIDEVRVMHRIATQSRGVKPLKYGGGGNDLSVYKYLSDVCYQVRAHFEFNTHRKELAGDRDEHKHHNIAKRMVERGGRRDIFLGTRECQGYVEPITYGEGEGYYDHAGEMPLGTMFHGFNYADETGGNMLQVRLWQPMMKDGVLRFPRPEECTLVRDVRKVTTKLFDKNSVTFAEEELKELEGGRL

SEQ ID NO: 2538 - protein, 245 aa, Streptococcus pseudoporcinus SPIN 20026
MFRSRNFYFRLRGNLALFTNPATKGGGERSSYSVPTRQALQGIVDAIYFKPTITNVVTEVKVCNQIQTELHGVRALLANYRSDLSYVSYLSDVEYLVKFHFIWNEDRPDLLYDRLPNKHEAIMERSIRKGGRRDIFLGTRECLGLVDDICQEDYEQAEVAYAGQTIDFGMMFHSFKYPKDKSESLKSYFAHIVMENGCIRFKEQKDCEIMNTLSSYAFKAPNQIKSADEEFAIYQADEESEKGGN

SEQ ID NO: 2539 - protein, 239 aa, Parascardovia denticolens DSM 10105 = JCM 12538
MQKHRNSIEFTISGRYALFSEATTRVGGEKFSYQVPTYQALKGMVESIYWKPTIIWIIDAVRVMNRVQTESKGIRPIKYNGGNDLSYYTYLKDVKYQIRAHFEWNNQRPELAGDRDENKHHQIALRSVEKGGRRDVFLGTRECQGYVEPCVFGEEPGFYDSYGEWNLGYMFHSFSYPDENADQDFLARFWTPVMKDGIIEFPRTDSQQLDSRVIRSHEKIKAKEFTIGKNMHLVGEDEK

SEQ ID NO: 2540 - protein, 244 aa, Pseudoramibacter alactolyticus ATCC 23263
MGYGFKVMISGDYACFTRPEFKVERVSYDVPTPGALEGLLKSIYWKPAIRYVIDQIVVFSPIKFVNIRRNEVKDKISQTKMKQQMNGQPEVNPCIYTTESISQRASMVLKDVCYGVAFHFELTGIRCERENKEGNPAAKHQAEIARRLDRGQFFRTPCLGCSEFPASRIERVQAFDLEQIDSSLAGDNDLGFMTYKVAFKDEGRPRKGEWRKDQFSDAAETIYYRPHLIDGVIDVAKYRGEQRC

SEQ ID NO: 2541 - protein, 240 aa, Selenomonas artemidis F0399
MMRNGIEFQVYGRMALFTDPITKIGGERSSYSVPTYQALKGITESIYWKPTIFWVIDEVRVMHRIATQSRGVKPLKYGGGGNDLSVYKYLSGVCYQVRAHFEFNTHRKELAGDRDEHKHHNIAKRMVERGGRRDIFLGTRECQGYVEPVAYGSGEGYYDHAGDMPLGTMFHGFNYADETGGNMLQVRLWQPIMKDGVLHFPRPEECSLVRDVRKVTTKLFDKNSVTFAEEELRELEGGRL

SEQ ID NO: 2542 - protein, 251 aa, Clostridium symbiosum WAL-14673
MSANYALFSDPIARMGGEKFSYMLPTYQALKGITESIYWKPSIIWVVDEMRIMKPIRTESKNIRPISYVAPKNTLSVYTYLADVSYQVRAHFIFNENRREELEQDFNENKHHNIAKRMVEKGGRRDIFLGTRECQGYVESCVFGEGESYYDHYGELEFGLMFHGFDYPDETGQNILAARFWKPKMVNGVVQFLPPEELPEEMKRNIRPMKAKQFGEKFGNFSGLKEETLKRELVWEGGETNELDAEIMRGV

SEQ ID NO: 2543 - protein, 247 aa, Ruminococcus albus 8
MKKHRNTVEFCVHGNYALFSDVLTRAGGEKYSYPIPTYEALKGILQSIYWKPTIIWYIDAVRIMKPIKTVRKGIRPIKYDGGNDLAYYNYLEDVCYQVRAHFEWNMNRPELEQDRNENKHHNIAKRMIERGGRRDIFIGTRECQGYVEPCDFEKGEGSYKGVDMTFPLMYEAVIYPDEAEKEEDMGYMTVCLWQPEMKDGIIEFIRPSESPFKRHVKKMEMKKFGREENNFIGLEEFAGGEFDGVDE

SEQ ID NO: 2544 - protein, 224 aa, Kingella denitrificans ATCC 33394
MNQIRLHIWGDYACFTRPEMKVERVSYDVITPSAARGILAAVHWKPAIRWVIDRIYVLKPIRFESVRRNELGGKISAGKVSGAMKCKSVADLYTLIEDDRQQRAATVLKDVAYVIEAHAVLTAKAGADETVTKHIEMFKRRAKKGQCFQQPCLGVREFPADFALIDEGEPLPPSALLENEANRDLGWMLHDIDFDHGNTPHFFRAEMKDSVIDVPPFYAEEVKA

SEQ ID NO: 2545 - protein, 221 aa, Eggerthella sp. HGA1
MAYGICVEVWGDRALFTRPELSVERVSYDAMTPSAARGLLESIYWHPGMRYTIDRIHVLNPIRFTNVRRNEVKSKALASTMRTAATGGGKLPYINTKDDIQQRASLILIDVRYVIEAHFDLTDKATPDDNAGKFKDIIRRRLERGQCYSMPYFGTREFPAHFKACEEVPSSCGFYADESERDLGFMLYDMDYRDPKNIAPMFFRAVMRNGVIDVAGSEVFR

SEQ ID NO: 2546 - protein, 246 aa, Lachnospiraceae bacterium 5_1_57FAA; identical to SEQ ID NO: 2492

SEQ ID NO: 2547 - protein, 220 aa, Lachnospiraceae bacterium 2_1_58FAA; identical to SEQ ID NO: 2487

SEQ ID NO: 2548 - protein, 237 aa, Thiorhodococcus drewsii AZ1
MSHGVRMLVWGDAACWTRPEMKAERVSYDVMTPSGARGVLEAIYWKPQIRWVIDRIHVLSPIRFTNIRRNEVAVAGDSGHKVPAGKISAAMQGSPAPLCVYADETQNRQQRASLILQNVRYGIEAHFELLDARERDGTIPTDPAAKHLDQFNRRLRKGACYHRPYLGCREFAAHFGPVESDFPPSPESLRGERDLGFMLHDIDFADGMTPRFFRARMVDGVIDVQACLEATMEMLGS

SEQ ID NO: 2549 - protein, 224 aa, Thiorhodospira sibirica ATCC 700588
MSYGIRLHVWGDRACFTRPEMKVERVSYDVITPSAARGILEAIHWKPAIRWIVDRIHVLKPIRFESIRRNEVGSKLSPGNVSKAMKAGTTAGLVAYVDNDRQQRAATILRDVAYVIEAHFEFTDAVGPDESVGKHLDIFNRRARKGQYFHAPCLGVREFPAHFSLIEDGQPLPEAHPERDADKDLGWMLHDIDFTQDMTPRFFRAQLKGGVIEVPPWQSTEVSA

SEQ ID NO: 2550 - protein, 218 aa, Desulfovibrio carbinoliphilus subsp. oakridgensis
MSFGVRLKVWGDFACFTRPEMKSERVSYDVITPSAARGILEAVYWKPGITWVIDRIHVLHPIRFTAIRRNELGGKIPYGNIKSAMKGGTPPPLFTEDDRQQRASLVLRDVAYVIEAHFELTGQDDNAAKHTEMFKRRARKGQCFNQPYLGCREFPAFFELLDGPAPASALADQDRDKDLGFMLHDIDFAHDMTPKFFRARLAGGVIDVPRFEAAEVRA

SEQ ID NO: 2551 - protein, 228 aa, Leptonema illini DSM 21528
MAKSKTLKIKVWGENACFTRPEMKVERVSYDVMTPSAARGILEAILWKPAISWRIERIDVLNEIRWQSVRRNELGSKIPFSNVTKAMKDGKGSLALYIEEERQQRAGLFLRDVAYVIHAHFSLSDRKGPADNIKKFEEMFERRVSKGQCHHFPVMGNREFPAFFAPADDGERPHPVDRDLGFILYDMEFGVWDENSSDYESARPRFFRARLESGSMVVPAWDSAEVLG

SEQ ID NO: 2552 - protein, 240 aa, Paenibacillus dendritiformis C454
MIRNSIEFEVFGTYALFTDPLTKLGGEKMSYPVPTFQALKGIVESIYWKPTILFVVDAVRVMNPIRMESKGVRPLDYGGGNTLAYYSYLKDVRYQCRAHFVFNPNRPDLEYDRNEHKHYSILKRSLRAGGRRDIFLGARECQGYVEPCEFGEGKGFYDDYGDLHFGTMVHGINYPDETGRKQMETRLWNPVMKNGVIEFIKPEQCTLVRPVAEMEPKTFTAGEIEAVEELEARLEAEGSR

SEQ ID NO: 2553 - protein, 247 aa, Desulfosporosinus youngiae DSM 17734
MEVKRNTVEFLVRGDRALFADPVTRVGGEKTSYYVPTYEALKGILASVYWKPTLVWMIDAVRVMNMIQTASEGVRTRNYDGGNDLSVYTYLKDVSYQVRAHFIWNENRPELAADRNEHKHHNIARRMIERGGRRDIFLGARECQGTVEPCVFGEGAGIYDQVEELHLGYMFHGFTYADEALREAEKGHMSVRFHHVVMKRGVIEFPGPEEIPDRDRRILHKMPVKPFGEAGGNFSGLAEFAGEGVAE

SEQ ID NO: 2554 - protein, 226 aa, Candidatus Arthromitus sp. SFB-co
MGFTLRVWGDYACFTRPEMKVERVSYDVITPSAARAIFEAIHWKPAIRWVIDEINVIKPIKFQTIMRNEVESVMSTQSIKKSINNKEEQFYIDSNKVRQQRNSMVLKDVEYIIKAHFEMTKHAGGSDDEKKHYNIFLRRARNGECFSQPYFGCREFSCNFELLENEDLPLNIQETRDLGWMLYDIDFVKKGDSYKGVKEYNPKFFRAEMIKGKVTIPKNLQMEVNK

SEQ ID NO: 2555 - protein, 226 aa, Candidatus Arthromitus sp. SFB-mouse-SU; identical to SEQ ID NO: 2554

SEQ ID NO: 2556 - protein, 254 aa, Treponema saccharophilum DSM 2985
MKEFFDKTFCLEVWGDYACFTRPEMKVERVSYDVMTPSAARAIFEAIFWKPAFEWKIKSIEVLNPIKWINLRRNEVGVVASENSEGFCVDEIDSRGSPKYRQQRAGLFLKDVRYRIYAELAYIPVSKRKSDSQKKSQELDLFSSVEENVHENENPEKYNSMFERRAKKGQCVFQPYLGCREFSCFFKLVDTEREPAVPIPETRDLGFMLYDMDYSGIKNPEKIGPDDIKACFFRAKLENGVVNVPDWNSKEVYR

SEQ ID NO: 2557 - protein, 224 aa, Neisseria sicca VK64
MNQIRLHIWGDYACFTRPEMKVERVSYDVITPSAARGILAAVHWKPAIRWVIDRIYVLKPIRFESVRRNELGGKISAGKVSGAMKRKRVADLYTLIEDDRQQRAATVLKDVAYVIEAHAVLTAKAGADETVTKHIEMFKRRAKKGQCFQQPCLGVREFPADFALIDEGEPLPPSALSENEANRDLGWMLHDIDFDHGNTPHFFRAQMKDGVIDVPPFYAEEVKA

SEQ ID NO: 2558 - protein, 218 aa, Desulfovibrio sp. U5L
MSFGVRLKVWGDFACFTRPEMKSERVSYDVITPSAARGILEAVYWKPGITWVIDRIHVLNPIHFTAIRRNELGGKIPYGNIKSAMKGGTPPPLFIEEDRQQRAALVLYKVAYVIEAHFELTGQDDNAAKHTEMFKRRARKGQCFNQPYLGCREFPAFFELLDGPAPASALADQDRDKDLGFMLHDIDFAHDMTPKFFRARLAGGIIDVPRFEAAEVRA

SEQ ID NO: 2559 - protein, 222 aa, Thiothrix nivea DSM 5205
MQTFCLEVSGDFACFTRPEMKVERVSYDVITPSAARAVFEAILWKPAIRWQVRRIEVLKPIRWINLRRNEVGGVVPAGAVKSAMKHGKGQLSLYVEEERQQRAGLFLRDVRYRLHADFEMLDNNSANNPVKFAEMFKRRASKGQCFNQPYLGTREFSCDFRLVEDAENIEIPAELQGRRELGWMLYDMDFTDANNPMPRFFQASMDDGVIQVPAWDSEEVRG

SEQ ID NO: 2560 - protein, 244 aa, Pasteurella bettyae CCUG 2042
MNSKFTFRVWGRQALFTDPITKIGGEKFSYQVPTYEALKGILKSIYWKPTLIWHIDRVRIMKPIQTQSKSTKPLEWNGGNTLAIYTFLQDVEYQVEAHFTWNEYREELKADRNLGKHMAIARRMLERGGRQDIFLGTRDCQGYVEPCEFDDLSRDGNKGFYDDINNLDFGLMFHSFGYPDEIGENKLVTRFWNANMQRGIITFPSTTDNEKLKTRFIRNMKPEKVFNQEQNINSVENETKELGL

SEQ ID NO: 2561 - protein, 224 aa, Haemophilus haemolyticus HK386
MNQIRLHVWGDYACFTRPEMKVERVSYDVITPSAARGILAAVHWKPAIRWVIDKIYVLKPIRFESVRRNELGGKISAGKVSGAMKRKSVADLYTLIEDDRQQRAATVLKDVAYVIEAHAVLTPKAGADETVTKHIEMFKRRAKKGQCFQQPCLGVREFPADFALIDEGEPLPPSDLSESEANRDLGWMLHDIDFDHGNTPHFFRAQMKDGVIDVPPFYAEEVKA

SEQ ID NO: 2562 - protein, 238 aa, Bacillus methanolicus PB1
MRNAIEFEVFGKYALFTDPLTKMGGEKLSYQVPTYQALKGIVESIYWKPTLLMIVDAVRVMNPIRMESKGIRPIEYGGGNTLAHYTYLKDVRYQVKAHFIFNPHRPDLAFDRNEKKHHNILKRSLKAGGRRDIFLGTRECQAYVEPCKFGEGEGFYDQYEEIHFGTMVHGINYPDETARNEMEVRLWNPVMKNGVIQFIRPDECIQIRKITDMEPKHFDETNVESADELLSKIEKGGD

SEQ ID NO: 2563 - protein, 242 aa, Streptococcus pyogenes HKU QMH11M0907901; identical to SEQ ID NO: 2384

SEQ ID NO: 2564 - protein, 233 aa, Opitutaceae bacterium TAV1
MSYGIKLHVWGDYALFSRPEMKVERVSYDVITPSAARGVLEAIYWKPQIRWVIDRIHVLKPVQFTSVRRNELASKASAATAKSAMRSGAGSLGIAIEDDRQQRAALLLRDIGYVIEAHFDLLPATEDGPEAGRVGKHLDMFKRRARAGQCFQQPYFGCREFPVSFVLLENDAPLPVCTLAPADRDKDFGFMLHDILFDQDAKTKAVRSTSPRFFRAVMKNGIIDVPSLQLAHA

SEQ ID NO: 2565 - protein, 242 aa, Streptococcus canis FSL Z3-227
MYRSRDFYVRVSGQRALFTNPATKGGSERSSYSVPTRQALNGIIDAIYYKPTFTNIVTEVKIINQIQTELQGVRALLHDYSADLSYVSYLSDVVYLIKFHFVWNEDRKDLNSDRLPAKHEAIMERSIRKGGRRDIFLGTRECVGLVDDISQEEYEAAVSYYNGVNIDLGIMFHSFAYPKDKKTPLQSYFTKTVMENGVIMFKAQSECDIVNTLSSYAFKAPEEIKSVNDEYMEYDNMEKGEN

SEQ ID NO: 2566 - protein, 239 aa, Fictibacillus macauensis ZFHKF-1
MRNAIEFEVFGDYALFTDPLTKLGGEKLSYSVPTYQALKGIVESIYWKPTLIMIVDEVRIMKPIMMESKGVRPIEYGGGNTLANYTYLRDVHYQVKAHFIFNMNRPEMAFDRNEHKHHNIMKRSLKAGGRRDIFLGTRECQGYVEPCEFGSGQGFYDHYPEIPLGTMVHGFNYPDETGRDTLEIRLWNPVMKNGVVSFITPEECDKVRSISSMEAKTFDTSNTQSADELLELLERGSEW

SEQ ID NO: 2567 - protein, 239 aa, Parascardovia denticolens IPLA 20019
MQKHRNSIEFTISGRYALFSEAATRVGGEKFSYLVPTYQALKGMVESVYWKPTIIWVIDAVRVMNRIQTESKGIRPIKYNGGNDLSYYTYLKDVKYQILAHFEWNCQRTELAGDRDENKHHQIALRSVGKGGRRDVFLGTRECQGYVEPCVFGEGSGFYDSYGEWSLGYMFHSFSYPDENADHDFLARFWSPVMKDGIIEFPRPESQQLDSRIIRSHEKIEMKEFTIGKNMHRVAEDEK

SEQ ID NO: 2568 - protein, 238 aa, Pelosinus fermentans B4
MENKVQFKVYGKYALFTDPLTKIGGEKCSYQIPTYQALKGIMESVYWKPTIVWIIDKVRIMKSIRTQTRSAKPINYGGGNSLAIYTYLSDVEYQVQAHFEWNLNREDMVKDRNENKHFFVAKRMIERGGRRDIFLGTRECQGYVESCDFGEGEGFYDSYGELAFDLMFHGFDYPDELGENKLQARFWRPKLVNGIVEFNRPEECINKFVKLMMAAPPISIGLQEEGILEGYSQEEALQ

SEQ ID NO: 2569 - protein, 238 aa, Pelosinus fermentans A11; identical to SEQ ID NO: 2568

SEQ ID NO: 2570 - protein, 238 aa, Pelosinus fermentans A12; identical to SEQ ID NO: 2568

SEQ ID NO: 2571 - protein, 238 aa, Pelosinus fermentans DSM 17108; identical to SEQ ID NO: 2568

SEQ ID NO: 2572 - protein, 238 aa, Pelosinus fermentans B3; identical to SEQ ID NO: 2568

SEQ ID NO: 2573 - protein, 224 aa, Bacteroides cellulosilyticus CL02T12C19
MEYFDKEYCLEVWGDMACFTRPELKVERVSYDVITPSAARAVFESIFWKDAIRWEVTKIEVLNPIKWTAIRRNEVGAVAGKNIKSIYIEEKRQQKNALLLKDVRYRIYAKLIFIPVRDRKNMKHDPGSDENPGKYNAMFERRAAKGQCFNQPYLGTREFAASFRLIDKNAGDLRPAIDENRDFGIMLYDMDFSDIKNVQPMFYRAKMVQGVIMVPAYNSEEILR

SEQ ID NO: 2574 - protein, 243 aa, Clostridium sp. MSTE9
MQHKNIVEFEVFGDYALFSDPITRVGGEKFTYQVPTYEALKGVLQSVFWKPTLIWVIDSVRVMNQIQTETKGIRPIKYQHGPNETGNDLSYYTYLKDCRYQVRAHFIWNENRPELQGDRNENKHHNIAKRMIERGGRRDIFLGTRECQADVRPCIFGAGTGFYDNTLQLDFGMMYHGITYADEAYSEETKGMLTVRLWRAVMKQGVIDFLPPQECLHRPVREMEIKPFGAEKNNFASIESEVI

SEQ ID NO: 2575 - protein, 236 aa, Methanofollis liminatans DSM 4140
MKIHCSLFKEVIAIGFGIKLKVWGDYACFTRPEMKVERVSYDVITPSAARGILEAIYWKPAISWKIDKIHVLNPIRFDNIRRNERPGKISAANVKKAFKGEDVALYQDSTEDTVQRASLVLRDVCYVIEAHFEMTDRAGPDDTVEKHYNIALRRMRKGQCFHHPYFGCREFPTQFEFIEGEVPVSCYRGEKGGERDLGFMLYDIDFSDETKAIFFRASMVDGVIDVQKCLCYGGVS

SEQ ID NO: 2576 - protein, 239 aa, Brevibacillus sp. CF112
MRNAIEFEVFGQYALFTDPLTKLGGEKLSYQLPTYQALKGVVESIYWKPTLLMIVDEVRIMNPIRMESKGVRPIEYGGGNTLANYTYLRDVRYQVRAHFEFNLNRPDLAYDRNEHKHHNILKRSLQAGGRRDIFLGTRECQAYVEPCVFGEGDGFYDNYGEIHLGTMVHGINYPDETGRNQMEVRLWNPVMKNGIIRFPRPEECPQIRTVASMKPKHFDSANLLSVDDLFAELEEVDNR

SEQ ID NO: 2577 - protein, 245 aa, Lactobacillus coryniformis subsp. coryniformis CECT 5711
MTSMRNQVAYCVNGPYALFTDPLSKAGGEKLSYQIPSYQALIGITESIYWKPTITYVIDEVRVMKPIQMESKGIRPMDYNNSAKADLASYTYLKDVCYQVKVHFIFNENRPDLKADRNENKHYQILKRSIKAGGRRDIFLGTRECQAYVEPCEFGSGTGYYDDYVGEYHFGTMVHGLNYPDETGKNELAVRLWQPVMQKGIIKFLTPEDCPVVHRLKSMDPKRFTMADIESVDVLYQELEAGEGK

SEQ ID NO: 2578 - protein, 239 aa, Selenomonas sp. FOBRC6
MRNSIEFQVYGRMALFTDPITKIGGERSSYSVPTYQALKGITESIYWKPTIYWVIDEVRVMNRITTQSRGMKPMKYGGGGNDLSIYKYLSDVCYQVRAHFEFNLHRKELAADRDEHKHHNIAKRMVERGGRRDIFLGTRECQGYVEPVTYGEGAGYYDASGEMPLGTMFHGFNYVDETGGSMLQVRLWQPVMENGIIRFPRPEECSLVRDIRKVGSKMFDKNSVTFAAEEWEQMEGGSI

SEQ ID NO: 2579 - protein, 229 aa, Leptospira kirschneri serovar Grippotyphosa str. RM52
MKESKIFQLKVWGENACFTRPEMKAERVSYDVITPSAARAIFDAILWKPAILWIIHKIDILKPILWESVRRNELGSKIAPQNITQTMEAGTGNLALYIEEERQQRAGLFLKDVSYILHASFKLTKRAGDGDSITKFEEMFKRRAEKGQCHHQPYFGNREFAAYFSLNDQTEKLIKIEQQDLGWMLYDLDFEDYDFDTKSYKDASPKFFRAEIQNGSIVIPDLNTNGARL

SEQ ID NO: 2580 - protein, 229 aa, Leptospira interrogans serovar Pomona str. Kennewicki LC82-25
MKESQIFQLKVSGENACFTRPEMKAERVSYDVITPSAARAIFDAILWKPAILWIIHKIDILKPILWESIRRNELGSKIAPQNIMQTMEAGTGNLALYIEEERQQRAGLFLKDVSYILHASFKLTKRAGDGDSITKFEEMFKRRAEKGQCHHQPYFGSREFAAYFSLNDQSEKPIKIEQQDLGWMLYDLDFEDYNFDTKSYKDANPKFFRAVIQNGSIVIPDLNTNGARL

SEQ ID NO: 2581 - protein, 234 aa, Leptospira interrogans serovar Bulgarica str. Mallika
METKSMKESQIFQLKVSGENACFTRPEMKAERVSYDVITPSAARAIFDAILWKPAILWIIHKIDILKPILWESIRRNELGSKIAPQNIMQTMEAGTGNLALYIEEERQQRAGLFLKDVSYILHASFKLTKRARDGDSITKFEEMFKRRAEKGQCHHQPYFGSREFAAYFSLNDQSEKPIKIEQQDLGWMLYDLDFEDYNFDTKSYKDANPKFFRAVIQNGSIVIPDLNTNGARL

SEQ ID NO: 2582 - protein, 234 aa, Leptospira interrogans str. FPW2026; identical to SEQ ID NO: 2581

SEQ ID NO: 2583 - protein, 240 aa, Selenomonas sp. FOBRC9
MMRNGIEFQVYGRMALFTDPITKIGGERSSYSVPTYQALKGITESIYWKPTIFWVIDEVRVMHRIATQSRGVKPLKYGGGGNDLSVYKYLSDVCYQVRAHFEFNTHRKELAGDRDEHKHHNIAKRMVERGGRRDIFLGTRECQGYVEPVTYGEGEGYYDHAGEMPLGTMFHGFNYADETGGNMLQVRLWQPMMKDGILRFPRPEECTLVRDVRKVTTKLFDKSSVTFAEEELKELEGGRL

SEQ ID NO: 2584 - protein, 239 aa, Bacillus cereus VD142
MRNSIEFELFGNYALFTDPLMKMGGEKLSYQVPTYQAIKGITESIYWKPTLLMVVDKIRIMNAIKMESKGIRPIEYGGGNTLANYTYLKDVRYQVKAYFIFNPHRPDLAFDRNEFKHHNILKRSLKAGGRRDIFLGTRECQGYVEPCVFGEDKGFYDNYGGDIHLGTMVHGLNYPDETGRNQLEVRLWNPVIRDGIIQFIRPEECSQIRKISRMEPKVFDRSNVESVDELIKQLEVGGE

SEQ ID NO: 2585 - protein, 239 aa, Bacillus cereus VD048
MRNSIEFEVFGDYALFTDPLMKMGGEKLTYQVPTYQAIKGIVESIYWKPTLLMIVDKIRIMNAIKMESKGIRPIEYGGGNTLANYTYLKNVRYQVQAHFIFNPHRPDLAFDRNEFKHHNILKRSLKVGGRRDIFLGTRECQGYVEPCVFGEGKGFYDNYGGDIHLGTMVHGLNYPDETGRNELEVRLWNPVMRDGIIQFIRPEECTQVRKISKMEPKVFDRSNVESVEELIKQLEKGGE

SEQ ID NO: 2586 - protein, 239 aa, Bacillus cereus VD115
MRNSIEFEVFGDYALFTDPLMKMGGEKLTYQVPTYQAMKGIVESIYWKPTLLMIVDKIRIMNAIKMESKGIRPIEYGGGNTLANYTYLKNVRYQVQAHFIFNPHRPDLAFDRNEFKHHNILKRSLKVGGRRDIFLGTRECQGYVEPCVFGEGKGFYDNYGGDIHLGTMVHGLNYPDETGRSALEVRLWNPVIKDGIIQFIRPEECTQVRKISKMEPKVFDCSNVESVEELIKQLEVGDE

SEQ ID NO: 2587 - protein, 239 aa, Bacillus cereus VD156
MRNSIEFEVFGDYALFTDPLMKMGGEKLTYQVPTYQAIKGIVESIYWKPTLLMIVDKIRIMNAIKMESKGIRPIEYGGGNTLANYTYLKNVRYQVQAHFIFNPHRPDLAYDRNEYKHHNILKRSLKVGGRRDIFLGTRECQGYVEPCVFGEGEGFYDNYGGDIHLGTMVHGLNYPDETGRNELEVRLWNPVMRDGIIQFIRPEECTKIRKISKMEPKIFDSSNVESVDELIKQLEEGGE

SEQ ID NO: 2588 - protein, 239 aa, Bacillus cereus VD169; identical to SEQ ID NO: 2587

SEQ ID NO: 2589 - protein, 239 aa, Bacillus alcalophilus ATCC 27647
MRNSIEFVLWGDYALFTDPLMKLGGEKMTYQVPTYQALKGIVESIYWKPTIVWYIDELRIMNPIKMESKGIRPIEYSGGNTLANYTYLQKPRYHVKAYFDFNFHRPDLAFDRNENKHHNIAKRALKVGGRRDIFLGARECQGYVEPHPFNEGEGFYDDYGEIHLGPMVHGINYPDEIGRDEMEVRLWSPVIKNGVIKFILPEQCPQVRSLGQMEAKHFDQSNVQSVEELSKVLEGEMSE

SEQ ID NO: 2590 - protein, 229 aa, Porphyromonas sp. oral taxon 279 str. F0450
MDKTNPKLYCLEIRGDFACFTRPELKVERVSYDVITPSAARNIFQCIFWKPAIQWHIRRIEVLKPIRRTSIRRNEVGSTMSPKATKPLFIEENRQQRTAYILRDVAYRIYAEMEFIPLEKRTKKQKEECKDPKAETPEKYDAIFLERATKGQCFTQPYLGCREFTCSFEYIPRGQKQDLPIDESRDLGIMLFDMDFEKNLQCPPPLFFHAQMEHGVIDVPHKSSKEILR

SEQ ID NO: 2591 - protein, 218 aa, Selenomonas sp. CM52
MAYGVRLEVWGEAACFTRPELKAERFSYAVMTPSAARGVLEAVFWHPGLKWRIDRIFILSGIQFTNVRRNELKAKIPARTVKAFAEKERGELYQSTKEDIQQRAATILKEPHYIIEAHFEMTEKASASDNEGKFREMFCRRARKGQCYHAPYLGCREFPACFRLYEEAELPPTNGETKDLGFMLYDIDYSDPKNLQPMFFQAQLVDGVLDLRDCEVYR

SEQ ID NO: 2592 - protein, 239 aa, Bacillus cereus HuA2-1; identical to SEQ ID NO: 2584

SEQ ID NO: 2593 - protein, 239 aa, Paenibacillus alvei DSM 29
MRNSIEFEVYGNYALFTDPLTKLGGEKLSYQVPTYQALKGIVESIYWKPTLLFIVDAVRVMNPIRMESKGIRPIDYGGGNTLANYTYLKDVRYQCRAHFIFNPHRPDLEYDRNEHKHHNILKRSLQAGGRRDIFLGSRECQGYVEPCVFGEGESFYNNYGDIYLGTMVHGINYPDETGRRQMETRLWNPVMRNGIIEFIAPDNCTQVRTIADMEPKQFTSGNMESVDDLFAQMEAGEAR

SEQ ID NO: 2594 - protein, 241 aa, bacterium
MEKENKVAFKVYGKYALFTDPLTKLGGEKCSYHIPTYEALKGVLSSVYWKPTIVWIIDKLRIMKRIRTQTKSVKPLEYGGGNSLAIYTYLSDVEYQVEAHFEWNLKRTDQEKDRNENKHFFVAKRMIEKGGRRDIFLGTRECQAYVEPCRFGEEKSEYDNYGEIAYDLMFHGFDYPDELGKNEFWARFWRPKMINGVITFIRPEECAIKKFVRSMKANPPESIGLDEEGLLEGYEEQEVLQ

SEQ ID NO: 2595 - protein, 234 aa, Salimicrobium jeotgali
MRNEIEFEVHGKYALFTDPLTKIGGEKLSYNVPTYEALKGITESIYWKPTLTFIIDDLRIMKSISMESKGVRPIQYHGGNTLANYTYLRDVRYQVRAHFEFNASRPELYHDYNEGKHFSILHRALNAGGRRDIFLGARECQGYVEPCKFGEGAGAYDNQEEYHLGTMVHGINYPSDIEKDEMQVRLWNPVMKNGIISFQRPEECRNVRKIRDMKRKEFDETNMTSVDDLFEQLK

SEQ ID NO: 2596 - protein, 219 aa, Oceaniovalibus guishaninsula JLT2003
MTAPGIRLLVRGRNACFTRPEMKVERVSYNVMTPSAARGILEAIHWKPAIAWVVDRIHVLRPIRFEAIRRNEVASKIPANKARAAMKAGDLGGLALAVDEDRQQRAMLCLADVAYGIEAHFEMTARAGPQDNPGKHAEMFRRRAEKGQCFHQPCLGVREFPADFELVEDFPEAIAEDRDLGWMLHDIDYANGRRSVFYRARMEGGVIDVVRCLAEGRMA

SEQ ID NO: 2597 - protein, 240 aa, Bacillus xiamenensis
MRNSISFRLYGNYALFTDPLTKMGGEKYSYHIPTYQALKGIVESIYWKPTLLMVVDKIRVMKPIKMESKGVRPIEYGRDKNTLAYYTYLQDVEYQVQAHFEFNLHRSDLAFDRNEHKHHNILKRALNVGGRRDIFLGTRECQGYVEPCEFGEGKGYYDDYGDIHFGTMVHGLNYPDETGGQHLEVRLWNPVMTDGYIQFIRPEECQLVRRVKQMGVKQFDRDHIESVEELLTHIKGEMGS

SEQ ID NO: 2598 - protein, 226 aa, Acidocella sp. MX-AZ02
MSYGIRLHVWGQYACFTRPEMKVERVSYDVMTPSAARGILEAIHWKPALRWHVDRIHVLKPISFQTIRRNEVNDKISESTARSAMKRRDLKGVWLSAGGGIGTQRSTTLLRDAAYVIEAHFSLTDKAGAEDTEAKHISMFNRRAASGQCFHRPCLGTREFAADFALIQDGAPMPASTLPVADQNRDLGWMLHDIDFVNGNTSRFFRARLEEGVLDVAKLAAEGMVA

SEQ ID NO: 2599 - protein, 226 aa, Parabacteroides goldsteinii CL02T12C30
MVYTNKEYCLEVKGNMACFTRPEMKVERVSYDVITPSAARAIFEAIFWKPAIRWNITRIEVLNPIKWFSFKRNEVGNLMSPRASGLFIEDNRQQKSSLLLKDVCYRIFAELEFIPIRNRTEEDKSKATAGSSDENPGKYNAMFERRAKKGQCFNQPYLGCREFSADFTYIENPVKGNGIPEDRDLGYMLYDMDFTNEKDPKPMFFRAIMKQGVLVVPSINSEEVRR

SEQ ID NO: 2600 - protein, 226 aa, Parabacteroides merdae CL09T00C40; identical to SEQ ID NO: 2488

SEQ ID NO: 2601 - protein, 240 aa, Bacillus azotoformans LMG 9581
MRNAIEFEVYGKYALFTDPLTKMGGEKLSYQVPTYQALKGIVESIYWKPTLLMVVDEVRIMEAIRMESKGIRPIEYGGGNTLANYTYLKDVRYQVRAHFIFNPHRPDMAFDRNEHKHHNILVRSLNAGGRRDTFLGTRECQAYVEPCVFGEDKGFYDNYDGEIHFGTMVHGINYPDETGRNEMEVRLWNPVMKNGIIQFIRPDQCTQIRKINYMNPKHFDDSNVEAVENLLNMLEEGGNQ

SEQ ID NO: 2602 - protein, 229 aa, Leptospira interrogans str. 2002000624
MKESQIFQLKVSGENACFTRPEMKAERVSYDVITPSAARAIFDAILWKPAILWIIHKIDILKPILWESIRRNELGSKIAPQNIMQTMEAGTGNLALYIEEERQQRAGLFLKDVSYILHASFKLTKRARDGDSITKFEEMFKRRAEKGQCHHQPYFGSREFAAYFSLNDQTEKPIKIEQQDLGWMLYDLDFEDYNFDTKSYKDANPKFFRAVIQNGSIVIPDLNTNGARL

SEQ ID NO: 2603 - protein, 234 aa, Leptospira interrogans serovar Pomona str. Pomona
METKSMKESQIFQLKVSGENACFTRPEMKAERVSYDVITPSAARAIFDAILWKPAILWIIHKIDILKPILWESIRRNELGSKIAPQNIMQTMEAGTGNLALYIEEERQQRAGLFLKDVSYILHASFKLTKRAGDGDSITKFEEMFKRRAEKGQCHHQPYFGSREFAAYFSLNDQSEKPIKIEQQDLGWMLYDLDFEDYNFDTKSYKDANPKFFRAVIQNGSIVIPDLNTNGARL

SEQ ID NO: 2604 - protein, 229 aa, Leptospira interrogans str. C10069; identical to SEQ ID NO: 2602

SEQ ID NO: 2605 - protein, 229 aa, Leptospira kirschneri str. H1
MKESKIFQLKVWGENACFTRPEMKAERVSYDVITPSAARAIFDAILWKPAILWVIHKIDILKPILWESVRRNELGSKIAPQNITQTMEAGTGNLALYIEEERQQRAGLFLKDVSYILHASFKLTKRAGDGDSITKFEEMFKRRAEKGQCHHQPYFGNREFAAYFSLNDQTEKLIKIEQQDLGWMLYDLDFEDYDFDTKSYKDASPKFFRAEIQNGSIVIPDLNTNGARL

SEQ ID NO: 2606 - protein, 234 aa, Leptospira interrogans str. UI 12621; identical to SEQ ID NO: 2581

SEQ ID NO: 2607 - protein, 234 aa, Leptospira kirschneri str. 200802841
METKSMKESKIFQLKVWGENACFTRPEMKAERVSYDVITPSAARAIFDAILWKPAILWIIHKIDILKPILWESVRRNELGSKIAPQNITQTMEAGTGNLALYIEEERQQRAGLFLKDVSYILHASFKLTKRAGDGDSITKFEEMFKRRAEKGQCHHQPYFGNREFAAYFSLNDQTEKLIKIEQQDLGWMLYDLDFEDYDFDTKSYKDASPKFFRAEIQNGSIVIPDLNTNGARL

SEQ ID NO: 2608 - protein, 234 aa, Leptospira kirschneri str. H2
METKSMKESKIFQLKVWGENACFTRPEMKAERVSYDVITPSAARAIFDAILWKPAILWVIHKIDILKPILWESVRRNELGSKIAPQNITQTMEAGTGNLALYIEEERQQRAGLFLKDVSYILHASFKLTKRAGDGDSITKFEEMFKRRAEKGQCHHQPYFGNREFAAYFSLNDQTEKLIKIEQQDLGWMLYDLDFEDYDFDTKSYKDASPKFFRAEIQNGSIVIPDLNTNGARL

SEQ ID NO: 2609 - protein, 234 aa, Leptospira interrogans serovar Canicola str. Fiocruz LV133; identical to SEQ ID NO: 2603

SEQ ID NO: 2610 - protein, 234 aa, Leptospira interrogans serovar Grippotyphosa str. Andaman; identical to SEQ ID NO: 2581

SEQ ID NO: 2611 - protein, 234 aa, Leptospira interrogans str. Brem 329; identical to SEQ ID NO: 2373

SEQ ID NO: 2612 - protein, 228 aa, Leptospira kirschneri str. 2008720114
METKSMKESKIFQLKVWGENACFTRPEMKAERVSYDVITPSAARAIFDAILWIIHKIDILKPILWESVRRNELGSKIAPQNITQTMEAGTGNLALYIEEERQQRAGLFLKDVSYILHASFKLTKRAGDGDSITKFEEMFKRRAEKGQCHHQPYFGNREFAAYFSLNDQTEKLIKIEQQDLGWMLYDLDFEDYDFDTKSYKDASPKFFRAEIQNGSIVIPDLNTNGARL

SEQ ID NO: 2613 - protein, 234 aa, Leptospira interrogans serovar Icterohaemorrhagiae str. Verdun LP; identical to SEQ ID NO: 2373

SEQ ID NO: 2614 - protein, 234 aa, Leptospira interrogans str. HAI1594; identical to SEQ ID NO: 2373

SEQ ID NO: 2615 - protein, 234 aa, Leptospira interrogans serovar Grippotyphosa str. 2006006986; identical to SEQ ID NO: 2581

SEQ ID NO: 2616 - protein, 231 aa, Thermaerobacter subterraneus DSM 13965
MGFTSSTVRVRVWGEYACFTRPEFKVERVSYPVMTPSAARGLLEAIFWKPEFRYEIRRIGVVKPGKQMVILRNELGERQGRKPYYVEDHRQQRSTLLLKDVDYIIEAEMKLRPHASDPVIKYVEQFQRRVERGQYHHTPYLGTREFAAHFAPVNGEAPAPFNLTIGTMLFDIAFVEDPNRAELEFKRPGRAEPVKGYAMALFFEAEVKHGWLAIPRERYLELYRLEEGQRV

SEQ ID NO: 2617 - protein, 234 aa, Leptospira interrogans str. 2002000621; identical to SEQ ID NO: 2373

SEQ ID NO: 2618 - protein, 229 aa, Leptospira interrogans str. 2002000623; identical to SEQ ID NO: 2602

SEQ ID NO: 2619 - protein, 228 aa, Leptospira kirschneri serovar Grippotyphosa str. Moskva; identical to SEQ ID NO: 2612

SEQ ID NO: 2620 - protein, 223 aa, Leptospira kirschneri serovar Valbuzzi str. 200702274
MKESKIFQLKVWGENACFTRPEMKAERVSYDVITPSAARAIFDAILWIIHKIDILKPILWESVRRNELGSKIAPQNITQTMEAGTGNLALYIEEERQQRAGLFLKDVSYILHASFKLTKRAGDGDSITKFEEMFKRRAEKGQCHHQPYFGNREFAAYFSLNDQTEKLIKIEQQDLGWMLYDLDFEDYDFDTKSYKDASPKFFRAEIQNGSIVIPDLNTNGARL

SEQ ID NO: 2621 - protein, 234 aa, Leptospira interrogans serovar Pyrogenes str. 2006006960; identical to SEQ ID NO: 2581

SEQ ID NO: 2622 - protein, 234 aa, Leptospira interrogans serovar Bataviae str. L1111; identical to SEQ ID NO: 2581

SEQ ID NO: 2623 - protein, 234 aa, Leptospira interrogans serovar Hebdomadis str. R499; identical to SEQ ID NO: 2603

SEQ ID NO: 2624 - protein, 229 aa, Leptospira interrogans serovar Grippotyphosa str. UI 08368; identical to SEQ ID NO: 2580

SEQ ID NO: 2625 - protein, 234 aa, Leptospira interrogans str. UI 12758; identical to SEQ ID NO: 2581

SEQ ID NO: 2626 - protein, 229 aa, Leptospira noguchii str. 2006001870
MKESKIFQLKVWGENACFTRPEMKAERVSYDVITPSAARAIFDAILWKPAILWIIHKIDILNPIRWESVRRNELGSKIAPQNITQTMEAGTGNLALYIEEERQQRAGLFLKDVSYILHASFKLTKRAGDGDSITKFEEMFKRRAEKGQCHHQPYFGNREFAAYFSLNDQTEKPIKIVQQDLGWMLYDLDFEDYDFDSKSYKDASPKFFRAEIQNGSITIPDLNTNGARL

SEQ ID NO: 2627 - protein, 234 aa, Leptospira interrogans str. UI 08452; identical to SEQ ID NO: 2603

SEQ ID NO: 2628 - protein, 234 aa, Providencia burhodogranariea DSM 19968
MKNSISFRLWGRYALFTDPITRIGGEKCSYHLPTYEAIKGVLKSIYWKPTLIWYVDRVRVIKPLQTQTKGTKPINWNGGNSLAYYTFLHDVEYQIEAHFEWNEHRPELAKDRVDGKHFSIAKRMLEKGGRQDIFLGTRDCQGYVEPCEFGSGSGAYDHIDELGFGLMFHGFDYPDETGKNELSARFWRAEMRNGIIEYPTPSHCEVNRFIRDMTAKTFELDVNQQSVDQTEGML

SEQ ID NO: 2629 - protein, 224 aa, Xanthomonas translucens pv. graminis ART-Xtg29
MSYGIRLHIWGERALFTRPEMKVERVSYDIITPSAARGILEAIHWKPAIRWVVDHFQVLKPIRFESIRRNEVGSKLSAASVTKAIKAGRTDTLVSYVEEDRQQRAATLLRDVGYVITAHFELTDKAGSDDNVGKHLDIFNRRARRGQCFQAPCLGTREFPASFALIEDDAAVPATDPALAGERDLGWMLHDIDFTDGMTPRFFRARMVDGRVEVPAPEDGGVRA

SEQ ID NO: 2630 - protein, 240 aa, Selenomonas sp. F0473
MMRNGIEFQVYGRMALFTDPITKIGGERSSYSVPTYQALKGITESIYWKPTIFWVIDEVRVMHRIATQSRGVKPLKYGGGGNDLSVYKYLSDVCYQVRAHFEFNTHRKELAGDRDEHKHHNIAKRMVERGGRRDIFLGTRECQGYVEPVAYGSGEGYYDHAGEMPLGTMFHGFNYADETGGNMLQVRLWQPIMKDGVLCFPRPEECTLVRDVRKVTTKLFDKNSVTFAEQELKELEGGRL

SEQ ID NO: 2631 - protein, 224 aa, Bacteroides oleiciplenus YIT 12058
MEYFDKEYCLEVWGDMACFTRPELKVERVSYDVITPSAARAVFESIFWKDAIRWEVTKIEVLNPIKWTAIRRNEVGAVAGKNIKSIYIEEKRQQKNALLLKDVRYRIYAKLIFIPVRDRKNMKHDPGFDENPGKYNAMFERRAAKGQCFNQPYLGTREFAASFRLIDKNAEDLRPAIDENRDFGIMLYDMDFSDIKNVQPMFYRAKMVQGAIMVPAYNSEEILR

SEQ ID NO: 2632 - protein, 237 aa, Prevotella sp. oral taxon 473 str. F0040
MINSNRKTFCLEIRGDFACFTRPELKVERVSYDVPTPSALRNIFSAIFWKPSMRWHIRRIEVLHPINRTSIKRNEVGSKMGKNPIYADDPKNRQQRTSYILRDVAYRVFADLEFIPLENRPKWLQQECKDSAAETPMKYFEMFERRASKGQCFMQPYLGCREFSCSFELLPQQPEGHGIEETRDLGIMLYDLDYIYESPTNPKEKKKEKSPNPLFFDAKMEHGVIVVPDYNSEEVLR

SEQ ID NO: 2633 - protein, 224 aa, Aggregatibacter actinomycetemcomitans Y4
MNQIRLHIWGDYACFTRPEMKVERVSYDVMTPSAARGILAAVHWKPAIRWVIDKIYVLKPIRFESVRRNELGGKISAGKVGGAMKRKSVADLYTLIEEDRQQRAATVLKDVAYVIEAHAVLTAKAGAEDNITKHIEMFKRRARKGQCFQQPCMGMREFPANFALIDEGEPLPESALSADERHRDLGWMLHDIDFDHGNTPRFFRAEMEDGVIDVPPFYAEGVKA

SEQ ID NO: 2634 - protein, 240 aa, Selenomonas sp. oral taxon 138 str. F0429
MRNSIEFQVYGRMALFTDPITKVGGERSSYSVPTYQALKGITESIYWKPTFYWVVDEVRVMNRIATQSRGVKPMKYGGGGNDLSIYKYLSDVCYQVRAHFEFNLHRKELVEDRDEHKHHNIAKRMVERGGRRDIFLGTRECQGYVEPVRYGEGKGYYDDSGEMPLGTMFHGFNYVDETGGSMLQVRLWQPVMEHGIIHFPRPEQCTLVRDIRKVESKLFDKNSVTFAAEEHELMGEEGSL

SEQ ID NO: 2635 - protein, 244 aa, Neisseria sp. oral taxon 020 str. F0370
MDNKISFRVWGRQALFTDPVTKIGGEKFSYQVPTYEAIKGILKSIYWKPTLIWHIDRIRVVKPIRTQSKSTKPRQWESLKGNHHTLAIYTFLQDVEYQVEAHFTWNENWEELAPDRIAGKHIAIARRMLERGGRQDIFLGTRDCQGYVEPCEFRSGEGFYDGIDNLDFGLMFHSFGYPEETGKPELVGRFWQAKMEYGVIEFPSVNDTTGRLKSRFIRKMQPEKPFKRGENLKAVENEAQELGL

SEQ ID NO: 2636 - protein, 239 aa, Brevibacillus agri BAB-2500; identical to SEQ ID NO: 2576

SEQ ID NO: 2637 - protein, 224 aa, Xanthomonas translucens DAR61454
MSYGIRLHIWGERALFTRPEMKVERVSYDIITPSAARGILEAIHWKPAIRWVVDGIQVLKPIRFESIRRNEVGSKLSAASVTKGIKAGRTDTLVSYVEEDRQQRAATLLRDVGYVIAAHFELTDKAGADDNVGKHLDIFNRRARRGQCFQTPCLGTREFPASFALIEDDAAVPATDPALAGERDLGWMLHDIDFTDGMTPRFFRARMVDGRVEVPAPEDGGVRA

SEQ ID NO: 2638 - protein, 244 aa, Photobacterium marinum
MKTTPKNSISFRVWGRYALFTDPVTKIGGEKCSYHVPTYEALKGILKSVYWKPTFTWVIDRVRIIKPIRTQTKGTKPLVWGGGNSLAIYTFLHDVEYQVEAHFEWNEHRPKLAKDRIDGKHFAIARRMLEKGGRQDIFLGTRDCQGYVEPCEFGAGESAYDNLDELGFGLMFHGFGYPDETGGKNLESRFWYPVMREGIIEFASPSQFDGQDPMLVKRTVRPMTAKEFNLDDNLKAVEQEEGEL

SEQ ID NO: 2639 - protein, 247 aa, Streptococcus mutans NLML8
MYRSRNFYARIRGDRALFTNPATKGGSERSSYSVPTRQALQGIIDGIYHKPTFTNVITEVKVVNQIQTELHGVRALLHDYSADLSYVSYLSDVEYLVKFHFIWNENREDLIQDRLPKKHEAIMERSIRKGGRRDIFLGTRECFGLVDEISQEEYETIPSYYNGVTIDLGIMFHSFAYPTSKDTPLKSYFTKTVMENGAIKFKPQSECEIVNTLSSYAFKSLGQLKSVDDEYVDDEYEEYEAMEKGEG

SEQ ID NO: 2640 - protein, 247 aa, Streptococcus mutans 1ID3; identical to SEQ ID NO: 2639

SEQ ID NO: 2641 - protein, 247 aa, Streptococcus mutans 8ID3; identical to SEQ ID NO: 2639

SEQ ID NO: 2642 - protein, 247 aa, Streptococcus mutans NFSM2; identical to SEQ ID NO: 2639

SEQ ID NO: 2643 - protein, 247 aa, Streptococcus mutans NVAB; identical to SEQ ID NO: 2639

SEQ ID NO: 2644 - protein, 247 aa, Streptococcus mutans A9; identical to SEQ ID NO: 2639

SEQ ID NO: 2645 - protein, 247 aa, Streptococcus mutans U138; identical to SEQ ID NO: 2639

SEQ ID NO: 2646 - protein, 247 aa, Streptococcus mutans A19; identical to SEQ ID NO: 2639

SEQ ID NO: 2647 - protein, 242 aa, Streptococcus mutans N34
MYRSRNFYAKIRGDRALFTNPATKGGSERSSYSVPTRQALQGIIDGIYHKPTFTNVITEVKVVNQIQTELHGVRALLHDYSADLSYVSYLSDVEYLVKFHFIWNENREDLIQDRLPKKHEAIMERSIQKGGRRDIFLGTRECFGLVDEISQEEYEIIPSYYDGVTIDLGIMFHSFAYPTSKDTPLKSYFAKTVMENGVIKFKPQSKCEIVNTLSSYAFKSPGQLKSVDDEYEEYEAMEKGEG

SEQ ID NO: 2648 - protein, 247 aa, Streptococcus mutans ST1; identical to SEQ ID NO: 2639

SEQ ID NO: 2649 - protein, 242 aa, Streptococcus mutans U2A
MYRSRNFYAKVRGQRALFTNPATKGGSERSSYSTPTRQALQGIIDAVYHKPTFTNVVTEVKVMNQIQTELHGVRALLHDYSADLSYVSYLSDVEYLVKFHFIWNKNREDLMQDRLPKKHEAIMERSIRKGGRRNVFLGTSECFGLVDEISQEEYENTPSYYDGVTIDLGIMFHSFAYPKDETTPLKSFFTKTVMENGAIKFKPQSECEIVNTLSSYAFKSLGQLKSVDDEYEEYEAMEKGEG

SEQ ID NO: 2650 - protein, 242 aa, Streptococcus mutans OMZ175; identical to SEQ ID NO: 2649

SEQ ID NO: 2651 - protein, 247 aa, Streptococcus mutans U2B; identical to SEQ ID NO: 2639

SEQ ID NO: 2652 - protein, 225 aa, Mannheimia haemolytica serotype 6 str. H23; identical to SEQ ID NO: 2486

SEQ ID NO: 2653 - protein, 234 aa, Leptospira interrogans serovar Pomona str. Fox 32256; identical to SEQ ID NO: 2603

SEQ ID NO: 2654 - protein, 234 aa, Leptospira interrogans serovar Lora str. TE 1992; identical to SEQ ID NO: 2581

SEQ ID NO: 2655 - protein, 234 aa, Leptospira interrogans serovar Canicola str. LT1962; identical to SEQ ID NO: 2373

SEQ ID NO: 2656 - protein, 234 aa, Leptospira interrogans serovar Grippotyphosa str. LT2186; identical to SEQ ID NO: 2603

SEQ ID NO: 2657 - protein, 234 aa, Leptospira interrogans serovar Copenhageni str. LT2050; identical to SEQ ID NO: 2373

SEQ ID NO: 2658 - protein, 223 aa, Rhodopirellula europaea SH398
MDLTKNRVALRVWGDLACFTRPEMKVERVSYDVITPSAARGVLEAIYWKPQIAWVIDRLHVLKPIRFTNIRRNELGGVGPSDRTLKPYLNGIKTEPLMQIIEDDRQQRAATLLQDVEYVIEAHYEVRSGNEPPQKHFEMFKRRASKGQCFQQPYLGCREFVADFSWQDEELPPTDESLKGKRDLGFMLHDIDFENAMTPRFFRATMTDGVIEVPRIQSEEVRS

SEQ ID NO: 2659 - protein, 229 aa, Leptospira interrogans serovar Pomona str. CSL10083; identical to SEQ ID NO: 2580

SEQ ID NO: 2660 - protein, 229 aa, Leptospira noguchii str. Bonito
MKESKIFQLKVWGENACFTRPEMKAERVSYDVITPSAARAIFDAILWKPAILWIIHKIDILNPIRWESVRRNELGSKIAPQNITQTMEAGTGNLALYIEEERQQRAGLFLKDVSYILHASFKLTKRAGDGDSITKFEEMFKRRAEKGQCHHQPYFGNREFAAYFSLNDQTEKPIKIEQQDLGWMLYDLDFEEYDFDSKSYKDASPKFFQAEIQNGSITIPDLNTNGARL

SEQ ID NO: 2661 - protein, 229 aa, [Leptospira interrogans str. FPW1039; identical to SEQ ID NO: 2580

SEQ ID NO: 2662 - protein, 234 aa, Leptospira interrogans str. UT126; identical to SEQ ID NO: 2603

SEQ ID NO: 2663 - protein, 234 aa, Leptospira interrogans serovar Valbuzzi str. Duyster
METKSMKESQIFQLKVSGENACFTRPEMKAERVSYDVITPSAARAIFDAILWKPAILWIIHKIDILKPILWESIRRNELGSKIAPQNIMQTMEAGTGNLALYIEEERQQRAGLFLKDVSYILHASFKLTKRAGDGDSITKFEEMFKRRAEKGQCHHQPYFGSREFAAYFSLNDQTEKPIKIEQQDLGWMLYDLDFEDYNFDTKSYKDANPKFFRAVIQNGSIVIPDLNTNGARL

SEQ ID NO: 2664 - protein, 229 aa, Leptospira interrogans serovar Pomona str. CSL4002; identical to SEQ ID NO: 2580

SEQ ID NO: 2665 - protein, 229 aa, Leptospira interrogans str. 2002000632; identical to SEQ ID NO: 2602

SEQ ID NO: 2666 - protein, 229 aa, Leptospira interrogans str. 2003000735; identical to SEQ ID NO: 2602

SEQ ID NO: 2667 - protein, 234 aa, Leptospira interrogans str. 2002000631; identical to SEQ ID NO: 2373

SEQ ID NO: 2668 - protein, 229 aa, Leptospira kirschneri str. JB; identical to SEQ ID NO: 2579

SEQ ID NO: 2669 - protein, 234 aa, Leptospira kirschneri str. MMD1493; identical to SEQ ID NO: 2607

SEQ ID NO: 2670 - protein, 234 aa, Leptospira kirschneri; identical to SEQ ID NO: 2607

SEQ ID NO: 2671 - protein, 234 aa, Leptospira kirschneri serovar Bim str. PUO 1247; identical to SEQ ID NO: 2607

SEQ ID NO: 2672 - protein, 234 aa, Leptospira interrogans str. Kito; identical to SEQ ID NO: 2603

SEQ ID NO: 2673 - protein, 234 aa, Leptospira kirschneri serovar Bulgarica str. Nikolaevo; identical to SEQ ID NO: 2608

SEQ ID NO: 2674 - protein, 229 aa, Leptospira interrogans str. 2006001854
MKESQIFQLKVSGENACFTRPEMKAERVSYDVITPSAARAIFDAILWKPAILWIIHKIDILKPILWESIRRNELGSKIAPQNIMQTMEAGTGNLALYIEEERQQRAGLFLKDVSYILHASFKLTKRARDGDSITKFEEMFKRRAEKGQCHHQPYFGSREFAAYFSLNDQSEKPIKIEQQDLGWMLYDLDFEDYNFDTKSYKDANPKFFRAVIQNGSIVIPDLNTNGARL

SEQ ID NO: 2675 - protein, 234 aa, Leptospira interrogans serovar Djasiman str. LT1649; identical to SEQ ID NO: 2373

SEQ ID NO: 2676 - protein, 229 aa, Leptospira interrogans serovar Zanoni str. LT2156; identical to SEQ ID NO: 2602

SEQ ID NO: 2677 - protein, 229 aa, Leptospira noguchii str. 2007001578
MKESKIFQLKVWGENACFTRPEMKAERVSYDVITPSASRAIFDAILWKPAILWIIHKIDILNPILWESVRRNELGSKIAPQNITQTMEAGTGNLALYIEEERQQRAGLFLKDVSYILHASFKLTKRAGDGDSITKFEEMFKRRAEKGQCHHQPYFGNREFAAYFSLNDQTEKPIKIEQQDLGWMLYDLDFEDYDFDSKSYKDASPKFFRAEIQNGSITVPDLNTNGARL

SEQ ID NO: 2678 - protein, 234 aa, Leptospira kirschneri serovar Bim str. 1051; identical to SEQ ID NO: 2607

SEQ ID NO: 2679 - protein, 234 aa, Leptospira interrogans serovar Muenchen str. Brem 129; identical to SEQ ID NO: 2581

SEQ ID NO: 2680 - protein, 234 aa, Leptospira kirschneri serovar Sokoine str. RM1; identical to SEQ ID NO: 2607

SEQ ID NO: 2681 - protein, 229 aa, Leptospira interrogans serovar Pyrogenes str. L0374; identical to SEQ ID NO: 2602

SEQ ID NO: 2682 - protein, 234 aa, Leptospira interrogans serovar Medanensis str. L0448; identical to SEQ ID NO: 2603

SEQ ID NO: 2683 - protein, 234 aa, Leptospira interrogans str. L0996; identical to SEQ ID NO: 2603

SEQ ID NO: 2684 - protein, 210 aa, Leptospira interrogans str. L1207
MKESQIFQLKVSGENACFTRPEMKAERVSYDVITPSAARAIFDAILWKPAILWIIHKIDILKAILWESIRRNELGSKIAPQNIMQTMEAGTGNLALYIEEERQQRAGLFLKDVSYILHASFKLTKRARDGDSITKFEEMFKRRAEKGQCHHQPYFSSREFAAYFSLNDQTEKPIKIEQQDLGWCYTILILKTIILIQKVIRTPIQNFFEQ

SEQ ID NO: 2685 - protein, 229 aa, Leptospira interrogans serovar Autumnalis str. LP101; identical to SEQ ID NO: 2674

SEQ ID NO: 2686 - protein, 234 aa, Leptospira interrogans serovar Pyrogenes str. R168; identical to SEQ ID NO: 2373

SEQ ID NO: 2687 - protein, 229 aa, Leptospira interrogans serovar Grippotyphosa str. UI 08434; identical to SEQ ID NO: 2674

SEQ ID NO: 2688 - protein, 229 aa, Leptospira interrogans serovar Bataviae str. UI 08561; identical to SEQ ID NO: 2580

SEQ ID NO: 2689 - protein, 229 aa, Leptospira interrogans str. UI 09600; identical to SEQ ID NO: 2580

SEQ ID NO: 2690 - protein, 229 aa, Leptospira interrogans serovar Grippotyphosa str. UI 12764; identical to SEQ ID NO: 2580

SEQ ID NO: 2691 - protein, 229 aa, Leptospira interrogans serovar Grippotyphosa str. UI 12769; identical to SEQ ID NO: 2580

SEQ ID NO: 2692 - protein, 234 aa, Leptospira interrogans serovar Medanensis str. UT053; identical to SEQ ID NO: 2603

SEQ ID NO: 2693 - protein, 234 aa, Leptospira interrogans serovar Pomona str. UT364; identical to SEQ ID NO: 2603

SEQ ID NO: 2694 - protein, 234 aa, Leptospira interrogans serovar Icterohaemorrhagiae str. Verdun HP; identical to SEQ ID NO: 2373

SEQ ID NO: 2695 - protein, 234 aa, Leptospira interrogans serovar Copenhageni str. HAI0188; identical to SEQ ID NO: 2373

SEQ ID NO: 2696 - protein, 229 aa, Leptospira interrogans serovar Bataviae str. HAI135
MKESKIFQLKVWGENACFTRPEMKAERVSYDVITPSAARAIFDAILWKPAILWIIHKIDILNPIRWESVRRNELGSKIAPQNITQTMEAGTGNLALYIEEERQQRAGLFLKDVSYILHASFKLTKRAGDGDSITKFEEMFKRRAEKGQCHHQPYFGNREFAAYFSLNDQTEKPIKIEQQDLGWMLYDLDFEDYDFDSKSYKDASPKFFQAEIQNGSITIPDLNTNGARL

SEQ ID NO: 2697 - protein, 234 aa, Leptospira interrogans str. MMD3731; identical to SEQ ID NO: 2373

SEQ ID NO: 2698 - protein, 234 aa, Leptospira noguchii serovar Autumnalis str. ZUN142
METKNMKESKIFQLKVWGENACFTRPEMKAERVSYDVITPSAARAIFDAILWKPAILWIIHKIDILNPIRWESVRRNELGSKIAPQNITQTMEAGTGNLALYIEEERQQRAGLFLKDVSYILHASFKLTKRAGDGDSITKFEEMFKRRAEKGQCHHQPYFGNREFAAYFSLNDQTEKPIKIEQQNLGWMLYDLDFEDYDFDSKSYKDASPKFFQAEIQNGSITIPDLNTNGARL

SEQ ID NO: 2699 - protein, 229 aa, Leptospira noguchii
MKESKIFQLKVWGENACFTRPEMKAERVSYDVITPSAARAIFDAILWKPAILWIIHKIDILNPILWESVRRNELGSKIAPQNITQTMEAGTGNLALYIEEERQQRAGLFLKDVSYILHASFKLTKRAGDGDSITKFEEMFKRRAEKGQCHHQPYFGNREFAAYFSLNDQTEKPIKIEQQDLGWMLYDLDFEDYDFDSKSYKDASPKFFQAEIQNGSITIPDLNTNGARL

SEQ ID NO: 2700 - protein, 234 aa, Leptospira kirschneri str. 200803703; identical to SEQ ID NO: 2607

SEQ ID NO: 2701 - protein, 229 aa, Leptospira kirschneri str. 200801925; identical to SEQ ID NO: 2579

SEQ ID NO: 2702 - protein, 234 aa, Leptospira kirschneri str. 200801774; identical to SEQ ID NO: 2607

SEQ ID NO: 2703 - protein, 228 aa, Leptospira noguchii str. 2001034031
MESKIFQLKVWGENACFTRPEMKAERVSYDVITPSASRAIFDAILWKPAILWIIHKIDILNPIRWESVRRNELGSKIAPQNITQTMEAGTGNLALYIEEERQQRAGLFLKDVSYILHASFKLTKRAGDGDSITKFEEMFKRRAEKGQCHHQPYFGNREFAAYFSLNDQTEKPIKIEQQDLGWMLYDLDFEDYDFDSKSYKDASPKFFRAEIQNGSITVPDLNTNGARL

SEQ ID NO: 2704 - protein, 234 aa, Leptospira interrogans str. UI 13372; identical to SEQ ID NO: 2373

SEQ ID NO: 2705 - protein, 229 aa, Leptospira interrogans serovar Pyrogenes str. 200701872; identical to SEQ ID NO: 2602

SEQ ID NO: 2706 - protein, 247 aa, Streptococcus mutans KK21; identical to SEQ ID NO: 2639

SEQ ID NO: 2707 - protein, 247 aa, Streptococcus mutans ATCC 25175; identical to SEQ ID NO: 2639

SEQ ID NO: 2708 - protein, 218 aa, Ruminiclostridium cellobioparum subsp. termitidis CT1112
MGFGIKLEVWGDYALFTRPEMKVERVSYDVITPSAARGLIEAIYWKPAIKWIIDKIHVYNKIQFTNIRRNEVNGKILKSNAKALMDGTKTIDFINTNEQRQQRAAMVLKDVRYAIEAHFEMTDKAEEGDTVEKHYNIALRRMRTGQCYHAPCFGCREFPANFKLIEGERIKPSYLGEQDLGFMLYDMDFSDPENIYPVFFRAKMVNGVIDLKNIDKVG

SEQ ID NO: 2709 - protein, 211 aa, Desulfotignum phosphitoxidans DSM 13687
MGYGIKLRVWGDYALFTRPEMKVERVSYDVMTPSAARGILEAIFWKPAIRWIVDRIHVLNPICFENIRRNEIAKKTSVSSTDMRGSKELCIYSDDSDIRQQRSSMVLRNVDYVLEAHFELTGKEKGDPGKFLAIFERRVKKGQCFHRPYFGCREFPVNFEWCTHIPASPFSGEQDFGFMLHDIDFSNDMTAQFFRAVMKNGVIDCRKEVVS

SEQ ID NO: 2710 - protein, 229 aa, Leptospira noguchii str. Cascata; identical to SEQ ID NO: 2660

SEQ ID NO: 2711 - protein, 234 aa, Leptospira noguchii str. Hook
METKNMKESKIFQLKVWGENACFTRPEMKAERVSYDVITPSAARAIFDAILWKPAILWIIHKIDILNPILWESVRRNELGSKIAPQNITQTMEAGTGNLALYIEEERQQRAGLFLKDVSYILHASFKLTKRAGDGDSITKFEEMFKRRAEKGQCHHQPYFGNREFAAYFSLNDQTEKPIKIEQQDLGWMLYDLDFEDYDFDSKSYKDASPKFFQAEIQNGSITIPDLNTNGARL

SEQ ID NO: 2712 - protein, 229 aa, Leptospira interrogans str. 2002000626; identical to SEQ ID NO: 2602

SEQ ID NO: 2713 - protein, 229 aa, Leptospira interrogans serovar Australis str. 200703203; identical to SEQ ID NO: 2602

SEQ ID NO: 2714 - protein, 234 aa, Leptospira interrogans serovar Copenhageni str. M20; identical to SEQ ID NO: 2373

SEQ ID NO: 2715 - protein, 218 aa, Schaedlerella arabinosiphila
MSKGVKVRVWGDYALFSRPEMKVERCSYDVITPSAARGILEAIYWHPGMRWVIDRIYVNRPIQFTSVRRNEVKSKISANNVLPVYNGNSKRLYISTKAEIVQRASLLLRNVEYVIEAHFEMTDKAETSDNPGKFKDITMRRLKRGECFHTPYFGCREFPVRFCLCEEDEISTAYEDERDLGFMLYDLDYSDPENIQPMFFRAIMKKGIIDLRNCEVIR

SEQ ID NO: 2716 - protein, 234 aa, Leptospira interrogans serovar Valbuzzi str. Valbuzzi; identical to SEQ ID NO: 2663

SEQ ID NO: 2717 - protein, 224 aa, Thauera sp. 63
MSFGIRLHVWGDRACFTRPEMKVERVSYDVITPSAARGILEAIHWKPAIRWVVDRIHVLKPVRFESIRRNEVGGKLSPGNVSKAMKAGTAAGLATYVDEDRQQRAATVLRDVAYVIEAHFELTDKAGPDDSVGKHLDIFNRRARKGQHFHAPCLGVREFPAHFSLIEDGQPLPEAHPEREADKDLGWMLHDIDFARDMTPRFFRAQLKAGVIEVPPWQGEEVKS

SEQ ID NO: 2718 - protein, 224 aa, Thauera sp. 27
MSYGIRLHVWGDRACFTRPEMKVERVSYDVITPSAARGILEAIHWKPAIRWVVDRIHVLKPVRFESIRRNEVGGKLSPGSVSRAMKAGTTAGLATYVDEDRQQRAATVLRDVAYVIEAHFELTDKAGPDDSVGKHLDIFNRRARKGQHFHAPCLGVREFPAHFELIEDGQPLPDAHPAREADKDLGWMLHDIDFARDMTPRFFRAQLKAGVIDVPPWQGEEVKS

SEQ ID NO: 2719 - protein, 224 aa, Thauera aminoaromatica S2
MTYGIRLHVWGERACFTRPEMKVERVSYDIITPSAARGILEAIHWKPAIRWVVDRIHVLKPIHFESIRRNEVGGKLSPASVSKAMKAASTAGLATYVDQDRQQRAATVLRDVAYVIEAHFELTDKAGPDDSVGKHLDIFNRRARKGQHFHAPCLGVREFPAHFSLIEDGQPLPDAHPERDVDKDLGWMLHDIDFARDMTPRFFRAQLRAGVIEVPPWQGEEVKS

SEQ ID NO: 2720 - protein, 235 aa, Clostridium clostridioforme 90A8
MEKRNTVQFKVYGKYALFSDPITRPGGEKISYQVPTYQAIKGITESIYWKPTFIWYVDKIRIMKRIQTESKGVRPIKINGGNELAYYAYLKDVEYQVSAHFEWNKQRPELESDRDENKHHNIAKRCIRQGGRRDVFLGTRECQAYVEPCTFGEGKSAYDNYGEIDFGIMFHGFDYPDETGNQELGVRLWQQKMKDGVINFCDPREIRSRRVVSAYDSHYSFKHFEEGVNLKIELV

SEQ ID NO: 2721 - protein, 219 aa, Clostridium clostridioforme 90A7; identical to SEQ ID NO: 2457

SEQ ID NO: 2722 - protein, 219 aa, Clostridium bolteae 90B3; identical to SEQ ID NO: 2457

SEQ ID NO: 2723 - protein, 260 aa, Clostridium bolteae 90B8
MKIRNQIEYCVWGNYALFSDPIARMGGEKFSYMLPTYQALKGITESIYWKPSIIWMVDEVRVMKPIRTESKNVRPISYVASKNTLSVYTYLADVSYQVRAHFILNENRRAELEEDFNENKHHNIATRMVRKGGRRDIFLGTRECQGYVEPCEFGKGEGYYDHYGELEFGVMFHGFDYPDETGRDMLAARFWRPKMVNGVILFHPPEEIPEEMKRNIRPMKAKKFGKKYGNSSGLEEEALQQEFAWEGGTYELDAEIVRGI

SEQ ID NO: 2724 - protein, 219 aa, Clostridium bolteae 90B8; identical to SEQ ID NO: 2457

SEQ ID NO: 2725 - protein, 219 aa, Clostridium bolteae 90A9; identical to SEQ ID NO: 2457

SEQ ID NO: 2726 - protein, 219 aa, Clostridium bolteae 90A5; identical to SEQ ID NO: 2457

SEQ ID NO: 2727 - protein, 219 aa, Clostridium bolteae 90B7; identical to SEQ ID NO: 2457

SEQ ID NO: 2728 - protein, 233 aa, Bacteroides massiliensis B84634 = Timone 84634 = DSM 17679 = JCM 13223; identical to SEQ ID NO: 2479

SEQ ID NO: 2729 - protein, 239 aa, Enterococcus haemoperoxidus ATCC BAA-382
MRNQVSFKVYGEYALFTDPVTKMGGEKMTYQVPTYQALKGITESIYWKPSITYYVDEVRIVNPIQMESKGIRPMKYNDSSASDLAYYTYLKQPCYEVKVHFEFNQYRPDLKQDWNEHKHFQILKRAIKVGGRRDIFLGTRECQGYVEPVDFGESEGFYDHYGELHFGTMVHGLSYPDETGKDELAVRLWQPIMENGVIHFLRPETCELIRPLKSMQMKPFTFNEIESVDQLTEVLEGEE

SEQ ID NO: 2730 - protein, 239 aa, Bacillus mycoides
MRNSIEFEVFGDYALFTDPLMKMGGEKLTYQVPTYQAIKGIVESIYWKPTLLMVVDKIRIMNAIKMESKGIRPIEYGGGNTLANYTYLKDVRYQVQAHFIFNPHRPDLAFDRNEFKHHNILKRSLKVGGRRDIFLGTRECQGYVEPCVFGEGKGFYDNYGGDIHLGTMVHGLNYPDETGRNELEVRLWNPVIKDGIIQFIRPEECTQVRKISKMEPKVFDRSNVESVEELIKQLEVGGE

SEQ ID NO: 2731 - protein, 239 aa, Bacillus cereus VD131
MRNSIEFEVFGDYALFTDPLMKMGGEKLTYQVPTYQAMKGIVESIYWKPTLLMIVDKIRIMNPIKMESKGIRPIEYGGGNTLANYTYLKNVRYQVKAHFIFNPHRPDLAFDRNEFKHHNILKRSLKVGGRRDIFLGTRECQGYVEPCVFGEGTGFYDNYGGDIHLGVMIHGLNYPDETGKNELEVRLWNPIMRDGIIQFIRPEECTQVRKISKMEPKVFDRSNVESVEELIKQLEVGGE

SEQ ID NO: 2732 - protein, 239 aa, Bacillus cereus HuB13-1
MRNSIEFEVFGDYALFTDPLMKMGGEKLTYQVPTYQAIKGIVESIYWKPTLLMIVDKIRIMNAIKMESKGIRPIEYGGGNTLANYTYLKNVRYQVQAHFIFNHHRPDLAFDRNEYKHHNILKRSLKVGGRRDIFLGTRECQGYVEPCVFGEGEGFYDNYGGDIHLGTMVHGLNYPDETGRNELEVRLWNPVMRDGIIQFIRPEECTKIRKISKMDPKIFDSSNVESVDELIKQLEEGGE

SEQ ID NO: 2733 - protein, 239 aa, Bacillus cereus VD146; identical to SEQ ID NO: 2584

SEQ ID NO: 2734 - protein, 239 aa, Bacillus cereus ISP2954; identical to SEQ ID NO: 2732

SEQ ID NO: 2735 - protein, 239 aa, Bacillus cereus VDM053
MRNSIEFEVFGDYALFTDPLMKMGGEKLTYQVPTYQAIKGIVESIYWKPTLLMVVDKIRIMNAIKMESKGIRPIEYGGGNTLANYTYLKDVRYQVQAHFIFNPHRPDLAFDRNEFKHHNILKRSLKVGGRRDIFLGTRECQGYVEPCVFGEGKGFYDNYGGDIHLGTMVHGLNYPDETGRNELEVRLWNPVMRDGMIQFIRPEECTQVRKISKMEPKIFDRSNIESVDELIKQLEEGGE

SEQ ID NO: 2736 - protein, 239 aa, Bacillus cereus BMG1.7; identical to SEQ ID NO: 2732

SEQ ID NO: 2737 - protein, 220 aa, Butyricicoccus pullicaecorum 1.2
MPIRLEVWGDYALFTRPEMKVERVSYDVMTPSAARGLMEAVYWHPGMRWSVDRIHVCSPIRFTNLRRNEVKATVSARSARTVMERGTGDLYLCTPENIQQRASMLLRDVHYVIEAHFDMTDRAAPGDNPGKFQDIIKRRVRKGQFYHQPYFGCREFPVNFKLCEQIPDCPESLKGERDLGWMLWDMDYTDPENIQPMFFRAVLRDGVLDVPTLESGEVHR

SEQ ID NO: 2738 - protein, 226 aa, Bacteroides vulgatus dnLKV7
MEYTDKEYCLEVWGDWACFTRPELKVERVSYDVITPSAARAIFEAILFKRYAMRWQVTKIEVLRPIKWATIRRNEVGAVASKSPIIIEDKRQQKNTLLLLDVRYRIYAKLVFIPVKDRPKEAFAKHQPSADENPMKYYQMFERRASQGQCFTQPYLGCREFSANWKYIESTDNLDYPLAEDRDFGIMLYDMDFEENPQKPNAMFYRAQMKKGVIVVPDKDSEEVLR

SEQ ID NO: 2739 - protein, 251 aa, Lachnospiraceae bacterium 28-4
MDKPNIIEYKVSGRYALFTDPLSKTGGEKCSYQIPTYQALKGITESIYWKPTITWIIDACRVMKPVQTESKGMRPVKYNGGNDLAYYTYLSDVEYQVRAHFEWNENRKDLADDRNENKHYDIARRMVERGGRRDIFLGARECQGYVEPCSFGEGESAYHGKRLSFGIMVHGITYPDEAVREEEKGKMTVRLWNARMEDGIICFPSPEECEIRRILRDAKQKEFVFGKNFRGLKEWEGGGLLGVDEDFGRNL

SEQ ID NO: 2740 - protein, 221 aa, Enterorhabdus caecimuris B7
MSYGVKVEVWGDYALFTRPELSVERVSYDVISPSAARGILESLYWHPGMKYQVDRIHVLNPIRFTNVRRNEVKSKALASSFRAVMSNGGDLPAIYTSEDIQQRASMMLRDVRYVIEAHFDMTDKAQPGDNPGKFKDILMRRLRKGACYSQPYLGTRECSCHFREWDAVEPPRGFYSDDGRRDFGIVLYDMDYSNPGSISPMYYRCIMENGVIDVAGSEVLR

SEQ ID NO: 2741 - protein, 237 aa, Paenibacillus barengoltzii G22
MRNEVQFEVFGDYALFSDPLTKIGGEKLSYSVPTYQAIKGILESVYWKPTIMYIIDELRVMKPIQMESKGVRPIDYGGGNTLANYTYLKDVHYQVKAHFVFNEHRPDLAFDRNEGKHYSILQRSLKAGGRRDIFLGTRECQGYVQPCEFGSGTGYYDTDGRTHYLGTMVHGFNYPDETGKNELSVRLWNVEMNQGYIRFPKPEECSIVRTVREMEPKSFHSDTIEPAEQLLRTLGGE

SEQ ID NO: 2742 - protein, 242 aa, Oscillibacter sp. 1-3
MQYPNIVEFQVTGDYALFSDPIMRVGGEKCSYQVPTYEALKGILSSVYWKPTLIWYIDAVRMMNQIQTEVKGIRPIHYQDSKNDLSYYTYLKNCRYQVRAHFEWNENRPELAQDRNENKHHNIARRMIKTGGRRDIFLGARECQGYVEPCVFGEGPGAYDKLPELSFGLMYHGITYADEAYSPETKGKMTARFWYPTMKQGVITFPRPEDCPLTKPLREMEIKLFGEDFGNFSGLREFGEVT

SEQ ID NO: 2743 - protein, 217 aa, Anaerotruncus sp. G3(2012)
MGYGIKLEVWGDYALFSRPEMKVERVSYDIITPSAARGILDAIYWKPAIRWVIDRIQVCSPVVFTNIRRNEVSSKLSHSTAWSVMNGSRKPLYINTSADIQQRASLLLRNVRYLIEAHFEMTDKAGERDDEKKHYNIALRRMREGQCFHQPCLGCREFPAQFRLVEDDPPAPLPETRDLGYMLYDMDFRDPENIQPIFFRARMENGVVDLTDCEVVR

SEQ ID NO: 2744 - protein, 215 aa, Lachnospiraceae bacterium 10-1
MSVRVEVWGEYACFSRVEFKVERVSYDVITPSAARGILEAIYWHPGMKWVIDRIYILSPIKMTNIRRNEVQSKILASNVRAAMAGGQNPLYISTSKDIVQRASLVLQDVHYVIEAHFNMTDKASESDNHGKFQDIMKRRLRKGQCFHQPYFGCREFPAKFKEWTDEKIPAIEETRDIGYMLWDIDFSDTSNIQPLFFRARMEKGVLDLTDCEVIR

SEQ ID NO: 2745 - protein, 249 aa, Dorea sp. 5-2
MKHRNSVEFEVKGEYGLFADPVTRVGGEKFSYQVPTYEALKGILQSVYWKPTIIWIIDEVRIMNQIQTETKGVRPIKYYNDKNDLSYYTYLKDCRYQVRAHFIWNENRPELENDRNENKHHNIARRMIERGGRRDIFLGTRECQGYVRPCIFGEGEGFYDNLAELSFGRMYHGITYADEAYSEETKGKMTVRLWQAVMKNGVIAFLPPWECIHRPVRKMDMKKFDEASGNFSVISEEGGGMDVMDEPAL

SEQ ID NO: 2746 - protein, 239 aa, Enterococcus haemoperoxidus ATCC BAA-382; identical to SEQ ID NO: 2729

SEQ ID NO: 2747 - protein, 224 aa, Delftia acidovorans CCUG 15835
MGFGVKLKVWGERACFTRPEMKGERVSYDVITPSAARGILEAIHWKPAIRWSVDRIHVLKPIRFESIRRNEVGSKISPASVSKAMKAGSTEGLVTHVDQDRQQRAATVLRDVAYVIEAHFELTPKAGADDSVGKHLDIFNRRARKGQCFQMPCLGVREFPADFGLLEDGEALPTPHESLLPERDLGWMLHDIDFANGMAPRFFRASMSGGVIAVPPWNSEELKS

SEQ ID NO: 2748 - protein, 220 aa, Coprococcus sp. HPP0074
MGMGVKVRVWGDYALFSRPELKVERYSYDVMTPSAARGILEAIYWHPGLRWIIDKIYVKNPIQFTSVRRNEVKSKILASNVLSAYNGGKKPLYISSKEEIVQRASMILTNVEYVIEAHFEMTEKANETDNPGKFKDIMMRRLRRGECYHMPYFGCREFPANFALCEEEEIKTAFDDVPEKDFGLMLFDMDYSDKENISPMFFRAVMKRGVIDLQNCEVIR

SEQ ID NO: 2749 - protein, 220 aa, Coprococcus sp. HPP0048
MGMGVKVRVWGDYALFSRPELKVERYSYDVMTPSAARGILEAIYWHPGLRWIIDKIYVKNPIQFTSVRRNEVKSKILASNVLSAYNGGKKPLYISSKEEIVQRASMILTNVEYVIEAHFEMTENANKTDNPGKFKDIMMRRLRRGECYHMPYFGCREFPANFALCEEEEIKTAFDDVPEKDFGLMLFDMDYSDKENISPMFFRAVMKRGVIDLQNCEVIR

SEQ ID NO: 2750 - protein, 227 aa, Atopobium sp. oral taxon 199 str. F0494
MGYGIKMLVKGPRACFTRPEMKAERVSYDVMTPSAARGILEAVYWKPAITWHIDSIEVLNKIRFETFRRNEVGSKLPYSGSAGAKSIEGGKNLPLYETVSTDRQQRATLLLRDVAYVVNAHFDLTNRVGEDDTVEKHYNIVLRRLRKGQCFNQPYLGCREFSAEVSLVEEGENVPLSAYAGVSEKDLGFMLYDLDFADMEHPEPKFFRAVMRGGVIDVSTAAREVIG

SEQ ID NO: 2751 - protein, 205 aa, Exiguobacterium sp. S17
MSYQIPTYQAIKGIVESIYWKPTIVMVVDAIRIMNPIKMESKGMRPIEYGGGNSLAHYTYLRDVCYHVRAHFEFNSHRPDLAFDRNEGKHYAILKRSLEAGGRRDIFLGARECQAYVEPIEFDEGEGFYDGVDLHFGTMVHGFNYPDETGVDELAVRLWQPVMKDGVITFTRPEDCSLVQPIKKMQAKTFTEEDIESAELLYEQL

SEQ ID NO: 2752 - protein, 229 aa, Leptospira noguchii str. 1993005606; identical to SEQ ID NO: 2677

SEQ ID NO: 2753 - protein, 227 aa, Treponema socranskii subsp. paredis ATCC 35535
MKENSIEYRLTGRYALFTDPVTKIGGEKSTYLVPTYEALKGITQSIYWKPTIVWVIDKVRLINKIGTESKNIKPLCYNGGNDLSVYTYLRDIEYQVKAHFEWNMQRSDLEQDRNENKHFDTARRSLEKGGRRDIFLGARECQGYVEPCEFGSGKSFYDDDGLFAFGLMFHGFDYPSEVDTDVLSARFWQAKMDKGIIEFPRPELCTVRREIRNYSVKNPKIKAEEDA

SEQ ID NO: 2754 - protein, 229 aa, Leptospira kirschneri serovar Cynopteri str. 3522 CT; identical to SEQ ID NO: 2579

SEQ ID NO: 2755 - protein, 224 aa, Pseudomonas stutzeri B1SMN1; identical to SEQ ID NO: 2392

SEQ ID NO: 2756 - protein, 205 aa, Megasphaera sp. BL7
MFSRPEMKTERVSYDVMTPSAARGIIEAIYWHPGLRWIIDKIYVLSPIQFTNIRRNEVKAKASARAAKQAMTKKNLALYLSTKEEIQQRASMVLCKVHYVIEAHFELTDKANASDNAGKFQDIIRRRLKRGQCYHTPYFGCREFPVNFREYEFDSVPTAYAGEDKELGYMLYDMDYSDLQHIRPMFFKATLHNGVLDLRDCEVHS

SEQ ID NO: 2757 - protein, 205 aa, Megasphaera sp. NM10; identical to SEQ ID NO: 2756

SEQ ID NO: 2758 - protein, 234 aa, Streptococcus agalactiae CCUG 39096 A
MRVSGQRALFTNPATKGGSERASYSVPTRQALNGIVDAIYYKPTFTNIVTEVKVINQIQTELQGVRALLHDYSADLSYVSYLSDVVYLIKFHFIWNEDRKDLNSDRLPAKHEAIMERSIRKGGRRDVFLGTRESVGLVDDISQEEYEAAVSYYNGVNIDLGIMFHSFAYPKDKKTPLKSYFTKTVMENGVITFKTQSDCDIVNTLSSYAFKVPGEIKSVNDEYMEYDAMEKGEN

SEQ ID NO: 2759 - protein, 234 aa, Streptococcus agalactiae BSU450; identical to SEQ ID NO: 2758

SEQ ID NO: 2760 - protein, 234 aa, Streptococcus agalactiae STIR-CD-13
MRVSGQRALFTNPATKGGSERASYSVPTRQALNGIVDAIYYKPTFTNIVTEVKIINQIQTELQGVRALLHDYSADLSYVSYLSDVVYLIKFHFIWNEDRKDLNSDRLPAKHEAIMERSIRKGGRRDVFLGTRESVGLVDDISQEEYEAAVSYYNGVNIDLGIMFHSFAYPKDKKTPLKSYFTKTVMENGVITFKTQSDCDIVNSLSSYAFKVPGEIKSVNDEYMEYDAMEKGEN

SEQ ID NO: 2761 - protein, 234 aa, Streptococcus agalactiae STIR-CD-09; identical to SEQ ID NO: 2760

SEQ ID NO: 2762 - protein, 234 aa, Streptococcus agalactiae GB00003; identical to SEQ ID NO: 2758

SEQ ID NO: 2763 - protein, 234 aa, Streptococcus agalactiae str. Gottschalk 1005B; identical to SEQ ID NO: 2758

SEQ ID NO: 2764 - protein, 234 aa, Streptococcus agalactiae GB00202; identical to SEQ ID NO: 2758

SEQ ID NO: 2765 - protein, 234 aa, Streptococcus agalactiae GB00219; identical to SEQ ID NO: 2758

SEQ ID NO: 2766 - protein, 234 aa, Streptococcus agalactiae GB00264; identical to SEQ ID NO: 2758

SEQ ID NO: 2767 - protein, 234 aa, Streptococcus agalactiae GB00247; identical to SEQ ID NO: 2758

SEQ ID NO: 2768 - protein, 234 aa, Streptococcus agalactiae GB00300; identical to SEQ ID NO: 2758

SEQ ID NO: 2769 - protein, 234 aa, Streptococcus agalactiae GB00535; identical to SEQ ID NO: 2758

SEQ ID NO: 2770 - protein, 234 aa, Streptococcus agalactiae GB00555; identical to SEQ ID NO: 2758

SEQ ID NO: 2771 - protein, 234 aa, Streptococcus agalactiae GB00601; identical to SEQ ID NO: 2758

SEQ ID NO: 2772 - protein, 234 aa, Streptococcus agalactiae GB00651; identical to SEQ ID NO: 2758

SEQ ID NO: 2773 - protein, 234 aa, Streptococcus agalactiae GB00653; identical to SEQ ID NO: 2758

SEQ ID NO: 2774 - protein, 234 aa, Streptococcus agalactiae GB00893; identical to SEQ ID NO: 2758

SEQ ID NO: 2775 - protein, 234 aa, Streptococcus agalactiae GB00909; identical to SEQ ID NO: 2758

SEQ ID NO: 2776 - protein, 234 aa, Streptococcus agalactiae GB00911; identical to SEQ ID NO: 2758

SEQ ID NO: 2777 - protein, 234 aa, Streptococcus agalactiae GB00914; identical to SEQ ID NO: 2758

SEQ ID NO: 2778 - protein, 234 aa, Streptococcus agalactiae GB00897; identical to SEQ ID NO: 2758

SEQ ID NO: 2779 - protein, 234 aa, Streptococcus agalactiae GB00933; identical to SEQ ID NO: 2758

SEQ ID NO: 2780 - protein, 234 aa, Streptococcus agalactiae FSL S3-014; identical to SEQ ID NO: 2758

SEQ ID NO: 2781 - protein, 234 aa, Streptococcus agalactiae FSL S3-137; identical to SEQ ID NO: 2758

SEQ ID NO: 2782 - protein, 234 aa, Streptococcus agalactiae FSL S3-442; identical to SEQ ID NO: 2758

SEQ ID NO: 2783 - protein, 234 aa, Streptococcus agalactiae CCUG 29376; identical to SEQ ID NO: 2758

SEQ ID NO: 2784 - protein, 234 aa, Streptococcus agalactiae CCUG 47293; identical to SEQ ID NO: 2758

SEQ ID NO: 2785 - protein, 234 aa, Streptococcus agalactiae LMG 15090; identical to SEQ ID NO: 2758

SEQ ID NO: 2786 - protein, 234 aa, Streptococcus agalactiae BSU454; identical to SEQ ID NO: 2758

SEQ ID NO: 2787 - protein, 234 aa, Streptococcus agalactiae BSU248; identical to SEQ ID NO: 2758

SEQ ID NO: 2788 - protein, 234 aa, Streptococcus agalactiae MRI Z1-198; identical to SEQ ID NO: 2758

SEQ ID NO: 2789 - protein, 234 aa, Streptococcus agalactiae STIR-CD-07; identical to SEQ ID NO: 2760

SEQ ID NO: 2790 - protein, 234 aa, Streptococcus agalactiae STIR-CD-14
MRVSGQRALFTNPATKGGSERASYSVPTRQALNGIVDAIYYKPTFTNIVTEVKVINQIQTELQGVRALLHDYSADLSYVSYLSDVVYLIKFHFIWNEDRKDLNSDRLSAKHEAIMERSIRKGGRRDVFLGTRESVGLVDDISQEEYEAAVSYYNGVNIDLGIMFHSFAYPKDKKTPLKSYFTKTVMENGVITFKTQSDCDIVNTLSSYAFKVPGEIKSVNDEYMEYDAMEKGEN

SEQ ID NO: 2791 - protein, 234 aa, Streptococcus agalactiae STIR-CD-25; identical to SEQ ID NO: 2790

SEQ ID NO: 2792 - protein, 234 aa, Streptococcus agalactiae str. Gottschalk 998A; identical to SEQ ID NO: 2758

SEQ ID NO: 2793 - protein, 234 aa, Streptococcus agalactiae str. Gottschalk 999B; identical to SEQ ID NO: 2758

SEQ ID NO: 2794 - protein, 200 aa, Phaeospirillum fulvum MGU-K5
KAERVSYDVMTPSAARGILEAIHWKPAISWVVDAIHVLKPIRFHTLRRNEVGSKIPVAKVKTALKRGSLDGLHLRIEDDRQQRATTLLVDVDYVIEAHFEMTPRAGAEDNPGKHLDIFNRRARRGQCFHQPCLGTREFPARFELVEPDAPPLPAIDDSRDLGFMLWDIDHGGDRASMFFRARMDRGVVRVPPPGSPEIRR

SEQ ID NO: 2795 - protein, 225 aa, Mannheimia haemolytica D38; identical to SEQ ID NO: 2486

SEQ ID NO: 2796 - protein, 225 aa, Mannheimia haemolytica MhBrain2012; identical to SEQ ID NO: 2486

SEQ ID NO: 2797 - protein, 225 aa, Mannheimia haemolytica MhSwine2000; identical to SEQ ID NO: 2486

SEQ ID NO: 2798 - protein, 225 aa, Mannheimia haemolytica D193; identical to SEQ ID NO: 2486

SEQ ID NO: 2799 - protein, 242 aa, Streptococcus pyogenes GA40634; identical to SEQ ID NO: 2387

SEQ ID NO: 2800 - protein, 229 aa, Leptospira noguchii serovar Panama str. CZ214
MKESKIFQLKVWGENACFTRPEMKAERVSYDVITPSAARAIFDAILWKPAILWIIHKIDILNPILWESVRRNELGSKIAPQNITQTMEAGIGNLALYIEEERQQRAGLFLKDVSYILHASFKLTKRAGDGDSITKFEEMFKRRAEKGQCHHQPYFGNREFAAYFSLNDQTEKPIKIEQQDLGWMLYDLDFEDYDFDSKSYKDASPKFFQAEIQNGSITIPDLNTNGARL

SEQ ID NO: 2801 - protein, 234 aa, Streptococcus agalactiae MRI Z1-038; identical to SEQ ID NO: 2758

SEQ ID NO: 2802 - protein, 225 aa, Gallibacterium anatis 12656/12
MKNNVRLHIWGDYACFTRPEMKAERVSYDVITPSAAHGILSSIHWKPAINWVIDKIYVLKPIRFETIRRNELGNKIPQSNIKTAMKRNSLEKLYTIIEEDRQQRAATVLKDVAYVIEAHIVLTDQAGESDNLNKHLEMFQRRAAKGQCFRHPCMGVREFPANFCLIEENEALPQTALSGAELDQDLGWMLHDIDFNHNNTPHFFRAKMQNGVITVPPFYSEEVKL

SEQ ID NO: 2803 - protein, 240 aa, Aggregatibacter sp. oral taxon 458 str. W10330
MDSKISFRVWGRQALFTDPVTKIGGEKFSYQVPTYEAIKGIVKSIYWKPTLIWCIDRIRVMKPIRTQSKSTKPLDWNGGNTLAIYTFLQDVEYQVEAHFEWNEHWEELAGDRNFGKHIAIARRMLERGGRQDIFLGTRDCQGYVEPCTFGEGKGFYDGYGNLDFGPMFHSFGYPEETGKPELVSRFWMANMQNGVIEFPSIDDTEGRLKTRFIRKMQPEKPFKRGENVKPVEDEAKELEL

SEQ ID NO: 2804 - protein, 224 aa, Aggregatibacter sp. oral taxon 458 str. W10330
MNQIRLHVWGDYACFTRPEMKVERVSYDVITPSAARGILAAVHWKPAIRWVIDKIYVLKPIRFESVRRNELGGKISAGKVSGAMKRKSVADLYTLIEDDRQQRAATVLKDVAYVIEAHAVLTAKAGADETVTKHVEMFKRRAKKGQCFQQPCLGVREFPADFALIDEGGPLPPLALSESEANRDLGWMLHDIDFDHGNTPHFFRAQMKDGVIDVPPFYAEEVKA

SEQ ID NO: 2805 - protein, 239 aa, Bacillus thuringiensis T01-328; identical to SEQ ID NO: 2732

SEQ ID NO: 2806 - protein, 240 aa, Atopobium sp. oral taxon 810 str. F0209
MKRQQLEDRRRHMGYGIKILVKGPRACFTRPEMKAERVSYDVMTPSAARGILEAVYWKPAIVWRIDSIEVLNKIRFETFRRNEVGKKLSYDKALSLCKGNNESFYIAASDTDDKTRQQRATLLLRDVAYVVNAHFDLTNRAGVDDTVEKHYNIALRRLRKGQCFNQPYLGCREFSAEVSLVEEGKNVPPSAYADVLEKDFGFMLYDLDFTDIEHPEPKFFRAVMRSGVIDVSAIAREAIG

SEQ ID NO: 2807 - protein, 220 aa, Clostridium sp. ATCC BAA-442
MSIQLEVWGDYALFTRPEMKVERVSYDIMTPSAARGLVEAIYWHPGLKWIIDRIHVCAPIRFTNLRRNEVKSTLSARSARTVMERGKGELYLCTSDDIQQRAALLLRDVRYVIEAHFDMTSQAAPGDNPGKFQDIVKRRIKKGQFYHQPCFGCREFPAHFRWCEELPPCPKELLGERDLGWILYDMDYTNPEDIRPLFFRGTLRDGVLEVPARESGEVRG

SEQ ID NO: 2808 - protein, 245 aa, Clostridium sp. KLE 1755
MQAKYRNTVEFQVSGDYALFSDPVTRVGGEKFSYQIPTYEAIKGILQSIYWKPTIIWRIDELRVMNPIQTETKAIRPIAYNGGNDLSYYTYLKDVRYQVRAHFVWNENRPELEGDRDENKHHNIAKRMIQRGGRRDIFLGTRECQGYVEPCVFGEGEGYYDTPSREVAFGFMYHGITYADEAVLEEDRGKMTVRFWRPVMKNGYVTFLAPEECSDKRMIHEMGIKAFPDKKFSGLQEFSEEGDEE

SEQ ID NO: 2809 - protein, 239 aa, Clostridium sp. ATCC 29733
MERENRIDFLVYGRNALFSDPVTRVGGEKCSYQVPTYQALKGIAESIYWKPTFTWVVDRVRVLNPIRTQSKGVRPIKYQSDENELSIYTYLTDVAYQVQAHFEWNEHRPELACDRNENKHYAIAKRMVERGGRRDIFLGARECQGYVEPCTFGEGPGAYDDCPELAFGVMFHGFNYPDETGRTQMETRLWLPKMERGVIAFCRPEECTLVHPVGERSAKAFVPGENLSLSDCLAEEVGL

SEQ ID NO: 2810 - protein, 229 aa, Porphyromonas sp. oral taxon 278 str. W7784
MDKTNPKLYCLEIRGDFACFTRPELKVERVSYDVITPSAARNIFQCIFWKPAIQWHVRRIEVLKPILRTSIRRNEVGSTMSPKATKPLFIEENRQQRTAYILRDVAYRIYAEMEFIPLEKRTKKQQEECKDPKAETPEKYDAIFLERATKGQCFTQPYLGCREFTCSFEYIPRGQVQDLPIDESRDLGIMLFDMDFEKNLQCPPPLFFHAQMEHGVIDIPHKSSKEILR

SEQ ID NO: 2811 - protein, 240 aa, Selenomonas sp. oral taxon 892 str. F0426
MRNSIEFQVYGRMALFTDPITKVGGERSSYSVPTYQALKGITESIYWKPTFYWVVDEVRVMNRIATQSRGVKPMKYGGGGNDLSIYKYLSDVCYQVRAHFEFNLHRKELAEDRDEHKHHNIAKRMVERGGRRDIFLGTRECQGYVEPVRYGEGKGYYDDSGEMPLGTMFHGFNYVDETGGSMLQVRLWQPVMECGIIQFPRPEQCTLVRDIRKVKSKLFDKNTVTFVAEEYELLGEEGRL

SEQ ID NO: 2812 - protein, 253 aa, Treponema lecithinolyticum ATCC 700332
MQEYFDKTFCLEVWGDYACFTRPEMKVERVSYDVITPSAARAVFEAIFWKPAFYWKIKKIEVLNEIKWINLRRNEVGAVASDKSDGIYIDELDNQGKLKYRQQRAGLFLKDVKYRIYADLVFIPPKKRKETANHLPEYLIDADEKEQLLSRALTEEHVHENPAKYNAMFERRAKKGQCFFQPYLGCREFSCFFKLIDFEHDTATPIDETRDLGFMLYDMDYSDCENIKPAFFRAKLEHGTVIVPDWNSEEVHK

SEQ ID NO: 2813 - protein, 253 aa, Treponema socranskii subsp. socranskii VPI DR56BR1116 = ATCC 35536
MQEYFDKTFCLEVWGDYACFTRPEMKVERVSYDVITPSAARAVFEAIFWKPAFYWKIKKIEVLNKIKWINLRRNEVGAVASDKSGGIYIDELDSQGKLKYRQQRAGLFLKDVKYRIYADLVFIPPKKRKEIDNPLPEYLVDADEKEQLLSRALTEEHAHENPAKYNAMFERRAKKGQCFFQPYLGCREFSCFFKLIDFEHDTATPIDETRDLGFMLYDMDYSDCENIKPAFFRAKLEHGTVIVPDWNSEEVRK

SEQ ID NO: 2814 - protein, 222 aa, Oscillibacter sp. KLE 1745
MLMPISLEVWGDYALFTRPEMKVERVSYDVMTPSAARGLIEAIYWHPGLRWVIDCIYVCAPIRFTNLRRNEVKSTLSARSVRTVMERGTGELYLCTANDIQQRAALLLRDVHYVIEAHFDVTDKAAPGDNPGKFQDIVKRRIQRGQFYHQPCFGCREFPAQFRWCEEPPPCPEELKGPRDLGWMLYDMDYTDPEDIRPLFFRASLEDGVLRVPGRNSREVRG

SEQ ID NO: 2815 - protein, 222 aa, Oscillibacter sp. KLE 1728; identical to SEQ ID NO: 2814

SEQ ID NO: 2816 - protein, 203 aa, Myxococcus sp. (contaminant ex DSM 436)
MACFTRPEMKVERVSYEVMTPSAARGVLEAILWKPAIRWHIHEIAVLAPVRWTSFRRNEVNSKATVGKFDYAADEDRAQRNTVALRDVDYVITASFTLVPGKTGPEDNARKFEDMFERRLERGQSFHAPYLGCREFAARVEPAERGLLPHESGQGRRPLGLMFYDFVFDVPGEPVRPEFFQAFLEDGVLRVPPRAQVLGGGVP

SEQ ID NO: 2817 - protein, 218 aa, Oribacterium sp. oral taxon 078 str. F0263
MSVGVKVKIWGDYALFSRPELRAERYSYDVITPSAARGILEAIYWHPGMRWQIDRIHALKPICFTSIRRNEVKSRIPREDPLTAYNGGKGESLFLNTKSDIVQRSSIILKDVAYGIEAHFEMTEKASPGDNPGKFKDIMSRRLRKGECYHQPYLGCREFPAFFCPWDEGEEHRGGESRDLGLMLYDMDYSNPEDIRPTFFRAKMENGVIDLRNCEVLR

SEQ ID NO: 2818 - protein, 250 aa, Streptococcus pyogenes GA41046; identical to SEQ ID NO: 2385

SEQ ID NO: 2819 - protein, 222 aa, Chitinivibrio alkaliphilus ACht1
MSFGVKVKVWGDYACFTRPEMKVERVSYDVITPSAARAVIEAIYWKPAIRWVIDRIHVMKPVKFDNIRRNEVDSKLSISAGKIATAMENNEAIQLFADDSKHRRQRAAMVLRDVEYIIEAHFEPINSEGENIGKHLDMFNRRAKKGQCFYQPYLGTREFSSSFELVEGDIPASQLTGERDLGFMLFDIDFSDKKNIQPMFYRPKMVDGVIAVPHPDSGEVLK

SEQ ID NO: 2820 - protein, 219 aa, Marinobacter sp. ES-1
MGFCLDVSGEFACFTRPEMKVERVSYDVITPSSARAIFEAILWKPAIQWQVTKIEVLNPIKWMNLRRNEVESIVSTRTAKSAMTSGEGHLGIYVDEQRQQRASLLLKDVRYRLHAEFQMTDKAGPQDSAAKFADMFRRRAEKGQCFNQPYLGCREFSCDFELVDADDGPDPIQRSSDLGFMLYDLDYGDPAYPQPLFFRAHMQDGVVAVPERNSPEVRG

SEQ ID NO: 2821 - protein, 219 aa, Marinobacter sp. C1S70
MGFCLDVSGEFACFTRPEMKVERVSYDVITPSSARAIFEAILWKPAIQWQVTKIEVLNPIKWMNLRRNEVESIVSTRTAKSAMISGEGHLGIYVDEQRQQRASLLLKDVRYRLHAEFQMTDKAGPQDSAAKFADMFRRRAEKGQCFNQPYLGCREFSCDFALVNASDSPEPIQDSPDLGFMLYDLDYSDPASPRPLFFRAKMENGVVAVPDRNSPEVRG

SEQ ID NO: 2822 - protein, 224 aa, Pseudomonas aeruginosa BL10
MAYGIRLMVWGERACFTRPEMKVERVSYDAITPSAARGILEAIHWKPAIRWVVDRIQVLKPIRFESIRRNEVGGKLSAVSVGKAMKAGRTNGLVNLVEEDRQQRATTLLRDVSYVIEAHFEMTDRAGADDTVGKHLDIFNRRARKGQCFHTPCLGVREFPASFRLLEEGSAEPEVDAFLRGERDLGWMLHDIDFADGMTPHFFRALMRDGLIEVPAFRAAEDKA

SEQ ID NO: 2823 - protein, 224 aa, Pseudomonas aeruginosa BL07
MAYGIRLMVWGERACFTRPEMKVERVSYDAITPSAARGILEAVHWKPAIRWVVDRIQVLKPIRFESIRRNEVGGKLSAVSVGKAVKAGRTDALVNLVEEDRQQRATTLLRDVAYVIEAHFEMTDRAGADDTVGKHLDIFNRRARKGQCFHAPCLGVREFPASFRLLEEGSAEPEVDASLCGERDLGWMLHDIDFADGMTPHFFRALMRDGLIEVPAFRAAEVKA

SEQ ID NO: 2824 - protein, 224 aa, Pseudomonas aeruginosa BWHPSA015; identical to SEQ ID NO: 2822

SEQ ID NO: 2825 - protein, 242 aa, Streptococcus pyogenes GA40056
MYRSRDFYVRVSGQRALFTNPATKGGSERSSYSVPTRQALNGIVDAIYYKPTFTNIVTEVKVINQIQTELQGVRALLHDYSADLSYVSYLSDVVYLIKFHFVWNEDRKDLNSDRLSAKHEAIMERSIRKGGRRDVFLGTRECLGLVDDISQEEYETTVSYYNGINIDLGIMFHSFAYPKDKKTPLKSYFTKTVMKNGVITFKAQSECDIVNTLSSYAFKAPEEIKSVNDECMEYDAMEKGEN

SEQ ID NO: 2826 - protein, 215 aa, Thiohalocapsa sp.  PB-PSB1
MKRYCLEVWGDYACFTRSEMKVERVSYDVITPSAARAIFEAILWKPAIRWHVRRIEVLRPIRWLTIKRNEVATIATDRASADAPRGIFIEDDHVQRSALLLRDVAYRLHADLAFFSDKDRAANPAKYWQIFERRADKGQCVNQPYLGCREFPAYFRRVPDGATEPPPIDASPDLGFMLFDMDFADRADPKPMFFRALMHKGVIEVPACDSVEVRR

SEQ ID NO: 2827 - protein, 240 aa, Brevibacillus panacihumi W25
MRNAIEFMVYGDYALFTDPLTKLGGEKLSYQVPTYQALKGIVESIYWKPTLIMVVDAVRVMKPIRMESKGIRPLEYGGGNTLANYTYLRDVCYQVRAHFEFNMNRPDLAYDRNENKHHNILKRSLRAGGRRDIFLGARECQAYVEPCVFGEGDGFYDNYGGDLHLGNMIHGINYPDETGRNQLEVRLWSPVMKDGYIEFIRPEQCTQVRTIMDMTPKRFDDANVSSAEELYAQLAVGGNP

SEQ ID NO: 2828 - protein, 242 aa, Streptococcus pyogenes GA16797
MYRSRDFYVRVSGQRALFTNPATKGGSERASYSVPTRQALNGIVDAIYYKPTFTNIVTEVKVINQIQTELQGVRALLHDYSADLSYVSYLSDVVYLIKFHFVWNEDRKDLNSDRLPAKHEAIMERSIRKGGRRDVFLGTRECLGLVDDISQEEYETTVSYYNGVNIDLGIMFHSFAYPKDKKTPLKSYFTKTVMKNGVITFKAQSECDIVNTLSSYAFKAPEEIKSVNDECMEYDAMEKGEN

SEQ ID NO: 2829 - protein, 239 aa, Youngiibacter fragilis 232.1
MNDWCLEVWGDYACFTRPEMKVERVSYDVITPSSARSIFESILWKPAIKWNVTKVEVLNPIKWISVRRNELGKVVTAPTEKQMSGALGAPMGIFIEDVRQQRAGLFLRDVRYRIYGYFDFINPESRVVKKKSREEEVGTPIRNDETEAKYAAMFQRRASKGQCFHRPYLGCREFACDFKLIEDQGIDKKNPIDITRDLGYMLYDMNFDEDVENPIPLFFKAKMENGTINTDRRQVEVIG

SEQ ID NO: 2830 - protein, 220 aa, Ruminococcus gnavus CC55_001C; identical to SEQ ID NO: 2487

SEQ ID NO: 2831 - protein, 239 aa, Bacillus thuringiensis serovar aizawai str. Leapi01; identical to SEQ ID NO: 2732

SEQ ID NO: 2832 - protein, 234 aa, Bacillus vireti LMG 21834
MRNAIEFEVYGNYALFTDPLTKMGGEKLSYQIPTYQALKGIVESIYWKPTLLMVVDEVRVMNAIRMESKGIRPIEYGGGNTLANYTYLKDVRYQVRAHFMFNPYRPEMAFDRNENKHHNILKRSLNAGGRRDIFLGTRECQAYVEPCVFGGGKGFYDNYGDIHMGTIIHGINYPDETGRNEMEVRIWNPVMKDGVIKFIRPDQCTQIRKITDMEMKQFNNTNVESADNLLKQLE

SEQ ID NO: 2833 - protein, 239 aa, Rheinheimera nanhaiensis E407-8
MTTKPMKNSISFRLRGRYALFTDPITKVGGEKCSYHLPTYEALKGVLKSIYWKPTLTWYVDRVRVLKPLRTQTKGTKPLNWGGGNSLAIYTFLHDVEYQVEAHFEWNEHRPELAADRIDGKHFSIATRVLEKGGRQDIFLGTRDCQAYVEPCEFGEGSGAYDNIDELGFGLMFHGFDYPDETGINELHSRFWHATMKHGIVTFPRPEDCQIRRFVREMQPKEFALDVNQQAVDELEAAV

SEQ ID NO: 2834 - protein, 242 aa, Paenibacillus popilliae ATCC 14706
MYLIRNSIEFEVFGNYALFTDPLTKLGGEKMSYPVPTYQALKGIVESIYWKPTLLFVVDAVRVMNPIRMESKGVRPIEYRGGNTLAYYSYLKDVRYQCRAHFVFNPNRPDLEYDRNEHKHHNILKRSLQAGGRRDIFLGARECQGYVEPCEFNIGEGFYDNYGELQFGTMVHGINYPDETGGKQMDTRLWNPVMKNGVIEFITPEQCTLVRPVAQMEPKRFAAGEIEAVEELEAWLGAEGSR

SEQ ID NO: 2835 - protein, 242 aa, Streptococcus constellatus subsp. constellatus SK53
MYRSRNFYARVRGDQALFTNPATKGGGERSSYSVPTRQALQGIIDSIYYKPTFINIVTEVKVVNQIQTELHGVRALLHDYSADLSYVSYLSDVEYLVKFHFIWNENREDLMQDRLPNKHEAIMERSIRKGGRRNVFLGTSECFGLVDEISQEEYENTPSYYDGVTIDLGIMFHSFAYPKDETTPLKSYFTKTVMENGLIKFKPQSECEIVNTLSSYTFKTPGQIKSVDDELKEYDAMEKGEG

SEQ ID NO: 2836 - protein, 239 aa, Paenibacillus sp. JCM 10914
MRNSVEFRVYGDYALFTDPLTKIGGEKLSYQVPTYQAIKGIVESCYWKPTLIMYVDRIRVMKPIRMESKGVRPIEYGGGNTLANYTYLKDVEYRVSAHFEFNMNRPDLAYDRNEFKHHNIFKRSVQAGGRRDIFLGTRECQAYVEPCELDDGESFYDNYGEIHLGTMVHGLNYPDETGRNQLEVRLWNPVMRNGIIEFPRPEDCNQVRVISDMMPKSFDSSNVESADQLWASIGGEEQA

SEQ ID NO: 2837 - protein, 234 aa, Leptospira interrogans serovar Lai str. 56601; identical to SEQ ID NO: 2373

SEQ ID NO: 2838 - protein, 234 aa, Leptospira interrogans; identical to SEQ ID NO: 2373

SEQ ID NO: 2839 - protein, 242 aa, Streptococcus mutans; identical to SEQ ID NO: 2649

SEQ ID NO: 2840 - protein, 242 aa, Streptococcus mutans; identical to SEQ ID NO: 2647

SEQ ID NO: 2841 - protein, 245 aa, Lactobacillus coryniformis; identical to SEQ ID NO: 2577

SEQ ID NO: 2842 - protein, 224 aa, Thauera sp. 63; identical to SEQ ID NO: 2717

SEQ ID NO: 2843 - protein, 229 aa, Leptospira noguchii; identical to SEQ ID NO: 2660

SEQ ID NO: 2844 - protein, 234 aa, Leptospira; identical to SEQ ID NO: 2607

SEQ ID NO: 2845 - protein, 223 aa, Halanaerobium saccharolyticum; identical to SEQ ID NO: 2453

SEQ ID NO: 2846 - protein, 211 aa, Desulfotignum phosphitoxidans; identical to SEQ ID NO: 2709

SEQ ID NO: 2847 - protein, 244 aa, Photobacterium marinum; identical to SEQ ID NO: 2638

SEQ ID NO: 2848 - protein, 239 aa, Rheinheimera nanhaiensis; identical to SEQ ID NO: 2833

SEQ ID NO: 2849 - protein, 224 aa, Xanthomonas translucens; identical to SEQ ID NO: 2629

SEQ ID NO: 2850 - protein, 240 aa, Selenomonas sp. F0473; identical to SEQ ID NO: 2630

SEQ ID NO: 2851 - protein, 206 aa, Lyngbya sp. PCC 8106; identical to SEQ ID NO: 2483

SEQ ID NO: 2852 - protein, 244 aa, Treponema primitia
MMQDWCLEVWGEYACYARPEMKVERVSYDVMTPSAARAIFDAILWKPAISWHITKIEVLNPIRWISIRRNEVGKIMGEPTQAQLEGKSGDSAGFFVEEHRQQRAGLFLRDVRYRIYGWFEFIPPEKRKPRLSQYDEFWADSEEQTNNTRSDESPAKYAAMFERRAKKGQCFHRPYLGCREFACNFTLVEGVHPIKEKINDDSDLGWMLYDMNYEDPSCPKPEFFRAYLENNTVNTDRRTLEVRS

SEQ ID NO: 2853 - protein, 203 aa, Sphingomonas elodea
MKVERVSYDVITPSAARGILEAIHWKPAIRWHVTRLHVLNPIRFQSIRRNEVGAKASAANAASAMKRGNTEGLGIAVDENRQQRAALVLVDVAYVIEAHFTMTARAGAEDSAAKHISMFNRRALQGQCFHRPCLGTREFPAEFALIEEGTPLPPSTLVEPDRDLGWMLHDIDFAKGNESRFFRAQMRDGVIDVPPFDAEEVVR

SEQ ID NO: 2854 - protein, 224 aa, Xanthomonas oryzae; identical to SEQ ID NO: 2376

SEQ ID NO: 2855 - protein, 230 aa, Nitrobacter winogradskyi; identical to SEQ ID NO: 2377

SEQ ID NO: 2856 - protein, 221 aa, Rhodospirillum rubrum; identical to SEQ ID NO: 2381

SEQ ID NO: 2857 - protein, 221 aa, Myxococcus; identical to SEQ ID NO: 2388

SEQ ID NO: 2858 - protein, 240 aa, Bifidobacterium adolescentis; identical to SEQ ID NO: 2437

SEQ ID NO: 2859 - protein, 237 aa, Chlorobium phaeobacteroides
MEHWNKQFCLEVKGDYACFTRPEMKVERVSYDVITPSATRGIFEAIFWKPAIRWRIRKIEVLNPIKWISVRRNEVGQTASERSDCIFIEVARQQRAGLFLRDVAYRLHAELEFISPSERPDAKHPVPEALLDGWETEELRKDENPGKYYGIFERRARKGQCFNQPYLGCREFSCEFRLVDDLSNEPAPISETRNLGYMLYDLDFQKNVKEPPPAFFRVSMENGVINVPAWDSEEVRK

SEQ ID NO: 2860 - protein, 227 aa, Desulfovibrio vulgaris; identical to SEQ ID NO: 2389

SEQ ID NO: 2861 - protein, 224 aa, Pseudomonas stutzeri; identical to SEQ ID NO: 2392

SEQ ID NO: 2862 - protein, 242 aa, Roseiflexus sp. RS-1; identical to SEQ ID NO: 2393

SEQ ID NO: 2863 - protein, 238 aa, Pelotomaculum thermopropionicum; identical to SEQ ID NO: 2438

SEQ ID NO: 2864 - protein, 250 aa, Alkaliphilus metalliredigens; identical to SEQ ID NO: 2394

SEQ ID NO: 2865 - protein, 247 aa, Actinobacillus succinogenes; identical to SEQ ID NO: 2395

SEQ ID NO: 2866 - protein, 223 aa, Gluconacetobacter diazotrophicus; identical to SEQ ID NO: 2443

SEQ ID NO: 2867 - protein, 218 aa, Methylobacterium sp. 4-46; identical to SEQ ID NO: 2396

SEQ ID NO: 2868 - protein, 229 aa, Phycisphaera mikurensis; identical to SEQ ID NO: 2441

SEQ ID NO: 2869 - protein, 228 aa, Pseudanabaena sp. PCC 7367; identical to SEQ ID NO: 2425

SEQ ID NO: 2870 - protein, 221 aa, Methanoregula formicica; identical to SEQ ID NO: 2426

SEQ ID NO: 2871 - protein, 246 aa, Desulfocapsa sulfexigens; identical to SEQ ID NO: 2428

SEQ ID NO: 2872 - protein, 246 aa, Bibersteinia trehalosi; identical to SEQ ID NO: 2429

SEQ ID NO: 2873 - protein, 218 aa, Thalassolituus oleivorans; identical to SEQ ID NO: 2452

SEQ ID NO: 2874 - protein, 218 aa, Ruminiclostridium cellulolyticum; identical to SEQ ID NO: 2398

SEQ ID NO: 2875 - protein, 249 aa, Dorea sp. 5-2; identical to SEQ ID NO: 2745

SEQ ID NO: 2876 - protein, 215 aa, Lachnospiraceae bacterium 10-1; identical to SEQ ID NO: 2744

SEQ ID NO: 2877 - protein, 226 aa, Phocaeicola vulgatus; identical to SEQ ID NO: 2738

SEQ ID NO: 2878 - protein, 251 aa, Bacteria; identical to SEQ ID NO: 2739

SEQ ID NO: 2879 - protein, 221 aa, Terrabacteria group; identical to SEQ ID NO: 2740

SEQ ID NO: 2880 - protein, 237 aa, Paenibacillus barengoltzii; identical to SEQ ID NO: 2741

SEQ ID NO: 2881 - protein, 217 aa, Anaerotruncus; identical to SEQ ID NO: 2743

SEQ ID NO: 2882 - protein, 242 aa, Oscillibacter sp. 1-3; identical to SEQ ID NO: 2742

SEQ ID NO: 2883 - protein, 220 aa, Coprococcus sp. HPP0074; identical to SEQ ID NO: 2748

SEQ ID NO: 2884 - protein, 220 aa, Coprococcus sp. HPP0048; identical to SEQ ID NO: 2749

SEQ ID NO: 2885 - protein, 224 aa, Delftia; identical to SEQ ID NO: 2747

SEQ ID NO: 2886 - protein, 227 aa, Atopobium sp. oral taxon 199; identical to SEQ ID NO: 2750

SEQ ID NO: 2887 - protein, 242 aa, Streptococcus agalactiae; identical to SEQ ID NO: 2454

SEQ ID NO: 2888 - protein, 241 aa, Paenibacillus sp. PAMC 26794
MLRNQIVFEVSGKYALFTDPLTKLGGEKFSYQIPTYQALKGIVESIYWKPTLTWIVDEVRIMNPIQTESKGMRPIEYSGGNTLAYYTYLRDVRYQVKAHFIFNPHREDLIHDQNEHKHHNIAKRAVQVGGRRDIFLGTRECQGYVEPCQFGEDDSFYDRIGELDFGTMLHGISYPDETGSNEREVRLWKAKMQHGVIQFIRPDECTLVRKVGEGTAKIFDAGNMQSVDDLHSEWFGNEVSE

SEQ ID NO: 2889 - protein, 240 aa, Paenibacillus massiliensis
MRNQIEFEVWGQYALFTDPLTKLGGEKFSYQVPTYQALKGIAESIYWKPTIIWIIDEVRIMNPIQTESKGMRPIEYSGGNTLAYYTYLKDVRYQVRAHFEFNEYREDLAHDRNEHKHHNISKRAVHVGGRRDVFLGTRECQAYVEPCVFGEGKGAYDDVPELDFGIMVHGINYPDETGRQEREIRLWRARMDRGVIVFDRPEDCTLIRRAGEGVAKSFNSTNMQSVDELYEELLGSGVSE

SEQ ID NO: 2890 - protein, 202 aa, Halomonas zhanjiangensis
MKVERVSYDVITPSAARGILEAIHWKPAIRWCVDRIHVLKPIQFESLRRNEVGGKLSATSVTKAMKAGRVDEVAYFVDQNRQQRAATILRNVAYVIEAHFEFTPRADDSDTPGKHLDIFNRRARQGQCFHTPCMGTREFPANFALIEPEQSLPPFDAALNGEKDLGYMLHDIDFVNGKTSRFFRAKMQDSVIEVPPFQETLA

SEQ ID NO: 2891 - protein, 236 aa, Teredinibacter turnerae
MEKNNSISFRLWGRYALFTDPVTKLGGEKLSYHLPTYEAIKGVLKSIYWKPTLIWHVDRVRVLKQFRTEAKSMKPLDWGGGNTLSIYTYLRDVEYQVEAHFEWNLHRPALEKDRIDGKHFSIAKRMLERGGRQDIFLGVRDCQAYVEPCEFGAGPGCFDELEQLDFGLMFHGFDYPDESGEPALYKRFWRPVMRHGVVEFPRPEVCEHREYVRPMSAKAFAEGNNLKGVVAEEALL

SEQ ID NO: 2892 - protein, 253 aa, Treponema socranskii; identical to SEQ ID NO: 2813

SEQ ID NO: 2893 - protein, 224 aa, Aggregatibacter sp. oral taxon 458; identical to SEQ ID NO: 2804

SEQ ID NO: 2894 - protein, 240 aa, Aggregatibacter sp. oral taxon 458; identical to SEQ ID NO: 2803

SEQ ID NO: 2895 - protein, 240 aa, Atopobium sp. oral taxon 810; identical to SEQ ID NO: 2806

SEQ ID NO: 2896 - protein, 220 aa, Clostridiales; identical to SEQ ID NO: 2807

SEQ ID NO: 2897 - protein, 245 aa, Clostridiales; identical to SEQ ID NO: 2808

SEQ ID NO: 2898 - protein, 239 aa, Clostridiales; identical to SEQ ID NO: 2809

SEQ ID NO: 2899 - protein, 229 aa, Porphyromonas sp. oral taxon 278; identical to SEQ ID NO: 2810

SEQ ID NO: 2900 - protein, 240 aa, Selenomonas sp. oral taxon 892; identical to SEQ ID NO: 2811

SEQ ID NO: 2901 - protein, 253 aa, Treponema lecithinolyticum; identical to SEQ ID NO: 2812

SEQ ID NO: 2902 - protein, 218 aa, Oribacterium sp. oral taxon 078; identical to SEQ ID NO: 2817

SEQ ID NO: 2903 - protein, 215 aa, Firmicutes bacterium CAG:124
MKEITIEVWGDFACFSAPYAKVERLTYPFPTPSAARGIFSAIYMKPKEFRWQINRIEVLNPIRYISFKRNEVKCTVGSESISTEEERTQRQTTALQDVRYRIAASIIPRPAFAGKELQLYEQALRRIRTGKCFHQPELGMREFVCYFEESDGTRSPIQQSMDAGLMVYDLFAPDDVEVTKKTKIKMSLFHAVMENGVILIPPYDSPEVLKGEGLC

SEQ ID NO: 2904 - protein, 232 aa, Firmicutes bacterium CAG:137
MTNILNCPQVTITVWGDFALFSRPEGKVERITYPVPTPSAVRGMLASIYSKPAEFYWQVQRIEVLKKIQYATFKRNELKSKMPRIPAGNPMKACLLIEEDRTQRQSVVLRDVRYRITAQIVPRPDFPGSAIQLYNQFERRVKRGQMFVQPVMGAREFPAYFTWGSTGETPIQESLDLGLMVYDVFDLNIWKVGKQAEPSVSLYRAKMDRGVIEVPAFDSPLVLKPGRRDGGC

SEQ ID NO: 2905 - protein, 239 aa, Youngiibacter fragilis; identical to SEQ ID NO: 2829

SEQ ID NO: 2906 - protein, 215 aa, Thiohalocapsa sp. PB-PSB1; identical to SEQ ID NO: 2826

SEQ ID NO: 2907 - protein, 239 aa, Paenibacillus sp. JCM 10914; identical to SEQ ID NO: 2836

SEQ ID NO: 2908 - protein, 239 aa, Paenibacillus; identical to SEQ ID NO: 2433

SEQ ID NO: 2909 - protein, 237 aa, Methanocorpusculum labreanum Z; identical to SEQ ID NO: 2390

SEQ ID NO: 2910 - protein, 224 aa, Pseudomonas stutzeri A1501; identical to SEQ ID NO: 2392

SEQ ID NO: 2911 - protein, 238 aa, Pelotomaculum thermopropionicum SI; identical to SEQ ID NO: 2438

SEQ ID NO: 2912 - protein, 242 aa, Roseiflexus sp. RS-1; identical to SEQ ID NO: 2393

SEQ ID NO: 2913 - protein, 250 aa, Alkaliphilus metalliredigens QYMF; identical to SEQ ID NO: 2394

SEQ ID NO: 2914 - protein, 247 aa, Actinobacillus succinogenes 130Z; identical to SEQ ID NO: 2395

SEQ ID NO: 2915 - protein, 223 aa, Gluconacetobacter diazotrophicus PA1 5; identical to SEQ ID NO: 2443

SEQ ID NO: 2916 - protein, 218 aa, Methylobacterium sp. 4-46; identical to SEQ ID NO: 2396

SEQ ID NO: 2917 - protein, 204 aa, Xanthomonas oryzae pv. oryzae PXO99A; identical to SEQ ID NO: 2397

SEQ ID NO: 2918 - protein, 211 aa, Pelodictyon phaeoclathratiforme BU-1
MSYGIKLRVWGDYALFTRPEMKVERVSYDVMTPSAARGILEAIYWKPSIRWIIDRIHVLKPIRFENIRRNEVAKKTSLNRVDMVGQYPISIIVDDSDTRQQRASMVLRDVEYIIEAHFYFSMKEDNNEGKHLDIFTRRAKAGQCFHRPYFGCREFPVNFEWCVDIPKSLLSGEQDLGYMLHDIDFENNMTARFFRAIMHNGIINCKQEAVS

SEQ ID NO: 2919 - protein, 218 aa, Clostridium cellulolyticum H10; identical to SEQ ID NO: 2398

SEQ ID NO: 2920 - protein, 234 aa, Geobacter daltonii FRC-32; identical to SEQ ID NO: 2399

SEQ ID NO: 2921 - protein, 224 aa, Azotobacter vinelandii DJ; identical to SEQ ID NO: 2400

SEQ ID NO: 2922 - protein, 234 aa, Leptospira interrogans serovar Copenhageni str. Fiocruz L1-130; identical to SEQ ID NO: 2373

SEQ ID NO: 2923 - protein, 236 aa, Teredinibacter turnerae T7901; identical to SEQ ID NO: 2401

SEQ ID NO: 2924 - protein, 224 aa, Xanthomonas albilineans GPE PC73; identical to SEQ ID NO: 2444

SEQ ID NO: 2925 - protein, 247 aa, Meiothermus ruber DSM 1279; identical to SEQ ID NO: 2402

SEQ ID NO: 2926 - protein, 219 aa, Desulfarculus baarsii DSM 2075; identical to SEQ ID NO: 2403

SEQ ID NO: 2927 - protein, 224 aa, Acidovorax avenae subsp. avenae ATCC 19860; identical to SEQ ID NO: 2405

SEQ ID NO: 2928 - protein, 239 aa, Syntrophobotulus glycolicus DSM 8271; identical to SEQ ID NO: 2406

SEQ ID NO: 2929 - protein, 220 aa, Planctomyces brasiliensis DSM 5305; identical to SEQ ID NO: 2407

SEQ ID NO: 2930 - protein, 220 aa, Planctomyces brasiliensis DSM 5305; identical to SEQ ID NO: 2407

SEQ ID NO: 2931 - protein, 227 aa, Nitrosomonas sp. AL212; identical to SEQ ID NO: 2409

SEQ ID NO: 2932 - protein, 229 aa, Marinithermus hydrothermalis DSM 14884; identical to SEQ ID NO: 2410

SEQ ID NO: 2933 - protein, 218 aa, Selenomonas sputigena ATCC 35185; identical to SEQ ID NO: 2411

SEQ ID NO: 2934 - protein, 227 aa, Treponema brennaborense DSM 12168; identical to SEQ ID NO: 2413

SEQ ID NO: 2935 - protein, 238 aa, Porphyromonas asaccharolytica DSM 20707; identical to SEQ ID NO: 2412

SEQ ID NO: 2936 - protein, 218 aa, Desulfotomaculum carboxydivorans CO-1-SRB; identical to SEQ ID NO: 2414

SEQ ID NO: 2937 - protein, 227 aa, Methylomonas methanica MC09; identical to SEQ ID NO: 2415

SEQ ID NO: 2938 - protein, 222 aa, Zymomonas mobilis subsp. pomaceae ATCC 29192; identical to SEQ ID NO: 2418

SEQ ID NO: 2939 - protein, 224 aa, Pseudoxanthomonas spadix BD-a59; identical to SEQ ID NO: 2421

SEQ ID NO: 2940 - protein, 246 aa, Clostridium sp. BNL1100; identical to SEQ ID NO: 2422

SEQ ID NO: 2941 - protein, 229 aa, Phycisphaera mikurensis NBRC 102666; identical to SEQ ID NO: 2441

SEQ ID NO: 2942 - protein, 229 aa, Thermus thermophilus SG0.5JP17-16; identical to SEQ ID NO: 2416

SEQ ID NO: 2943 - protein, 227 aa, Desulfovibrio vulgaris RCH1; identical to SEQ ID NO: 2404

SEQ ID NO: 2944 - protein, 234 aa, Leptospira interrogans serovar Lai str. IPAV; identical to SEQ ID NO: 2373

SEQ ID NO: 2945 - protein, 221 aa, Rhodospirillum rubrum F11; identical to SEQ ID NO: 2381

SEQ ID NO: 2946 - protein, 242 aa, Streptococcus mutans LJ23; identical to SEQ ID NO: 2440

SEQ ID NO: 2947 - protein, 227 aa, Geobacter metallireducens GS-15; identical to SEQ ID NO: 2380

SEQ ID NO: 2948 - protein, 228 aa, Pseudanabaena sp. PCC 7367; identical to SEQ ID NO: 2425

SEQ ID NO: 2949 - protein, 221 aa, Methanoregula formicica SMSP; identical to SEQ ID NO: 2426

SEQ ID NO: 2950 - protein, 221 aa, Myxococcus stipitatus DSM 14675; identical to SEQ ID NO: 2427

SEQ ID NO: 2951 - protein, 246 aa, Desulfocapsa sulfexigens DSM 10523; identical to SEQ ID NO: 2428

SEQ ID NO: 2952 - protein, 246 aa, Bibersteinia trehalosi USDA-ARS-USMARC-192; identical to SEQ ID NO: 2429

SEQ ID NO: 2953 - protein, 218 aa, Thalassolituus oleivorans MIL-1; identical to SEQ ID NO: 2452

SEQ ID NO: 2954 - protein, 224 aa, Azotobacter vinelandii CA; identical to SEQ ID NO: 2400

SEQ ID NO: 2955 - protein, 224 aa, Azotobacter vinelandii CA6; identical to SEQ ID NO: 2400

SEQ ID NO: 2956 - protein, 242 aa, Streptococcus agalactiae ILRI005; identical to SEQ ID NO: 2454

SEQ ID NO: 2957 - protein, 239 aa, Paenibacillus polymyxa CR1; identical to SEQ ID NO: 2433

SEQ ID NO: 2958 - protein, 225 aa, Mannheimia succiniciproducens MBEL55E
MANRIRLHIWGDYACFTRPEMKVERVSYDVITPSAARGILSAIHWKPAINWVIDKIYVLKPIRFESVRRNELGAKISESKVSGAMKRKSVADLYTVIEDDRQQRAATVLKDVAYVIEAHAVMTSKAGVDENTTKHIEMFKRRALKGQCFQQPCMGVREFPAHFALIDDNDPLPLSQLSESEFNRDLGWMLHDIDFEHGNTPHFFRAELKNGVIDVPPFYAEEVKR

SEQ ID NO: 2959 - protein, 222 aa, Methylococcus capsulatus str. Bath; identical to SEQ ID NO: 2375

SEQ ID NO: 2960 - protein, 224 aa, Xanthomonas oryzae pv. oryzae KACC 10331; identical to SEQ ID NO: 2376

SEQ ID NO: 2961 - protein, 230 aa, Nitrobacter winogradskyi Nb-255; identical to SEQ ID NO: 2377

SEQ ID NO: 2962 - protein, 237 aa, Chlorobium luteolum DSM 273; identical to SEQ ID NO: 2378

SEQ ID NO: 2963 - protein, 238 aa, Chlorobium chlorochromatii CaD3; identical to SEQ ID NO: 2379

SEQ ID NO: 2964 - protein, 221 aa, Rhodospirillum rubrum ATCC 11170; identical to SEQ ID NO: 2381

SEQ ID NO: 2965 - protein, 222 aa, Hahella chejuensis KCTC 2396
MSYGIRLLVWGERACFTRPEMKVERVSYDVITPSAARGIIEAIHWKPAIRWVIDRIHVLNPIRFESIRRNEVGGKLSARNVAKAMKAGRVDGVAFFVEEDRQQRAATVLRDVAYVIDAHFELTEKAGVDDSEGKHLDIFNRRARKGQYFHAPCLGVREFPAYFRLLDADESPPQPHTSLEGEVDLGWMLHDIDFVNGMTPRFFRARMVNGVIEAPSFAEAIA

SEQ ID NO: 2966 - protein, 224 aa, Xanthomonas oryzae pv. oryzae MAFF 311018; identical to SEQ ID NO: 2376

SEQ ID NO: 2967 - protein, 221 aa, Frankia sp. CcI3; identical to SEQ ID NO: 2382

SEQ ID NO: 2968 - protein, 237 aa, Rhodoferax ferrireducens T118
MVNPNGIEFKVSARHALFTDPLTKIGGEKCSYHIPTYEALKGITKSIYWKPTLIWVIDEVRVMKRIRTQTKGTKPLDYGGGNTLAIYTFLADVEYQVRAHFEWNLHRPELKDDRIPAKHLAIAQRMVERGGRQDVFLGTRDCQGYVESCVFGEGDSPYDVEGELAFGLVFHGFDYPDETGESKLHARFWQPTMFNGRVTFKRPEDCTVRKYVRDMGIKKFGDQNLRGVEAEAAELED

SEQ ID NO: 2969 - protein, 225 aa, Methylobacillus flagellatus KT; identical to SEQ ID NO: 2383

SEQ ID NO: 2970 - protein, 221 aa, Myxococcus xanthus DK 1622; identical to SEQ ID NO: 2388

SEQ ID NO: 2971 - protein, 240 aa, Bifidobacterium adolescentis ATCC 15703; identical to SEQ ID NO: 2437

SEQ ID NO: 2972 - protein, 237 aa, Chlorobium phaeobacteroides DSM 266; identical to SEQ ID NO: 2859

SEQ ID NO: 2973 - protein, 227 aa, Desulfovibrio vulgaris DP4; identical to SEQ ID NO: 2389

SEQ ID NO: 2974 - protein, 593 aa, Nitrobacter winogradskyi Nb-255
MSILASLVRAYDHLPDAPPFGYSMQNIGVIVSLNEDGSVANVIDWRDGEGKRKKPRPMLVPQPVKRTAGIAPNFLWDKTSYVLGVTSGDGRRTADEHAAFKERHERELAGSDDAGLNALLKFLRQWTPDQFLAPVWPDEMRDQNVGFVLESDRRENLWLHQRDAAKALWERISQEASGGAQICLVTGEANPVARLHPSIKGVWGGQTAGASIVSFNLDAFTSYGHEQGDNAPVSELAAAKYTTALNRFLERGSGHRIQIGDASTVFWADSADAEAAKIAESAFSQFFDPADDAAAGDAAETRKIAILLERIRKGEQIEKIDAGLAKDVRFYVLGLAPNAARISIRFYFEDDFSVLGRNYQRFVEDMRIEPAWRQPYPPLWRYLRETAVLGKGENVPPNLAGEWMRSILSGTNYPLTLLAAVLSRIRADGEINALRVGMLRALLVRNYRMKPENRNKRREAPVALDPENRNKGYLLGRLFAVYEQAQTAALGRNVNATIKDKFYGSASATPRRVFSLLDRNSANHLSKVGKERPGQRVNIEKTIGAIMDMMMPGEDPFPASLSAAEQALFGLGYYHQRGEFFRKRETVAAEEAA

SEQ ID NO: 2975 - protein, 581 aa, Pelodictyon luteolum DSM 273
MILQALYDYYQRKAVDPDSGIAPEGFVWKEIPFVIVINHEGDFISLEDTREGDGKKKRAKKYLLPKSVGRSGSNGWMTSFLLWDHYGYVLGHARSEGEKDQVMAQKQMLSFIKKIQDLPQEIKEDNGVLAVIRFYDQRSYEKVKDSDKWEECSKIIGCNMSFRLDGDSSLIPCNTSVQKYIADQCDENADGVTGLCLITGKRGEIARIHSDTPINKDSKKFVSFQRSSGYDSYGKEQAFNAPISKSAEFAYTTAMNMLLGKDSINKVQVGNTTSIFWSQKEDVFEAIFPSFFGYNKDNPDADVKAVKTLFESAWTGYVNTNSNTRFYILGLSPNSARIAVRFWHTGSIGKCSGNIKQHFDDLEIIRPSHDRGHYSLFWLLSAIAHEKKVDNIPPNLSGQIFEAVITGGTYPATMLQQTIRRIRATQDVTRVQAGILKAYLNRFHRIYSTKEKETITVALDSNNINPGYRLGRLFAVLEKIQEEANPGINATIRDRFYGAASSTPVTVFSQLLKLKNHHLAKLDNEGRKVNFERMLSDIFAGIDASMPAHLAMEDQARFAIGYYHQRQALFTKSSSNNESKN

SEQ ID NO: 2976 - protein, 642 aa, Chlorobium chlorochromatii CaD3
MSWMQRLCETYDNAHNKVGDYNDDAILLPLYHTTMTCNIEVTLNENGEFVQAKPSEKKKIIIIPCTESSAGRSGDSPKAHPLSDKLQYIAGDFSHYGGEVTSGFKNDPEEPFRQLYQQLTEWSEASPDKYKLRAVKRYLEKKRLIEDLIEAGVLHLDEDRKLLKKWDSKGKKKTDKPPIFESITNVNDATVGWHVEKKGEPTEPLWKDKDIHKAWQAYYESRKINPKLCFISGRSDVAPAEQHPKKILQGASNAKLISSNDKKGFTFRGRFTTAEEACTISAVASQKMHNALSWLVERQGYNKGTLNIVAWAVSGGNIPDPMKETAPYDYDDLGDDYNAAQAFGLAFKKRIAGYRARISSTDSILVLAFDAATSGRASLTYYRELTGSDFLDRLERWYARHEWLYSKPEKKRGFFIQVRSPEQIAKDIYEHNKTEDKEKKTDDIIRSVVQRLLPCIIDGQKVPFDLVVAARNRASKPMSFKKYKEDWKNREDWENTLSTACALFRGYYYTNFQEEYSMSLDPNRTTRDYLYGRLLAVAESLEKSALGLADEGRSSTAERYMQQFAERPFNTWKTIELSLSPYIARLQSNAPGLKKFYTDKLDEIHCLFNPDDFENNEPLTGEFLLGYHCQRLKNYEGSSKKD

SEQ ID NO: 2977 - protein, 586 aa, Geobacter metallireducens GS-15
MILQALHGLYVRKQDELPPEGFEQKEIPFLIVLNGDGTFGDFQDTRNRSGKKLIARQFRVPKDSGRSGKNAWQSANLLWDHYGYVLCWPKSDSDADKEMARKQHGTFVERVGELAAAYPQDKGVQAVMRFLKSDEREKLLEHPAWEECRKIPGCNLSFRLSDELSLVCESDNVREFVAKSSAQDDDEDDSTTGDVEGICLVTGESATVARLHPRTPIIGAKSNAKIVSFQKNMGFDSYGRQQSYNAPTSKGAAFAYTTALNHLLAKESRQKLLIGSDTMVFWAGEKHRVEDLFADLFGEPAKENLDQTTQAIRSLYTAPQAGTPPLDHDLTPFFVLGLAPNAARIAVRFWHAGTVGETARHIRQHFDDCAVVHGPNQPEYLSLFRLLVSTAMQGKSENIPPNLAGDLMKSILAGTPYPQSLLSAAIRRCRAEREITYPRVSVIKAVLARGTRYYTSNEQEVGMALDVTNTNPGYRLGRLFAVLEKIQEEASPGINATIRDRFYGAASGTPVAAFPHLMKLKNHHLAKLENRGRAVNLEKIVGEIMDGLDDFPTHLSLQDQGRFAVGYYHQRQDFFKKNETTTNVNP

SEQ ID NO: 2978 - protein, 560 aa, Moorella thermoacetica ATCC 39073
MLLESLREYSTRLDLPPVMYVKTPIRWFIDLDSQGNLLGFVSATGPETRGKDRGKIMYAPNIVRSSGVKPKLLADKGDYVLGLASEKSKLERVNECHRAFIDLVRQCAISTGNKSVQAVLRFLENWDPEGARLPEDFNPGDNLTFRVDGRLPIEDPDVQSFWADYTNPQEGEATTCLLCGQLKTPAERHPVKIKGIPGGQTAGMALVSANAAAFESYGLQASLIAPICYDCAERYGKAANALIENDATHLRLGSCIYLFWTRKPSNFSIASLLSNPQPEDVKALLAAVYTGRQADLEDDNLFYATALSSSGGRVAVRDWLETTLGDVKRNLGHYFALQRLVDAGGREGPPLGLFPLAWSTVREPKDLPPTTTRALLHFALKGGALPHWLLYEAIKRARAEKDQEKITRSRAALIKMVLFSQKPNLAEGSALEKLDTSNRNPAYLCGRLLAVLEGIQWSALPGIKATIVDRFYGTASTAPAAVFSRLLRGSQSHLGKLRKEKPGLYYYWQQALESILGNLSSFPPVLTLEEQGYFALGYYHQRAANREGTNSKEDGEETRP

SEQ ID NO: 2979 - protein, 607 aa, Rhodospirillum rubrum ATCC 11170
MSLLAALTRAYDRLAERHEVPAFGYSTQNIGFLISLTDDGALAGPPIDLRQGAGKKRVGRPMAVPLPVKRTSGIAPNFLWDKTSYVLGVSAGAGKRLAEEHAAFVTSHQSALVGSEDPGLRALLTFLQAWTPDHFDTLGWPEEMKDQNVIFALESERLRDVYLHDREAARSLWARQLAATDRPRAVCLVSGEKAPIARLHPAIKGVWGGQSSGVSLISYNKESFDSYGHEQGDNAPVSEVVASAYTAVLNQFLASDSGHRIQIGDASTVFWADASDAETASLAENSFLAMIDSIDEDKQAGEVGAILEKMRTGMALSDAAPRLAEGVRFYVLGLAPNAARVSVRFWFEDDFGVLAKNYQRYAEETRIEPSLRDAYPPLWKVLLETAVLGKRENVPPNLAGAYLRAILTGTRYPQTLLSTLLMRLRSDKTVSPLRVALLRALLIRNLACKEAPVALDPENTNKGYLLGRLFAVYEDIQRAALGYHVNATIKDKFYGSASAQPRRIFKILANGAANHLSKIGKDKPGLKNTLEGAITAITEVLSPGEDPFPVAFSTEQQALFGLGYYHQYADISRRRAEAIQRAKEKKAKEKAAASAAENASATEETAQ

SEQ ID NO: 2980 - protein, 627 aa, Frankia casuarinae
MLLQRLTEFQRPMISGVDDLPPFYQSRPMRWGLMIDADGQLAMPDLLDLSDPTDKLRRFGEPGPVPYLTRSSGASPLLGADDIQYVLGWADDDAKPDWVGRCHASFVDLVHRWATAFPADLIAQAVDGFFTRRGHNQVRRPEVWTSKQGIVLLVGDDGHWLPEERSVQIFWEREVQRRKAGGDSPDGGRRGVCLVCGQDGVLVERFPQGIPRRLVPLAGQAIAALVSANKKIHTYDFSDSLATVPICIGCARISVANLHYLLDHPDHSLSGSDGRMTWWTIGREVAVMTLMGQARAADVRVLGERVHSGRGTEDTDLEHERFCSVTISGSGARIAVRDWIDMPLAQLEENIIHWFGDHQTYGVNLARGGYVPLTRLVLATGRWIEQGGGDRSSGEYARFDDRSAQRPDGVRRDLLRIALKNLPVPPALFGHLLTRIRTDGHVDDARVALLRLALVRRARLADERNRPVPGPGLDPDNHDPAYLAGRIFAQLESIQYYASQMGREKGDRLNTTFADRYFAGAVANPKTALIQGWLLVHPWLKKIRRDSIARAVALENQLHGLNELLVASGGFPGRGNPDDQAMFILGYSHHRSDSMRRGGAANAAKTPGPGFPPNTPGMPADPGTPTP

SEQ ID NO: 2981 - protein, 636 aa, Rhodoferax ferrireducens T118
MSWIHKLYETYEQCQGRDMAGEAQLLPVSHAQQQAHIEIALDAQGGFKTARLINKIETYIPATEQSAGRVGTKPPPHPLCDKLQYCALDYPLHGGKKPSFFNEYEGLLNAWCSSEFAHSKAQAVLRYVHGGTLITDLVDAGILHVDANDNLLTRWTGSGPAPELFRMLTPNAGERDQGDAFVRWQVWEQGNPCTAVWEDTSLQKAWAWFDASTKTLKGLCMVTGVGETALAENHPKRIRHAGDGAKLISANDSSGYTFRGRFTDKTGLQACGVGYEVTQKAHNALRWLIHRQAYRNDDQVIVTWAVAGKDVPDPFQDSLALFLSAEEISQADTQSPPTNVGDVGQAFSLRLNRAIAGYRAKLAPTDDVVVLGLDSATPGRMAISFYRELKSSNFFERLQTWHRRSAWMQNFGANRQFIGAPSPRDVAEAAFGRRVDEKLRKSTVERLLPCIIDGQRLPRDLMNSTVRRATNRVGMAHWEWEKTLGIACALFNSYFHERDYQMTLETDRLSRDYLYGRLLALAEHIESRAIYLGGEKRDTTAAKLMQRFADRPASTWRTIELALTPAKSRLRAKQAGFLHKMEVLHDGIVASFQGDDFLDDRKLTGEFLLGYHCQRRELNSPKVDAIASTTEEAIAN

SEQ ID NO: 2982 - protein, 604 aa, Methylobacillus flagellatus KT
MILSALVGYYQRLLNHPDPNTGQPKVPAYGYSAEKIAYVILLSRDGEVVDVQSNLDTTGKKPVPRLISVPRPEKRTSGIKPNFMWDKTAYVLGVESNKDKSAAKEQPWVVADKTFQAFKQLHLEKLQSVEDVGLQALCKFLQSWQPTEFAQAPFSAEMVDANVVFRLDGDYEFLHEKPETRQIWGAMLVPDDDALIAPCLVTGEASAVARLHPPIKGVYGGQSSGGSIVSFNADAYASYGKVQGENAPVSEAAAFAYTTALNYLLRRDNRQCVSIGDASTVFWAVASDETSAQEAEQFFAACFDRPVDDAEEQARIRPFLEKISHGRPLAECNPGVDLQTRFYILGLAPNAARISIRYWMDTTFGELAEHVAQHFRDMQLEPCAWREPPSIWRLLIQTAAQGKSENIPPQLAGELMRSIVTGQRYPRMLLSQLTQRVRVDGDVTGLRAALIKAVLQRDYRKRLIQEEVPVGLDRDNKNVAYLLGRLFAVIERIQEATLGDVNSSVVDKYYGSASSIPFSVFPRLLAGSQNHLAKLRRDKHGYAVLLGRDMGEIVDGLGGTFPKHFSMEDQGRFAIGYYQQKQHYFTTRGSKNEKVLEADAVPED

SEQ ID NO: 2983 - protein, 661 aa, Deinococcus geothermalis DSM 11300
MLAALIRQAQQAGLSPEPGFAPKELHWLAQLHSGKFTGVLPLREGKKGRQVARCPELSQPEMMALPKALGQTQAAHFLADSCGVIALLPERAGQEVDTKTQAKHGAYAALLERAAQDLPQLLPVLEVLRDPAELAELRAELAQRGAKATDRLSFAVDGLDLLESELWHDWWRRFRRQVFGQPTTTGTMLDLSSGEVVTPAKTHPKLNKLGVGAMPTGASLIGYDKEAFSSYGLQAGENGAVSEENAAAYRAALEHLLAQAPVLGQMKVAVWFDHRQAEGQALIDAIENPATLTQASETFSWDDWDDSASVAVVQTPEQQAAVAHTRAQQLLSALRRGETPPTLTAQYFALAISGASGRAMVRDWHTGSLEHLAEAVATWFEDLAITNLSGKRAKRPRFFSLLMNIQRPKPQSTSMDDYLKPIRNLQLPLWRAALDPNAPIPFSAVAKLMEAHKAQVMTGQFSEALSRDGDGEDKGRIYTRMALLKAYHNRKARRQLARGQGGFLMSSSVDPHHPSPAYHCGRLMYLLANVQDAQGSDVNAGVVQRYYGAASSTPALVLGRLTRLSQHHLAKIAREKPGLALTLERDIAAVWSALGHDLPKTLSLEEQSLFALGYYQQLADSVARRQDLAAQRKAATAQADPHPETSPLAETTQTEQTAQGE

SEQ ID NO: 2984 - protein, 582 aa, Myxococcus xanthus DK 1622
MMLTALNDFARERGLTDDPLYEVKPVDFFIRISAKGKFIKLESLAREDGRGNAMPIPRLPQRSVNIAAGFFADNSKYVLAYEKDAPKAKAGGVEKRLARLEAFLKPVREVVAETKDAEARAVESFLDSEAERSKALADRGAEEWTGSEMLAFVVGEATTPVHQNPAIRACWERRAGAQRALGRRALCLVTGREGVVAVTHPKLKNVPEAQPSGASLVSFNAPAFSSHGLEQGENAPISQEASLGYVLALNDMLRRTEQRRFRQGIQLADGSVMVFWTRASPSEESFLLSLLDPTEDDLKRFVESPRKGVEPGELDDRAFYAVTLAGNAGRVAVRDWFESRVGEVKQNIRRYFDDLRMGDAPAGPIPVYRLLKAVEAPSGRGLTPDIAARMLGAALRGQPFPRQLLVAALDRLRLPPADGGVEREQLRLRVALIKAYLLRDRNRGSTPLEVTVSLDKDNPSQPYVLGRLFAVLERLQGVALKDLNATIRDRYFGAASRNPVTVFPRLIQLSVHHASKAGENGRWLERTKGEVMALLPSKDPFPPVFQPEQQGLFAVGYYHQREAFFTKREAAAAPADSTASST

SEQ ID NO: 2985 - protein, 566 aa, Nitrosomonas eutropha C91
MILQALCKYYERKPDLPRPGFEIKPIPFIIEINADGRFVQIEDTRTMAGKKKIAHSFLVPQGVKKTSGIAANPLWDTTEYVLGVTSTGKPERVQEQHAAFLAKLEVLANEINDAGLNAICTFLHSPEKERLENNPLWSEIRDTNSILTFRLSGDKELVCQRPAVYTLFENASTETEKIICLITGKPDHFERLHTAIKGVWGAQTSGANIVSFNKEAFNSFAKEQGANAPVGKHAAFAYTTALNHLLSRESTQRIQVGDASTVFWSEQSSPLEDSFASIFDEPPKDDPARQTRAIEALFKSPETGTFSNEGGDTPFYVLGLAPNAARISVRFWLTGTAAGMSQRIRRHFEDLKIVHASFEKPYLSLFRLLVSTAAQGKSENIPPNLAGDFMRAILEGLPYPQTLLAAAVRRIRAEREITCPRASLIKACLNRQAHRSSSQEKEITVSLDNSNTNPGYRTGRLFAALEKIQEESSPGLNATIRDRFYGAASSTPVTVFANLMKLKNHHLAKLEEGRKRFFEKLIGEIMASISDFPAHLNLADQGRFAIGYYHQRQAFFTKSEPANKGE

SEQ ID NO: 2986 - protein, 600 aa, Syntrophomonas wolfei subsp. wolfei str. Goettingen G311
MIIQSLQEYYERLDKDPLSGIAPMGYSKAKVAFAFNLSENGELLDIFPLYEVKGNKKISREMLVPEQVKRSSGVNANCLCDNSSYVLGIDNKGKEQRSRDCFMAFKELHNEILTGVVDEGAKAVLVFLNSREAGQFSEKTLQDNMEQLLEGGNIVFRLDGADGYIHERAPIKKAWEKYQETDKTDAYIAQCLVSGEKGPVALLHPSIKGVRGAQSSGASIVSFNDDAYVSYGKKQSYNAPVSVNTTFAYTTALNYLLSNPKNRIKIGDTTVVFWAEREPEENLIAAFFDPPEEPKEQEMAQIDHASIQKIRDILMQLRDGKKPPNVDIDERTRFYILGLAPNAARISIRYYYQGEFGTLMKNVGLHYADMLVVLPKDYRPVFPPVWRILMETATGGNTENIPPILGGALMRTILSGGAYPQSLYSVILSRIRADSIVNPIRTGIIKACLLRQFRINGQKEKEDVIKMSLNPENTAPGYLLGRLFALLEIAQQDSADTKLNATIVDRCYGTASTTPAAIFPMLVKLSKHHLKKIKSTKPGLGYALDNKMQEVVNVLDDTKGLPRYLNLDEQGLFVLGYYQQKQDWYTSKEKQGGIIDGDNN

SEQ ID NO: 2987 - protein, 647 aa, Magnetococcus marinus MC-1
MSWMQMLHTTYECCKDQLGPIYHTTQQAHLEVVLDHSGTFLRAHVPSSKTDSTTLIPCSEKSAGRTSGLMNHPLADKLQYVAGDYLSFAGALSEKEQTKMMESHRLYKEALATWADSPQSHPTVKAIYAYVAQGRLVGDLVNAGILPCVEGSIPPKWQGPKEETPAIYKAVTGMPLDAFVRWRVEPAPGVCEIEPWNDPQLIQAWIDHYLALLEESAPRGTCMVTGQTDVLLAQSHPAKLRHAADKAKLISANDSSGYTYRGRFLSADEVCGVGLETTQQVHNTLRWLIEKQGYRQGDLRIVAWAVDGRTTPGILISTQELLGDNVPAETEEEDELLPTSSMGHSVDQSFGLRLGKKISGYYSQLGDLTDIVVMGIDSATPGRMSIIYYRELQQTEFLQRLEKWHSQMAWPQNFGKDSQFTGAPAPRDIAEAAYGRRLDDKLKSTTLQRILPCIIDEQPFPEDLIHAVVHRTSNRVAFDRSKTGFQWEWEKCLGIACALVRGSNLRAHIKKEYAMALEPDYTSRDYLYGRLLALADYLEEQALHAANEHRATNAARLMQRFSQRPNATWLTIYDALLPYKNRLQVNKPGLYINMMRELDNVMNLFAIADYQNDAPLKGEYLLGYHCQRAVLWAKKGDKTGTQATETE

SEQ ID NO: 2988 - protein, 574 aa, Chlorobium phaeobacteroides DSM 266
MILHALYDYYQRKAADPESGIAPEGFEWKEIPFVIVIDQVGNFITFEDTREGDGKKKWAKKYLLPKSIHRPGSNSWMTSFLLWDHYGYVLGHARGESDKDQKMAHKQMPTFIKKIQALPSEVKEDEGVIAVIRFYENGGYEKVKSAHNWSECAKIVGCNLSFRIDGESDLVPCRDAVRKYVASQCSDNTDGVSGLCLITGENAAIARIHSDTPINKDSKKFVSFQKSSGYDSYGKEQAFNAPISKSAEFAYTTTMNMLLGKESKNKVQVGDATTVFWSQKQEAFEEVFPALFGYPKDDPDADVKAVRALYEGVNTGHANMDSDTRFYVLGLAPNSARISVRFWHTGTIAEFAGNIRQHFDDLAIIRSQKDSDHFSMFWLLSAMAHEGKVDNVPPNLSGQIFQSVITGGLYPATMLQQAIRRIRATQAKDLKNRSTQASILKAYLNRFSRIYKTKEKEINVALDPTNDNPGYRLGRLFAVLEKIQEEASPGINATIRDRFYGAASSTPVTVFPQLLKLKNHHLSKLKNVGRRVNFERILASIFDGIGNDMPSHLSMEDQARFAIGYYHQRQDFKK

SEQ ID NO: 2989 - protein, 599 aa, Desulfovibrio vulgaris DP4
MILQALHGYYQRMSADPDAGMPPYGTSMENISFALVLDAKGTLRGIEDLREQDGKKLRPRKMAVPAAVTRTSGVKANFCWDKTAYVLGNDANGAAKNAERFAAFRELLTAVCADVDDEGFRAVTRFLDTWDPEQAAQVVAALHDWDDIVPANLVFRLEGTKGFIHDRPAIQKAWSAFCANSDNSPKGRCLITGERDVAQALVHTPIKGVAGGQTSGGYIVSFNAPAFVSYHKDKADVGEVAAFAYTTALNTLLARGSRQRVPIADATVVFWAERSSPAEDIFAGMFDPPSTTAKPESSNGTQPEDSEEGSQPDTTRDDPHAAARMHDLLVAIRSGKRATDIMPDMDESVRFHVLGLSPNAARLSVRFWEVDTVGHMLDKVGRHYRELEIVRQYDNEPEFPPLWLLLRQTAALNKTENISPVLAGGLFRAMLTGGPYPQSLLPAVLGRIRAEHTVTYYRAALIKAYLIRNRKLEVPVSLDPARTDRPYLLGRLFAVLEKAQEDAVPGANATIKDRYLASASANPGQVFHMLLKNASNHTAKLRKDPERKGSAIHYEIMMQEIIDNISDFPVTMSSDEQGLFMIGYYHQRKALFTKKNKEN

SEQ ID NO: 2990 - protein, 649 aa, Methanocorpusculum labreanum Z
MTWITKLYETYENCGNTVGIDNADGNAPLLPIGHTAQKTQIEITIDEDGTFQSVSIDPPKETKTIIIPCTMESEARSSGNTPHPLFDNLKYLAPDFQDTKKNDGNFFEKYLIQLEDWCESEYSHPKAQAILRYVKKGTIISDLRNAHLLNEKMESSPQNFYVRFNIYEGDVQEGWKDVSLRNRYIAYYLNSVIGKGPQSLCYASGKSLPVSRLSPRSVRRPGDGAYLISGTDESNFTFRGRFATRDEALCLSYDVSQKAHKALKWLIDKQGYKNGDQVFVVWGTKDQPIPAIWDPDDVYANIPADEQLPDTAEGFARRMITALSGYSQSLTPDSSVVVIGLDSTNGAKGRLSITYYQELAGSEFLKRICHWYQTTKWYPIYYVKKNNGEKEGKSIAITGVPTPNDIFFAAYGRETESTKKIKKATVSRIMPCIIEGKPIPYDLVHSSANRAARLILAGKSDKQWETNKTLNIACALIRKYYNDQKNERNDFEHYNEVWKMDLDIMQTDRNYLFGRLLAYARTIEEFSIKSSGNGYRQTNAERMIPRFRQHPAETWEKLYEKLLPYMAKFRTTSPNSLGNRLEADMNAILDLFKIQPDGFSDEALTPIYLLGYQSQLTQFDKERKEAIAKKTARLEAEQITDDDSTNGGN

SEQ ID NO: 2991 - protein, 607 aa, Desulfotomaculum reducens MI-1
MIINALYQYYGTLLNDQDSGVSRPGFSKAKVGYCLVLSREGQLLDIIDLRVERNKKLVSREMDVPEQVKRASGVAANFLCDNCTYILGLGQKNKQEKRDRIKKCFEAFVQRQEEILQGVEDEGAVALLKFLRGWDIASAVEHPAIIRQLDGLVEGSNLVFKLEGNEGYIHERKTIREAWNRHRNAQVSDIRMQCLVTGEKTGIARLHPSIKGVTGAQPSGASLISFNLNSFTSYRKTQSFNAPVGEEAVFGYTTALNYLLGSEKHRIRIGDTTTVFWAEKSTNGLEEDLLGLLFFPVAEENGKSDKKDDHSLRQATRDPQTVKLLHDIFRRVKEGKAVSQELTGINLNTNFYILGLAPNASRLAVRFWHVDTYGKLIAKIAQHYRDMAMVKNFEKNPYFIPLGMILKETAPLKDSKRIAPLLGGVLMRAILSGTPYPMSLYSSMISRIRADQEVNYVRAAVIKACLVRHERFYNKGNEVELTVALNEQNSNKGYLLGRLFSLLEKAQEDANPGINSSIRDRYFGSASATPGSVFPILLRLAQHHITKAEYGRHTDKRIEDVISSIDGFPAYLTLEEQGQFVLGYYQQRQALYTKTEKKGELNNVRTN

SEQ ID NO: 2992 - protein, 571 aa, Chlorobium phaeovibrioides DSM 265
MILQALNDYYQRKAADSLSGIAPEGFEWKEIPFIVVIDQKGTFVTIEDTREGDGKKKTAKRFLVPAAEKRTVGIKANLLWDNAEYTLGANPRNRADVHERKSAFIHRLRSEFANDEAEKKVEPLIRFLENEPLAKIESATIDASLWQDLFEKNANVIFRIAEAPEPTIIDELRPYIAAPIEGDGGICLVSGTQGAISRLHASIKGIRGAQSSGAALVSFNLPPFQSYGKTQNYNAPVSESAAFAYTTALNTLLGKESKNKLTIGDTATTVFWSEKSTAFETDFAAFFSFPPKDDPDADVRAVKKLYDGIYTGNNTTDSETDFYVLGLAPNAARISIRFWQKGTVKSLSQNIRKHFDDLEIIRSKNDKNHFALFWILSAMAQENKVDNIPPNLAGQIINAVLNGTQYPTTMHHQVIRRIRATQNVTRLQAAILKAYLNRFHRIHSTNEKEITVTLDMENNSPGYRLGRLFAILEKIQEEANPGINATIRDRFYGAASSTPVTVFPQLLKLKNHHLAKLSNTGRKVNFERMLAEVFSGITTEMPAHLAMGDQARFAIGYYHQRQALFESKTQS

SEQ ID NO: 2993 - protein, 646 aa, Roseiflexus sp. RS-1
MNWMQSLYETYEQCAKGGLVGYVSGTKRPLLPICHITIQAHIEVVIDGCGNFRRAQLVSKDDAVTIIPATESSASRSGSKPECHPLCDKLQYLAGDFVKYGGKVTSGFQRNPAEPHQNFVTLLSGWNSKCLHPKVSAILKYIQKGTLMADLVKEGVLLIDHRRLLAKDDIEPEKRRGTIFDVLNDQGDAVVRWVVEIPGDTESRVWRDTKVWDSWIDYYLNHRSGTSEICFVIGEERTLTNNHPKYIRREGDNAKLISSNDTQGFTFRGRFITDEQACSVSLEASHKAHYALMWLIDRQGYRDGDLAIVAWAISGATVTVPQPTDDPIATLFGDLPSDDKSIDTAQDVAIRLKKKIAGYRQEIGDRTDVVVMGVDSATPGRLAVIYYRTLKGSDFLDRIETWHDTCAWRHTYRVIEERDTNGKLYRRRIPFIGAPAPADIAEAAYGRRLDDRLKQATIKRLLPCIVDGQPLPRDLVESAIRRASNPVVLSDDQKEKVLTIACALYRKYMYGKEQYDMALDETRRTRDYLYGRLLAIADVIEERALYKAEQNRPTNAIRYMQQFSQRPFRTWKQIHDLLMPYLMRLGGRAYYYKNLIAEVESMFTPEDFVSTRSLSGEYLLGFYCQRQKLLEKRADDREDDNDGTSI

SEQ ID NO: 2994 - protein, 651 aa, Alkaliphilus metalliredigens QYMF
MNWIHKLYDTYENCKSEVGVARTDSKTPLLPLSHTIVNSNIEIVVDIHGNFRRARNVSKSEAMTIAPCTEDSASRGNGNNPHTLFDKLQYVAGDYTSFFNDKRDKKFFIEYIKLLEAWSNSEYKDEKVIAVLNYLKKERLVADLISEKLLEVDENSHVTNKWFGDKDNKPMKTSDIFVRFIVEIPGDVNCRLWENTDILRKYHNHYLNTKTKYGLCYIQGNNMLTTLKHQSKIRGNGDSAKLISANDENGFTYLGRFSDSNQVVSIAYETSQKAHNALKWLVDIQGQKFGNPKDGQKIIVAWGTKNQTIPQILEDTQGGIFGKEETAIVSTEKEFAQRLNKAIAGYGCDLDTKAEIVIMGLDAATTGRLSIAYYRELYGTDFLNRIKHWHSTCIWQHSYKIIADGFDEKGKAKFKTISFIGAPSPKDIATIALGSPRENSKTQKKHLELKDSLLKATVERLLPCIIDGAKLPYDLVNSVVNRVSNPVSMEKWEWEKALTITCALVKKYKYDKLKEVWEMALDENQKDRSYIFGRLLAIAQQIEEYALYTTGEKRPTNAERLMHQFKLHPYKTWGIITDKLGPYIARLGSKGTGLTELMTQVNSMIPYEEFTSPKKLDDSYILGYYCQRQVFIDEKNIRIQANAIKKLGQAN

SEQ ID NO: 2995 - protein, 687 aa, Actinobacillus succinogenes 130Z
MSWMQKLYRTYNEVEMRSDLSDTDKEALAPLWHSPQTAHIQITLDGAGNFISAKVLVDKPIIMLPVTESSEGRTSGLAPHALADSLQYVAKDLGLTYQKEVITEIEGKNDKKKKTKIKQEDLIFNLYVEQLDKWCAKTDNKKILAIQKYVHKGTVLADLIKVKVVPTNEQGTLLDNWIEKDNKERSKPELFTVLAKEQGKFEIRKALVVWAVEIPGDESSATWKDKEVQQNWGIYYQSTLDSQFCMMTGEERQIRESHPAKLTYTGDKAKLISANDKDGYTFRGRFETSNQASSISAEVSHKAHAVLRWLIARQGIRNGDQVTVAWAISGKEIPSPMKDTFDEIDWDNLDTSAVENNEEIKMPSENENNGIDWSANIGRQAAAIIKKKWRGYQAELKEYEQISLLMLDSATPGRMALTYYQEFLPADYFDNLDAWVDDFAWYQRRSIEKKNGKKNDKQTLWPELPPSPFDIGHAVYGKALSDTLKKQLYARLLPVIAGGRQVPIPYDLVQKSFQTACNPHGFENWEWQRNIGVACALYKGWRARHHDLSQRRTYLMSLDKENRSRDYLFGRLLAVADNIESYALYLAGEKRAPTAERYMQQFAERPFSTWRNIELALKPYQERLRNNGKDTGSQAISEIMELFAWEEFVDDGKLSGEFLLGYHCQKMAIAREISERVAAKTKTTETH

SEQ ID NO: 2996 - protein, 600 aa, Methylobacterium sp. 4-46
MTMLQALDRYYDRLERRGEVVMPGWSTEPLGLVLELAEDGTPLGLADRLTARGKPQLDRVPKWFSRSGTGSTPFFLWDNLAYALGLGTKDPAKTARDHAAFRDLHLRELAGERDPALAALRRFVEAWVPDPEAARALGLQSRHMALNLGFRLRGETVPLHHRPAAAAHVERLRAAHEGGPEGFCLVRGARLPLVRLHPKVKGIDGGAAAEIPLVSFNQDAFTSYGHDQGFNAPTSAAAAFRYGAALNALLQRGGPNRLRIADSTVAFWADARAYDASVAEPIALAAEDIFGDALRDGPGPAGTTDARETQALREALVTVAEARAAPDLRPDLMENVPFFVLGLAPNMARVAVRYWLAGTFGSFRRALDAHAAALAIEPKPRGWGAKPPSPARLLLKTTALAEEFDNIPHGLAAEVTRAILENRPYPRTWLAATIARLRAGDDPGRGWHAAAIKACLNRRSEREMLPVALDPAHTDPAYQLGRLFAVLEAAQRTALPGVNTTIGDRWYAAASSTPARVFGPLLRSLKTHVADARKRGLGGWIEPKVAEIMQRLPPDLPRVLSLEAQGRFAVGYYHERGTRPEKKTDSPTTTGTDPEETPHG

SEQ ID NO: 2997 - protein, 595 aa, Leptothrix cholodnii SP-6
MILQELVRYYDRAGDLAPEGWEWKRIPYVIEIRADGTFIQLTSLRTGAKSSEVKASLVPKSENRQGTKAYEKPNLLWDHYGFVLGHAKSDKATDVLTAQRQHEHFVKRIDALIDIGVDDPGLRAVASFLHGDVRERVHHDPLWAECIKVPGCNFTFRLAGDDVLVVQRDAVRAVVDRRPVADPATAGTDLARCLVTGELAAIKALHFPIAGVCEKPAPMAAVNDGVSPAYSSFGKSQGFNFPVGEAAVFKYTTALNRLLQPGSRQRLKVGDTATVFWAQSADDEDVENSFAALFDEIPDDPNAHTNQVRALFASIESGRFDGAPGGRIFFVLGLAPNSARVVVRFWQAAALRDVAHRVKEWFDDLDLIHAPTEPPHPALYHLLRSVALNREAKNVPPNLGGEVMRAILSGGPFPTTWLNAAVVRCRAEREVPYLRAAAIKACLNRSIRFQQPTSEEVYTAMLDAQNPNAAYRLGRLFATLEKIQEEASPGLNATIRDRYYGAASSTPVAVFTTLLRLKNHHLAKLTNRGRATNFEKLVGEIMDGIADFPLHLTLPDQGRFALGYYHQRQSFFTKNETDAPAAAIATERPVQTSLI

SEQ ID NO: 2998 - protein, 621 aa, Exiguobacterium sibiricum 255-15
MSVWKQLYDTYEMNLKHVGQFESRWEGQDFTLLPLSHTTQTAHVTVTVTLDGDFHSATVIEKGHGNTLIPCTEDSANRAGSVVAPYPLHDKLAYVAGDFLKYGGVYKGENAHHAYLSQLKAWVETAPYDPLESIYCYVQKGQLIEDLIQEGIFSATGSGELRWTWKEAGDKPPIYGLVTGGLEGTFVRFQVRSTEGVQRQPWRDKAFFDSFITFYGTRPGKEGLCFVTGKQERLSSKHTNKIRNSGDKAKLISANDSSGFTFRGRFDKPDEAASISYQASQKAHNALKWLIQRQGRSIDQRVFLIWGNQQPSLPNPLENTLSLAQLFGEKEELISHTVQEGALAFSDALLGFKRRLPKQEVNILTLDAATTGRMAILYYRTFDQETYFKRLEQWHTKYPWEYIYQDADKKRQVYIGAPSLKDIALMTYGTRGNEKLIKATVERLLSCVIDERRVPMDIIRCLTQRASNPVGMDHWEWEKTLSIACGMVNKKEEMTVSLDQEINDRDYLFGRLLALADYLERRALGQDNRATNAIRYMNAFSQNPARTWMTIQSALQPYQAKLGGKVLFINRQIDEIGSRLTIEQFTNKPLSGKYLLGFYSQRHELYQKREETFDKEERGEA

SEQ ID NO: 2999 - protein, 614 aa, Xanthomonas oryzae pv. oryzae PXO99A
MILSALADYYQRLLDDPESGISAPGYSREKIGYTVVLATNGNVISVDDEHRADGKKRLPKSVSVPASFKRPGTGAKSFFLWDKTSYVLGISASSKRSEQEHAAFKALHYQALSDTDDPGLHALLAFIERWTPDGYVDHPAFAPHSEALLDANLVFRLEGDSCYLHERPAARAAWDGQQGRGADGVSGLCLVSGTMAPLARLHPAIKGVNGAQSAGASIVSFNLDAFTSYGKQQGENAPVSEQAAFAYTTALNHLLRRDPHNRQRVQIGDTTVVFWAQASTPMRSQNAEDIFADFMRGSDADDPAIADGQATRRLELVMKQVRQARPLRDLDDSLDDDARIFVLGLAPNASRLSIRFWETQSLAGFAKRLADHYDDLALEPPAWKRPPTPAYLALQTAPVYGEHGKPKAEDVSPLLAGELTRAILTGIRYPQSLLGSIVMRFRADGQLTPLRIALCRAVLARDARLCRQQGLSTDPKEPPMSLDTGNTDPGYLLGRLFASLENLQRAALGDRINATIRDRYYGAASATPASIFPVLLRSAQNHFGKLRKEKAGLAVNLEKEIGQIIDALPPSFPRSLPIQEQGRFAIGYYHQTQARFARNDGPDAPDTASEGETA

SEQ ID NO: 3000 - protein, 675 aa, Cellvibrio japonicus Ueda107
MSWMAKLYETYENAMTLDLPEEKQLMPTSHTMQNAHINIQIDFDGNFIGAKVLEKTQIILPATERSAGRSSGEAPHPLADKLQYVAADYEKFGGQKSPYFKGYQSQIRDWCDSRFGHPKVQAVCNYISKQTVIEDLIGAKVCYVGENNKLLTSWPFDISDENPLPLLFKTLPKEKGELDQGNAMVCWSVITPGDLFPDTWKDNSIQQSWIAFDAEDSGGDELCYVSGRLQPSASNHPAKLRHTGDKAKLVSANDTSGFTFRGRFIGGEQVANVGFEITQKAHNTLRWLIANQSSKNGDQVVVAWAVSGKPIPAPLVPSLDLDNFDEVVDGGKDILVTETDITSDLGQNFAKALNRYMAGYFDGRIASLKEHESIVIMGLDSATPGRMAIIYYRDFMAKDYVQTIEKWHSHLAWPQRVSTEVELGNKKKAKVYWPVSAPSPWNILQAAYGDVVKSNEELKKSLYERIMPCILEGRALPIDIVNLAISRASNRNNSEHWEWERNLGVACALYRGLHHPERQPDSKKRREYVMSLDMQYTGRDYLFGRLLAVAERIEEMAMVVASEPSRSTHASRLMQRFADRPASTWLNIHKALAPYQQRLRAKLPPLESAYSKLLDDISAAFIPADFSSEKRLSGEYLLGFHCQRKWLREHKLEKGMWISKSTEETELTINEGEQQ

SEQ ID NO: 3001 - protein, 553 aa, Pelodictyon phaeoclathratiforme BU-1
MIFQSLIELYDRLAINDDVPPYGFSMEDIGFFVTIDKEGNLIGDPEESRKPIKPNVFEYYLSKTPYTNEVNVRAGGGAKETPNFMVDKADYFFGMSGNTEKNEHHSSFVNLISEVCSNSSDEGVIAVISFLKKWNALDSIGLKNWKEISGNKGKWVAFKLFGDSQFIHERVEVRKLWTNHLLKKEYKKGFSLIDGKIHDLQTQYAQFKFGSGASLVSFNDVSYESYGKKKGENALISVEAEFKSSTALKYLFRSKTQRLQIAETTTVFWAEKKSSVENFMGILLNPSIEDKIANIPIQKFLETIRDGKLPDDIEKEKELKFFILGFSLNKARLSLRFSYVSTVNKMMKRLREHFLCLQMERSKKDDVICPGIWHLLKETVREPKDISPVLGGALLRSILTGVNYPQHLFQGVLGRIRVDKVNYLRASILKAVLQRNYKMEVPMSLDTERREIEYLLGRLFAVLEKAQFDAIGNVNASIKDRYYTAASTTPASVFPRLISLSHHHIGKSDYGDISDRRIREIIEHIDTFPALLNLKQQGLFAIAYYQQKNAFYK

SEQ ID NO: 3002 - protein, 627 aa, Streptococcus equi subsp. zooepidemicus MGCS10565
MDFFASLLRAYEHAEDIGLVDNQEQSGTILLPIYHTNRRSNGKDTIVVQLDKTGQFMKAEYLADGETIIFPVTAESVARSGKNPAPHPLVDKLTYFVSAHNQEQYETYHQQLEGWINACQDKQVMSYLSLIQQFILKEDFLDLICQSLFGKQISRNGLKVTYVLSEEKEKTVDLSACFLTFQIAQFIGFKTVSVTNFTALHKDYIAYLMSKQTANTICNISGQKEVLATKHRGLLGNAKLISVSNHAEAYKGRFRERDDVFRVGNQTSEKLHLMAKYFLEHEQTHVWLGSGQHMINWFSDDLANDSQLNITQALLLDPFDDEETFLSTPMISEENKSINRSFITGQRQFSDNASYYIAILNKTNDGRIALKYFRQLQASSLLKNLAVWQENYSWELQRKGNQFVQKLPSFKEIILAAYGVDRDRSLELDNDNFRSDQYQRLVTSLIDGKPLPDTIVKKLEANIKQRQKYRKHWHQVEHISLAILHKQNGEEFTPMLDRDNTNRSYLFGRLLGIYELIEKSRNNSKGRAKDELKRITNAERYWTAYANRPASLMRNLEDKIYPYSEYLKINEAGLWSKLEKEREEIIALLTSSLETTDFNKPLDYRFIFGYYAEKKYFYTPKDESEDA

SEQ ID NO: 3003 - protein, 607 aa, Gluconacetobacter diazotrophicus PA1 5
MTIQKRPGPLEALVDFYARMDDAEDPGWGREKFGWCVVIDAEGQPIDVLDQHDHDGRKPRPRLFLVPAAVKRASGIAPNFLWDKTSYVLGRTAGAGKRTVQEHEAFVAFNLKRMAETSDVGLVAFRRFLERWTPAQFDTPLFPAEMLDANIMFRLEGDRDYLHRRPAAQRLVEAPLDNGHERQSFCLVTGQRAAPARLHPTIKGVEGAQTSGASLVSFNLDAFCSYGRKQGDNAPTSQAAAFRYGAALNRLLTRDGPNRLRRPIGDATVIFWADGSDAQVAKKADAWIQEAIAPNLLDADAARRIGEELTALAQGRPLSQLRPDIPPDTRFYVMGLSPNAARLSVRFWLSDSLDVFAHRLAEHYEDTRIAPSPWSRPPTVNLLLARTVAAQDKYDNIPPLLAGEIMRAILTGTPYPRTWLAAILMRLRAGDDPATGWHAAALRAVLQRRRRLTKNASDNGDVPVSLNRDYPSIGYQLGRLFAVYELAQRAALGIGVKATMRDKYFAAASAAPASIFPVIIRNSQNHLSNVRKRTPGWAGVIERELDEIFGRITPSGPHVLPRALSLEHQGEFAIGYYHQRRERIGGRMAETALQDDEQDIEDNATHD

SEQ ID NO: 3004 - protein, 629 aa, Desulfovibrio vulgaris str. 'Miyazaki F'
MILQALNAYYQRLADDPSENVPRQGYSREKIHFALVIGQDGTLLDVHDLRERAGKRTVPKELLVPSLGKPRSGTKAPPNFLWDNTGYVLGADAKGKPEHARSCCLAFRELVRKVPADGDTGIAAVLAFLDNWNPDDASQAVSAFLPWDEVAGWNVVFRLDGDMGYIHDRPAARTAWEALRGQSADAEQGFCLITGRLASIARLHPTIKGVHGAQSSGAALVSFNLDASTSYGKKQNHNAPVSEAAAFGYTTALNHLLRESNNRRVQIGDATTVFWSERPSVLEDLLGLFLGKSPPPAAPADNTDAAGVAEGQTNDDADGRTADDGGLARHIHRILKAVCKGQMPPELGDTNVPFYVLGLASSMARLSVRFFEVSSTGEIVARMGNHFRHIAIETRPLSLQKHAFHSRNSRHTRRFEQDLEFPSVAQLLTELAPTRKNDSIPPPTLTGALMRAILGGHPYPRSLLATIIERIRADHEVSYLRAALLKGYFTRAPKGDNTWEVGVTLDPASTDIGYRLGRLFAVLEKAQRDALPGINATIKDRFYGSVSSTPRVAFPRLIHLAQAHLGKLDRPKRIFIDKLLLEIADEIDNFPAHLTMDEQGRFALGYYHQCNALWRSSDTTAQAPVPADD

SEQ ID NO: 3005 - protein, 616 aa, Rhodobacter sphaeroides KD131
MSLLASLVRAYERLPDKTPYGYSTEKIGFCVVLTPEGAVTEVMDLRDSNKKRSPAPVQVPQAVKRTMGLAPNFLWDKSAYVLGVTGRAGKRTAEEHAKFSSRHQEWLAGTEDEGLRALLRFLDTWQPEDFRPPLWPEAAQDQNIVFRLLGERSFLHDRPAAVALWARIGTEGASAPRICLVSGQSAPIERLHPSIKGVWGAQSSGASLVSFNLDAFTSYGHKQGDNAPISEAAAFAYTTALNGFLADKAHRLQIGDSSTVFWADASDAALAEEAEAWGSFMLGNRSTSGATEALAETRIKANLQRLRDGRTLSEIEPSLALGVRFHVLGLAPNAARLSVRFYWEDSFGTFAHHYAEWMRDTALDGVGPPRDISIRNAVLRTAPAQEKNGHIAFDSDHVSPLLSGELLRAILTGGRFPRSLLSQLLMRIRSDHLLDRVRLSLIKAVILRDMRREGRLPPRPDGTVMEDYLMRPDPDDPNPARRLGRLFALIERAQLTALGDAINATVTDKFLGAAAATPGRVFPGLIRGAREHHLKRLRNGHADAKWITDADHARAVARGLEREIGVLWASFTEGAPSQHSTEEQGLFLVGYYQEKYARRGEAETDQPEAAETGSEE

SEQ ID NO: 3006 - protein, 633 aa, Geobacter daltonii FRC-32
MSWIEKLHQTYENNLGNIANPKDAVPLLPLFHSTQNAQLHVVLDGQGNLLDASVVMKDDAQTIIPATEASAGRSGAKIAPHALCDTLQYVAGDYLEYGGNPNKKKNESGFEPYLKGLKAWVDSSQHRKLQSVFAYLKQGRLIKDLIEKKVLYADNSGQLAAEWIDEADAPPVFKIIKQANKKGQFEAFVRFSVEISGDTQSELWKDASLWDSWRSYYAGLQTNRDLCMVTGGTAGLASNHPKNIRYPGDGAKLISSNDSEGFTYLGRFTTDAEACGIGIEVTQKAHSALRWLIERQGRRDGDQAVVAWAVSGADVPDPQADTFAFLFGGKDAPASPKTGYTAQEVGVALSKKLAGYGAKLKPTDEVVVLGLDSATPGRMAISYYRELLGSEFLERIESWHTSCCWLQYFGKDRIFVGAPAPRDIAEVAYGRRIDDKLRKATIERLLPCIVDGAPIPRDLVESCVRRASNKNGIEYWEWEKALGIACALYRKRHEKEGYTMALDENRTTRDYLYGRLLALAENLEHWAIRTAGESRPTNAERMMQRFADRPYSTWRTLELSLLPYKVRLGDKAHKVKSLLDAVHVKFDPPEEFTRDDRLSGEFLLGYHCQRAALKPAVASEATGANDDLDNSDD

SEQ ID NO: 3007 - protein, 618 aa, Acidobacterium capsulatum ATCC 51196
MFVQALAGYADTHLRKQLDDVAFEERPVQYFLQIGKDGSFLGVIPRFTEVPVASPKQKKGSADKPPKTRLQPELLSVPRSPANRNSGLHPLLGSDDIKYVLGPGPWTKASELENHRDRHEAFVELLRRVAKETRDRALEICAQFYDQPEQVERAREALAKVTPGSNVALFVFGQPVTERDEVRAWWRQHYEASTAERGAGQTAECLISGVVGPIPSTHAKIKGTSALGGQPAGVSLMSFDKPAFRSYGWEQNANSPVSSDRAMAYVLALNDLLKPGSQNRKDFDGVAFLFWLKRDVDIDYNSLLEEPPSDVLLDKARAIIGLKNGAWMRQEERNELYMAAVSATGSRLVLRSWSSMPLEDALESLLGFWEQLKMQPLEKDKPPRAEPFWKLLHALDREGRPPASRTVALRRRALEGRCSPLGYRIVSDVLARMRADKEKRRDIAALGLLRLCLNDLHATTGKGEPMPAALDETEPPQHPAYVCGRLLALHDSLQWRTFDAAEEAQPNATVADRYYTLMMNSPAIGVAKVFDLGRKHLSKLRKLDAKSGTSYCDYFTRRICELEEHLGGEPPVQFDLHDKARFALGFYHEKAPRFRARKAESISTKLQANSNSTDEENQ

SEQ ID NO: 3008 - protein, 598 aa, Azotobacter vinelandii DJ
MILSALNDYYQRLLTQDVGIALPGYSQEKISYVLVLSPGGELVDVQDIRVQAGKKLQPGLLSVPQPEKRTSGVKSNFLWDKTSYVLGVSAKEGGRMAQEHQAFKELQCSFLGDSSDPGLQALLKFLAQWTPEQFLPPLFNVEMLDSNLVFRLDGQLHYLHDTPAAQSIWSRLQAGTDCKQGLCLVTGEYQPLARLHPAIKGVNGAQSSGASIVSFNLESFSSYGKSQGDNAPVSERAAFAYTTVLNHLLRRDDSNHQRLQIGDASVVFWAEAASAAQADAAETLFWEMLDPPADDASETERLRQALEAVASGLALRELNPELEDDTRLHVLGLSPNASRLSIRFWESGSLHSFAKRLAEHFQDLALQPQPWKTEPAMWRLLHATAPSRDGKSKAEDIPPQLAGELTRAILTGSRYPRSLLNTIIMRLRADGDISGVRVALCKAVLARDLRLGVKGINEEIPMSLDKEASNPGYRLGRLFAVLESVQRGALGKHVNATIRDRYYGAASATPATVFPMLLRNTQNHLAKLRKEKPGLAVTLEKEIGEIIDGLPPQFPRSLRLEDQGRFAIGYYHQSQVRSTHGKDEDADVTESTEQGTQE

SEQ ID NO: 3009 - protein, 677 aa, Teredinibacter turnerae T7901
MSWMAQLYQTYENCVDMDLPIEQRVMPICHTPQQVHIHVSIDDQANFISAEVLEKFSVVLPATESSASRSSGVAPHALADKLQYVAADFEHYSTSRKPFFSAYSQQLAAWCESEYAHPKVQLIYRYLTANNLIADLIKHGVCWVDENNKFLEAWDQDATGRDTVPPIFKVLTKTQGVIDQGNALVCWSVLLPGDPQNKTWEDESIRESWIRFDLSNAGESKFCYITGANKPAGKNHPAKIRYGSDKAKLISSNDNSGFTYRGRFVDPQQAATVSFEVSQKAHNALRWLIDRQGSKGRNGEQVVLAWSTTGVPVPNPIVDPAEWGDELSPNGPEVSVADSEIPDYGRNFAFYPAQALKRKIQGFAEQLHINDSINILVLDSATPGRMAVSVYLNFLRDDYFASLENWQTHFCWWQRLSAEKQDKNRRLYYQRWRVEAPSIWKIAEATFGEAIKNNDKLKRAIVERLLPSILLNRNIPDDIYQRCIQRACQRSGKEPWEWERDLGVACALFSGFHHPDRQIKPERQRTYTMALDTNYTSRDYLYGRLLAVGELIETWSNEAMRIPARTTHVSRLFQRFSDRPATTWLTIEKHLAPYRQRLKTRSWPNSKALEGTLDQILSLFDTTDFNSDAKLSGEFLLGYHCQRLALDEERAERRAKAKADKNIDTEDEEISTEGDAA

SEQ ID NO: 3010 - protein, 596 aa, Aggregatibacter aphrophilus NJ8700
MILASLARYYRRLAVETDDMGNPKVPPYGFSEEKIGWILVLDTEGRLKTAVPNLTADKKPQPKLMSVPRPEKRTSGIKPNFLWDKTAYALGVEANKNKAEAKEKPFTSSEKTFEAFKQYHLDLLQNSEDEGLQALCRFLQNWLPENFAAENLPAEMLDANIAFSLEKPTALIHKREAAQTLWVGCLKSDEALEGLCLISGDTAPIARLHPAIKGVFGGQSSGGSIISFNKEAFASFGKEQGANAPVSEQSAFAYTTALNYLLRQRNQESNNHCLTIGDASTVFWAEADDNATAQAAEGFFAQVFTPPDDEQESAKVFNVLEQMSKGRPLQEIAPELSPNTRFYILGLAPNAARISVRFWLDTTFGQLAENLAQHWQDLAIEPCAWKTPPSIWRLLLQTAVLGKSENISPVLAGEMTRAVICGTPYPLSLLSQLITRIRADGDVNGLRVAMMKAVLERRFRKGFIEEGVPMSLNNESPNRAYLLGRLFAVLERIQYQALGELNAGIADRYYGSASAVPFSVFPRLLSGAKHHLSRLRKDKAGMAVNLDKDLGEIIAKLPETFPRHLSIDEQGRFAIGYYHQKQSYFAKKETAEIIEN

SEQ ID NO: 3011 - protein, 582 aa, Eggerthella lenta DSM 2243
MILQALADYYEQLSREHPERIARPGWCSRQVAFMLELSPDGELVNVIPAEEKRGWTREVPEQAKRTVGVTANLLCDNATYLLGLDAKGKPERARRCFDDARRKHLELLADVDSPVATAIRSYFETWNVEEASEHPRVVDAGEGLLAGGNLVFFVQGCEALADRDICAAWDRRCERSGKDEEVTTCLVTGEKAPIARLHPAIKGVMGAQSMGASLVGFNARAFESYGHDEEQGLNAPVSERVTFAYTTALNYLLSDRNHHIRLGDTTIVYWADSDDEDCAALFSQAINPNFGERAEGEDDPDEKLDAIMGALAAGRQVESAKLDATFHVLGLAPNAARLSVRFFMSGMFGSMLDNLRKHYDRIDITRAPYEKKYLSPYFLLAETANPNAKQAAATSVLAGALMRSILADAPYPEALYSNVLLRVRATQDDDDRRTRKVTRGRVAIIKAYLIKNLNKEAVTVSLDETKRDTPYMLGRLFSVLERVQEEANPGIKTTIKNRYFDSANAMPSVVFPVIMKLGQNHLNKIAGDRKGLAVFYEKQIQELCNGIQGFPKRLSLSEQGGFILGYYHQTQKRYEKKNDQEG

SEQ ID NO: 3012 - protein, 642 aa, Desulfofarcimen acetoxidans DSM 771
MGWIHKLYDTYENCQAEVGMAGPDGQVMPLLPIGHSTQNAQIEVILNGEGNFRSAKVLDKEETVTIIPVTEDSATRSSGIAPHPLCDKLQYVAGDYIDYVTKKNGREFFTKYMEQLEDWCGSVYSHPKVRAVFNYLKKESLIGDLISQKILVCDDKGLLAKGVKMGAGEQSDAFIRFRVETEGEEESAVWLDPQVYESYINYYLSRQKEIDLCYVRGQTIPCSDKHPAKVRNTGDKSKLISANDTVGFTFRGRFNDKSQAVRVGYETTQKGHNALRWLIDRQGYKNGDQAIVAWGTKNQFLPPFLNDTEDFFPEEPPSVATEKEFAQRLNKAIVGYGCELDTKAEIVIMGLDAATVGRLAITYYRELDGWDFLNRIKAWHSSCIWKHSYKKVPDGFNEKGKPNFKYLTFIGAPSPREITWAAYGDKASDKLKKATVERLLPCIIDGARLPYDLVSSAVNLVSNPLGLENWEWEKALTITCALIRKYRYDKSGKKEVWEMSLDENQKDRSYLFGRLLAIAQQIEEYALYTTGEKRVTNAERLMHQFKIHPYKTWGIIIDKLRPYLDRLGSKAAFLTELLTQVNAMLPFEEFTSRDKLQDSYILGYYCQREVFMEERKQRREEKQKKKLANVTERENEHEPIDK

SEQ ID NO: 3013 - protein, 583 aa, Zymomonas mobilis subsp. mobilis NCIMB 11163
MSVIASLVEAYTRFPDTPPFGYSAEQISYVISLNDDGTVAHVIDLRVENKKKRIPRKMFVPHSVKRAANIAPNFLWDKTSYVLGVTAKETKRTEEEHRAFVEKHINAIGDSTDVGLRAFRLFLENWCPEDFIGPVWREEMKDQNVVFALENNRLKNIYLHDSDASKSLWKEVSSEGEKKSDICLITGETSNIARLHPSIKGVWGAQSSGAALISFNLEAFTSYGHKQGRNAPISEASVFAYTTMLNYFLDRSSHHRFQIGDSSTIFWADAGNKQTAEDAESLFYTSIDIDDLHQEEKISTNRLQETLARLRRGEPIELVEPELAKGVHFYILGLSPNAARLSVRFFYSDNFCDLIHNYQSFVSDMRIEPPPHEEYPPLWRYLLETAVPRKRENIAPNLAGEWFRSILTGSSYPLTLLSSVIRRIRADGQVNGLRVGILKALLIRNFNRKDVPVALDPDNINKGYLLGRLFAVYEQIQTAALGSKVNATIKDKFYGSASAQPRKVFPVLDKGSASHLSKIGKEKPGFRIVLEKTVASIMEKMRPDADPFPTSLAAQDQALFGLGYYHQRSEFFKKAGNTANPEE

SEQ ID NO: 3014 - protein, 578 aa, Halothiobacillus neapolitanus c2
MILQALNDYYQRRQRSSNPQDRLPAFGLEEKEISFVIEIDAKGRLVNLADTRTIEGKKKIGQRFLVPQGIKKTSGVAANLLWDTAEYVLGVDTKGKPERVVEQHAAFRARLEALPEDALRDAGIQAILAFLKNIDLKQLETLPAWPDILTTNPVMTFRLHGDVELVCQRPAIVDTTAQTIEEKPDGICLVSGIPMAIERLHPSIKGVWGAQTSGANIVSFNLDAFNSYGKSRGANAPLGKPATFAYTTALNHLLARDSRQRIQVGDASTVFWAEQANDLETALPDLFGEPPKDDPNRGTDALKVLYRAVQTGKFTNGSATDRFHVLGLSPNAARIAIRFWETASALNLAKRIACHFDDINIARAPHDPEHLSLFRLLTSLAVQGKADNIPPNLGGEVMRAILEDLPYPATLLNQAVQRNRAEQKPNYARAAIIKASLNRLIRRTHNEKEFMVMLDPTNTHPAYLLGRLFATLEKIQEEASPGLNATIRDRYYGAASSTPVAVFTTLLRLHNHHLGKLSKGRGVQMERLVGEIMGGLDDFPRILALPDQGRFALGYYHQRQAFFTKSDTPTTNNPEESK

SEQ ID NO: 3015 - protein, 629 aa, Bifidobacterium dentium Bd1
MSLWSSLLETYDEVQNASGRGHQGYGNGDEAKKILLPLDHMSMPGQLRVILKSDGCLESIKKEAVAWTMIIPCTEESMGRTSKPVPHPLCDQLQYVDKVCDAKRTCMYLDQLAKWKGDDEKLNAIYRYVSEHSISKDAIQYGIQLTGRDEKIGVCFEVEIPGKACRPVADDPEIRNRWIEFQQREHAWAGTDIFGRDFYSQASNYPKNIVSTAGNAKLISANDNTNFTYRGRFGNRDEALRIDSETSQKIHSTLRWLVNNHATITDTQAIIIWAVKKPEENVVNPELNFAETLSHMLLNSESEQHDVVQDALIATDMNYAKRFRALLRGYGSPDFLQKHANKMAIVILDAATSGRLSVTFYRELRENEYLENILKWHTDTAWPLTYFERNQNGDKTSFKRTPYIGAPSFVDIINCTYDASDRSSKSYKRYAKYMKKRLIECMFGDRALPISILNAAFHKVTRPISYNEGDLVWERDFEIACSLWKKHFNDEAKRHHDSKEVSMELNLERKDRDYLYGRLLALADYFERGVLLKQQVDRPTNAVKLMSNFIAKPYSTWGALWKQLIPYLKTMNGAEWFQSGIDDVMALFEEGDFEDNKTLSPLFLLGYSSQRRSLRNPTRLHKDESDKQN

SEQ ID NO: 3016 - protein, 591 aa, Acidaminococcus fermentans DSM 20731
MILQALVRYYETLLKQGKVEEPGWSVAKVSAEIQLDEEGKLLGILSLRNEVQRGKKTALTDSLLQVPEVFKRSSGVRPNFLYDNSSYFFGVDGKGKPKRSLQCFEASRAFHHQLLDGCDSPVARGILKFFDSWQPEKAEENPVFQQNRDAIVGASGLVFSVNGQEAQKDPEIRRRWMEYKKEGGGENSEKGQCLVTDKVAEIALIHPNIKNVRGAQSSGAALVSFNAPSLESFGHVDDQGLNAPVSEYAAFAYTTALNQLIREGNSLLCGDTTVVFWAQSAEPLYQQVYMNFLNPSGTGENREQTVKAVLDKMLQGVAADVDGITLSPDEPFYVLGLAPNAARLSVRFFWQNTFGVTLQHLQKHQKRLEIVQPSWEQASFLPLWRLLKESVNPNATKSQASPLLAGSLLRSILQDTPYPEAMYRQFLLRIKADSGDGKISYPRAAFVKAYLLKNHQEKWGGEITMNVNENCKAVPYVLGRMFAVLEGLQQDSSEVSATIKDRYFNAACATPGAVFPVLLKLANAHLNKLNRTNKGLAVIAQKKLGSLMEKITVPDEGNPIPSRLTLDEQGMFILGYYQETQARYTKKEEQA

SEQ ID NO: 3017 - protein, 618 aa, Meiothermus ruber DSM 1279
MLSQLVSYTQQKGLLAEPGFTTKEIRWLVGVSPQGAFTELIPLENQAKTAPDLSQPDMMSLPGYLRGQGHPVEQAAHFLADTCAVVFGLAERDANGQVKRPDEHAKNLQKQATFRLLIQLAANDVPLLKPIAQALSDPAQMQLILQKLEAQTQKKGAEKLKPTDKVSFWLQGQCVLDFPDWRDWWRRFRAQAFPKPDAEGRMPSFASGALVTPASTHPKVTRLGGSAFGHALVTYDKEAFESYGLSQGENAAVEEQAANAYRAGLDALLEKAETLGEMKVVVWYDREIPKEDDFFKDLFAPVTDEAQELQALERAHQVLQALRTGQAPPELRSARFFAAAMSPASGRVMLRDWQMGQLEDFVAAVEAWFTDLAIVRRDGQGPASLPGLNRLFLSLQRPKTPEQNFDDYLKPIKQLQTPLWRAALNPRLPIPYAAVAKIMETHTAEVMTGAFTEALKAQKPDAAALGRIYARMGLLKAYHNRKGGYRMSAELDLSHPSPAYHCGRLMCLLAQIQEAASESEINAGVIQRYYGAASSTPSLVLGRLTRLSQHHLAKMAKDAPGLAYWFNTQLAEVWKALGKNLPRTLSLEEQSLFALGYYQQMAASRKKETPQTQAPSAP

SEQ ID NO: 3018 - protein, 618 aa, Stackebrandtia nassauensis DSM 44728
MLLQRLAQFAAQRETDENPIPAFYIEKPVRWVLRLHADGTPETLDMTDRADPSDTARRFGTPMAVPSVTKTSAPAPTPGVDTVEYVFGWVTTDPKANVKPDKVVKRHKAFIALNERWARDDPDSPASAIAAFYRDGHHRTIMEPMRINGRGEELQRVPAWSRGDLVCFEIDGAKAAASTSAQRFWASIAAERKGSGTSGLCLVCGEWAELLKTVPQQLPQRLVPGATQSASLVSVNKPTHGFDLTTELRHTPICQGCGLRVMSGLGMLLDDKQHSTGSGDSRMAWWTIGGEQVSLDMLLHPHQHLDDVHHLITAARTGHRHSVKDIDTGRFCSVIVGGNVSRIMVRDWVEQPLTQVQANLGRWFNDITTTDGDNTRLPGVGLLALACGRYDPKLTAESGGYLGFNKPGADRPDGVYRSLLQAALYGRRLPPGLSKHIIHRIRRDGYLDPARAALLHVGRIRQATTNDQKEPMEITTSSTEEPAKVAGQIFAMYEYLQWAATNPTPNKTTGRAERVNTSFTDRHFSGAITNPRRALTAGARISQAWLKRVRRDNPARAEWIDRQLTELYEHLNQAGGPPSTALLSQQSDFILGYYQQRQQRFANRSANNTTTETESNDE

SEQ ID NO: 3019 - protein, 582 aa, Nitrosococcus halophilus Nc 4
MILQALSEYYQRKTREGGNELPPIGFEKKEIPFIVVLDEEGRFVDLEDTRTGKGKKKTGRIFIVPQGEKRTSGILPNLLWDTLDYALGTVSAVKAERLEANKREKEQQRAKEKRAAFIQRIKDTFPEVGADKGIKAVLAFLEKGDFQSLYAHSLWDDINRSTGNLSFRLQNSTELICQRNAVRRAIVEWVTERKKQRQRCLVSGEVDSIARVHPPIRGVWGGQPSGADIVSFNRDAFTSYGKHQGINAPVGERATFAYTTALNHLLRKGSRQRIQVGDASTVFWAAKDHPSEEQFVAWLDPDPDDPDRGTEAIRALYAAPKSGAKPIDEDNTPFYVLGLAPNAARIAVRFWYPGTVGEVARHIRQHFNDTHIIHAPQEPEFLPLFRLLKASALQGKVENVPPNLAGDFMKAILVGMPYPRTLLAAALRRVRAEHHITYPRVALIKAVLTRNARLFNHSQQEVNVALDLKNLNIGYRLGRLFAVLERAQKLALPNVEATIRDRFYSAASSTPRTAFPHLLKLKNYHLDKLEEGQIIWLEKLMGEIMDGIEYFPAHLSLDDQGRFAVGYYHQRQAFFNKKNLDN

SEQ ID NO: 3020 - protein, 579 aa, Rhodobacter capsulatus SB 1003
MSLLASLVRAYERMPDAPPYGYSTEKIGFCVVLTAAGEVVEVADLRDTDKKRSPRMLMVPQAVKRTVGIAPNFLWDKSAYVLGVTAGEGKRTAEEHAKFRERHLTALAGAEDPGLLALARFLQTWTPEAFGPPLWPEEAKDQNLVFRLADEFGYLHDRPAARALWARLGAEAASEAQVCLVTGASAPVARLHPSLKGVWGAQSSGASLISFNLDAFNSYGHEQGDNAPVSEGAAFAYTTALNRFLEKDSGHRLQIGDASTVFWADASEAEAAQAEGFFAAFFDTAATEKIEALNIGAQLARIRACEPLAEVAPQLASGVRFCVLGLAPNAARLSVRFWWEDDFGTLTAHYQRYLDDMRLDPPPRDDWPPLWRYLSELAPQGKRENVPPLIAGDWMRAILTGTAYPLTLLSTVLMRIRADGEINALRAAMLKSVLIRNFQSKEAPVALDPASKDTGYVLGRLFAAYENIQKAALGKGVNATIRDKFYGSASATPARVFGSLAANAFNHLAKIRKEKPAFAHYLQDELQQIANLLEVSAEPFPSSLSQESQAKFALGYYHQASFRKPADTEQEPHSEEQPQ

SEQ ID NO: 3021 - protein, 602 aa, Thermincola potens JR
MIINSLYQYYERLLEDEGSGVSKPGYSKAKVAYALVLSCKGELVNILDLRVVKGKKLVSREMDVPEQVKRSSGVAANFLCDNCKYVLGLNPEIKKEKTQKDRSRETFQAFVNLHKEILDGMDDQGAEAVLSFLTTWDVTNAANHPKIVENIEGLAEGGNLVFRLEGTEGYIHERQAIINAWDKYRSGQVSEVTGQCMVTGKISPIARLHQSIKGVVGGQSTGTSLVSFNFKASESYGKEQSYNAPVGENVAFGYTTALNYLLSNEKHRIRIGDTTTVFWAECSTDGLEEDLLGALFYPIVQGDSETNERIDDEQSKVRRDPQTVRLLHDIFTKVRAGEPVDEGLVGIDPNVNFFILGLAPNSARLSVRFWHVDRYGNFLDKIGRHYSDLAIIKDFDKAPDFISVSMLLKETAPLGDAKRIPPLLGGVLMRSILTGMPYPQALYNAILSRIRADQRVNYVRAAIIKACLVRSQRFYNKGNEVNVLMALDEQNTNLAYRLGRLFALLEKAQQDANPGLNATIRDRYFGAASATPGSVFPILLRLVQHHLAKAEYGRITDKRIEEVMGGIGSFPSYLNLEEQGLFVLGYYHQRQALYAKNEKKEG

SEQ ID NO: 3022 - protein, 621 aa, Meiothermus silvanus DSM 9946
MLAQLVDYARLKGLGTEPGFTSKEIRWLVGVSPAGQWTELIPLDQAKTAPDLSQPDMMSLPGYLRAQGHTVEQAAHFLADTCAVVFGLPERDAAGNIRRPEEHAKNLQKHAAFRLLIQLAANDVPLLEPIAQALSDPQQVQAFLQKLEAQAQKRGPERLKSTDKISFFVNGRCVLDCPDWHDWWRQFRAHAFPRSGAQGQMPSFASGELVTPASTHPKVTRLGGSAFGHALVTYDKEAFESYGLSQGENAAVDELAATAYRAGLDALLEKAQTLGEMKVVVWYDREIPEEDDFFRDLFAPSSGEAEELQALERAHRVLQALKTGQAPPEIRNSRFFAAAMSPASGRVMVRDWQIGRLEDFVEAVTTWFEHLAIVRRSGDQSASLPGLNRLFLSLQRPKSPEQKLDDYLKPVKTLQVPLWRAALNPRLPIPYAAIAKIMESHTAEVMTGAFSEALQAQKPDAATLGRIYARMGLLKAYHIRKGESMSTALDPQHPSPAYHCGRLMCLLAQIQEAASESEINAGVVQRYYGAASSTPALVLGRLTRLSQHHLAKMAKDAPGLAYWFNTQLAQVWSALGSNLPRTLSLEEQSLFALGYYQQLAQSRKKETPQTQAPTTPSLFQE

SEQ ID NO: 3023 - protein, 607 aa, Syntrophothermus lipocalidus DSM 12680
MLKELVDKAEKLEKEGNKNPIGYDRYSQPIKWVVHIYPDEDRVEVEEYAGENRPRPKPANRTSNVYPCPLADEATYVLGINRISQDKVDRKAAAKHQAYKAMLEQIALSPCIEDDLLREAVTRVSERVEDGSVAKAFGKRDILGKQWITFVYEKGPLRGKHLHEMPQIKEFWARKVSGDVASSAEQPCCICGRRERIVRNIPTKIVLKSGNRQIASFNKSAFVSFSFSEEGAPVGMCVPCAENASQALNYLVQQNSQVIYEDRTAKGKVNNDSPRNQVAVYWLKEDAKFSLEGQEISFEKLFATPMVVPESMEVKTTEELIDRFLRAPLGTGANALNLDENTFYLAVLSPNTGRIAVRDWIEVGAGQVKANLARYFEALRLVDAAGNKRAPYNISQLLAPLPDADPGMAKSLIRSAYRGEKPPSSLLLSAVRRVRVSGARDGGLEAKKRDKRRLDPVEVWQRLCTLIKFCLTFGKEDAQEMETLQRSRRDSAYQAGRLLAVLEEIQKRAAGSTLSSTLIDRYYGSASTSPATVFPLLISMATKAHMPKIRKKYFNLCRELEALLEEIMLAIDELGGFPQTLPVSQQGEFALGFYHQRADFAATRANR

SEQ ID NO: 3024 - protein, 620 aa, Truepera radiovictrix DSM 17093
MNLLSQLRDYELRMRAESERDETASDVLPFMYAMQKVRWEIRLREDGSFRDVLPRSGGEARGKDLGLPLAAPNIVRTVGIKPRLLMDNAEYALGLPKKANDKNTLKRHEAFKALVQACADATGEPSVRAVATFLKGHDPEAFRAMLEQRHPTFEADSNVMFTVEGVNPLELPSVQAFWAAQFAQDDEDGEGLTAECLITGDIGPVMEREPVKIKGIQGGQTSGMNLISANAQAFESYGLKASQIAPVRLEVAEQYANGLNRLLADPNTSLKVGGITYAFWTGAGAVPLVGESLREPPTGLRLRFKAQKTRGRQAHTEEVRAALWSLFTGKQHDLKPGAAFFAVGMTPSGSRIAVRTHLTSTVQEVVDRLAAYFAAQALAPLSENDRDAYDLRTLVSAMYRDVNKEHTAPDVDALVQFALAGRPLPYAFLVRLAGRSRAERRVTRPRAVLTKMVLLSRNWKELAMDKDTLEALNPNQQEPAYHLGRLLAVLDDIQYAVMPKANTTLVDRFYGSMSTTPYAVVGRLMQASQAHLQKLRKEKEGAYISKQRELENVMRHLTDIPAKPLSTAQQALFALGYYHQRAHISASIGERTAAKREREAQAKAEPATQPALLTDEGDAQ

SEQ ID NO: 3025 - protein, 590 aa, Sediminispirochaeta smaragdinae DSM 11293
MILQELSKYYKRLLEDPQIDICEPGFSPENISFRIVISKDGDFINLEDLREPDEKNNLRPTIMNVPKFDGKRARGIKPYFLWDKSHYTVGIKSENSIEEETLEHKNAFILLIDEIMGDSLSDYSSIVAIRKFSSNKDNIAKLKAHTHWNDFLNNFAVFEVEGSGFQTVFDDPQILEIWRKHYAKSATGKEMQQGLCLVSGEKGSLTTTHPTIKRGIGGKNDVPLVSCNIDSGESYNKTKGENAPVSSISASYFTGALNYLVDHNTNNILLGDTRGGDRLLFWAEENKESESFFGSVFDNQKRDESKLKELEATFKIIRKGQYPDELDDDSHFFVLGLAPNSARVSVRFWHVDTVKSMVTKIGRHVEDLQIIKMFPERETNIPSIWQLLIETAVLRDSKNILPTLAGPLMRSVLSGNRYPNNILALLIGRIRHDQDDKKKGKWKISSYRASFIKAILNRNYNKELSVALDKEKTSVPYCLGRLFAVLEKIQEDSADGEINTTIKDRYFSSASATPKVVFPTILKLSQNHQKKLRTKSPGNMINKEKLLGEIMGNISEFPATLKLEDQGEFAIGYYHQRQNFFTKKENKGDN

SEQ ID NO: 3026 - protein, 598 aa, Desulfarculus baarsii DSM 2075
MILQALRKYYERLTRDPRRDVPLPGFGLAKISFALVLSADGELVDVHDLREQKGKKLAPRPLQTPQAVKRTVGVAANFLWDNTGYVLGVDGKGKLERTAQTHQVFKALCRQLLAELDDAGARAVLVFLERWRPTPEPALPGDALWKDVCDQNLVFVLDGQRGYIHERPAIKEAWLAHCLKNPDALEGQCLVSGEMGPLARLHPAIKGVWGAQSSGANLVSFNLDAFASYGKSQSYNAPVGEAATFAYTTALNNLLAEGSKQRIQIGDASTVFWSEKASKLEDTLGSLFGASPEKADDDDHEAEDSSLTDNVGLFLKAARDGVPDDAPEARNPFYILGLSPNASRIAVRFWHASSVGQMERRLGEYLDDITIVRQYDNQPEYPPLWLLLRQTAVQGKAENIPAQLAGEVARAVFEGSALPSSLLAALIGRVRADGDMGYLRAALLKAYFCRRRRLDKSHANDSPIMEVKVSLDIENKTPAYLLGRLFAVLEKLQADAIPGVNSTIRDRYMSSASSAPQATFPQLLRLAQAHIKKSDWGWKYDERIKEILNDIDAFPKTLSMEQQGYFFLGYYHQVVDLFAKKSKESASQDQAGQRDEEE

SEQ ID NO: 3027 - protein, 589 aa, Ketogulonicigenium vulgare Y25
MSVLSSLSRAYERLPDAPPYGFSSEKIGFCIVLNADGSVHDVIDKRQDDKKRSPAMLLVPQAVKRTAGIAPNFLWDKTAYVLGVTAGEGKRTADEHAKFREMHVQWLAGTQDEGLLALLRFLDAWTADRFTAPVWPEDMRDQNIVFALASEYRERYIHERSGAKEIWQRLGTEGASDPQICLVSGDPAPIARLHPSIKGVWGAQTAGASLVSFNLDAFTSYGHEQGDNAPVSEVATFQYTTALNRFLEKDSGHRLQIGDASTVFWADASGLISEMAESLFAGMFDTPEAAHDDDSIETKKIAAKLERIRRGERLDEVEPQLTQGVRFHVLSLAPNAARLSVRFYWENDFAQLTRNYQAYLEDTKIEPPPRDGWPPLWRYLVELAVLNKRENIPPNLAGEWTRAILTRTPYPMTLLATALMRIRSDGEVNALRAAVLKSVLVRNFNKEAPVALNPTFSDSKGYLLGRLFAAYEEVQREALGRNVNATIKDKFYGAASASPQKVFATLDSGAQNHFTKLRKINAGRAVNLDQLIMSIMDQMSPDKDPIPAFLNAPEQGLFGLGYYHQRSDFFRKRDTKTDSVTETQPETTA

SEQ ID NO: 3028 - protein, 589 aa, Rhodomicrobium vannielii ATCC 17100
MSILASLAKAYGRLPDAPPFGFSSEKIGFLISLNEDGTVACPPVDLRQDDKKRTPRTVAVPASFKRPGITPRSFFLWDNSAYALGVTGAESKDAASRHKVFCECHLGALRDTTDPGLKALVIFLKTWFPRRFDEYGWPEEMKDQNIIFCLEADRRANIWLHDRPAAKALCARLSAEGAKSEAVCLISGQRAPVARLHPAIKGVWGAQSAGASIVSFNLDAFSSYGHEQGDNAPVSEAATFAYTTALNRFLEKDSGHRIQIGDASVVFWADASAAKAAEAENIFAGFWDDSGDEPLGVDEGTQAQIVGARLKQIRNGEPLRNVAPDLAEGVRFYVLALAPNAARLSIRFYFEDDFGAIAANYQRFLADMQIEPPPRDGQPALWKYLAETAVLKKRENVPPNLAGEWMRAILGGTRYPQTLLATVLMRLRADKDVNALRVAILKALLIRNNNRKDTPVALKPDYPSKGYQLGRLFAVYERIQSDALGAKVNATIKDKFYGSASAQPRKVFGLLEKGSANHLSKIGKQSPGRKVNLEKLVGEIMGAMDPSADPFPNALSAEDQALFGLGYYHQRNEFFKSTKNGTPVEETAP

SEQ ID NO: 3029 - protein, 612 aa, Desulfovibrio vulgaris RCH1
MILQALHGYYQRMSADPDAGMPPYGTSMENISFALVLDAKGTLRGIEDLREQEGKKLRPRKMLVPIAEKKGNGIKPNFLWENTSYILGVDAKGKQERTDKCHAAFIAHIKAYCDTADQDLAAVLQFLEHGEKDLSAFPVSEEVIGSNIVFRIEGEPGFVHERPAARQAWANCLNRREQGLCGQCLITGERQKPIAQLHPSIKGGRDGVRGAQAVASIVSFNNTAFESYGKEQSINAPVSQEAAFSYVTALNYLLNPSNRQKVTIADATVVFWAERSSPAEDIFAGMFDPPSTTAKPESSNGTPPEDSEEGSQPDTARDDPHAAARMHDLLVAIRSGKRATDIMPDMDESVRFHVLGLSPNAARLSVRFWEVDTVGHMLDKVGRHYRELEIIPQFNNEQEFPSLSTLLRQTAVLNKTENISPVLAGGLFRAMLTGGPYPQSLLPAVLGRIRAEHARPEDKSRYRLEVVTYYRAALIKAYLIRNRKLEVPVSLDPARTDRPYLLGRLFAVLEKAQEDAVPGANATIKDRYLASASANPGQVFHMLLKNASNHTAKLRKDPERKGSAIHYEIMMQEIIDNISDFPVTMSSDEQGLFMIGYYHQRKALFTKKNKEN

SEQ ID NO: 3030 - protein, 613 aa, Ruminococcus albus 7 = DSM 20455
MSWTNELLEVYNNAVKIKAEPNKPKLLPISHTMVKANIHITLTEDGELDNTGIKEITSEDDENTIIPDTGKAKTGIYPPPYPLNESLRYLAGDFNEYISDNIKSNERNHQDYIEQLKDWKDSEYSHPALNAIYTYITKNTLIYDCICNNVLLLDDKTGKLKEKQLGVSVDKCFVRFSVQYADMQHEPRTWKDETLYNSFIDYLNSNAVEKRLCYATGDYLPITYTHPYGIVKSNARAKLISSNDDKNYTYRGRFSTKEEAFAVSYDYSQKVHNALKWLIGRQSFSFDSLTLVVWNSALDFVPNITENVWGDVEIEEYSSKPIFSEMLRKNILGGKAEFDPNSKVMVMGLDAATTGRLSISMYTELAESEFAKYLEFWHTSTAWKRKKYIKDKYEYILDSCSLPQIANCLYGTEQNGRLECDKKVLGDTILRLLPCVTERRKLPRDIVQTICNKASNPLAFDKEYNHMMIVENACALIRKEYSDYNKGEIKMAYDPTCTDRSYLFGCLLAIADKAERDTYEKDEKRITNARRYWNAFSSRPYQTWQIIEEKIEPYLEKDPRLMTKYTKHINDIMAKMSPDTFKDNSKLSPLYLIGFHHYNTLLWKGSEDNNKEE

SEQ ID NO: 3031 - protein, 655 aa, Ethanoligenens harbinense YUAN-3
MGWMQKLYETYESCQREVGRTEEGKLPLLPIYHTTQQAQIEAVVDSDGNWCLGRAQVILNKNDMTTIIPCTESSGARTSGLEPHPLFDKLQYIAGDFETCVTGKKSGFQGYITALADWCASPYAHPNVRALYAYLQKGTLMADLMADGILFRDETGALPAKWAGKKEDTPSIFKACAGAQTDAFVRFRVVPADGSPDIHSALWQNPAVWQSYIDYENHRQQKQDICYVRGEELPVSTLSPKKIRNPGDGAKLISSNDTSNFTFRGRFRDATEAFCISRETTEKAHSALRWLISRQGWPNGEQVIVTWGTTGRKLPDPCADALDLFFNKLKKPEEPIPTKDEFAARLRRALSGYICDLQNGEEATIMGLDSATPGRLSVFYYREMQAVDFLARVQSWHDTCGWAHDYGWVPDPVDAKKRKHVAFVGAPSPKDIVFAAYGPNADDKLKKNIVQRLLPCIIDGARLPRDIMLCAVHRASNPVGREDWEVRKTRGIACALIRKYHNDRYNGETIKDATYKEVWAMALDKQIDERDYLFGRALAYAQKIESYALDGAGEKRSTNAERLQTAFCQHPARTWLTIDRQLRPYLLRLGKKATRYHDELNEILSRIPPEAFTSAPLSEKYLLGYACQMQAFHEEMEAYNRHKKEKANTAEGVQE

SEQ ID NO: 3032 - protein, 586 aa, Rhodopseudomonas palustris DX-1
MTALAALVRAYDRMAQRGEVPPFGYSQQNIAFVIPLNADGTVAGAPIDLRLGEGRKKTARQLTVPQPIKRTSGVAPNFLWDKTAYVLGITAGEGKRTAQEHQAFRDQHQAWLAGTTDEGLQALLRFLEAWTPERFAEWGWSDEIKDQNVVFALETERLHNVYLHDRPAARALWARLMAGSDKTEAICLVSGERAPLARLHPAIKGVWGAQSSGASIVSFNLDAFTSYGHDQGANAPISEAAAFAYTSVLNRFLDRGSGHRIQVGDASTVFWAEASDRASADTAEQMFASLFAVDENTESKKVGAILEKVAQGRPISDLKPDLPPGVRFYVLGLAPNAARLSVRFYVEDDFDVIAVRYLRHLARLRIDPPPREPSPSLWRYLIETAVLRKSENIPPNLAGDWLRAILTDTPYPLTLLSSLIMRLRADHDVSALRVGLMKSILIRNFGMENTPVALDLNCKDQGYLLGRLFAVYEQIQTAALGRNVNATIRDKFYGAAAAQPRKVFALLAAGAGNHLSKIGKLRPGHRVNLEKDVGSVMDMMEPDSDPFPASLSDKSQALFALGYYHQRNKYFRTSESPDTAAPEIAA

SEQ ID NO: 3033 - protein, 562 aa, Bacteroides helcogenes P 36-108
MFAELVELGKRIRKGHDALKEEKCSWDIVIDQDGNFIQLIPCDITVEAEMLTAKQGKARLLLDKPQETLGFEGSKDKHKAEDKHKKYLAKLEEYKEVQELFPIFSFYNKPKEVEKAIKAFSNLPPAKQNSNMTFMVNSTRLVSLECVKDAIKKKYEDTLCSKKQGNLCAVCGTNTYPILDEPHGPVKLPKGQTAGSMLVSYNTNAFESYNLKGNLNSGICTNCARNYIEALRYLVGNGHEIIVEKGKKGEKKFKFSNRQNISDDTIALFWTKEQDNDIDPFSDILQPTEERVKKLFSSIATGEYQSIDTEMENYFYCCTISSAAARIAVRDWIAISVTQYQKNLKQWFDDIETVKDGKIIYPGINNILNSCIKKKKDPTDSDAKAKARIGTILWHAALTNTALPLMILQSVLDQIEHEKKTFSVEKSTVVRLVLNRNIKNTYYMNKELDEQNESKAYLCGRLFALICKLQFMAQGEVNSSIKDRFFASASNTPGRVMGILLTQYVPVYQKKTKGAYTKSITEIVAKIKHFPDKLTLTERGEFALGYYYQYNTKQNENNNENN

SEQ ID NO: 3034 - protein, 580 aa, Desulfobulbus propionicus DSM 2032
MILQALASYYRRLSEEAGAEVAPEGFEKKEIPFVIVLDRSGHFIGLDDTREGEGKKKLARVFTVPKGIKKTSGIAANVLWDTPAYIVGRPKPDPKKETVKLLERAQEQFQCFQDTIRATFSDNEQDEAIAAVLNFLGKRDFEQLFSHTAWKEIEEKGMNISFRLDTDTCLICQRPGIVAQLIGNTQRVEGGDTHRVCLVSGEPDEPTRLHTAIKGVWGAQTSGANIVSFNLDAFRSYGKEQGLNAPVGGRAEFAYTTALNSMLVKGSKQRMQVGDASTVFWAEKKNDLEDVFADIFGEPSKENPEQATKAIRILYEAPKAGAPPLTEDYTPFFVLGLAPNAARIAVRFWHAGTVGETARHILQHFEDCKMVHGPKQPGFLSLFRLLVSTALQGKSENIPPNLAGEFMKAILAGTPYPKTLLAAVLRRCRAEREITYPRAALLKAVLARAARFYRQSEQEVGMALDTGNSNIGYRLGRLFATLEKIQEEASPGINATIRDRFYGAASSTPVAAFPHLMKLKNHHLAKLDNRGRAVNLEKVIGEIMDGIVDFPTHLSLQDQGRFAVGYYHQRQAFFIKNETN

SEQ ID NO: 3035 - protein, 613 aa, Acidovorax avenae subsp. avenae ATCC 19860
MILQALATYYQRLLARGEKGLSPFGYSPEKISYEILLAPDGRVVQVNDIRDPSGKKPVPRVMNVPQPEKRTVGIKSNFLWDKTSYVLGVSATSKRADKEHEAFKALHQQSLAGTDDAGLKALSAFLSGWNPDHFRTEPFKEEMLDANVVFRLDGEAAHLHERPAAQAARARLLSVDDDSASTLAHCLVTGERMPVARLHPAIKGVNGAQSSGASLVSFNLESFTSYGKSQGENAPISEQAAFAYTTVLNHLLRRGEHNRQRLQVGDATVVFWAEAASEDAAQAAELLLASTWELDESPTDAQDSGALRIALEKLVQGRPLTEIDPRLSETTRIYVLGLAPNASRLSIRFWTVNTLGALAQNVAWHARDLSIKPARWKVMPSLWRLVLATAPSREGRAKAEDVPPQLAGELMRSILQGHRYPGSLLANTLMRMRTDGDLSDVRVAICKAVLARTRRLAASNATNNDTEEVPVSLDTASLNPGYRLGRLFAVLEAVQRSALGGQVNATIRDRYYGAASATPASVFPVLLRNTQNHLGKLRKEKPGLAVNLEKDIREIVDGLPEHFPRSLRIEDQGRFAIGYYHQSQTRFVKGDGSAAQDSNDHDSNADTTEGAPA

SEQ ID NO: 3036 - protein, 654 aa, Syntrophobotulus glycolicus DSM 8271
MSWLQKLYQTAENCQSMIGYGSDENEVPLLPICHTTQKAQIEIVIDQDGNFKRARVIPKEEARTIVPCTETSGGRSGRKPETHPLCDKLQYIAGDFVEYGGEVTSGYAKKPREPYEKYTKILSNWCESPYPNTKAQAILKYIKKLNVIKDLIDFQILFVDDNKKLLKSWEEDEESEKNKPDIFKLLPGKINKKNGEVESWQADAFVRWIVEIPNDPQSAVWTDARLFDSWTKYYSSTKESKTLCLVTGKEVMAADQHPAKIRNDGDKAKLISANDTSGFTFRGRFLSAEQACGVGFEVTQKAHNVLRWLINRQGYRRGDQAIVAWATSGKEIPDLMADSLSMLELADMENDSEPVISTVQDLALKLSKKIAGYSVELGSTANVVVLGLESATPGRMAMTFYRELTGSDFLDRLEKWHKMCCWIHGYRSKEIIDSRTGKKRTLHYRFVGAPAPNDIAEAAYGMRVDDRLRKATVERIIPCIIDGRKLPRDLMESAVRRASNRISLEDWDWNKTLSIACALYKKYHEKEDFDMALDEKRNTRDYLYGRLLALADNIEEWAINDSGEKRQTNAARLMQRFADRPYSTWRNLELALGPYKARLGGKSAGRQKLISEVIDMFKPDDFISDKKLSGEFLLGYHSQREALRKKRDEEKQND

SEQ ID NO: 3037 - protein, 588 aa, Rubinisphaera brasiliensis DSM 5305
MILQALNSLYSRLENDPETQIAPFGYSPQKIVGSIVIDRDGQLIDFVPQYREEGKKRIARTVQVCGGAKPSGSGINPCFLWDNPAYLLGYKPDDTKPERTREAFEASRQLHLSYEKEIDTPDYSAVCRFLENWNPDEAANYPALVDNATGFFVFQISGKQQYAHQNEAIKRWWNQRLQGSESEAAGLQGICLVTGETQIMARLHEPKIKGVRDAQAAGAALVSFNANAYESYGKSQSYNAPVSEQAAFQYCTALNYLLARENNRSLTIGDATVVYWSEEPTPVEDVLSLMFSPPVSAEDASTRNAIAKDLELISQGLFPPERFGNLETRFYVLGLSPNAARLSVRFWYVSTLREMLEHLQQHMQDLQMCGKPEKEFAMPAVWQLTAETARESKDVSPLLAGAVMKAILTGQPYPEALYSAILRRLRMDRNMNYRRACILKACLNRNHRLGTNSQLPKEVSVSLDPEYPDAAYHMGRLFAELEKSQEDALPGLNATIKDRFFGAASATPASVFPRLIRMNQHHLSKLEGGSKHYHEKRIQEICQQINTFPSHLQLHQQGLFALGYYHQRADIFTKKEKPTEPEKVAAAE

SEQ ID NO: 3038 - protein, 588 aa, Rubinisphaera brasiliensis DSM 5305; identical to SEQ ID NO: 3037

SEQ ID NO: 3039 - protein, 608 aa, Nitrosomonas sp. AL212
MILSSLAQYYQRLADMPDAITGLARVPSYGFSEERISYILVLNRNGQLVDVQSNLSDDKKPKGRYLTVPWSVKRSGQFTEKAFKEGKNNAFFLWDKTAYCLGVESSDKKDLRLSQLTFDAFKKLHLDFLADTEDEGLRAVCLFLKNWSPDQFKSPFFKNEMLDANFVFKLDDDRQYIHERQEAVNVWLKTIAPKNDARKAICLATGKHEPFMNLHPSIKGVYGGQSSGGSIVSFNADAYTSYGKSQGENAPVSEMAAFGYTTALNYLLRRENNQCISIGDTSTVFWAVAGDGQTAQQAESLFAFMLNMPADDGQQIAQIKPVLDKIAKGRPLNEFAPHLDPETRFFVLGLAPNAARLSIRYWLDTTFGQLANHIGEHFQDLSLNPLPWREPPSVWRLLIQTAAQGKSENIPSQLAGELMRAIIAGQSYPRMLLAQLIQRIRSDGDISGIRVAMIKAIIQRDFRKGLIQEEVPMSLDLNITHIAYRLGRLFAAIERIQEAALGRDLNSTVTDKYYGTASTVPFSVFPRLLSGSQNHLTKLRKDKPGYAVNLKKDLAEIIAGIENSFPRHLSVEEQGRFAIGYYHQKQSYFESSKKTDAVADESNESTNN

SEQ ID NO: 3040 - protein, 603 aa, Marinithermus hydrothermalis DSM 14884
MFKALVELGKALEQQGKLPPPGYYYYKEPIRWRVRVFPDRFLLTPIDRNAARPFSGRTSGVQAHFLVDEAGYALGVDRTPKGSPEKRAKEKFAAFCALLEKFLSWPDLRDKDLAREVERLLEGLRAGWGRDQLESTEIFSKEWVEFVPEVGPLQGTPLFEHPEAVRFWVTELAERAAPRGGEVIGQCAVCGQHAVRLVGRIPLGVKLVGNAPLHSFNQSAFPSYYGGSSPENNAHIGLCLPCADTASRAFNYLSQSENHRKSLISDSNKRDALTNQIALFWTKSPSAIEIGTQNLNGGELNALISEVLSESFASKPITPKPTLPQLQQLLSLPWRPVDSHLNLDDYGFYLAVLSPNVGRIALRDWMAVSLTTLKETLRTFLSATCIVPPGGGPAEPRAIGELVRALESANPNHLRGLLRTAYLGDPPPAGLLQAAVVRFRNARVLENPRESWRLRALASLLKLTLFYGKKEVERMEKLNPSHKTPAYLSGRLLAVLEEAQKRAQGFNLKRTLVERFYGAASTAPAATFGMLLRTAAVAHLPKAGRLNLLVEEILGALDDAGGFPKTLTLKEQAEFALGFYHQRASFREKTKEENLSEAEVQHE

SEQ ID NO: 3041 - protein, 579 aa, Selenomonas sputigena ATCC 35185
MLQALVKRYETECKEGRLPQAGWEYRGVLFALVLSEAGDLLQVMPLAQQTMRGKKQVNVPRRIIVPMGETRASGICPFFLCDNSSYFLGLDEKDKAKRTAECFAAAKKLHEEVLGGVQSEAARAVLAFFERWQGGKEVLHTHPALGPYAAEISAGANLVFRVARTFVHEDPAVCEAWEKYLDDSGSKEKRRCLVTGTLAPIAAKHPALKGVTGAQATGAMLVSFNANAYESYGHDGEQGGNAPVSKKAAFAYGTALNALLADREHTKIIGDTTMVYWAEEESEAAQDLLCGMLFGDEDKMTDDLLDAVLKKVQAGAAIDYEGVAISYANPCYILGLAPNAARLSVRFFLQGSFGDFLRNLALHMEQMKIVRPSWETRGNVPLWELLRETVNPNAKVKMASPIMAGAMLRAVLTGGKYPVSVFQNILLRIHAEQGERKINARRAGFLKAYLMRNRGRKIAVALDENSTDVAYLLGRWFAVLEEVQEKANPEIKATIRDRFFDSACGTPAHVFPMLQKLALHHLKKLEAAPRVYLDKKLSEIMGKLDAKDMPRHLPLEEQGVFILGYYHQKQKRYEKKEEK

SEQ ID NO: 3042 - protein, 615 aa, Porphyromonas asaccharolytica DSM 20707
MILQALYNYYEAMRKAHRIATPGLEVKPIRWVIVIREDGSFVRLKNLKDPSDKKSKGQDYLVPAGLKRSGKCPPAQPFWDNRKYILGYEESAEGVSPCTDRLEDFKRLMAEIAELYPDNASFQAVCRFYEHYLGDEMPLPEDAHTERILASDWMTFQLQGDTELLATQDDAHDYTAQAYNTEENLGTCLITGEKKSLASFHARIVAPGSQAGATIASFNDPAYLSYGKKQGENAPISKYASFAHTTALNDLLRNEQTRYTLGDISYVFWNSNLDDPSINETFRTVIFEGVKDDDAQEPSDTDDEQPKRKGKSKKKAPNPTRETYKVLEQFKAIRGNRGQGQHWEDERQFYVLGLTAGGRITIKYWQQGTVSEIFDRVYQHLVDMNIIRRDGNVDEENPPLRSLYGIVKSVSSPSKSSTFAMNLVQSIVESVLNGTPYPMTLQQACINRITKERAVSELRAAILKGCINRKARIYKHLKELDMALDKQNDNIAYLAGRLFAVLEQIQQASLGKGVNATIRDRFYTSASTRPNMVMGRLIALSNHHLSKLRKEKPGLAVNLEKLLGEIFALIPAEVPTFPATFSLDEQSLFAVGYYHQKVDTYKKEDTNNSTEETEQ

SEQ ID NO: 3043 - protein, 614 aa, Treponema brennaborense DSM 12168
MSWITELRDVYDAVAGGGSSADSKPLPLYHIQNNAQITVVLDGEGNFRAAKLIDPKDRKERATCMPCTEKSAARTASIAPYPLCDKFEYVAGDYGRYSDGKNLSEKNGEFLTQLEGWCRSPFSDPKIESIFAYVKKGTLITDLIEKARLFSLDEKGNLAEELTDFIRWEVELPGDPVSAVWKDTSLQSKWVRYYESLGECRALCYACGKDAVILDLHPAKLRNSGDKAKIISANDDQNFTFRGRFHTAQEACQISADVSFKAHNALRWLIEKQGTRVGDGLTFVEWSAAGNVPPPVLCGGLDLYGDEDVEYTTDAAFASAVNRSLHGYYADIRNPGKNMIMGINAATPGRMSIVLYREIAQTDFIDMLNVWHSGLAWFYTYWKRDTADPKVGCVISTISSPSPKEIAKAAYGERIKPKQEEKTVERLVSCILDRKPIPKEIERRCVCRASKLALYKKGFERDQVLNTACAVYKYNHTVEGYTVALEENRTDRDYLYGRLLAAADAVERSVLKKMGAERDTNAMRYLQRFAARPASTWKMLYEKLIPYKRQLEPGLRNWFEGRIRDITVLFVADDYISDAPLSGEYLLGFQCQSKDFYVKKNDADSKTVTMETEE

SEQ ID NO: 3044 - protein, 652 aa, Bifidobacterium breve ACS-071-V-Sch8b
MSLWSSLLQTYDAVNSSAGITPLNEDVNKTLLPLYHTTLKTQLQVTLDENGYPTIKRDNADIEIIAPCTEQSMGRSGTVLPPHPLFDQLQYIDTNYDPVKHESYLSQLASWKGDNAKLNAIYQYLSQHSIIEEARAQGIGIDPKKDSKIGVRFAVHVRHGDYEPNVWADHAIRDLWIAHEEQVRHGASLGTDLFGETLYKPSTNFPKKIVNVNGNAKLISANDNTNFTFRGRFANRDEALSIDTLTSQKIHTTLRWLAANNGTLTGSQDIVIWAIDGHPTDNVFDPTGNSRDVAEQVDDRTDSEKLIDANVQTYANYAKQFGKLLRGYGNEKVLQQMQQHSRRIVVTIFDAATSGRLSVTFYRELSQNEYIESVLQWHEDAAWYLTCFDNKNSASTDDEAPRGSKKSSDKLKPIPYIGAPSFADIINCVYSTDDHSSDSYRRFAKYVKKQLVECMFSNAGLPASLLQPAFHKVIRPLSYDSLSVWQHDFEVACSMWKKYYIDQDKRLPLNERNNITMDLDEKRTDRDYLFGQLLALADNYEYRVLLRQSGGRTPDRTTNAVKLMNNFVAKPSTTWLTLRQQLNPYIISSTNGMFFQNEVDEVMSKFKEGDFESNKPLSSLFLLGYSHKRRQLIQRADAAKQLKEQNIENKGE

SEQ ID NO: 3045 - protein, 592 aa, Desulfotomaculum nigrificans CO-1-SRB
MIINALYECYERLLTDPGSGVSPPGYSKAKVSYALNISHKGELLNVIDLRVMKGKKLSSRDIDVPEQVKRASGIAPNFLCDNCVYVLGIGYIGKEKDSKWIMKRFEAFRRRQHEILDGVDDIGAQALLRFLDDWDPTKAVEHPLLREHLDGLADGGNIVFMLKGEHGYLHERPALRAAWEYHRSNSDSDRIGQCLVTGKRAPLARLHPSIKGVTGAQPSGASLVSFNLNAFTSYGKEQSYNSPVAVEAAFAYTTALNYLLASGRHRLRIGDTTTVFWAERIGSGIEEDFFAELFDPAWDTGKRDNKDDKPKRDPKTTGLVRDVLTRIREHKPVRDVMKEVDPDARFYILGLAPNASRLSVRFWHVDTFGSLTEKIGRHYSDMAIEKNWDTDPDFIPLWQILKETAPLGDMERVSPLLAGALTRAILLGLPYPQSLFTAMLSRVRADQTVNYVRAAVVKACLIRNYKHLDESKKEVVESMSLKEDNLNLPYRLGRLFALLEKVQQDANPGINATIRDRYFGAASATPRAVFPLLLRLSQHHISKAEYGFVTDKKIEEIMIGIDNFPSHLNLEEQGLFVLGYYHQRNALYKKSN

SEQ ID NO: 3046 - protein, 607 aa, Methylomonas methanica MC09
MILSSLAQYYQRLADTPDTLTGFARVPSYGFSDEKISYVLVLSSDGRLLDVQNYMDTSGKKPQPKLVSVPRPEKRTSGIKSNFLWDKTAYVLGIESNKDKATVQQTPWVITQRNFDAFKQLHLTALADVDDAGLQALKIFLQNWQPEQFNQSPCPLEMVDANLVFKLDGEAQFLHQSTAAKNLWAKMVAPEDDVVTACCLVTGENSAIARLHPSIKGVYGGQSSGGSIVSFNADAYTSYGKSQGENAPVSEMAAFAYTTALNYLLRRENNQCVSIGDTSTVFWAVAGDGQTAQQAESLFALMLNMPADDSEQTAQIKPVLDKIAKGRPLNEFAPNLDPETRFFVLGLAPNAARLSIRYWLDTTFGQLANHVSEHFQDLSLNPLPWREPPSVWRLLIQTATQGKSENIPPQLAGELIRAIITGQSYPRMLLAQLIQRIRSDGEISGIRVAMIKAIIQRDFRKGLIQEEVPVSLDLSSTHTAYRLGRLFAVIERIQEAALGRDLNSTVTDKYYGTAATVPFSVFPRLLSGSQNHLTKLRKDKPGYAVNLKKDLAEIIAGIENSFPRHLSVEEQGRFAIGYYHQKQSYFESNKKADTVANESNESIINQG

SEQ ID NO: 3047 - protein, 585 aa, Thermus thermophilus SG0.5JP17-16
MLRELKEAFHRFRKEGVLLPLAYKRKSVSWFIRLEGGKARLEGPYGKKEGVEPVPAPDRQRSGKASEGNLKPYLLADDARYVLGLPEEGKEEEAALLHKGFKELTEKAWRETQSPHVKEVLDLLSSPELGDLREEFRQKGGKPRDLLAFKVHGVLPTELEEVQAFWARHLAEEIQGDKGYCALCGNFGPVLRIFPREVVVLGQKCQLVSFNQKAFESFGKEQAANAPLCFTCASQVVDTLDHLIRSERHSRPLYREEEGGLRNQLAVFWLSEKVEVPLETPVDLEAILGAVLSGAPVQTPPADLTQLQELLATPWTGKAWPLNLDETRFHLAVLSANKGRLVVREWFAVSLGRLKETLGRFLEGTRLVRPWGEAPHPVPVGALVQALGDGNPGLVRGLLRTAYLGTPPPHALSLAIHLLRNPKALTPEEREDWGRLHALVAALKLWLFYGKEEAKRMAELDKERKNPAYLSGRLLAVLEEAQKRASSYTLRRTLVDRFYGAASTTPAATFGVLLRLSTTAHLPKVGQELNQAVEEILSRLDEAGGFPRTLNLVGQAEFALGFYHQRAYFRANRAGKKGESGQGGS

SEQ ID NO: 3048 - protein, 709 aa, Desulfotomaculum ruminis DSM 2154
MNWVSSLCALYDANAERAGQAERWKKKNLVLFPVGYDTMEAQIEIHIDQEGNYLGAHLLEKDEAETLVPYPEGRTSGLKALPLFDSLSYVAGDLLEVLTFYFPDAKNEKEKQSKIARLKGAFPLYLAGLKTWCDSPFSHPKVQAIYRYVTKQTVAQDLIRSQVLPMDENGIVSDKVKVQNTSLDKAFVRFRVFMHDKRLPEDILDNRDNAHDSAVWLDRSVQRSFINYYLSTFQAKDLCYMTGEYTPIAKTNPLKIRGKWDTKAKLISANDDTNFTYRGRFHTKEKETGYNEALSIGYVASQKAHNALKWIIRRQGFSRDGVCIVAWENALRDLPDFYASAADILSQVPENAADGVEVELEEEVLFEEDEAEIPETNYVSAKKFNAALDGYKAKLSGISRMVVLALDSATPGRLAITYYKELASSRYLQNIRQWHDSCCWKHEYIQDKQRKVYEGMASIREIALAIYGTEQGEDNNPQLKLSKNSDNKSPMLVAAFERLRPCIIDGAAIPRDMVRAAVLKASNPLAYKAKFNYHKVLHIACSMVKRLYWEKQQRNEREGVILGMELDKTNRDRSYLYGRMLAVAERVERSTYEKGETRITNAERYMQAFSRSPFRTWKIIWNNLQPYMKQLKPSAREYYKNLLGEITELFAYEDRISNELLDGKYLIGYDCQRMDLRRWPKEQISSHEGTNVSQKRTNECHQDDQEGEE

SEQ ID NO: 3049 - protein, 384 aa, Bacillus coagulans 2-6
MKFLIIFEFIQSDRGEQRVIPNRSRASGVSPILLTDKAEYVFKLPKNPANAKRAAECHLAYMKLLKECCEATRNELVQKIVQILERQNDPETTSMFTFLSDPDPVAVRRILSSPFKRAENHGSLDRICILALSANKARMVVRDYEEPPVWKVKNQIRQFFDAQQIVGAPKPASIYSLAACMYHDGRKEMQKEDVQDWMNWAIYGKRLSGRIIAKMVKRIQARGGMAWIHAAAIKSWLISQKKEEWTVDLDQARVTPAYLCGRLFAVLEAVPYEAVKGNETTASRFYAAASSTPRTIFGLLMRNSKWHLSKISKENKGYEVRYQQRIQLITGQLKEFPAVLDLQGQAEFALGYYHERQDIYKKKENMPADAANVSDLNKTVVEGE

SEQ ID NO: 3050 - protein, 630 aa, Streptococcus parasanguinis ATCC 15912
MDFFTSLLKAYEKAEEIGLVDQRTGDNDPVLLPLYHTSLKSNGNNIILIKLNKDGTFYKAEFMPDNQSIIFPVTSDSVARSGSNPAPHPLVDKLSYYVQEVSQSQYEEFHNQLANWVCFCKEDEVKDYLEKIQRFILRADFLNIVLNSLFGESYQRENLKVTYQDSNEKSKTIDLSACFIEFSIVQYHGFKDESVTTYKELHQSFISFVRAFQDNMGVCNISGRNETITNKHRGLMGNAKIISVSNKVEAYKGRFKEREDVFSVGYETSEKIHLMIKYLLENNNSSTWLGSSQYLINWFSDDLANKSQLDIVKPEFDSLFEDEEDDIEERHQLIRPNAENQEIGSSFIKGRKLFGNDATYYIAILNKTSNGRIALKYFRQLQVSQLLKNLENWQDTYSWEARTKSGTYKQKTPNFNEIINAAYGVDRGRYLELDNDSFRSDQYQQLVTALIDGKSIPNTIVKKLEANIKHRQNYPKCWHSLQQVSLAVLHKQYGREFNPMVDHENTNRSYLFGRLLAIFELMEAQRYRIEGGNQERITNAERYWNAYTSQPAKLMMNLANKIKPYEETVKLNSRGIYNKLEKEREEIISLLSPLMMNKDINDPLDYQFIFGYYSEKQYFYTKKEKYESEN

SEQ ID NO: 3051 - protein, 583 aa, Zymomonas mobilis subsp. pomaceae ATCC 29192
MSVIASLVEAYKRFPDTPPFGYSAEQISYVISLNDDGTVAHVVDLRVEDGKKRIPRKMFVPHSVKRAANITSNFLWDKTSYVLGITAKEAKRTEDEHRAFVEKHINAIGDSTDAGLRAFRLFLEGWRPEYFTGPVWLDEMKDQNVVFALESNRLKNIYLHDSDAAKLLWSRIFSEDEKKNDICLVTGEAGNIVRLHPSIKGVWGAQSSGATLISFNLESFTSYGHKQGRNAPTSEAAVFAYTTMLNYFLDRGSHHRLQIGDASTVFWADAGDKQAAEDAESLFYTSIDIDDLHQKEEISTNRLRETLARLRRGEPIELVEPELAKGVHFYILGLAPNAARLSVRFFYSDNFCDLIRNYQRFVSDMRIEPPPREEYPPLSRYLLETAVLGKRENIVPNLAGEWFRSILTGSSYPLTLMSSVIRRIRADGQVNGLRVGILKALLVRNFNRKDVPVALDPDNINKGYLLGRLFAVYEQIQTAALGSKVNATIKDKFYGSASAQPRKVFPVLDKGSANHLSKIGKEKPGFRIVLEKTVASIMEKMRPDADPFPTSLAAQDQALFGLGYYHQRSEFFKKANNTAISEE

SEQ ID NO: 3052 - protein, 579 aa, Corallococcus macrosporus
MLTALNDFARERGLTDDPLYEVKPVDFFIRISAKGKFVSLESTAGEDGRGKPMPVPRLPQRSVNIAAGFFADNPKYVLAYEKDAPAAKAGRVDKRVARLEAFLKPVREVAAETKDAEARAVESFLSNEAERNKVLAARDGEEWTGSEMLAFVVGDGTVPVHQRPAIRACWERRSGEKLAKGRRAVCLVTGQEGVVAVTHPKLKGVPEAQPAGASLVSFNAPAFESHGLEQGNNAPISEPAALGYVLALNDMLKRTEQRRFRQGILLGDDSVLVFWTRASPSEESLLLSWMDPTEEDLRRFAESPLHGLEPGALDDRAFYAVTLAGNAGRVAVRDWFESRVGAVKQNIRRYFDDLRLGSAPASPIPVYRLLKAVEAPSGRGLSPDVATRMVGAALRGHPFPRQLLAAALDRLRLPPADDRFEREQLRLRVALIKATLLRLPRSGTTPLEVSVSLDKNNTTQPYVLGRLFAVLERLQGVALKDLNATIRDRYFGAASRNPVTVFPRLLQLSVHHASKAGETGRWLERTKGEVMALLPADRFPRVLDLEDQGLFAVGYYHQREAFFTKREASAPAEPDASAS

SEQ ID NO: 3053 - protein, 626 aa, Treponema caldarium DSM 7334
MILQALYNYYKILLDDPEVEIAAPGYSAANVSFALNLSSNGDLLDIIPLTTKSPDGKKERNFRRMIVPEQVKKSSGIVANFLCDTVPYVLGISEKEAKDPKYAEKRFEAFRDFNIEILSHANSDAARAVVAFLQKHNPQKAQQHPVIAQQLEGLLEGGSLIFQLQGKDVIQDPEVRRAWEDYKLGQEAVEMQCLVTGKIEPIARLHPSIKRVRGAQPTGASLVSFNERAYESYNRLKGQGLNSPVSQRVASGYGVALNYLLSEQNPNRPIFLGDTTVVYWADTADKRYSDAFYALLNPEYQQVEDVAAEETKEKRKRDKEGERTLGEVAESVQHGKAIDLAALSKELDKDTRFYVLGLASNVSRLAIRFFLTEPFGVFAERIMQHYEDLKIVKEYANQSDYISPYRILAECVSPKVTRRDDEVKQSWSLLGGAFMRAILTGAPYPEGLYAAFINRIRHDTDETNDEGRRRSVKINYIRAAYIKAHLIRKFRRQGDNNNYKEALQMSLNESYDHPAYVLGRLFAWLEKAQAEAIGQNINATIKDRYFTSACATPASVFPTLLRLSNHWTGKAEYGGTLDKNIQALLGKLEAQPFPQRFTLEEQGVFILGYYHQRSAFYPKKDSNGGE

SEQ ID NO: 3054 - protein, 589 aa, Ketogulonicigenium vulgare WSH-001; identical to SEQ ID NO: 3027

SEQ ID NO: 3055 - protein, 583 aa, Roseburia hominis A2-183
MILQALVEHYEDLLKQGRIAKPGWGKVKVSYGLNLDRQGHVLGLIPLKVAQETGGSKKKTVFVARMMEVPHPEKRSVAVCPNFLCDNATYILGVDEKGKPERTSQCYEACMEKHMELLSDIHTPAAEAICHYFEYWSPDAARQCTDIEDNWSDLMAGVNLLFYYEGEAVTEDPAIREAWQQFYDRKDESGQTLCLVTGKKDKLAVLHPSIKGVRGAQAMGASLVSFNAASFCSYEKEQGANAPVGEYAAFAYTTALNELLNDRAHTGTIGDTTVVCWAEGGESLYQDVGMMAMFGLTDESGMTDGELRAIIGKVANGEPVQIEDIRLDPDRHFYVLGLAPNAARLTVRFFMRDSFGTMIRHVNEHQERLRIVNARQKEYPIIPIWKLMSETVNQNARDKSPSPQMAADTLKAVLTGGKYPASLLNAVMLRIRAEHRITRERAAMIKAYYLKNENKDCPKEVLQEMINEESKNVPYTLGRLFAVLEHLQQEANPGINTTIKDKYFNSAAATPAQIFPLLLNLAQKHLRKLANEGHKVYFNRQIGKLAEVIGESFPKRLNLPEQGAFQLGYYCQTQKRYTKKEEN

SEQ ID NO: 3056 - protein, 607 aa, Rhodospirillum rubrum F11; identical to SEQ ID NO: 2979

SEQ ID NO: 3057 - protein, 329 aa, Bacillus coagulans 36D1
MPPCIYEFLLKECCEATRNELVQKIVQILERQNDPETTSMFTFLSDPDPVAVRRILSSPFKRAENHGSLDRICILALSANKARMVVRDYEEPPVWKVKNQIRQFFDAQQIVGAPKPASIYSLAACMYHDGRKEMQKEDVQDWMNWAIYGKRLSGRIIAKMVKRIQARGGMAWIHAAAIKSWLISQKKEEWTVDLDQARVTPAYLCGRLFAVLEAVPYEAVKGNETIASRFYAAASSTPRTIFGLLMRNSKWHLSKISKENKGYEVRYQQRIQLITGQLKEFPAVLDLQGQAEFALGYYHERQDIYKKKENMPADAANVSDLNKTVVEGE

SEQ ID NO: 3058 - protein, 611 aa, Pseudoxanthomonas spadix BD-a59
MILSALDEYYRRLSDDRESGIAAPGYSQEKIGYAIVLDADGRVVDVQDLRDSSGKKPAPRLLGVPQPEKRTVAVKSNFLWDKTSYVLGIGKNTARTQQDHAAFKTLHRQALAGSEDPGLKALLAFLDDWTPAQFADNPLFSRHGEALLDANLVFRFDDGTQQFLHQRQAARDAWNRQQALGADGVRGMCLVTGQQAPMARLHPAIKGVNGAQSSGASIVSFNLDAFTSYGKSQGENAPVSEQAAFAYTTALNHLLRRTEDNHQRLQLGDTTVVFWAQGAGAQAAEDFVATFFGTQQPDSEGLDDAQATRRLAQALEQLRQLRPLRELDSRLDEDTRIFVLGLAPNASRLSIRFWETTSLSSFANRLADHYRDLALEPSAWRRPPTPQYLALQTAPVYGENGRPKAEDVPPLLAGELTRAILTGMRYPRSILGAIVMRFRADGQISPLRVALCKAVLAREARLGMHHGTSTNKGEPPVSLDTSNTDPGYLLGRLFSSLENLQRAALGAQVNATIRDRYYGAASATPASIFPVLLRNAQNHFGKLRKDKAGLAMSLEKEIGQIVDSLPPSLPRSLLIEAQGRFAIGYYHQTQARFARSGNQDAPLTDSEGETA

SEQ ID NO: 3059 - protein, 709 aa, Desulfosporosinus orientis DSM 765
MNWVASLCALYDANAERAGKAEKWKGKPLVLFPVGYDTMEAQIEIHIDQEGNYMGARVLEKEEAETLAPYPESRTSGPKALPLFDSLAYVAGDLLEAVTFYFSDAKNEKERQRKLARLKESFPRYLAGLKAWCESPFSHPKVRAIYRYVAKQTVAGDLIRSQVLGADENGIVSDKVKVQKTSLDKAFVRFRVFMNDELLPEDILGDPNNAHDSAVWLDRTVQNSFIDYYLSTFQTTDLCYMTGEHTPRAKTHPLKIRGKWDTKAKLISANDDTNFTYRGRFITKEKDTGYNEALSIGYVTSQKAHNALKWIIRRQGFSRDGVCIVAWENALRDLPDFYASAADILSRVTENAEDEAEFETEEEILLEEDEGEIPETNYASAAKFNAALDGYASKLSGISKMVVLALDSATPGRLAMTYYKELESSRYLKNLHQWHDSCAWKHEYIQDKKLKVYEGMASLREIALAVYGTEQGEDNNPQLKLSKNSDNKAPMLADVFERLRPCIIEGGAIPRDMVRAAVLKASNPLAYKGKFNYNKVLHIACSLVKRLYWEKQQRMESEGVILRMELDKTNRDRSYLYGRILAVAERVERATYEKGETRTTNAERYMQAFSRSPFRTWNTIWNNLQPYLKQLKPAAREYYKNLLGEITGLFEYKDRISNEFLDGKYLIGYDCQRTDLKRWPKEQPAPEGGHSSPEGTDEDHNNEEGEERR

SEQ ID NO: 3060 - protein, 585 aa, Sphaerochaeta pleomorpha str. Grapes
MILQALSEYYYRLDGNGKDLIAPLGWEKKEIPFIFVLDEQGSLLNVEDTREGEGNKKLAKTFLVPQGVKKTSGVAANLLWDTVGYVTGYLDTKKMSETQAKKKIERLPKEHQAFIERIETELIDSPKKSALIHFLHSISLDDLRSFPCWEEIAVVNPNVSFRFSQDLQLYCQNNEVKKALAKIEPKKNDATQQVCLVSGEKDSICTLHTAIKGVYGAQSSGANIVSFNLSPFNSYGKKQGENAPISEKAMFTYTTALNTLLGKNSKQRMQIGDASTVFWAGRMNQFEKDFLKFFAEPSKDDPNANTQSIRSLMDSPKTGEYYADSCEDPFYVLGLSPNAARISIRFWFNGIVSDFSKRIRVYFEDLAIVKPPNEPEYYSIWRLLVNIAVQGKSENIPPNISSDFMRSILMGTPYPQSLLQMTLRRIKNDGENRVPPVRAALLKAILNRNLRLYPKQNQKELDMSLDIDQPSIGYQLGRLFSTLTKIQEEANPGINASIADRYYGSACSTPVSVFGTLMRLMRHHLAKIENPGRRIQLERQINEIVSHIDEFPAHLNLNEQGRFAVGYYHQRQAFFTKKETELSDK

SEQ ID NO: 3061 - protein, 645 aa, Clostridium sp. BNL1100
MGWINKLYDTYENCISEVGKPRTDKKTPLLPVGHSTQNAQIGVVIDIEGNFRRARILDKNEQVTIIPVTEDSATRSSGISPHPLCDKLPYVAGDFSQYVNKEKGKDFFNKYIEQLEDWCSSEDKNKKVCAVFDYLKKKQLIADLVEQKVLYCDESGNLKKDIKLGTVSQIDAFIRFVVEDTGNSSSETAVWLDNEVYKSYIKYYLKKQNGADICYIKGEKIPYSEKHPSKVRNSGDKAKLISANDESGFTYRGRFSDKKQVIIVSYEVSQKAHNALRWLIDIQGYRFGNPKDGEEVIVAWGTNNQKVPPLLEDTDDIFGEEGDSLTIVSTQKEYARRLNKAISGYGCELDTNADIVIMGLNSATTGRLSITYFRELKGPDFLNRIEKWHNTCSWRHSYKRIQDGTDEKGKNKYKTIEFIGAPAPKEIVRAAFGIERNERLEVDDKLMKSTIERLLPCIIDGARLPYDIVNSAVNRASNPISMNPFNWEKSLSIACSLVKKYRNDKYQKEEWDMALDENQNDRSYLFGRLLAIAQEIESWAISTTGERRETNAERLMHQFKLHPYKTWGTITNKLRPYIARLGEKGKKYVELKTKVNSMISYEDFTSSEPLKDSYILGYYCQRQVFIDEMNRKIAEKNEKKLENLN

SEQ ID NO: 3062 - protein, 677 aa, Aggregatibacter actinomycetemcomitans D7S-1
MSWMQKLCRTYEYVQEQGLEDEDLALPFHMSKAVHLKVILNNKAELVGVERFEGKKQVPIQVTEKSSKRAGSTIAPYALHDGLQYIAKTAKEYLTIEYLSKVAEKENGKKWKNFLAGTDEDKRNFADTEKTRYKTSFKAYEEQLSAWAEASHLQEIKIVLQYIQKGSLIEDLLEKKVFTLENNILLAGKDDPFNFTIVWAVEIPNDLHSNLWSKSSIKEQWIKYQESQSGQEDEKPELCYITGESSYLANAYPKIEGNAKLVSANDTDGFTFLGRFLIDKQAAALGREVSQKAFNMLKWLIKRQGVRNGDQVTVAWAISGKAVPSPMKDLSDEIDWDNLDISADESAVENSDRFSSPTSSETPDWSTNIGKPAAQIIKKKLHGYQEELKNHEQISLIMLDSATPGRMALTYYQEFLPADYFANLDAWVDDFSWYQRYSVEVQNGKKTDKRTQWRGVPPSPYSVADAVYGKSLSDTLKKQLYARLLPVIAGGKSVPIPDDLMQKSFQVACNPNGSENWEWQRNIGVACALYKGWRARHHDLSERRTYSMALDKENRSRDYLYGRLLAVAENTESYALYLVGEKRATTAERYMQRFAEHPFATWRNIELALKPYQDRLRNNGKDTGAQAIGEIMDLFENQDFSSDDKLSGEFLLGYHCQKMDIARRIAEISANKSKTDE

SEQ ID NO: 3063 - protein, 591 aa, Aggregatibacter actinomycetemcomitans D7S-1
MILASLARYYRRLAVENDEVGNPKVPPYGFSEEKIGWILVLDKEGRLKTAVPNLTADKKPQPKLMSVPRPEKRTSGVKPNFLWDKTAYALGVEANKNKDEAKETPFTSSEKTFAAFQQYHLDLLQDSEDEGLQALYRFLQNWQPENFAAANLPPEMLDANIAFSLEKPTALIHKRDAAQTLWAGRLKSDEAVEGLCLISGENAPIARLHPAIKGVFGGQSSGGSIISFNKEAFASFGKEQGANAPVSEQSAFAYTTALNYLLRRENGHCLTIGDASTVFWAEAADNATAQAAEGFFAQVFTPPDDEQESAKIFNVLEQIAKGRPLEEIAPELSPDTRFYILGLAPNAARISIRFWLDTTFGQLAENLALHWQDLAIEPRPWKTPPSVWRLLLQTAVLGKSENISPVLAGEMIRAVICGTPYPLSLLSQLIARVRADGDVNGLRVAMMKAVLQRRFRKVLSKKEFLNLNHESPNRAYLLGRLFAVLERIQYQALGDLNAGIADRYYGSASAVPFSVFPRLLSGAKHHLSRLRKDKGGMAVNLDKDLGEIIAKLPETFPRHLSIEEQGRFAIGYYHQKQRYFTEKEPAETIEN

SEQ ID NO: 3064 - protein, 635 aa, Tistrella mobilis KA081020-065
MILQQLSEYYDRRIEGGDTDLPEEGMSEQAIDAAVDLERFQPGCVPPVLLLGDRSGKKPKPLRMTVPAAIKRTSGVAANFLWDKSAYVLGVKRAGKTPDAGVVAAGKEFDAFRQLHIEALAGTEDRALLKLLEFLEDWTPERAVAAVEAGEIPIEAVDGNLIFRFGRGTVRDLHRFRAARAAWAARREAVAGAAGRCLVSGIVAPIAKLHPSIKGVRGAQSSGASLVSFNLDAFTSFGKEQGANAPISERVAFAYGAVLNKLLAPDGAHRVQIGDATTVFWTDAPNPADDTASRVLANAVSPAYGLMDQDAGAEADEAGEDGTAKKPKIDLKMSDEEAKRVRTALSALARGRTMGEAISADLDPDTRLWVLGLAPNAARLALRFWYEDRLGDAVDHVRQHWHDLRLDPGIDPGRPVSVYALLKALAPQGKLDNLPPKLGGDIMRAVLSGRPYPANMAALALMRIRADGEISALRVAMLKAWLLRRSGKEPLEREGDLVSLDPAETNTGYRLGRLFAVLENLQRAALPGLNATIRDRFYGAASATPGSIFPVLMRGSTHHAAKLRKDRGGLAHWYDTTIAEVIDGLPSNLPRHLGVEDQGRFAIGYFHQRQAMMTRAPAEVKAAEAGEPAVIGDDA

SEQ ID NO: 3065 - protein, 617 aa, Desulfomonile tiedjei DSM 6799
MLQLLLKYAAENLEPEPGFASKDVRWAVICGQDGKYQGVIELGDVNTEKNLGTTFPKCPDLSQPELVLGSTTKCHFLVETAKVVMLFDPAKKDSDYITPDEGSHAKHEFFVSLLRQAALEMSQLMTVADCISNQDVIKQACRDLKRQKAQANDKVTFRIGNAFPVESHQWHEWWRNFRKNLADTKSEKRIKKAGPKKTATGVMRCFASGELVEPLLTHPKIKGLEKVGGLQSGDALIGFDKDAFCSYDLQQSANAAVSEQAATAYRDALNHLIKKNGHVLAGMKIVHWFKEKIEPPDDPLSWLQDDPNLQKASAEERARELLDSIRTGKRIDLLNNRYYALTLSGAAGRVMVRDWMEGAFEELVENVSCWFDDLAIVDCFGNPPTKSPKLETVLTSLLLPRKHKQEYRDWVASIGPARMGLWQAAIRGTGIPHVVVSRLVPLHNAFVSNGTLEAALNANENVGLFISLLQTRMGLLKAYHTRKHRINGGNLMSGTLKPGLNEDHPSSAYHCGRLMAVLADVQRAALPDVGAGIVQRYYAAASATPALILGRLTRLSQFHLSKLKTPLARWYEKRLSSIWALLGDGPPRTLDLEKQSLFALGYYQQMAFREDKGGQDE

SEQ ID NO: 3066 - protein, 699 aa, Desulfosporosinus acidiphilus SJ4
MNWVSSLCALYDANAYRAGEVERWKGKDLVLLPIGYDTMEAQVEIHIDQNGNFIRARTLEKDEAETLVPYPDSRASGIKALPLFDGLSYIAGDLLETVTFYFSGAKNEKDKKKKKARLRESFPLYIAGLKAWCESPFSHPKVAAIYHYVGKQTVAKNLIDSQVLVADENSIVSDKIKIQNASVEKAFVRFRVFTNDNNSPDSILSDPDNAHDSAVWLDKTVQRSFIAYYSSTLHKKDLCYMTGEHMPIAKTNPVKIRGKWDTKAKLISANDESNFSYRGRFNTKEKKTGYNEALSIGYNTSQKAHNALKWIIRRQGFSRDGVCLVAWENALRDLPNFHDSAASILAKVSDDGEADEAEFEEEALFEEDEADVPVTNYVSAAKFNAALDGYASKLSDISNMVVLALDSATPGRLAITYYKELKSSRYLKNLRTWHESCCWKHEYIRDKELKVYEGMASIPEIALAIYGTEQGEDKSNPKIKLSKNSDNKSPMLVSAFERLRPCIIEGAAIPRDMVRAAVLKASNPLAYEAKFNYRKVLHIACSMVKRLYWEKKQRNEREGVIFKMELDRSNRDRSYLYGRLLAVAERVERVTYEKGETRITNAERYMQAFSHAPFRTWTMIWSNLQPYMRQLKPSGREFYKNLVGEITEQFKYEERISGDPLDGKYLIGYDCQRSELKRKPNGQSSSEEENKKENNEGEE

SEQ ID NO: 3067 - protein, 637 aa, Bacillus thuringiensis MC28
MSWLLNLYETYQLNLDRVGKMEKKYNGQEYTLLPISHTTQTAHIEVSVTDDGEYHTAEIIDKSDANTLIPCTENSANRAGATIAPYPLHDKLSYVAGDFVTYGGKIKKDEPFSYYIRQLEEWAVSPYATAKVKSIYTYLRKRRLIKDLVDEGILHMDTKGELLEAWDKNAEALLGEKPAIFSVVTGNQENAFVRFNVYSPNKMLTKVWKDPEMYDSFIKFYSNFLGKDDYCYVTGNKIPSTVKHANKIRNAGDKAKLISANDTSGFTFRGRFSRANDVANISYDVSQKAHNTLKWLINKQGKFVDQRVFLVWGNDSEDVPDFVEDSYNIYSMNLRLTEKREINSYTHEQFADEVSKAIDGYKNNLLSSVNVNILMLDSATTGRLAVLYYRNMDKNLYLNRLKYWHSTCAWEHHYLKNKDNKFVGFYGAPSMIDIAFAAYGPKANEKLVKGLMERILPCILDEKKIPSDIVKSAFHRASNPVSMERWEWEKTLSITCALINTMEGYQLVLDKENNDRDYLFGRLLAIADVLERKSLDTNNQRATNARRCMNSFSQRPERTWKTIQGALQPYQTRLGEKVWYYNKLIDEVGSKINIEDFNNQPLSGRYLLGFYSQRHELYQKEEGNVSLDATENKGGEN

SEQ ID NO: 3068 - protein, 570 aa, Pseudanabaena sp. PCC 7367
MILSQLYEYSQRQMELPPAMYKGTKVRWVISLSTEGEFRDFIPRGGNSKADKRGTEMTAPHILRTVGVKPKLLADTGEYVLGIARPNSKPQRVKDCHQQFKDLVQQCANSTEEPTIRAIVKFLDTWNPETDRGKLPKDFDPADVITFEVGDTLPADEKAELHRIEEFWADYTLGDSDKSMPIMTCLITGERKPVVSTLPLLIKGLVGGQPSGTAMVSANAKPFTSYGLKSSLTSPISRDAAEGFAKALNHLIASPNFRLRIGSTTYVFWTRDQEDDFDALSYLDDPDPEKVKSLLSSPFTGQQSFSVDENQFYCLTLTANNARAVVRDWLETTVPEVKRNLCNWFEAQRIVAPDGEEFKSWGVYKLAASAYRDPAKEMLPAVPNALVKFALSGDRLPHDLLARVLRRNRAEQKVTYARVALIKLILTSQNKFARTEMETLNPNPDFPAIADHTAYHCGRLLAELEAIQRTALGKINATLTDRYYGAVSSTPASAFPPLLSGAKRAHLPKLRKNRPGAYQALEKRLEEIMSHLSELGFPKTLTLQQQGLFAIGYYHQKAANRAAAQTNQAS

SEQ ID NO: 3069 - protein, 584 aa, Chamaesiphon minutus PCC 6605
MILTQLKEFADTQMTLPPVMYSEQKIRWSIDLNLDGTLVGKFVPWGGDTKANKRGEPIVVPFVGRTVGVKPKLLADSIEYVLGVGRPDSKPERVADCHQQFKTLIQKCFEITQEPMLDAVRVFLTKWHPNQLGECLPTGFKLDKFDPSENITFRVDGVVIADARAQIKSIEQFWADYTSGSDDADKEPAPIMTCLITGEMSEVAQRMPVLIKGLIGGQPSGTALVSANSDPFTSYGLKNSLSSPISRDAAEKFAKALNHLLADDSSRLYVGSTAYVFWTRKKTDFDPISFLKAPDPQAVKNLIESPLSGSQVHTDTDDRFYALSLSASMARSVVRDWLETTIPNVREHLKRWFINQKMVDGYGIEMRSFSVYTLAASVYRDPSKEMQPTVPTALIRHALSGAPLADDLLVKLVRRNRAEQDITYPRAVLIKLILISQGKLNMTDMDTLNPNPELEGVDNAAYHCGRLLAELEAIQRAAQGNTNATLVDRYYGSASSTPAKAFAPLMRGVQNHLGKLRKNSPGIYKLCDQRLEEIMLNFPEKRFPNTLKMGHQAIFSLGYYHQRAANRAAIAQAKADKEAAKLKA

SEQ ID NO: 3070 - protein, 560 aa, Chamaesiphon minutus PCC 6605
MQINSVVSPTGIDRPYGYTPMDVSIEILLGSNGQIGPANLMPLETDNKTRKRFWLPDLPRTSGIAPIVGSDKLDYYHPTRKPQAFAAMVEFLKQRCTEVPELQLIIDWMQSDRPLELERQISEKPKADITAIESGRIVWRLEDGTYIHDLPSIRSAHAAQTLERAIGTGDRDLLGALPRIHSKKLAAPLLGCNDDMFRSWGQHEKLPLNISAEAAVIATQKYTELLEAKGHNIWLGNGRYWVWGALPEMAELSEAGKAMAVYFDSDEAKNLDPVQALEDIIREVKTGAKGIGKIPEDLKIACGYIGIGGSGKGRTAIGQVTELSALQLLNNLLLYHQQQRRYLTISKPYWVFGALTVAEGSSKQAVAKANEQIFEAMINGQLPPQAITTSVIHRLKIEGVPNPNAKKSNREWAQIAYLAWLSPNFIEGDRMMKPETTPDNLLAWHVGRVFAACKAMSYHYAARSAAPGEGWKDPLDSYRQTLFSSPAQGFAQIIAKVSPYLAARPDKAVWYDKTLAELGEDCPNAFPPRRWTDKQAFFLALGISQFQEARRTANAGKTSE

SEQ ID NO: 3071 - protein, 597 aa, Thermobacillus composti KWC4
MILQALYRYYERLEERGETLPGDAYSAAAVSFVVQLDKDGSVKAVIPFVNEKGKPDKRKYMVPKQVKRTSGIKPYFLCDKAEYFFGSAIGMREACRTSMRKLWLSVLEHVSSNSDEIQALRLFVAMDAGQLEENLTQVVDDRVLDSLTKGGLCVLQYSPTGILYHQLPALKSAWEKFHLRAEEHGADADYMSCLITGERVPQSRIARLHPNIKNVIGAQSSGAAIVSFNLDAFCSYGLKQSYNAPVSQKAADAYGYVLNRFLADPAHKVRLNDTTVVFWAESDAPEEQEFLASLLQEAGSHEPEDEDSIRSRVRSALTRIRKGQTFRETFSDLNPDTRFYVLGLSPNAARLSVRFWYTGSLGEIGERVWQHYIDLSVQGLDRSPSVRELLRELAVQGDWENIPPLMEGLMLRSILHGLPYPRSIFPQLMNRIRAESSDRKLNPRRAALLKGYFIRQARLHNDFMKEANLTMAENENSTSTAYHLGRLFACLEKAQKDAHENKLNATISDRFWGAASTTPALVFPRLVQLSRYHVSKDEKNGRFNDMAIAEVMSKLPDRFPARLSLEEQGMFALGYFHKRQKLYEPRKQSNQTNGNEG

SEQ ID NO: 3072 - protein, 628 aa, Methanoregula formicica SMSP
MIIQSLVRYYDILAGDPTVKIPEPGYSLADISFALVISRDGKLKNILDLRSDDKRKTPKEMETPYQKSRAVGIVPYFVSDNAKYIFGIEKVSNGEKKKTAAEIVKILEESDGEKIVVTKRSLDCFSRCRALHHILMDALDDSDVHSFLAFLDSWKPESSLQDPKLSEFKDLILDGGLFVFDIGGRYIHENPVVHQAWDEYYVNGRGLEQTEIAQCLVTGKMAPIAGTHQKIKRVLGAQPAGANLVSFNDGAFWSYGKNDNKQALNAPVSELAMFKYTTALNHLLKRDSKNRIQIGDTSTVFWADTTKKNCENLAHFLIDPVEDEEEADPNSEGSLRQQDRGTRQLVNDILQKVKTGKYLEEKDLGVDPNTTNFYILGLSPNNARLAVRYWHQDNFGNFITRLARHHLDMEIDRDNRGAQYISMYRLLRETVPQSSTDKAASPLLGGLLMRSILDDTPYPVPMYNAIVNRVKVERSINYARAGFIKACLIRMARARGKHEEDMITVSLNEKSTDVPYRLGRLFAVLEKAQSDSNKDLKSTINSKYFSSASTTPAVVFPVLLKLAQHHIAKSDWGFKSNQWIEEVVSGIDEFPAFLNLEDQGKFMLGYYHQRKAFFKKKEASEDNKEDKK

SEQ ID NO: 3073 - protein, 587 aa, Prevotella dentalis DSM 3688
MILQALCEYYQRKAALNEMPPYGREWRAIPYLIVIREDGHFVKLEETYEGEGKQREAKSFSMCHARGRSGSNSWKTANILWDHYGYVLGLPKKMALADENAVQTGKKQNESFVKEIDRLVSLNPNHVGIYAVRQFYTVFEDNLNAIKKDALFEDSVNKEGTNFAFKILGQLEPVGVDSTIDYGEDGKDAPVRLCLVHGDRKPIAVLNNSVSLIGASSMGAKLVGFQKGAGYDSYHKEQGLNAPISQQANNAYTMALNTMLAKDSKNHFYFSGDTLVFWASRENEFENQFSFFFAAPPKDNPDKSVEMISHLMKAPLSGTIHDNDETRFYILLLSPNVARIAVKLWEETTVREAGANIRQYFEDLNISRGKMDKPYYSLYELLANIALQNDTKNLPRTLFNGMVRAAIENLPFPALAQMQCIGRIKADRKVNCRRAGLLKAYLNRKNRNNKQNVEKDITMALDLENKNQAYLCGRLFAILERIQEESATGKLNATIRDRYYGAASRTPSVVFPRLIDLSNHHLVKLSEKEKVYYERMKGEVMLDINARGFDTHFSLDDQSRFAIGYYHQRQFFYTKKEVANFQDNNNN

SEQ ID NO: 3074 - protein, 588 aa, Myxococcus stipitatus DSM 14675
MMLAALNAFAQERGLADDPLYEHRPVDFLIRVSAKGKFQGLESTQDERGKGVSMLIPRIPQRAVNIAAGFLADNSKYVLGYEEAPAPRTGKAGKGAVRFEAFLKLVREAVSELNVPELRAVELFLASDASREQALAERAKEEWTGSEMLAFVVGDSLEPVHLLPEVRDWWEKRGAEEAAQGRMGLCLVTGKTGVLAETHPKLKNVPEAQRAGAALVSFNARAFESQGFEQGDNAPISRQAALGYVLALNDLLRKSEDRRYRQGIQVGDDSVLVFWTNSTAKEECALLSWLDPSEVDLRRYLEAPFRGLEPSALDTRRFYSVTLAGNSGRVAVRDWFQTSVGEVKQNLRRYFADLRLGAGPAEKPTPVWRLLKAVEAPSGRGLSPDVSTRMLGAALRGQPFPRQLLSAALDRLQLPPSDDKFEREQLRLRVALIKATLIRLPRSGTASLEVSVSLDKTNSSQPYVLGRLFAVLERLQGAAQGDINATIRDRYFGAASRSPMTVFPRLLQLSVHHVSKAESERKGSGKRLERIKGEVMALLDSKVFPRIFFLEEQGLFAVGYYHQREDLFAKHAPSESMSSDDEPSDDTE

SEQ ID NO: 3075 - protein, 654 aa, Desulfocapsa sulfexigens DSM 10523
MILQALCEYYERRAAEPNSKIAPIGFAWKEIPFVIVLDRHGKVVDLQDTRQMNGKKLVGRKFLLPKVQGRSGQNAWATACLLWDHFGYVLGHLKGESKKDAAKTIKQVRKQFDLLSEKERLEPGIAKALQFCEKYEIDAEKTIQSFGSFRKILLGLPENLQETKVISTVISSYKKDKEMADKQLGTFKKTINTLPPELLADEGVAAVVSFYATAEYQKVTGFDAWPSCREINGCNLTFRLDGDAGGIAEREAVITYQKSVALVPDETETREAYCLVTGKKQPIQRLHAATAIAGGKSTAGLVSFQKNSGYDSYGKEQGFNAPVGKYAQAAYSTALSTLLTSNNRIFVGDATTVFWAGKATQIENDFSLFFTDPPKDSDDPDAGIKAVRALYESIYTGSLAAESDIPFYVLGLSPNAARISVRFWSQGTVLKFAEKIKNHFDDLEIVRSGKDQEFFSLHKLLSHTAFDFKISNVPPNLAGAVMQAIFEGKPYPVTLFQQCMRRIRAERHVNRIRAAILKAYVNRRNRYYHKIENEEISVSLDKNNMNPAYRLGRLFAVLENIQKRAQGKETIRERFYGAASSSPVSVFPQLLKLKNHHLAKLKGGAGVYFETILGEIFSGIVEIPAHLPLDAQARFAVGYYHQRQDLFTKKEDKE

SEQ ID NO: 3076 - protein, 652 aa, Dehalococcoides mccartyi DCMB5
MSWMYDLYQTYQNCISIVGKENGKIPLNPVGHVTVKQAHIEVRLDGNGNFKGAEVITNPNKARTIIPATEKSAGRTSGPEAHPLCDKLQYSARDYKESCGEKPPHFDKYIEQLADWATSEYAHSKVKAVYQYQKNANLISDLIRHKILIPDKYGKMLEKWEGDKKDEPLIFRATKQQAESFVRWRVEIEGDPCPELHLDKAVWENWQQYLQSKEPVKGFCCVSGKETSLATHHPRKIRSDGDGAKLISSNDTANFTFRGRFTQAEQACSIGFDVTQKAHSALRWLIGLQGKNYDNLSVVAWAISGNNIPNPTQNTYELFPQTEQEAQASTPYTAQEVSSSLIKLIGGYKAKLAPTENIAMLMLDSATSGRISIKFYQRLTSADFLEKLYAWHNPDIGCSWHQYFSKTQKFLGAPSAANIASIVYPGSNKGDNNMRANAISCILPSIIQGRPLPRDIIQSCIRQTIRLGGIKSKQKDTKDIKTPNNWFLFEKALGIACALYRYQNKNRRYQVSLERDRTSRDYLYGRLLAVAEALEQSTLDNNSENRSTNAERLFQKFAERPFYTWSILEPLLNPYKMRLRNKNPNYLIFYQKKLDEIACKFLPEDFTSDKKLSGEFLLGYHCQRADIYREKVLKEEAPEEDSLEDHTETHKN

SEQ ID NO: 3077 - protein, 660 aa, Bibersteinia trehalosi USDA-ARS-USMARC-192
MQKLYRTYEAALQKASNLSEEPLTPIGHTQQNAHIVIVLNGDGEFRTAQVMPPKTAIMLPATESSENRTSGEAPHPLADKIQYVARDYSAYGGEKKAYFQGYLNQLQAWCDSAASHPKVSAVLHYVKKGKVVEDLITAGVFQLGADGKVLSKWVEKGDAPAIFSTLPKTKGEIEFGSALVCWRVEIKGDPQSDTWTDVTVQQSWIDYLALADSQTGFCFIQGKESPVSNMHPAKLRHTGDKAKLISSNDTAGYTFRGRFETAEEAASISTEVSAKAHSALRWLISRQGIRNGEQVTVAWAISGEKVPSPLQDPFDECYDYDLEEISAVENNVESEMPSETRGKIDHSVDLGKNAAEMIKKKYQGYKAKLKAHEQISLLMLDSATPGRMALTYYQEFLPADYFANLDAWIDDFSWYQRHSIETKNGKKNDKRLVWAIVPPSPFAIGNAVYSKSLSDSLKKQLYARLLPVIAGGKSVPIPYDLVQQSFQVACNPHGCENWEWQRNIGVACALYKGWRARHHNESERRTYDMSLDKENRSRDYLYGRLLAVAENIEAYALYLAGEKRSTNAERYMPKFANRPFYTWRNIEIALKPYQERLRNHNKDTGSQALAEITDLFVTEDYTNDSPLSAEFLLGYHCQKMEIARQLAELTAKKSKTTETE

SEQ ID NO: 3078 - protein, 648 aa, Bifidobacterium thermophilum RBL67
MTLVSSLLKTYDCVQNAAGITVAQASQGGEPTDKDRDAAVRSTLMPMNHTTLKVQIHVTLDSEGNVVSIEKEGKAHTIIIPCTEKSMSRTVAPCAHPLCDQLQYVDKQIDGMRTEKYLTQLAEWKGDNTELNLLYGYLSSHSISEDALGFGIELKPKTRDANGKESKGDAADGVWFTVISPDGELVDLDRDPAIRARWQEYLAAGRSAKGHDMFGEKLYGQAKTFPKKLLPAAGNAKLISSNDSTNYVYRGRFTSPDQALVVDTDASQKIHTTLTWLLANNATIVGKQAILVWAVDGRPSFRVVDPMADTLDAFPAENDEDVVTDARMAAGTPYAAQFQALLHGYGDPSFLERQKRTIVVAVFDSAVPGRLGVTYYQELPEGEYLDRIVRWHRGVAWPLTTFVAIPGSDKRKPVDYVGAPSFIDIVNASTDSPDRSSDGYKLHRKLVERQLIETIFNGTAVPRNILMAMCHKVEKPMAYDDLRKWHRDLEICCSLLKKSTNDEPKRFHRTGKEIGMELDKDRTDRDYLFGRLLALADNFEGYVLRKQNGGKADRATNAVNLMGNFASKPATTWEEIWRRLTPYIQSQNGAPWFQQNVDDVMALFQPGDYEKKTPLGPLYLLGYSHQRRELLTNARKAKETAMSQETAN

SEQ ID NO: 3079 - protein, 569 aa, Mannheimia haemolytica USDA-ARS-USMARC-183
MPSYGFSEEKIGWVLELDSKGNLVNVISNLTEDKKPKPKLMSVPRPEKRTSGIKPNFLWDKTAYVLGIESNPDKATAKDQPINFAEKTFEAFKQYHLDLLADSNDEGLMAIRNFLQQWQPTHFAESICPREILDANVVFKLVGTSGYIHQREAAQTLWTSLLINQSDNAEKGLCLISGKLSPIQRTHPPIKGVFGGQSSGGSIISFNKESFTSFGKEQGSNAPVSEQAAFAYTTALNYLLRTEKHRLTIGDASTVFWAEADNTTQAEAAEGFFAALMTPPDDEQENQKIFEELQKISKGRPLAEISPELSENTRFYVLGLAPNAARISVRFWLDTTFGQLAKNLSEHWQDLALEPCPWKTPPSIWRLLLQTASLGKSENISPVLAGEMARAVISGHLYPMSLLSQLVTRIRADGDINGLRVALMKAVLQRKFRKGFIKEGVPMSLNKESDNQAYLLGRLFAVLERIQSQALGELNAGIADRYYGSASAVPFSVFPRLLSGAKHHLSRLRKDKGGMAVNLDKDLGEIIASLPENFPRHLSIDEQGRFAIGYYHQKQSYFAKKETTESIEN

SEQ ID NO: 3080 - protein, 594 aa, Mannheimia haemolytica USDA-ARS-USMARC-185
MILSALTRYYYRLAAQEDRLTGEAKVPSYGFSEEKIGWVLELDSKGNLVNVISNLTEDKKPKPKLMSVPRPEKRTSGIKPNFLWDKTAYVLGIESNPDKATAKDQPINFAEKTFEAFKQYHLDLLADSNDEGLMAIRNFLQQWQPTHFAESICPREILDANVVFKLVGTSGYIHQREAAQTLWTSLLINQSDNAEKGLCLISGKLSPIQRTHPPIKGVFGGQSSGGSIISFNKESFTSFGKEQGSNAPVSEQAAFAYTTALNYLLRTEKHRLTIGDASTVFWAEADNTTQAEAAEGFFAALMTPPDDEQENQKIFEELQKISKGRPLAEISPELSENTRFYVLGLAPNAARISVRFWLDTTFGQLAKNLSEHWQDLALEPCPWKTPPSIWRLLLQTASLGKSENISPVLAGEMARAVISGHLYPMSLLSQLVTRIRADGDINGLRVALMKAVLQRKFRKGFIKEGVPMSLNKESDNQAYLLGRLFAVLERIQSQALGELNAGIADRYYGSASAVPFSVFPRLLSGAKHHLSRLRKDKGGMAVNLDKDLGEIIASLPENFPRHLSIDEQGRFAIGYYHQKQSYFAKKETTESIEN

SEQ ID NO: 3081 - protein, 618 aa, Meiothermus ruber DSM 1279; identical to SEQ ID NO: 3017

SEQ ID NO: 3082 - protein, 598 aa, Azotobacter vinelandii CA; identical to SEQ ID NO: 3008

SEQ ID NO: 3083 - protein, 598 aa, Azotobacter vinelandii CA6; identical to SEQ ID NO: 3008

SEQ ID NO: 3084 - protein, 602 aa, Desulfallas gibsoniae DSM 7213
MIINALYRHYETLLNDPDSGVSRPGFNKVKVGYCLVLSRQGRLLDILDLRVERDKKLVSRDMTVPEQGKRAVNIFANFLCDNCTYVLGLGQKGKTVKLDRIKKCFQEFVQKHDQILGNVADEGATALLEFLHSWDITGALEHPVISRHIDELSEGLNLVFKLEGATGYLHENKAMVDAWEMYRSGQASNINMQCLVTGKDTGIARLHPNIKGVTGAQTSGASLVSFNLDAFTSYGKKQSFNAPVGEEATFGYTTALNYLLSNAKHRVRIGDTTTVFWAECSTGGLEEDLLGALFFPVGEESDAKKEKENKNSFQVVRDPQTVKLMHDIFQRVRAGKPVGQGLVGVNWDTNFYILGLAPNASRLAVRFWHMDPYVKFIEKIGQHYADMAIVKRYDNDPDFISISMLLKETAPLRDTKRIAPLLGGLLMRSILTGMPYSTALYNAIISRIRADQEVNYVRAAAIKAFLARNRRYYNKGNEVDLTVALNESNNNTGYLLGRLFALLEKAQEDANPGINSTIRDRYFGSASASPSSVFPILLRLAQHHISKAEYGRYTDKRIEEVISAIDCFPAYLNIEDQGQFVLGYYQQRQALFIKSEKKESVN

SEQ ID NO: 3085 - protein, 569 aa, Mannheimia haemolytica D153; identical to SEQ ID NO: 3079

SEQ ID NO: 3086 - protein, 594 aa, Mannheimia haemolytica D171
MILSALTRYYYRLAAQEDRLTGEAKVPSYGFSEEKIGWVLELDSKGNLVNVISNLTEDKKPKPKLMSVPRPEKRTSGIKPNFLWDKTAYVLGIESNPDKATAKDQPINFAEKTFEAFKQYHLDLLADSNDEGLMAIRNFLQQWQPTHFAESICPREILDANVVFKLVGTSGYIHQREAAQTLWTSLLINQSDNAEKGLCLISGKLSPIQRTHPPIKGVFGGQSSGGSIISFNKESFTSFGKEQGSNAPVSEQAAFAYTTALNYLLRTEKHRLTIGDASTVFWAEADNTTQAEAAEGFFAALMTPPDDEQENQKIFEELQKISKGRPLAEISPELSENTRFYVLGLAPNAARISVRFWLDTTFGQLAKNLSEHWQDLALEPCAWKTPPSIWRLLLQTASLGKSENISPVLAGEMARAVISGHLYPMSLLSQLVTRIRADGDINGLRVALMKAVLQRKFRKGFIKEGVPMSLNKESDNQAYLLGRLFAVLERIQTQALGELNAGIADRYYGSASAVPFSVFPRLLSGAKHHLSRLRKDKGGMAVNLDKDLGEIIASLPENFPRHLSIDEQGRFAIGYYHQKQSYFAKKETTESIEN

SEQ ID NO: 3087 - protein, 569 aa, Mannheimia haemolytica D174; identical to SEQ ID NO: 3079

SEQ ID NO: 3088 - protein, 569 aa, Mannheimia haemolytica USMARC_2286; identical to SEQ ID NO: 3079

SEQ ID NO: 3089 - protein, 627 aa, Streptococcus equi subsp. zooepidemicus
MDFFASLLRAYEHAEDIGLVDNQEQSGTILLPIYHTNRRSNGKDTIVVQLDKTGQFMKAEYLADGETIIFPVTAESVARSGKNPAPHPLVDKLTYFVSAHNQEQYETYHQQLEGWISACQDKQVMSYLSLIQQFILKEDFLDLICQSLFRKQLSRNGLKVTYALSEEKEKTVDLSACFLTFQIAQFIGFKTVSVTNFTALHKDYIAYLMSKQTANMICNISGQKEVLATKHRGLLGNAKLISVSNHAEAYKGRFRERDDVFRVGNQTSEKLHLMAKYFLEHEQTHVWLGSGQHMINWFSDDLANDSQLNITQALLLDPFDDEETFLSTPMISEENKSINRSFITGQRQFSDSASYYIAILNKTNDGRIALKYFRQLQASSLLKNLAVWQENYSWELQRKGNQFVQKLPSFKEIILAAYGVDRDRSLELDNDNFRSDQYQRLVTSLIDGKPLPDTIVKKLEANIKQRQKYRKHWHQVEHISLAILHKQNGEEFTPMLDRDNTNRSYLFGRLLGIYELIEKSRNNSKGRAKDELKRITNAERYWTAYANRPASLMRNLEDKIYPYSEYLKINEAGLWSKLEKEREEIIALLTSSLETTDFNKPLDYRFIFGYYAEKKYFYTPKDESEDA

SEQ ID NO: 3090 - protein, 582 aa, Hyphomicrobium nitrativorans NL23
MTALASLARAYERMAARGETPAPGYSPQRIGFLVSLTSDGQPSGPPHDLREADGRRRTAALMAVPQPGKRTSGVMPNFLWDKTAYALGVTAGEAKRTAQEHRAFADKHREWLEGTTDEGLLALLGFLDFWTPEKFGELGWPEDMKDQNVAFALERERLDNIRIHDRPAAKALWARLSGDGEKTDALCLATGERGPLARLHPAIKGVWGAQTAGASIVSFNLNAFTSYGKEQGENAPLSEAAAIAYTEALNAFLRGTQNRIQIGDATTVFWADASDTNAARKAEGLFGAFSKVTDQGEAKKVAAILERIQRGLPVDDFDPVREGVRFHVLGLAPNAARLSVRFYVEDDFGEIARRYADHHERMRIEPEPKDGWPPMWRLLIETAALRKTENIQPNLAGDWMRAILTGSPYPLTLLSSIVMRLRADHDVNALRVAILKSVLIRNFKVKETPVSLDPEFKDAGYLLGRLFAVYEQVQVAALGTGVNATVKDKFFGAASAQPRKVFHILASGASNHLSKVAKQSKGRQVNLEKAISAIMELMKPGDDPFPASLPDKSQALFALGYYHQRNEFFRKAEKTTSGEDAQ

SEQ ID NO: 3091 - protein, 617 aa, Marichromatium purpuratum 984
MILQALHRHYQHLLERDTEGVAALGYSQEKVSYAIVLDPTGAVVAVDDIRDTSAKKPRPRLLEVPQPPIRKVNIASCFLWDKTSYVLGVSASSKRTEQERAAFVALHESALAGTEDPGLLALLRFLQWWTPERFVPPMFTDEVLDTNLVFRLDGERRYLHQREAARRARADLLADAGGDGEHVTCLVTGVSQPMARLHPPIKGVRGAQSSGAGIVSFNLDAFTSYGKKQGGNAPVSQAAAFGYTTALNHLLRPGEHNHQRLLIGDTTVVFWAETAAGAPAPEAELLFDLLLDPPSGDAPPDEAQETQRVREVLEDVRRGRPLVGRDPGLAPDTRMFVLGLAPNASRLSVRFWQVDTLDALTRRLAQHAEDLRLEPVPWRTAPGVRRLVLATVLHRDGAMPKMDDAFDNLVGELLRAILGGGRYPRSLLANTIMRIRTDGHLSGLRVAICKAVLTREQRLGSPPRPAAARGSIHTSEEEIPVSLDTRSTQPGYLLGRLFALLEHIQRGALGTQVNATIRDRYYGAASATPASIFPVLLRNTQNHLAKLRKERTGLAVTLEQQLGAIVDGLPERFPRSLRIEDQGRFAIGYYHQTQAFYTKRAATDTAADETDSEGTDA

SEQ ID NO: 3092 - protein, 592 aa, Mannheimia varigena USDA-ARS-USMARC-1296
MILSALTRYYYRLAAQEDRSTGEAKVPSYGFSEEKIGWVLELDSKGNLVNVISNLTEYKKPKPKLMSVPRPEKRTSGIKPNFLWDKTAYVLGIESNPDKATAKDQPINFAEKTFEAFKQYHLDLLADSNDEGLVAIKNFLQQWQPTHFAESICPSEILDANVVFKLVGTSGYIHQREAAQSLWGRLLVSEESEQGLCLISGEIAPIARLHPAIKGVYGGQSAGGSIISFNKESFTSFGKEQGSNAPVSEQAAFAYTTALNYLLRTEKHRLTIGDASTVFWAEADNTTQAEAAEGFFAALMTPPDDDQENQKIFDELQKISKGRPLAEISPELSENTRFYVLGLAPNAARISVRFWLDTTFGQLAKNLSEHWQDLAIEPCAWKNPPSIWRLLLQTASLGKSENISPVLAGEMARAVISGHLYPMSLLSQLVTRIRADGDINGLRVALMKAVLQRKFRKGFIKEGVPMSLNKESDNHAYLLGRLFAVLERIQTQALGELNAGIADRYYGSASAVPFSVFPRLLSGAKHHLSRLRKDKGGMAVNLDKDLGEIIARLPENFPRHLSIDEQGRFAIGYYHQKQSYFAKKETTESIEN

SEQ ID NO: 3093 - protein, 592 aa, Mannheimia varigena USDA-ARS-USMARC-1312
MILSALTRYYYRLAEQEDHSTGEAKVPPYGFSEEKIGWVLELDSKGNLVNVIPNLTSDKKPKPKLMSVPRPEKRTSGIKPNFLWDKTAYMLGVESNQDKAFAKDQPIKFAEKTFEAFKQYHLDLLADSNDEGLIAIKNFLQQWQPAHFAESICPVEMLDANIVFKLVGTSGYIHQREAAQSLWGRLLVSEDSDQGLCLISGEVAPIARLHPAIKGVYGGQSAGGSIISFNKESFTSFGKEQGSNAPVSEQVAFAYTTALNYLLRTENHRLTIGDASTVFWAEADNTTQAEAAEGFFAALMTPPDDDQENQKIFDELQKISKGRPLAEISPELSENTRFYVLGLAPNAARISVRFWLDTTFGQLAKNLSEHWQDLAIEPCAWKNPPSIWRLLLQTASLGKSENISPILAGEMARAVISGHLYPMSLLSQLVTRIRADGDINGLRVALMKAVLQRKFRKGFIKEGVPMSLNKESDNHAYLLGRLFAVLERIQTQALGELNAGIADRYYGSASAVPFSVFPRLLSGAKHHLSRLRKDKGGMAVNLDKDLGEIIASLPENFPRHLSIDEQGRFAIGYYHQKQSYFAKKETTESIEN

SEQ ID NO: 3094 - protein, 682 aa, Mannheimia varigena USDA-ARS-USMARC-1388
MQKLYRTYNEVEKNPELLDSDKLMFAPLWHSPQTAHINITLDGEGNFIRAKVLSDKPILMLPVTESSEGRTSGLAPHALADSLQYIAKDLGLIFSEEIVKEVEADNGKKKKIKEKVELPIFKLYSEQLDSWCAYTKNPKIHAIKKYVHKGTVLSDLIKAKVIPTDENGQLLNNWSEKENNGRLKPELFNVLTKEQGKFEIRKALVVWSVEIPNDLIPETWKDTEVQRDWGEYYQSTLKSQFCSILGKESEIRESHPAKLTYSGDKAKLISANDKEGYTFRGRFENANQASSISAEVSHKVHAALRWLIDRQGIRNGEQVTVAWAISGKEVPSPLQDPFQNFDFDNADTSAVENNAEFHTSADSETKPDWSANIGKEAANIIKKRYHGYKAKLDHHEQISLLMLDSATPGRMALTYYQEFLPKDYFANLDAWLDDFTWFQRHTFEVKGGKKNEKRTLWLELPPSPFAIAQAVYGKSLNDTLKKQLYARLLPVIAGGKSVPIPYDLVQKSFQVACNPHCCDTWEWQRNIGVACGLYRGWRARHHKESERRTYDMSLDIKNRSRDYLYGRLLAVAENIESYALYLAGEKRSTNAERYMQQFADRPYYTWRNLELALRPYQERLKNNGKDTGRQAISEIMELFATEDYLNDEKLSGEFLLGYHCQKMEIARQVAELKAKSAKQTEE

SEQ ID NO: 3095 - protein, 665 aa, Bibersteinia trehalosi USDA-ARS-USMARC-188
MQKLYRTYEAALQKASNLSEEPLTPIGHTQQNAHIVIVLNGDGEFRTAQVMPPKTAIMLPATESSENRTSGEAPHPLADKIQYVARDYSAYGGEKKAYFEGYLNQLQAWCDSAVSHPKVSAVLHYVKKGKVVEDLITAGVFQLGADGKVLSKWVEKGDAPAIFSTLPKTKGEIEFGSALVCWRVEIKGDPQSDTWTDVTVQQSWIDYLALADSQTGFCFIQGKESPVSNMHPAKLRHTGDKAKLISSNDTAGYTFRGRFETAEEAASISTEVSAKAHGALRWLISRQGIRNGEQVTAAWAISGEKVPSPLQDPFDECYDYEFEEISVVESDVESEVPSEIEGKIDHSVDLGKNAAEMLKKKYQGYKAKLKAHEQISLLMLDSATPGRMALTYYQEFLPADYFANLDAWIDDFSWYQRHSIETKNGKKNEKRPIWAVVPPSPFAIGNAVYGKSLSDSLKKQLYARLLPVIAGGKNIPIPYDLVQQSFQVACNPHGCENWEWQRNIDVACALYKGWRARHHNESERRTYDMSLDKENRSRDYLYGRLLAQAERLEWYALYLQNGKKTPSRATNAERYFQRFAQLPYSTWLNFERERLVPYKNYLTSLGKDFYKQAIGEIIELFQNNDFTCDDKLSGEFLLGYYCQKMEIDRQIAARKAAKQKTTETD

SEQ ID NO: 3096 - protein, 660 aa, Bibersteinia trehalosi USDA-ARS-USMARC-189; identical to SEQ ID NO: 3077

SEQ ID NO: 3097 - protein, 592 aa, Bibersteinia trehalosi USDA-ARS-USMARC-190
MILSALTRYYYRLAAQEDRSTGEAKVPSYGFSEEKIGWVLELDSKGNLVNVISNLTEDKKPKPKLMSVPRPEKRTSGIKPNFLWDKTAYVLGVESNQDKATSKDQPITFSEKTFEAFKQHHLDLLADSNDEGLMAIRNFLQQWQPTHFAESICPTEILDANVVFKLVGTSGYIHQREAAQTLWGRLLVSEESEQGLCLISGEIAPIARLHPAIKGVYGGQSAGGSIISFNKESFTSFGKEQGSNAPVSEQAAFAYTTALNYLLRTEKHRLTIGDASTVFWAEADNTTQAEAAEGFFAALMTPPDDEQENQKIFEELQKISKGRPLAEISPELSENTRFYVLGLAPNAARISVRFWLDTTFGQLAKNLSEHWQDLALEPCAWKTPPSIWRLLLQTASLGKSENISPVLAGEMARAVISGHLYPMSLLSQLVTRIRADGDINGLRVALMKAVLQRKFRKGFIKEGVPMSLNKESDNQAYLLGRLFAVLERIQTQALGELNAGIADRYYGSASAVPFSVFPRLLSGAKHHLSRLRKDKGGMAVNLDKDLGEIIASLPENFPRHLNIDEQGRFAIGYYHQKQSYFAKKETTESIEN

SEQ ID NO: 3098 - protein, 665 aa, Bibersteinia trehalosi USDA-ARS-USMARC-190
MQKLYRTYEAALQKASNLSEEPLTPIGHTQQNAHIVIVLNGDGEFRTAQVMPPKTAIMLPATESSENRTSGEAPHPLADKIQYVARDYSAYGGEKKAYFEGYLNQLQAWCDSAASHPKVSAVLHYVKKGKVVEDLITAGVFQLGADGKVLSKWVEKGDAPAIFSTLPKTKGEIEFGSALVCWRVEIKGDPQSDTWTDVTVQQSWIDYLALADSQTGFCFIQGKESPVSNMHPAKLRHTGDKAKLISSNDTAGYTFRGRFETAEEAASISTEVSAKAHGALRWLISRQDIRNGEQVTVAWAISGEKVPSPLQDPFDECYDYDLEEISAVENNVESEMPSETRGKIDHSVDLGKNAAEMLKKKYQGYKAKLKAHEQISLLMLDSATPGRMALTYYQEFLPTDYFANLDAWIDDFSWYQRHSIETKNGKKNEKRPIWAVVPPSPFAIGNAVYGKSLSDSLKKQLYARLLPVIAGGKNVPIPYDLVQQSFQVACNPHGCENWEWQRNIGVACALYKGWRARHHNKSERRTYDMSLDKENRSRDYLYGRLLAQAERLEWYALYLQNGKKTPSRATNAERYFQRFAQLPYSTWLNFERERLVPYKNYLTSLGKDFYKQAIGEIIELFQNNDFTCDDKLSGEFLLGYYCQKMEIDRQIAARKAAKQKTTETD

SEQ ID NO: 3099 - protein, 588 aa, Bifidobacterium breve JCM 7019
MIIGDLCDAYAVLVSQNKAPAHGYDNTNVPYGLVVDDDGTLIRVRPLGDFSGKKPVNIIPVPARFPRSSGIVANFLCDNVTYLLGCDTKGNAKRAAQAFQACGELHRRILDGVKDRAASAVCAFFSKAPQWQTAQRLMGYEAWKSSVTMNFALEYDDGGRTIFIGELPSIREAWDAYYGRVDDADESALVSSLVSGERIAPEKVHPKIKGVAGAQSSGASLISFNAPAFCSHGAEQNENAPMSKREAYEYTTALNTLLADRDRVQRIGGDTVVSWANCGDNAYRDVWDQYMGQSGGLSEKVVVDATRALAQGKPYDYEGIHLSPDEQFHILALSPNAARLSVRFYLTDTFGAFARNIDRHYRDTAIRRPVYDSTTSLPTWRLLNQTIRTQSKTAKVSPQMAGAVMKAILEDTPYPMTLINAVERRINAEHDISPDKAAIIKAYYLRATTNAQFKEVLQMDINEESDYLPYVLGRMFSIYEQIQSAAIPGINTTIKDKYFTSASTTPARIFPILGDLAAKHMRKTWKSEGLKVKLDKALGELTGRVGDRYPSRLSLEERGAFQLGYYFENQKRFDKANKNNNEQEENND

SEQ ID NO: 3100 - protein, 665 aa, Candidatus Endomicrobium trichonymphae
MSWFQRLYETYGNCVAAQGKFEIAPVAHTNKVCNIEIKLNEKAEFIEAEFIEAITPIPTTDDNNCLWPLAVDIKTYQKEKDKQGKELKVTYKKLLKEWSDTADIKIQIVNKYIQKNTLIQDLVEKKRILWLSEDGKFIEKPKNKKDITDKYKIFQYVKKQEDVFIRWIVDTDKCRKTWEDKAIIESWINFRKQKENKKYKSEIEKTYRKIDKENNIVSRLTDDKICYISGEITDCITTNHPFANGTSKLIAVGDDLVFKGIFEEYYEALSVSFDVSQKAHNTLKWLISKERKQAYRNYPQIIVAFTINGKSGNVGLIFGEDFVKSAKGYRIDFEKFEEDEKIVKTSLQSRKHKIDFEKFEEDEKIVLLEMNAASPGRACITYYKELLGSQYLKNIKNWHKKYCWQFLKRKNKNSQKKEYQYFCGTPSINTIANSYFYKKDKYSAEKSEQNIKRKLIRDLMPSVLENKNIPEYIEKHFIEKASNPVVLNNIQWKTILSIACSIYKGNHLYYDENKKEEDCLMSVDENCKDRNYLYGRLLAVIDDAEKSALLKQNKENSNAKEAIRSTNAQRLMRQFSIKPFETWKFLYEKFNDAYKKRLSGDWIDKRIADIKDKFTSIEEFENNLKLTGLYLLGYFHQLKTIENERGAAIQNKNKKEKEFSNDTAK

SEQ ID NO: 3101 - protein, 587 aa, Streptomyces rochei
MLLQRLNEYADRLGDILPAEYYRPKQIHWVLDLKEDGTGKLTDLRVSAKNRDQARIVPVPYVQRSGTKVPPYMLVDTAEFVLGVPKADKKNPPTKEAQEEATRRHAAYRELALLWARGMKDSVGAAALKSYFANGGPAGVKIPEDVQAKDAVAVMVGTRWLHDEPTVKTTWASIARARKSGSDDRTGLCLVCGTSGSLLATIPEPVKKGAVPTSGGSNEGQLVSINKAAQGRDGKIQLVNTPICQRCGGRTMAVLNHLLASDTNSRRFRDDGVMVWWTRQAGDDSAMALLFGNVPDPADVAHLIDSINNRPTPHAGERVDDDEFHALTLGLNNARLVVRDWIDIPLTGLKATVAAWYQDHGVYDGWTGTTRYVPLWLLALCCGRAQDGRYAKDSAPHGLEAELVHSALHRTPPPARTLPLLLQRIHADQQIDTARIALLRLILNRSSNPKDHVMPTLDDTCREPSYLCGRLFFVLEDIQSTALPNLNTTLRDKYFRTAATAPGTTLTNLHVDATAHLKRLRRDNKKAAASLERRLGELFAMVSDDIPRHLTPVQQGRFVIGYEHERAAKWDRIRRAKEKGQATGEEQ

SEQ ID NO: 3102 - protein, 611 aa, Candidatus Arthromitus sp. SFB-mouse-Japan
MILKELVDCYDLMVNSDKFEVSDSNFSNEKVSFKITIDEDGLITKIIDLREGSGAKKKTILVNVPYQSGRTSGIKPYFLCDNAKYFFGYEIDSKSLELKRCDQHIEASKNLHMEILENSYSKYKLILERFFDNHDKNLEIIKEKDPEVLKGGSIILRLKDDMKCIHEQGEVKKAFALYRQNKFENVEEVRGTCLINGDSNAPIAKIHKTIKGVSGSSISGAMIVSFNASSFESYGKSQGYNASISTENEFKYTTALNKLLSTDDNNMYLSGNTIVFWSSKLGAEEEQIIPAFMKDDDEVEDDNGETGGAKYNQEGIDKIESIIKLIKQGKTVNVDRINLDDSVNMYVLGLYGSRSRIFVRFWFKNSLEDFIKLTNKHFEDTKLKKKRKFSKKDFIYEEVGVKLSSILKTITPYGKSQNTPKTLINSLFKSILTGGVYPISIYNKILERIRAESGEDFAINHTRISFIKGYLKRYYRLNNLKDKEEEVTVSLNKESTNIAYNLGRIFAILEKIQMDSSNGATNIREKYLSSASSTPKSIFPNLLNLAQYHIAKINKENNTKFNYYDKVIGEILLNVNEFPAVFSSDEQGMFILGYYHQREDIYIAKKDKEEN

SEQ ID NO: 3103 - protein, 601 aa, Sphingobium sp. SYK-6
MTILQALVRYYDRLPGVAAQGWSSEKFGWCIVLNADGDAVEVETLHDLSGKKPRPTLRVVPAAVKRTVAIAPNFLWDKSAYVLGRTAGEGRRTVDEHAAFVALHLERLAGQGDVGLVALRRFLENWRPERFDELPRGTPDILDANILFRLEGERGYLHERPAARALVEAGAVAGDGVGSLCLVTGEIGPIARLHPTIKGVEGAQSSGAALVSFNLDAFTSLGKEQGANAPTSEAAAFRYGEALNKLLRRDSRNRLPRPIGDTTVVFWADSSDVKAAEAADMLAGDWLLGGADEVSDAQEAAKVREQLEKIAAGRPIQEIADGIEPGTRFHILGLSPNAARLSVRFWLCQSFSDFARALAQHYQDMRVEPLPFSWGAAPSVGRLLVNSTAAQRDYKNIPHALAGEVLRAVLYGGRYPQTLLATALIRLRAGDDAGSGWHAAVIRGVLVREGRAKPLVPESGELPMSLQRDYQDAGYQLGRLFAVYELAQRSALGRVNASIRDKYFGAASAAPASVFPIIVRGGQNHLAKVRKEKPGWAALIERELEEIHGHLAPALPRSLTLQKQGEFAVGYYHQRAAKLSDGKEVIDPATLNDTTNSEGEA

SEQ ID NO: 3104 - protein, 611 aa, Candidatus Arthromitus sp. SFB-mouse-Yit
MILKELVDCYDLMVNSDKFEVSDSNFSNEKVSFKITIDEDGLITKIIDLREGSGAKKKTILVNVPYQSGRTSGIKPYFLCDNAKYFFGYEIDSKSLELKRCDQHIEASKNLHMEILENSYSKYKLILERFFDNHDKNLEIIKEKDPEVLKGGSIILRLKDDMKCIHEQGEVKKAFALYRQNKFENVEEVRGTCLINGDSNAPIAKIHKTIKGVSGSSISGAMIVSFNASSFESYGKSQGYNASISTENEFKYTTALNKLLSTDDNNMYLSGNTIVFWSSKLGAEEEQIIPAFMKDDDEVEDDNGETGGAKYNQEGIDKIESIIKLIKQGKTVNVDRINLDDSVNMYVLGLYGSRSRIFVRFWFKNSLGDFIKLTNKHFEDTKLKKKRKFSKKDFIYEEVGVKLSSILKTITPYGKSQNTPKTLINSLFKSILTGGVYPISIYNKILERIRAESGEDFAINHTRISFIKGYLKRYYRLNNLKDKEEEVTVSLNKESTNIAYNLGRIFAILEKIQMDSSNGATNIREKYLSSASSTPKSIFPNLLNLAQYHIAKIKKEDGKNFNYYDKVIGEILLNVNEFPAVFSSDEQGMFILGYYHQREDIYTSKKDKEEN

SEQ ID NO: 3105 - protein, 612 aa, Candidatus Arthromitus sp. SFB-rat-Yit
MILKELVDCYDLMANSDKFQIADNNSNNENVSFKVTIDQDGIVSSVIDLREGSGSKRKPVLMTVPYKFSGRTGKSIVPYFLYDNAKYLFGCELDSKSLELNRFDEYVGASKKLHMEILEGSQSKYQLILEKFFDNRDQNIEIVKEKDTEALKSGFIVLCFKNDTKCIHEQQEIKKAFALYRQIKFKDVKDLKGDCLISGFTNVPIARTHTPIKGVLGSSASGAMIVSFNESAFESYGKKQSYNASVSNGNEFKYTTVLNKILSGNENKIYLSGNSIVFWSNKIGCKEEKIIHAFLRDDEDDNDEEGNGGIKYNQEGVDKIESVIKLIKQGKTVNIDKLKLDDSVNMYILGLYGTKSRIFIRFWFKNSLIDFVKLTNKHFEDTKLKRIRKINKKDLIHEEVGVKMSLILKTITPYGKSQNTPKALINTLFKSILTGVVYPISIYNKILERIKAEAGEDYAVNHTRVSFIKGYLKRYYRLNNFKDKEEEITVSLNKESKNVAYNLGRIFAILEKIQMDSNNGSTNIREKYLSSASSTPKSIFPNLLNLAQYHIAKINKENNRMFNYYDKIIGEILLNINEFPAVFSSDEQGMFILGYYHQREDIYTPKKDKEEN

SEQ ID NO: 3106 - protein, 631 aa, Streptococcus mutans LJ23
MDFFTSLLKAYEKAEEIGLVDQQKGDNPVLLPLYHTSLKSNGKNIIIVKLDQDGSFYKAEFMADNQTIIFPVTGDSVARSGSNPAPHPLVDKFSYYVSEANQSQYDNFHEQLANWIAYCEEGEVKDFLIKIQQFILQPDFLNDILHSLFGEDYRREGWKITYLDSTGKDKTLDLSAYFLEFSIVQFHGFKDESVTSYKALHQSFISFMTANQDNLRTCNISGRMEQITNKHRGLMGNAKIISVSNKGEAYKGRFREREDVFSVGYETSEKIHLMIKYLMENNNSSTWLGSSQYLINWFSDDLVNESQLDIVKPIFNDLFEDDEEESLVPIKPNEESRQIGSSFIKGQKLFGNDATYYIAILNKTSNGRIALKYFRQLQVSQLLKNLESWQENYSWEAKTKAGDYKIKIPIFNEIINVAYGVDRERYLELDNDAFRSDQYQQLVTALIDGNPMPSTIVKKLEANIKQRQKYPKHWSQVQQVSLAILHKQYGREFKPMLDHENTNRSYLFGRLLAIFELMESKKYEIENPNKDKKESNRITNAERYWNAYTSQPAKLMMNLTNKIKPYEEAVRLNAYGIFHKLDKERAEIVQLLSPLMAKKDINDPLDYQFIFGYYAEKQFFYTKQEKNESEE

SEQ ID NO: 3107 - protein, 629 aa, Taylorella equigenitalis
MSWINSLIDAYERLEVDKKSQEIIKLTPVFHNKQNAHLIVTVDIEGNFESVETITKDQKKPAIIPVTPKSDNRSGTLPPPHPLADKLEYVAGDLKEYFSIEEIKKKKLEYKNSTYLELLDKWCKTEQNELLHSIQKYVNKKSLIKDLIKHKILDESLNITCENLPHKLKAEDLFVIWVVSGYSKSSTGDSSKYLLNTWRNEKLFSSWIKFCYENLGLEQKFCFHYGEKRHFAPKHSSKIYGADDGHKIISSNDERGFTFRGRAIKSDDVATLSVEASYKLHGMLRWLHEKGQRITLGDIEIYIWANANKKLLESTEKSDNLIDLFDSNNDKKEPDWSKNFGFEASEKIREKLKGFRNELSETDKISIIIFKLSSKARRSIIYYREILKNDLLGNIEKWNADFAYPVFYKYKIINISPSPRDIVDILFYKENENLKASIYSELLPIQINNLNFPWNLVYKSYLIACNPLKYDIIKRRENISLACSIYKGYLIRNLDKEVEMSLNKNNKSRDYLYGRLLAVAQAVEDSVIKVIEPGSKRETSAERYFQRFSTRPYTTWKVIYDSLKIYQKRYKFGNPEILIGEVMELFDEENFKNDKPLSPEFLLGYHCQLNEIYRKKVLDASKENNSTTE

SEQ ID NO: 3108 - protein, 631 aa, Streptococcus pyogenes M1 476
MDFFTSLLKTYEKAELADLVDHQKRNNEPVLLPIYHTSLKSNGKNIISVKLDKDGQFHKAEFMADKQMIIFPVTADSVARSGSHPAPHPLVDKFAYYSAEMGQIQYDSFHKQLNNWIDYCEEGDVKKFLTFVQQFILKPEFLTLILDSLIGPDYQHNQLKVTFCDATGKEKLIDLSACFLEFSIDQFQGFKNESVSTFKALHQSYISFVEANRENLGICNISGREEQLTDKHRGLMGNAKIISVSNKREAYKGRFREREDVFSVGYETSEKIHLMLKYLLENKNTSTWLGSSQYLINWFSDDLTNDSRLDIVSPIFDDGLEEEDDDDTPPVITLATEDNKRIGKSFIKGQKLFANDATYYVAILNKTSNGRIALKYFRQLQASQLLTNLNKWQETYSWESRSKFGKSRLRTPTFHDILNVSYGVDRDRFLELDNDNFKSDQIQKLVASLIDGKPMPQSIVKKLGNNVKERHRYRKHWYQVEQVCLAILHKQNGEEFSPMLDHTNQNRSYLFGRLLAIFELIETLRYGLDGNNNDRITNAERYWTAYTGQPTKLMMLLENKIKPYEEPLKLNRRGSWMKLEKEKEEILELLNPLLETETMEKPLDYRFIFGYYAEKNYYYTKQNTEVTESEE

SEQ ID NO: 3109 - protein, 524 aa, Clostridium cf. saccharolyticum K10
MVSRSSGIAPNFLCDNSKYLLGIDKNGSGKRLRECFEAAKNRHLEILDGVSGEAAEAVCAFFKSWDPDKAAENPVISEKWEELTAGGNLIFSVGMDEAQKDESIRCAWEESQNRKGEGEEKAGVCLVTGKRTEIARIHNTIKGVSGAQSSGAALVSFNADSFTSYGKEQSYNAPVGIYAAFAYTTALNYLLSQRRYVFQLGDATVIFWSESGEEAYQQAFWMGIEAREDDQEKLRELLEAMQKGRPVAIDDISLNPEQSFCVLGLSPNAARLSVRFFYKDSFGSILTNLKRHYEQMEIVRPSWDRTEYLSAGRMLYETANQKSRDKKAPPNMAAAVFESILSGAKYPESLYSNVLIRIRAENGAGKVTRGRAAIIKAYLIRNKEERLIKEGTFVRVNESCVDTAYVLGRIFAVLEEIQEKANPGLNSTIKDRYFNAACSRPQLIFPTLFKLESSHIRKLEDRAAIYYERQLTELQGMLQAEKGENGIREKAKSYPASLNLEEQGAFILGYYHQVQKRYTKKEDK

SEQ ID NO: 3110 - protein, 578 aa, Eubacterium rectale DSM 17629
MILQALVKEYENLAENNLVPKRGWCQAKVSYAIDLNPNGKIKEIYPLKTEQTSGKKKVFLPVAKSVPEMVTRSSGVAANFLCDNVKYMLGIDQSGTNARVQECFQAAKEKHLALLKNVDEPMANAICNFFNLWNPETAYDNACVREKSDELNEGGNVIFCMGNDFAQDNDTIKKIWDNYVVHQTENTNDGICLATGEKTEIARIHRGIKGVPGAQTSGAALVSFNAPAFESYGKEQSYNAPVGKYAEFAYTTALNYLLSNRDKTFQLGDSMVVYWAENGMEEYQKTFSFVMNPHIDNEEQLQRIFDSLKKSRYVDVDNVQMDFEQSFYILCLAPNAARLSVRFFYQNTFGDILKNIKEHYKRLDIVKPLWVEKKYLSVYELLRETVNPNSKDKTPIPNMSAMVLQSILSGNRYPASLYTDTVIRIRSEQGNVTWGRASIIKAYLIKNYSWKEGENYMGLEETCNDTAYILGRLFSVLESIQKEANQGINATIKDRYFNSACATPASVFPILFKLENSHIKKLEREKGSGSKIFYEKIIGNLMKKLVLFPRSLSLEEQGKFMLGYYHQTQKKYEKKEDK

SEQ ID NO: 3111 - protein, 578 aa, Eubacterium rectale M104/1
MILQALVKEYENLAENNLVPKRGWCQAKVSYAIDLNPNGKIKEIYPLKTEQTSGKKKVFLPVAKSVPEMVTRSSGVAANFLCDNVKYMLGIDQNGTNARVQECFQAAKEKHLALLKNVDEPMANAICNFFNLWDPETAYDNACVREKSDELNEGGNVIFCMGNDFAQDNDTIKKIWDNYVVHQTENTNDGICLATGEKTEIARIHRGIKGVPGAQTSGAALVSFNAPAFESYGKEQSYNAPVGKNAEFAYTTALNYLLSNRDKIFQLGDSMVVYWAENGMEEYQKTFSFVMNPHVDNEEQLQRIFDSLKKSRYVDVDNVKMDFEQSFYILCLAPNAARLSVRFFYQNTFGDILKNIKEHYKRLDIVKPLWVEKKYLSVYELLRETVNPNSKDKTPIPNMSAMVLQSILSGNRYPASLYTDTVIRIRSEQGNVTWGRASIIKAYLIKNYSWKEGENYMGLEETCNDTAYVLGRLFSVLESIQKEANQGINATIKDRYFNSACATPASVFPILFKLENSHIKKLEREKGSGSKIFYEKIIGNLMEKLVLFPRSLSLEEQGKFMLGYYHQTQKKYEKKENK

SEQ ID NO: 3112 - protein, 587 aa, Faecalibacterium prausnitzii L2-6
MILQALTAYYEQLLAQGRVEAPGWDSRFKVSYELRLGPDGQLLALNDLRQEVPKGKKTVLAPRELPVPHRVRRTSGVAADFLCCNTSYLLGADEKGKPERSRQCFEACAALHHKVLDGVDSPAAKAILAFFDSWEPDTAPTHPLLAGQWANLNNNANLVFGYESPDGAHWLATTDKDIRAAWQSAFDTSDADAETARCLITGKEAGIARIHPAIKGVMGAQAAGAALVSFNAPAFCSYGHEQGANAPVSEYAAFAYTTALNLLLADRNCCQRIGDTTIVCWAESAAPAYSNAMLMFFCGGAEARGVSESDLAAALKALSQGRPVSFLDDKLDPNQNFYVLGISPNAARLSVRFFLHSSFRQFAKNLQDHADRLEITRPAFDKRENLSVWALAQETVNQRSRDKNPSPQLVGDLLRAILTGGPYPATLLNGVTLRIRAEREVTRGRAAILKAYYLRNYPTELNKEVFTVSLNESSNVPYVLGRLFSVLETIQSVANSDINATIKDRYFNSACATPATAFPTLVKLAQKHLQKMTTPNEVHFSKQLTELMAQLPETGFPARLSLPEQGAFEIGYYHQTQKRYAKKNEEE

SEQ ID NO: 3113 - protein, 613 aa, Ruminococcus champanellensis 18P13 = JCM 17042
MLIKALCDYAEKQQASSSQNASVPEYYRPQKISYRIVLSPEGKLLDILPQRHLETYYDKKGKEKQKDVPDTIYLPMRNKTSIVQAYYLDHRPLYIFGLNYVKENGQEIWTPDDETNKARRSHKAFVEHELAFMDGLDSEICTAYRRFLETWDPEQETENPVLRQLGAAYSGSYFGFTLGVGKANLEEDPELIAKYQKICQQDDCRTDEPADTVCSILGERLSIARKHNPFDFPNQTGCRLVCMKHSAYESYCKEKSFNSGVSEKAMKLYTDQLNKLLQDRQHHVILEGMTVVFFAMCQNDEAQCDFFASMLGGSTDQQTEQSIQKLLTYAKGGYTGDPEAIRRMEEMNNTTFYIVGLTNTITRVSQKFIYRDRFGNLIQNLLKHQEDLRIREQDTHPIPFKWINKELVSPKSSNKDVPPPLESSIILAALQNTRYPDALLATVVRRVKTDQDDENDAKGGKYIKLNRVRAGIIKACLNRKNHKEEITMAWNEENRNPAYICGGLFAVYEKLQKDATKGPLNRTIKDAYFSSACSRPASVFPTLAKLSQNHLHKLDEERVRVFYGRLVGSLMNQLEGEFPQTLSLDDQGRFIIGYYQMNQKLWTSKEETKEDEN

SEQ ID NO: 3114 - protein, 595 aa, Eubacterium siraeum V10Sc8a
MRAYDILNSTNDRNLLPLCHSTQNAQITIDINSDGTIPSIGFAEKVEKEDAVTIIPVTEDSSSRGAGINPHPLADKLIYIAGDYPKYADVKKSDNSDYYNAYIENLKKWCESGYALQEVKAVYTYLSKGTIIADLIDAGIFTLNEKGKLSDEKIANYDPAECFVRFSVDGKKLWKDESLYQAYIAYACGDCATSDICYASGEHGGITYKHPSKIRNTGDKVKLFSTNDVSGFSYRGRFADKTQATAISFDYSQKLHNALKCLIKKQGYIVDGLCILVWENNLEEIQKPFEGCSFDDDEDGYIPESNTGEINKTLTIASITGTKNKYKSDSKTLLIMFDSATTGRLSMTEYAEVATSDYLSNLEKWHRDTSWICYGKRRSFSVYEIAACAYGNEEGSVLKPGKKTKKDVYQRLIPYIVCGGRIPQDIVNQLFIRACRYNAFDNKSNNWQRVVNCACGMIRKRIIETKGECTMSLEKECCDRDYLYGRLLAVADYAEGSTYDDNENRPTNAKRLIEAFSNHPCETWKVLCLSLRPYLNRMNIGKRSYFERMINQITAMFPLDSYNDNSPLSSEFLHAYSCQMNDFFTKKTDDNKEEE

SEQ ID NO: 3115 - protein, 676 aa, Methylomicrobium alcaliphilum 20Z
MSWMEKLYQTYEAAILLDLPIEQRLMPISHTNQNAHINIVINGEGNFKRATVLEKTQIVLPATEQSAGRTGTKPPPHPLADKLQYVAKDYSEFITYKPSFFEEYYKLLKSWCDSKFSHPKANAVLEYVKKGRVISDLVENKILFLDQEKKYLLRQWTSDSSDEMPLIFKVLPKEKKQVDQGAALVCWSVEIENQPDSDTWKDISLQNSWNTFISANEGVGGLCFVTGNFTALASNHPAKIRHTGDKAKLISFNDFNGFTVLGKFTDTKESFKKNGSQSVGVGLLTTQKAHNALRWLISRQGYRNGDQVYVAWAVSGKPIPEPLADTWSFLNTGDFDLEEVDQAEAPEQTDDTVDHSIDLGQSYAQQLSKKMAGYRAELTANEQIVVMGIDSATPGRMGILYYRELFRDDFFNRLESWHTEFSWPQRHTLEIPNDTGRKPKTKVIWPVSSPVPIAIAKAAYGEKVTDNLKKKVIERLVPCIVDGQPFPWDLVDNCIRKATNRNAYASDGQWLWEKNLAIACALFKGYYRRHPNSNQRRNYAMALEENNRSRDYLYGRLLAIAERIEEVALNVGGENRSTTAARLMQRFADRPYETWRSIELALQPYIQRLRVSRAGFLTNRQKELDAVIALFNGEDFRSKAPLSGEFLLAYHCQRQKFKTKTDTHEPNETEAQGDSE

SEQ ID NO: 3116 - protein, 622 aa, Xanthomonas citri pv. punicae str. LMG 859
MILSALADYYHRLLDDPTSGIAAPGYSQEKIGYTIVLDGGGRVVAVEDEHDYDSKKRVAKALSVPQPEKRTVAVKSNFLWDKTSYALGVSASSKRSAQEHAAFKTLHQQALGGSEDPGLRALLTFLDTWSPAQFADHPQFSRHGEALLDTNLVFRLEGDTGYLHQRATARAAWERLQGQSADGASGMCLVSGLRAPLARLHPPIKGFESTGSSIVSFNADAYISYRGSLLKVQSKHKENDSGANAPISKSAAFAYTTALNHLLRRDPRNRQRVQIGDTTVVFWAQARTTAHAEEAEDLIADFLRGGETEGPGIADGQATQRLHLALEQVRQARPLREMDDALDDDARIFVLGLAPNASRLSIRFWETQTLAGFAARLAAHYQDLKLEPPAWKRAPTPQFLALQTAPVYGEHGKPKAEDVSPLLAGELTRAILAGTRYPRSLLGGIVVRFRADGQVNPLRVALCRAVLAREARLDTQQGLSSTKGEPPVSLDTANTDPGYLLGRLFSSLENLQRTALGGQVNATIRDRYYGAASATPASIFPVLLRNAQNHFGKLRKDKAGLAVNLEKEVGQIIDALPASFPRSLPIHEQGRFAIGYYHQTQARFARNNGQDAPDTASEGEPT

SEQ ID NO: 3117 - protein, 590 aa, Phaeospirillum molischianum DSM 120
MSILAALTKAYDRLAEDHKVPPFGYSSEKIGFLISLNEDGTPAGLPIDLRQGTGKKLTARMLSVPASFKRPGITPRPFFLWDNTAYCLGITASPDKDALSRFSSFKDFHAKVLSQSDDPGLLALLGFLRDWTPDRFAALGWPEEMKDQNVIFTLESDRLSNRYLHDRAAAREVWADLASAETQTQAVCLVTGKTAPIARLHPAIKGVWGGQSSGVSIVSYNKDAFESYGHQQGDNAPVSEAAAFAYTAVLNRFLESDSPNRLQIGDASTVFWADASDAATAQLAEDAFLAMFDSIDEDKQAGEVRAILDKIRQGLPVHDFAPQLCEGVRFYVLGLAPNAARVSIRFWFEGDFGRLAENYRRYVEDIRIAPPPRDPHPPLWRYLQETAVLGKRENVPPNLAGDVLRAILTGSLYPLTLLSNILMRLRSDKTVSVLRVALLRAVLIRNYGYTDKEAPVAFDPDNTNKGYLLGRLFAVYEQVQSAALGRNVNATIKDKFYGAASAQPRKVFAILESGSANHLSKVGKARPGARVNLEKEIGAIMGLMSPGDDPFPASLSAEQQALFGLGYYHQRNQFFVAKDHDSSAQKETAV

SEQ ID NO: 3118 - protein, 631 aa, Streptococcus dysgalactiae subsp. equisimilis AC-2713
MDFFTSLLKTYEKAELADLVDHQKRSNEPVLLPIYHTSLKSNGKNIISVKLDKDGQFHKAEFMADKQMIIFPVTADSVARSGSHPAPHPLVDKFAYYSAEMGQSQYDSFHKQLNNWIDYCEEGDVKRFLTIVQQFILKPEFLTLILDSLIGPDYQHNQLKVTFCDATGKEKLIDLSACFLEFSIDQFQGFKNESVSTFKALHQSYISFVEANRENLGICNISGREEQLTDKHRGLMGNAKIISVSNKREAYKGRFREREDVFSVGYETSEKIHLMIKYLLENKNTSTWLGSSQYLINWFSDDLTNDSRLDIVSPIFDDGLEEDDDDDTPPVIALATEDNKRIGKSFIKGQKLFANDATYYVAILNKTSNGRIALKYFRQLQASQLLTNLDKWQETYSWESRSKFGKSRLRTPTFHDILNVSYGVDRDRFLELDNDNFKSDQIQKLVASLIDGKPMPQSIVKKLGNNVKERHRYRKHWYQVEQVCLAILHKQNGEEFSPMLDHTNQNRSYLFGRLLAIFELIETLRYGLDGNNNDRITNAERYWTAYTGQPTKLMMLLENKIKPYEEPLKLNRRGSWMKLEKEKEEILELLNPLLKTETMEKPLDYRFIFGYYAEKNYYYTKQNTEVTESEE

SEQ ID NO: 3119 - protein, 576 aa, Magnetospira sp. QH-2
MILQSLARYYDRLLATGEVEPPGFQKKVIPWVIELAPDGAPVALHHTERTFTLPAEVKRTVGIAANLLWDNAEYVLGLTRAGATDKQAAKVPERRAAFVEKVAALPTEALADAGVRAVTAFLARRDNAVLEALAGWETLAAEGGNVSFRLQGDDGLVCERPMVAAAIAGVASSGDSVRCLVTGMQGPVAVLHPSIKGVRGAQSVGAALVSFNLEAFTSHGWKQGANAQVSEQAAFAYTAALNKLLARDNKERHMVEGDTTFVFWAQDDTAMEESFGSFFSGYEVATDDQEKPVKKTLGAVRRGLNDAKDDGTPFYVLGLAPNAARLAVRYWYEGTVGELSNQMKKHFDDLAIIGLKQGEEDPLPSLWRLLGTIAIGGDPKSLPDGLRGNLAADIVRAALENTAYPATLLARAVERCRAEQSVPTMRAALIKAVLNRRIRQSDIPAKEITVTLDPENTTTGYLLGRLFAVYEGIQQAANPGINTTIRDRFFGAAGSTPRAAFVELSRLKNAHLKKVRRANERYSRRYENLINEIMGKLDGTEGFPAHLEIDDQGRFVIGYHHQNRDLYTKHDTHEEN

SEQ ID NO: 3120 - protein, 577 aa, Clostridium ultunense Esp
MLYELIELATKLQKNQKLPSASYKPKSVTWVIDLSEDKPYLKGPFKKGEYRSVEAPDRQRSGRVSLDNLKPYLLLDDARYVLGIPENKTKVDESELMHQGYVQLLQEAYAKTGVGELAKILEFLNQPLPEEFRQKIKAKDIVTFQTNQEMLPFERPEIQQFWSEYLAENLLSDDEAECSICGKKKAYVRYIPNPITVFGQSCQLTSFNSASFKSMGKDQTNNVPVCFSCATLTVDTFNYLLRETHHHTVLLRNERDPLRSQIAVYWLKQPAEMEWNGIVVDQKLLAAPIQNLVFDEEAKRRVPPPELGQLQELVKLPWTSREQALRIDEASFYMAILSANKGRLVVREWIHTSVSRLLDSLGQYLDAIRIVHPNGEQDKLLPLPAILQAIEVSDANLVRQFMHTIYQGYTPPNQLLIAALQRFRLPQVLTDKTETWRYHALASVLKLVLTYGKEEAKTMESLNPGYLKPSYLCGRLLAVLEEIQQRASGFKVGSTIVQRFYGAASTAPASTFGPLLRLATTAHLPKVSPEMARLLEEVIQHLDEAGGFPSTLSMKQQAEFGLGFYHQRAEFSSKRKK

SEQ ID NO: 3121 - protein, 551 aa, Halanaerobium saccharolyticum subsp. saccharolyticum DSM 6643
MILEKLCEFAETVEDFPPPHFKKRSIDYLIEINEEGELLGFTDVSDEGKIFIYADHLIGRTSQVKPHLLVDKASYVFGNIEEESLSSRQKKTKNEFYKLILESYQATSEQTIYSILKFLENNQVEDHIENDLKNNNWLAFRVNGKDPLKIDSIQEFWQKRQNKVANEKRSDFISECLICGQEKVIADRDPEQFKLLRVGGQSGGSSLISANHKSFESYGLSGSYIASICFDCATQYGRAANYLIAKKEHRLKIGDILYIFWTKNNLEFNGFELLENPEENELRDFLKSFKSGKKSYIDDEKFYCLALSANNSRTVVRDWISTTIENVEENINNYFREMQLDDNKSERYYGINSLVSQTAFKFDDIKPIVAESIAAYAIKGSPLAEAVLFNTVKRIKADVEFRVTRPRASLLKMYFNSHPEGGIKVKNKLNKKENSPAYLCGRLFSVIEIIQKKALPGIKSTIVDRYYGTASSAPASVFGNLIRKAQHHLAKLRKEESTTGLYYWLQSELEDIMVELNDFPATLSLKEQGLFALGYYQQKAYRPEKDKKEEN

SEQ ID NO: 3122 - protein, 632 aa, Streptococcus agalactiae ILRI005
MDFFTSLLKTYEKAELADLVDHQKRNNEPVLLPIYHTSLKSNGKNIISVKLDKDGQFHKAEFMTDKQMIIFPVTADSVARSGSNPAPHPLVDKFAYYSAEMGQSQYDSFHKQLNNWIDYCEEGDVKRFLTIVQQFILKPEFLTLILDSLIGPDYQNNQLKVTFCDATEKEKLIDLSACFLEFSIDQFQGFKNESVSTFKTLHQSYISFVEANRENLGICNISGREEQLTDKHRGLMGNAKIISVSNKREAYKGRFREREDVFSVGYETSEKIHLMIKYLLENKNTSTWLGSSQYLINWFSDDLTNDSRLDIVSPIFDDGLEEDDEEEDLPSVIALATEENKRIGKSFIKGQKLFANDATYYIAILNKTSNGRIALKYFRQIQASQLLTNLDKWQEKYSWESRSKSGKSRLRTPAFHDILNVSYGVDRDRFLELDNDNFKSDQVQKLVTSLIDGKPMPQSIVKKLGNNVKERHRYRKHWYQVEQVCLAILHKQNGEEFSPMLDHTNQNRSYLFGRLLAIFELIETLRYSLEGNGSDRITNAERYWTAYTGQPTKLMMLLENKIKPYEETLKLNRRGSWKKLEKEKEEILELLNPLLETETMEKSLDYRFIFGYYAEKNYYYPKQNTEVTESEK

SEQ ID NO: 3123 - protein, 637 aa, Eubacterium sp. CAG:146
MSWMRALYDTYDNLELQEKEGLLKIAHSTQKAHLEVQLSKDGKVIAVSFLPVKDSDTVIPVTEESASRSSGAAPHPLFDKIKYLAGDYEFYTGERNEEHHQKYMENLKKWCDSEYGDYKIEVLYKYLQENRLIHDLVERGIFSLDEKQHLTKKWENAGEKLTVGDQKDAFIRFQVDGVNLWEDTKLQENYIHYYLSNGGEIGFCQVTGREERLCVNHPSKIRNSGDKAKMISSNDKTNFTYRGRFHDVGEAYTISYEASQKIHNALKWLIERQGVKVGDKEFVLWGVKSENVPSILESTEGVASAYEEEEDIFATFYGEEEDKTVSIQEDVAERFNRAIRGYHGNVRADSHFVLLGVDAATTGRLSVIFSREYFGADGNELIERIEQWHRDCAWNVSSYNKKLQKRVYFTGAPSPYEIALCTYGREQGNSIKGTDKVIANAVERILPCIVDGKKVPIDIMREVVHRAQHPQNYKSKTLWQQVLSVACALTRKHLIEKGEECLVMKSPESLDAKCGRMLAIADAIEAWVLREEKIDRTTTAMRYYTKFCENPCDTWVIIQKNLKPYEMKLRGRARNLQTLLGEISATISEEEFQQKRNLDGTFCLGFDSQRYEIIEEAKRIKKENDEKKMKKLEEEEK

SEQ ID NO: 3124 - protein, 592 aa, Clostridium sp. CAG:149
MILQELVKYYERLAEQGKVSKPGWCSAKVSYCLDLRPDGTVARVISCLKEEERGKKKVLVPQDFTVPAMVSRSSGIAPNFLCDNSKYLLGIDKNGSGKRLRECFEAAKNRHLEILDGVSGEAAEAVCAFFKSWDPDKAAENPVISEKWEELTAGGNLIFSVGMDEAQKDESIRCAWEESQNKKGEGEEKAGVCLVTGKRTEIARIHNTIKGVSGAQSSGAALVSFNADSFTSYGKEQSYNAPVGIYAAFAYTTALNYLLSQRRYVFQLGDATVIFWSESGEEAYQQAFWMGIEAREDDQEKLRELLEAMQKGRPVAIDDISLNPEQSFCVLGLSPNAARLSVRFFYKDSFGSILTNLKRHYEQMEIVRPSWDRTEYLSAGRMLYETANQKSRDKKAPPNMAAAVFESILSGAKYPESLYSNVLIRIRAENGAGKVTRGRAAIIKAYLIRNKEERLIKEGTFVRVNESCVDTAYVLGRIFAVLEEIQEKANPGLNSTIKDRYFNAACSRPQLIFPTLFKLESSHIRKLEDRAAIYYERQLTELQGMLQAEKGENGIREKAKSYPASLNLEEQGAFILGYYHQVQKRYTKKEDK

SEQ ID NO: 3125 - protein, 584 aa, Firmicutes bacterium CAG:646
MILQALVKHYENLEREGKVSKRGWCSAKVSYGIELSKDGQIKTIIWLKEEHMAGKKQVWLPKILTVPEMVTRSSGVSANFLCDNSKYLLGIDKETIQGNTNPRVLECFQAAKEKHLALLEGVPGEMAQAIRLFFEMWNPACAEENQEVKENWEELTDGGNLIFCMGADFAQDDENIRDIWEQNQKESQEEGAVKGICLATGREDEISRIHKTIKGVPGAQSSGAALVSFNAPAFESYGKEQSYNAPVGKYAEFAYTTALNYLLAQREYTLQVGDTKVLFWAESARKEYQESFFFCVDPQKDNQQVAKDLFNKLSNYQMGELQEINLDPEQECYLLGLSPNAARLSVRFFYYNSFGEILENLRKHYERMEMVKPSWETRDYLGITDMLQETVNQKAKDKKPVSHMAAMALQTILTGARYPFSLYSDTLIRIRAEQGNVTWGRASIVKAYLIHNTQWKEGVNYMGLNEESNDTEYVLGRLFAVLESIQLDANPGIKATIRDRYFNAACATPASVFPILFKLKNSHIKKLEREKESSKIYYEKLLVSIMEKLSLENYPQRLSLEEQGKFILGYYHQMQKKYEKREEK

SEQ ID NO: 3126 - protein, 577 aa, Clostridium hathewayi CAG:224
MILQSLVTYYESLERKGKITSPGWCSAKVSFALELSEAGELLHIIPLKESVLRGKKTTLVPTIWKVPQMVARSSGVSANFLCDNSSYLLGIDNKGKPERSVECFEAAKEKHLEILEETDGKVARAVVLYFKTWKPEKAMEHPVLSEVLEEITAGGNLIFFIGDEFAQDDCAVKAAWEIYSQKPGDGVEGTCLVTGKRAEIARIHATIKGVPGAQSSGASLVSFNAPAFESYGKEQSYNAPVSTYAAYAYTTALNYLLADRDHMTMIGDTAIVYWSEDGEEVYNRTFSFMMEPTVDNQEIVDGVFKNLAAGKAVDENCTRESLSLDQKFYILGLSPNAARLAVRFFYQDSFGNILRHVREHYDRLRIIRPAGDCMEYLGVWRLLSETVNKKSKDKKPAPNMAGSLYRSIISGSNYPESLYQAVLGRIRSEQDDSESHIYKITRGRVAIIKAFLLKNRGCSEEEITMEMNENSNDVAYILGQEFAVLEAIQEEANPGINATIKDRYFNSACSTPAYIFPILFKLKNSHLQKLNNKNKEHEYEEMLGFLQGKITKVPKRLNLDSQGRFILGYYHQIQKKQ

SEQ ID NO: 3127 - protein, 654 aa, Ruminococcus sp. CAG:254
MLRWADELYQIYERFCGQPIGGDTAVLLPVAHSTANAQIEVTLSEDGIFQAAKKIEDKKDAVTIIPVTENSGSRSSGITPHPLADKLIYLAGDYGNYVPEKAEKASKSYAAYLEQLKIWAEENHSHPAVRAIYTYLQKGCLIQDLLAASVLNLDEQTGKLGKEKICEVVQSDCMVRFRVYQLNPGSRDETWLDSTLYESWIEQNEEQNASQQVRQLCYATGKVTECSYKHPNKIRNAGDKAKLFSANDESGFSYRGRFQNKEQAVSIGYDFSQKMHNALRWMIQRQGYSISKTMTVLAWESNLEAIPNLMESSFEMSSGYKEQCKKSQKDDAINIFDIPTNDFGADVASERTFASYREDLIKMIRGYQRNMEPLSNVTVMVLDSATTGRLSMTMYAQMEHSEFFENLKEWHEQTAWRYWRRKEFDIFSFDLRDIVNCAYGTEQKNVLKCDDKLMPFTIGRLLPCVLQKQAFPMDLLQALCDKAAYPQAYEQKYNWDLVVACACGMLRKKICEQKGECNMELDETCTRRDYLYGRLLAIAEVAESVALNKKEGNDTRITNARRYFTAFVNQPYRTWNVIRQRLEPYLSAMPKTQRNYYCTMIDEITSQFDHTAFMDNSKLEPEYLHAYSCQLQKISADKKHKNQNDSNNEEETES

SEQ ID NO: 3128 - protein, 588 aa, Clostridium sp. CAG:138
MILQALTSLYEALAQKGEISKEGWSREKISFALSIDEEGNLLRVTPLFDTVDGPKGKTREVPQKMMVPAAVKRTSGAAANFLWDNSSYILGVSLKKGEDDAEREKRRNKDIKCFEACRELHHSMLDGMEYPAAKAVLNFLDKWEPQKAEENNLVAQYAKEILSGANMVFRFNGGYVHDDPQLASVWQKANAKQKDNIGQCLVTGALDEIQKTHPTIKGVQGAQSSGAALVSFNASAFCSYNKEQNQNAPVGKYAAFAYTTALNHLLADRKNVHRIGDASVVCWAENADKQYEDFAAEVFFGDNVDKSDEQRLSALRTSLKLLADGLPCKEMDLDPDRKFYILGLSPNAARIAVRFFYCDSFGKIAGNIYRHHERLEIVRPSYDKFPILPLWKLLSATVNPNAKDKTPNAAMAGAVARAVFSGGRYPASLLECTFLRIKAERNITRERAAIIKAYYLRNPNEKCPKEVLTVSLNENSKNIPYTLGRLFSVYEEIQQAANPGINTTIKDRYFGSAAAMPATVFPILSNLAQKHLRKLSDAQRVYLDKKVMTLKSVLGEQYPAHMSLPEQGSFDLGYYHQTQARYTKKEDK

SEQ ID NO: 3129 - protein, 598 aa, Ruminococcus sp. CAG:579
MLIKALCDYSRIQEKEVQDGYCKQNVNYLIQLSPEGCIDNIISVEESKPIKNKNGKEKMVLAPKVAELPVRTQKPGIDGNIIEHRPLYIFGLNYNKKDGTLSTEDKTDKAKKSHKAFCDVNLAFFEGIDSPLCRAYCNFIKTWKPEEHTSDPILLGLGSRFGAASVYYEFGFDTDKLLQDDPAFREAYGKYLAEKQAAAEAENTELAVCSILGERLPQARIHDKIKGIAGGIASGCVMVSAKEDAFESYGKTQSFNSGVSEKAMKMYTSALNRLLADEAHHKVMDDLTLVYFAMKRDDVNESRLVSRLLTGADNTLNDTFAKALKGMPIEFPDIDERVDFYVAGLTANSSRVCQKFALRRKYGDIIDNIMEHQRNMAIGYEPKYISAGRMLHELVSPKSSNDRVPPPLLSGIFEAIFNGTNYPTSLLSTMIRRVKTDSDDDNNHFIKLNNARAGIIKACLIRNYKKEDIKMLINQDSREPAALCGRLFAVLEKIQCDSVTGDLNRTIGDTYFSSACSQPATIFPILMKLSRNHMRKLGKPAFIYYDKLLTELNAGLNDRYPKQLSLEDQGMFIVNYYQQKSELYTKKETKEKAAQADE

SEQ ID NO: 3130 - protein, 579 aa, Oscillibacter sp. CAG:241
MILQALTQYYEDLLHRGEIAAPGWSPAKISFALCLDKDGQVTQIINIQQPSENGKAQMPQTIKNLPAPVKRTVGIASNFLWDNSTYLLGVDQKGKPKRSQDCFRAAASLHHTVLDGVDSPIAKAILRFFDTWQPEKAMEHPALSGQYEAVTAGGNLLLRVDGRYSYEDTAIREAWQRYRDGAGEDAVRMQCLVTGREDEIAATHPTIKGVRDAQSSGATLVAFNAHAFCSYGREQSYNAPVGKYAAFAYTAALNHLLAKRNNVQVIGDTTIVCWAEGAEPAYPDLFMAFMSGNMPSGLSEKDLQAALKNLAKGLPSTDLGVDPDRTFYILGLAPNAARLSVRFFLRDSFGRLMQNVNAHYERLEIVRPANAKPGVLPLWALLRETVNPNSKDKSPSPAMAGATARAIFSGGLYPASLLEAVMLRIRAERNITWGRAAIIKAYYLKNPHTDCPKEVLTVSLNEASTNIPYTLGRLFSVYESAQQAANPGINATIKDKYFNSAATMPASIFPVLNNLYQKHLRKLEPGQRVYFDKQVTVLKGLLGESYPARMTLAQQGSFDLGYYHQTQKRYTKKEENENV

SEQ ID NO: 3131 - protein, 591 aa, Clostridium clostridioforme CAG:132
MILQALVEYYEALERKGKITSPGWCRARVAYGLDISEQGELKSVIPLKQERQKGKKTVTVPQSLTVPQMVSRSSGVSANFLCDHSGYMLGIDNKGKPERSRECFECAKKKHKDILEHISSPAAGAVCRFFDRWAPDQAAENPCLIPELEEIISGSNLVFMVDGEYVHEDPDIRQCWEEYSRQSGTGPVGVCLVTGRREEIARIHGTIKGVQGAQSSGAALVSFNAPAFESYGKEQSFNAPVGTYAAYAYTTALNYLLGDRTHRTTIGDTAVVYWSEEGDERYQNIFACVSEPTMENQEIVDGVFKNLAEGKAVAAQDVQDSLDMDRKFYILGLAPNAARLAVRFFYQDSFGNILKHIKEHYDRMEIVRPAADAVEYLGMWRMLQETVNKKSRDKKPVPSMSGAVYRAIISGSRYPASLYQAVLGRIRAEQDDGDSRIYKITRGRAAIIKAYLLKNGNEKEEITMALNEDSNNTAYVLGREFAVLEAIQEDANPGINATIKDKYFNSACATPAAIFPILFKLKNSHMKKMNNGAKEIYYEKILGDLQGRLTVAEGQKAACPRRLTLEEQGMFILGYYHQTQKRYEKKIKEED

SEQ ID NO: 3132 - protein, 638 aa, Clostridium sp. CAG:352
MSWITETAALYDEIKEKVNDSDEWEPILPLYHSTSNAQIQVTIFSDGTFSHAEVVDADDAKTIIPVTEDSGSRGNGILPNPLCDKLIYIAGDYSTYVAKAKSDADEYFVTYIKALKAWAESEYSDICITAIYDYLSKRMLINDLIGDGILKLKGAVLDEEYKITKSAKQIDSFVRFVVNDLDSGENIKVWKSKALFDKYIAYYEALGKERDCQLCYASGKIVPVTYKHMARIRNGGDKAKLISSNDKSNFTYRGRFANREEAFAVGEIVSQKAHLALKWLIKTGGISVGDEKYVAWESCLNEIPNVFGRIALDASENSGSFAKDKDDKVYAKTAEQYKNIIEMAIKGYKKNLDLNSSKVILMALDSATPGRLSIIMYQELTSTDFYKNIQEWYSKVYWHSCYKTDDGEVIHCVQTPTPIEIARCAYGNERDGDLIIDYKSGIFKTVIKQIYPCITLGARFPENILKRIFTRASNPQLYSEQNNWKRVLDVCCALYRKYYEDKGVELTMELNRSYNNRSYLYGRLMAVAEKLETDTYDDNEARMTNAARFMNSVIASPYKSWGNVCKRLIPYINKIQSKNPGLCVYYQKELGEIYNMFKAGEYEMKKPLEPLFFMGYYGEQQYLYTSRKNKNDDNKEDL

SEQ ID NO: 3133 - protein, 650 aa, Clostridium sp. CAG:58
MSWIERCYQTYENNITEVGVPSVNRLGRELPVLLPVGHTSQKVHVEISLTKEGKFLFARILRMDEMTTIIPCTEESSARTSGPVPHPLVDKLQYIAGDYGKYGGSKKMMWAEYLKQLRDWCNSPYGLPQVRAVLFYLEKGCLIEDLIEDGILFIGSDGKLVKKWTGAKEETPLIFQTITGGDQTEAFVRFNVDGKALSNDTMVWNSFIQYYLSILKREGFCYVQGRKMLLSQLSPYKIRNPGDRAKLISSNDGTNFTYRGRFNDAEEALSIGYETTQKAHSALRWLIGRQGISIGDQTILVWGMADEQVPSVTEDTYGLVKDMEEDDPYLDGPEDIPEFDKPIADTRAAFALRFNNAIQGYREKLTDYSQITVMILDSATPGRMSIRYYRELSGSRLMDAVEDWHRNFAWEQCYRKEQKEKKGKSVSESIVFFGAPAPKDIAEATYGVNVDSKLKQHTIERLLPCITEQRPFPRDLIRTLMYRAANGIAMEPWEAKKTRGIACALVRGYYHRNKKEDFSMALDENCHDRSYLFGRILACADQLERTYNYYFSGDVHRPTNALRMETIFTQRPAKTTDRLRKKLEPYLERLLKNNKSIYSNDLMLKLLDRIPIKEFNNDPLSELYLLGYASQRAEFFKKSDTDRSIDANNE

SEQ ID NO: 3134 - protein, 614 aa, Ruminococcus sp. CAG:379
MLIKALCDYAEKQQASSSQNASVPEYYRPQKISYRIVLSPEGKLLDILPQQHLETYYDKKGKEKQKDVPDTIYLPIRTEKSGIESNYIEHRPLYIFGLNYEKENNQGFLTPDDRTNKARKSHKAFVEHELAFMDGLDSEICTAYRRFLETWDPEQETENPVLRQLGAAYSGSYFGFTLGIGKANLEEDPELIAKYQEIYRKAHCQTDTETDTVCSILGERLPIARLHNKIKLHGGQSSGCQLVCMNDDAFESYGKTQSFNSGVSDKAMKLYTDQLRNLLEDSQHHVLLNSMTVVFFAMCQNDEPQCDFFASMLGGSMDQQTEQSIQKLLTYAKGGYTGDPETIRRMEEMNNVTFYVAGFTPNAARICQKFIYRDRFGNLIQNLLKHQEDLRIREQDTHPIPFKWINKELVSPKSSNKDVPPPLESSIILAALQNTRYPDALLATVVRRVKTDQDDENDAKGGKYIKLNLVRAGIIKACLNRKNHKEEITMAWNEENRNPAYICGGLFAVYEKLQQDATPGTLNRTIKDAYFSSACSRPASVFPTLAKLSQNHLHKLGEGGRVFYGRLVGGLMNQLEGEFPQTLSLDDQGRFIIGYYQMNQKLYTRNEETKEDEN

SEQ ID NO: 3135 - protein, 611 aa, Eggerthella sp. CAG:298
MLKALVDYYEYLRSHNKEGIVAPGWSPTKVIAFLDLDQEGNLVNVIPVEEKRGVERTVPRQVERSSGVAANLLCDTSSYILGIDAKGKPERSMKCFECAQELHTKTLSSCESTAGKAIRSFFEKWDPTEAASNQVVQEYEELLLAGRNLAFSIEGHEALNDEAIVELVNKRASSLEDVDSSVSQVSLISGEKLPVARIHPKIKGVPGTQSSGAVLVGFNAPSFTSYGHDEDQGLNAPIGEYEAFAYSTALNYLLSDPGHHIQVDDTTIVFWTLEQDEERSEDIIQMVEPGALLQLSSASAEESDETPNAQSRQEKADQKISAIMRSVERAKKVGDSSIDAPFFVMGLAPNAARVSVRFFLVSTFGDLVTNISRHYERMQLARGPFGRTYLSPQRIIYEVENPNSRTSTAARRLTGALIRAILTDTAYPNALFQHAMARLKATQDNEEKHVKKVDYGRAAIIRAFLIKNCGISEKELTVDLNTERGSVPYNLGRLFAAMEKVQEEAAWIDERKLNSTIADRYFDSACATPGIVFPVIGKLNNTHLCKLRKNGRGGAKAKLIADLNMKIHARTEHYPSRLTLEEQGDFVMGYWCQRQDFFTTKDKTETKTEEN

SEQ ID NO: 3136 - protein, 601 aa, Anaerotruncus sp. CAG:390
MILPSLVSYYEALEAKGELKRPGWSIVRVSYAVLLRPDGSIADIVSLKKDEVRGKKTVSVPQNLFAPAPVVRTAGIRANFLCDTAAYLLGASLTDAKAQQKFEAARELHLRILKNAGSAAAETLRRFFENHQPTNIAAIGIPDNIAAELDKGAVVTFADEDGCYMMDDPEIAAAWDAAYGNGSDDAVTGRCLVTGREDMIAILHDKIKGVEGAQSIGASLVGFNAPAFESYGKDGGQGLNAPVGRYAMYAYTSALNYLLSGRHRTRVGDATVVWWTLDADDVCEDFFGDFLYGSDDDETLNSAMKRILRGEPLDFSETTLRKPFCILGISPNAARLSVRFFYRDTFGRFIDNIAAHYRRLEIDKSEKQRRYLTPYRLLLETVRQSRAKAVSPLLGGETVSPNVQKRAKAVSPLLGGALLGAILNDWRYPEALYESVLIRIRAEHEVPSGKAAIIKAYLIKNTNCGSYKEVLSMALNEESTNRAYVLGRLFAALENAQYNANKSSNFRERYMTSASATPALVFPSMLQTANHHLAKSGSVADAKLIATLMDKLEGGVPFPARLNNTEQGLFLLGYYHQTQKKFRDIEEAKNNKSTNKDNTEV

SEQ ID NO: 3137 - protein, 623 aa, Ruminococcus sp. CAG:330
MSWANELYQIFENFHDRTDFSKRMLPISHSTAKAQIEITIREDGTFSSAKLVEKEDSETVIPVTEDSGARANGIYPMPYAEKLPYIAGDYGAYTGKSNQDKYKAYVEQLASWDASEYTHPSVHALLLYVQKGCIIHDLVNSGLLKQNEDRTKLSDEKINGIAPEDVFLRFRVDYKNLERENCTWRDETLQKCFIAYQRSLLHNRQMCYATGEECLVTYKHPAKIRDSKDMAKLISANDKRGFSYLGRFSTKNEAFSIGYEYSQKIHNALKWLVRLNNGFSCGDLTVVVWASAMQPMPKVDAAFSQLEDAWEDEDDDDDCEAMKPLPTTEPIYADLVQKMVFHYQKQLDIHAKVMVMGLDAATVGRLSISMYSELEGSQFLKNLENWHRSVAWKQHDSVKEYDVIDSFPLYVILSYAFGGENDNDNKKWLNGQMVRLLPCVTEGRAVPQELVRRLVLRASNPYSYCNSKKYEHQRALAIACAMIRKKNLERGKGMTSMELDRNCDDRSYLFGRLLAVADKLERDTYDKGTERETNAMRFWNAFSVRPCRTWKTLRERLIPYFNKLSVNSSRDYQEEIQKICEKMTPEVFSSGAPLGPLYLLGYDHEMFYLNHNHQNAETKKEEE

SEQ ID NO: 3138 - protein, 604 aa, Ruminococcus sp. CAG:403
MLIKALCDYSAAANLCGDIEAYYKQAIDFEILLALDGTVTAIQDLRKPIEGTKRYITPELLLPEQRGNTTVIYSYLIEHRREYIFGLEREKGKNSFKTIPGKAGKKSKHDTFCERNLPFFEEIDSDICKAYCNFIRTWNPDLQTENEILLQMGANFDNARFCFGLDGSPEIMLHEDPRVKENYQALLLEEQKEKQATQQTGFCSILGERLPICEMHDKLKGIGSQAKLVSFGKDQTDRNAFYSYGKSLGYNCNISEKAMKQYTAALNFLLADNGHHKNFGDMVVVYFAMKQNDTAECDAFSLLFGDFASDQKETVDQETEKDLNQVYNYAKTGVLKDLSGMDPDSIFYVAGLTANSSRICTKFVVRNRFGVILEHVAAHQKDIRILEKQKPVSMYWIQKQLVSPKSKDAKVPPPLIAGLFASILNGTRYPDALLATVIARVKTDTDETQQKKVNHIRAGLIKGCLNRKAKKEEITMSLNLDNTNQAYLCGRLFAVLEKIQQDASGGNLNRTIKDSYFSSACSKPATVFPKLIQLSQNHLKKVEYVLFYQKLCGDIIDQLEDAFPSTLSLDEQGKFIIGYYQQNKALYAKKEKQQETATDDSVAE

SEQ ID NO: 3139 - protein, 591 aa, Faecalibacterium sp. CAG:74
MILQSLVRCYNSLAAQGKLERPGWSSVKVQWGLRLKENGELVSVELLGKPDEKGKPIPVQKPLPTPVKRTSGKATCFLCDNAKYLFGITNEPYDGTGKNPAKEAEACFRISAKKHHELLDGVSCPMAQAILRFFDTWQPEKAAQSPALQEHFDDLCKGGNLLFCLINELGTVTEAQNVPEIQAAWDASVSNSSERSTFGRCLVTGTQDTIAILHPSIKGVVGAQSSGASLVSFNAFAFESYGRSGSQGLNAPVGNHAAFAYGEALNYMLRVKDYHSLLGSATLVYWAETAQSAYSDCFAALLGTNEDMTQNTLDGIMKAIRLGQGLQWENVPLDSRTPFYILGLSPNASRLSVRFFLQGTFGDFAANLARHQERLNIIRPSYDTRETLSAYSLLKETANPNSRDKLPPSHLVGDLLRAILGDTPYPVSLLTQTELRIHAEHSVSRGKAAILKAWLLKNGSNPQYKEVIDVQLNEQTNYAPYVLGRLFAVLESLQQKANPGINATIMDRYFNAACATPSIVFPTLLKLAQSHLKKLDTGYFIYYDKQMTELCGRLTDSYPARLNLQDQGIFQLGYYHQKQKFFTKKEENSNV

SEQ ID NO: 3140 - protein, 591 aa, Clostridium clostridioforme CAG:511
MILQALVEYYEALERKGKITSPGWCRAKVAYGLDISEQGELKSVIPLKQERQKGKKTVTVPQNLTVPQMVSRSSGVSANFLCDHSGYMLGIDNKGKPERSRECFECAKKKHKDILEHISSPAARAVCRFFDRWAPDQAAENPCLIPELEEIISGSNLVFMMDGEYVHEDPDIRQCWEEYSRQSGTGPVGVCLVTGRREEIARIHGTIKGVQGAQSSGAALVSFNAPAFESYGKEQSFNAPVGTYAAYAYTTALNYLLGDRTHGTTIGDTAVVYWSEEGDERYQNIFACVSEPTMENQEIVDGVFKNLAEGKAVAAQDVQDSLDMDRKFYILGLAPNAARLAVRFFYQDSFGNILKHIKEHYDRMEIVRPAADAVEYLGMWRMLQETVNKKSRDKKPVPSMSGAVYRAIISGSRYPASLYQAVLGRIRAEQDDGDSRIYKITRGRAAIIKAYLLKNGNEKEEITMALNEDSNNTAYILGREFAVLEAIQEDANPGINATIKDKYFNSACATPAAIFPILFKLKNSHIKKMNNGAKEIYYEKILGDLQGRLTVAEGQKAACPRRLTLEEQGMFILGYYHQTQKRYEKKIKEEA

SEQ ID NO: 3141 - protein, 657 aa, Lactobacillus helveticus CIRM-BIA 953
MNWISDLAKVYDDNESIAGKAETVSVGKEKTKTVTLVPISHIAVNIPIQINLDKDGGFKGADVIDEKDNQRTIIPATLKSASRSSGSAPMPIDDTLKYIAKDYYPEISNKDKDSHYYSDYINQLKGFVEYVNNKNSSDRVRQQVNAIYTYVSQNDIFADLLFKAHLFGDEIKQVSAIPMKWTGKEEKPAVYKAITGDLDRSFVRFNVRGLGLDRSFEDPDLYEAWGKYYLTTLRNDTGVDYVDCNNDAILTDNHPKGIIPSASNAKLISANDTTNYTFKGRLLNSDEVATIGYLNSQKAHHALRWLIDKQGFSIGGRYYLAWGRKQQNYMIDNQTSPMFKILTSTYNTDQAESYTNERLAKSYYNSLVKGIELNGDNLEDLVYLMQIDTSTPGRADIVSYQALDLNQYIRKLSSWYGKISLFIQNKAGEFVDPPYSLRTIANMIHGSKANDDLKKNTISELISVILGSQIVPRGIIMPLYNKAIRPLSFNPKDPEARFIGWQPIVRLTSKLLKIWYENEGIKAMLNDEINDRSYLYGRLLAVADVLEGDALKNKEVDRPTNAQRYMSAFAQRPADTWKTIYMNAQPYFKQSKGNRRGQILIDHIFDKLQINEENINRLNDPLDGKFLIGYSQQKVDWFRKIREYSEKKQKEQEKGDK

SEQ ID NO: 3142 - protein, 578 aa, Pseudoflavonifractor capillosus ATCC 29799
MILQALTEYYRTLEQAGKISAPGWKKSDISYAIYISDSGALEQIVPIKVPVQQGKKTVLRPQSIELPVPTDGRTSTAIRPNFLWDKSDYLLGISKGGTERGAACFAGAAAHHKAILSGISSPASAALLSFFQTWEPEKAMEYPALLEYIEDFLKGATLLFRYGGGYVHEDAAVRDAWQRYYSAQESGIVSACLVTGKTGSIARIHPKIKGIINGEAMGNTLVGFNSPAVCSYGKEQSYNAPVSQEAVFFYTTALNHLLSDREHVYRMGDATVVCWAKCGGDVYQNLMGWALFGQEPSYTLTDLQGALKNLCDGSPAELDEERLDPNMEFYILGLSPNAARLSVRFFLHNTFGHFLKNAQAHQQRLEIVKPAYDKFDVLPLWKLLDETVNQNSRDKTPAPNMAGEVLRSILTDTRYPATLLSGVTLRIRAEHAVTRGRAAIIKAYYLKNPHSDVPKEVLTVSLNPDSSNLPYNLGRLFSVLETIQSAANPGINSTIKDKYFNSASATPAIVFPVLLNLAQKHLKKLDTGLRTYYDKQLTTLLSKLGEGYPQRLNLPQQGSFQLGYYHQTQVRFEKKEEK

SEQ ID NO: 3143 - protein, 584 aa, Ruminococcus gnavus ATCC 29149
MILQALAKYYENLAEEGKVPKPGWCSAKVSYQINLSEEGDVKGISCLKTEEERGKKTVQVPQVFLVPEMVTRSSGVSANFLCDNAKYLLGISQETDEKSKKRAKECFDAARERHLSILAPGKSTMAKAVYLFFEKWNPEEAMEHPEIRDNWEEITDGSNLIFGMDMDYAQDDTEVKVAWDSHNSGESKDVQGICLVTGERAEIARIHRGIKGVPGAQSSGAALVSFNAPAFESYGKEQSYNAPVGTYGEFAYTTALNYLLSNRTYSLQIGDTMVVFWAESAETDYQAVFMGCMDSPTDNQEELKSLFERIRLGQPVIYQGNELDPEQRFYVLGLAPNAARLSVRFFYENSFGNILKNIFAHYKRMELIRPKWEQKEYLSVREMLFETVNKKSTDKKPVSNMAAMTFRAILSGSRYPERLYSDTLIRIRAEQDEGKLNWRRIAIIKAYLMRNRNWEKGEDYMGLNEESNDIAYVLGRLFFVLEAIQIEANPDIQATIRDRYYNSACGTPASVFPILIKLKNSHLKKIGREKDGAKKYYEKLLAELMWKIDCQKGFPKRLSLEEQGMFAIGYYHQKQKKYEKREEK

SEQ ID NO: 3144 - protein, 584 aa, Parabacteroides merdae ATCC 43184
MILQALYEYYQRKAADPGSTIAPHGLEWKEIPYLILIDKKGNFLELQDTTEGVGKQKRAKKYLVVKSKGRTGSNSWQTANVFWDHFGYVLAQPKNTDDKGMPKALDDAAKQNKTFVQEVRRLAEMYPSNEEIQAVAKFYDNPDNLQRIKMDPLWEECIKKDGTNISFKVAGNNTIVAANPDVTSSIEDCSDKDEPTGICLITGKKAPIAILNSAIAIPGGKSGAKLVGFQKKSGYDSYYKEQGMNAPISKEAEAAYTTALNSLLGKDSSNKYRLHDTSVVFWSQKPTKLEQCFCFIFTSPPKDDPDKNTEVIRDFLKSPFSGVLNDEDKTPFYVLGLSPNAARISVRFWRQGTVGEFASHIRQHFKDLEIIKSKNQRAYFSLFNLLTQVASLNKMENLPPCLASDLSQSIWDNQPYPTTLQMQCLIRIKADRNITSIRAAILKAYLNRKFRNHNNPPKEIQMALDLENKNQAYLCGRLFAILEKIQSDAIPGANSTIKERYYGAASTTPTTVFGRLLSLSRHHLAKFDTGKSVYYEKLLQSVITNLDSNGLPKYLSMDDQSRFAIGYYHQREDLYKTTTDKEKN

SEQ ID NO: 3145 - protein, 581 aa, Coprococcus eutactus ATCC 27759
MILQSLMQYYESLAEKGKVPRMGWCYAKVSCAIDLNEDGQVKAIIPLKVPEMFGKKEVWVPKQMHVPQMVVRSSGISANFLCDNSKYMLGIDSKGTSQRIKECFMAARDKHCSILQDSEGRMAKAIIRYFETWNPDNADVNPVIKAHWEELTDGGNLIFCLESEYAQEDEEIKKIWHIYQENNSGLVDGICLVTGEKSEISRIHRGIKGVPGAQSSGAALVSFNAPAFESYGKEQSYNAPVGKYAEFAYTTALNYLLSEKKYTFQLGDSMVVYWAESAQTQYQDMLKNFFNSNIDNQKELEKIFGNLKNGLAVDIDDVKIDLNQRFYILCLAPNAARLSIRFFYENSFGNILKNLSDHYERMAIVKPEWEKEYLSIQEMLMETGNNKLKDKKLVSNMASLVLRDILMDDRYPTGLYTEVLARIRAEQGGITYGRAAIVKAYLIKNYNMKEGEKYMGLNENCNEQAYVLGRLFAVLELIQKDANPGINSTIKDRYFNSACATPASVFPILIKLKNSHMKKIERGSTGLKIQYEKTITELMGKLNMAETQIGFPRRLSLEEQGKFMLGYYHQVQKRYEKKEDK

SEQ ID NO: 3146 - protein, 604 aa, Eubacterium siraeum DSM 15702
MILSWTDELMRAYDILNSTNDRNLLPLCHSTQNAQITIDINSDGTIPSIGFAEKVEKEDAVTIIPITEDSSSRGAGINPHPLADKLIYIAGDYPKYADVKKSDNSDYYNAYIENLKKWCESGSAPQEVKAVYTYLSKGTIIADLIDAGIFTLNEKGKLSDEKIANTDPADCFVRFSVDGKKLWKDESLYQAYIAYVCGDCATSDICYATGEHGGITYKHPSKIRNTGDKAKLFSTNDESGFSYRGRFADKTQATAISFDYSQKLHNALKCLIKKQGYIVDGLCILVWENNLEEIQKPFEGCSFDDDEDGYIPESNTGEINKTLTIASITGTKNKYKSDSKTLLIMFDSATTGRLSMTEYAEVATSDYLSNLEKWHRDTSWICYGKRRSFSVYEIAACAYGNEEGSVLKPGEKTKKDVYQRLIPYIVCGGRIPQDIVNQLFIRACRYNAFDNKSNNWQRVVNCACGMIRKRIIETKGECTMSLEKECCDRDYLYGRLLAVADYAEGSTYDDNENRPTNAKRLIEAFSNHPCETWKVLYLSLRPYLNRMNIGKRSYFERMINQITAMFPLDTYNDNSPLSSKFLHAYSCQMNDFFTKKTDDNKEEE

SEQ ID NO: 3147 - protein, 659 aa, Clostridium scindens ATCC 35704
MSWFSELYDLYEKNEEKIGRVEYKTRQGKKGPEQVPLVLLPIFHTTVAAQITVDIDSEGNILGASRVPDEDKMTIIPVTETSNSRTSDPKAHPFCDNLKYLAADYARYVKNGKKDFSKNHKLYIEGLKSWHLSEYTHPKVDALYAYLSKGTLMADLVEEGVLITDEKGVLLEKAKIQIVSQADAFVRFRIIEKADLSQDILNDPSGRYFSECWLDGTLQKSYIKYHRSRLTQTDFCYLTGENVPVSYLQPKKIRNEGDGAKLISSNDNKNYTFRGRFSDKTEAFAIGYEVSQKVHNALKWIIRKQGYSWGGLCIVIWESNLKPIPDWGADTDKIEEACQEAQESEYEGWGEEEEQEYETGAAAAARFKAAMRGYGENLKTDSKVMILAFDAATTGRLAMVENKEFAASRYVDNIKYWHDSCRWLQSKYKNGHNFRYFGMAGVKDIAEALYGTEQKGIISLGGNTRMYAEVCKRLLPCISERRRVPRDIVNAAVQKASSPVSYDNRYNWEKVLSIACALVKKQKMEVEKEEWKVSLNEESRNRDYLYGRLLAMADRIEYRTFDRDEDGKRVTNAKRYMNAFAQHPYQTWKVLEERIQPYLQKLDIKERNSYNKTLDEIYELFDEKEFTNNDRLEGLYLLGYHSQSYELKYRPKKAEEEKE

SEQ ID NO: 3148 - protein, 630 aa, Bifidobacterium dentium ATCC 27678
MMSLWSSLLETYDEVQNASGRGHQGYGNGDEAKKILLPLDHMSMPGQLRVILKSDGCLESIKKEAVAWTMIIPCTEESMGRTSKPVPHPLCDQLQYVDKVCDAKRTCMYLDQLAKWKGDDEKLNAIYRYVSEHSISKDAIQYGIQLTGRDEKIGVCFEVEIPGKACRPVADDPEIRNRWIEFQQREHAWAGTDIFGRDFYSQASNYPKNIVSTAGNAKLISANDNTNFTYRGRFGNRDEALRIDSETSQKIHSTLRWLVNNHATITDTQAIIIWAVKKPEENVVNPELNFAETLSHMLLNSESEQHDVVQDALIATDMNYAKRFRALLRGYGSPDFLQKHANKMAIVILDAATSGRLSVTFYRELRENEYLENILKWHTDTAWPLTYFERNQNGDKTSFKRTPYIGAPSFVDIINCTYDASDRSSKSYKRYAKYMKKRLIECMFGDRALPISILNAAFHKVTRPISYNEGDLVWERDFEIACSLWKKHFNDEAKRHHDSKEVSMELNLERKDRDYLYGRLLALADYFERGVLLKQQVDRPTNAVKLMSNFIAKPYSTWGALWKQLIPYLKTMNGAEWFQSGIDDVMALFEEGDFEDNKTLSPLFLLGYSSQRRSLRNPTRLHKDESDKQN

SEQ ID NO: 3149 - protein, 582 aa, Ruminococcus lactaris ATCC 29176
MILQALVKYYEELVQQGKAAKPGWCQAKVSHAIELNADGTIKTIISLKKEEQRGKKKVWVPEPLNVPEMVTRSSGIASNFLCDNAKYFLGIDAEGTNQRVIDCFHAAREKHLAILGEAEGEMAKAICLYFKNWNPEQAKKNPVIKEHWEELNEGGNIIFSMKGIYAQEDDEIKKLWDKLQVKENSGKKGICLVTGQKTEIARIHRGIKGVPGAQSSGAALVSFNAPSFESYGKEQSYNAPVGKYAEFAYTTALNYLLSQREYQFPLGDSMIVFWAESGKEEYQKTFLSWMNPKPDNQKEMRKVFGNLEKGLWVDLEDINLDPNQPFYILCLAPNAARLSVRFFYQNSFGTIIKNISRHYQRMEIVKPSWVENEYLGVKKMLDETVNQKSKDKTPVPNMASMVLRAILEDSRYPESLYTDTLIRIRAEQGNVTYGRAAIIKAFLIKNRGWKEGDDSMGLNEECIETSYVLGRIFAVLESIQKDANPGINATIRDRYFNSACATPASIFPVLIKLKNSHIKKIDRESVARKIYYEKVLADLMGKLDVSEENAGIPKRLSLEEQGRFMLGYYHQIQKKYEKKEDK

SEQ ID NO: 3150 - protein, 601 aa, Verrucomicrobiae bacterium DG1235
MILQSLYELYGRLADDPAYEISEFGYSPQKISFKIVLFPDSRFEIQDARKTDEKGKLRPTYFKVPGDGKRSGSKPVPFFTWDNALYLLGIPPSERSQDWADERREAFLDKHIAILESVDSPFLQKACQFLRDWNPCMAEDPKNKIISEIVTHYGVLQLAGTWQYLHEDPALLSLWDAENGGSGQPDGQCLITGTQSKIARLHPTIKGITPPKGKQQKDGPLVSIDKGSPAFASYGKTQSYNSPVGEDAAFRYGTALNAMLNGPKSHKHRMRIGDTTCVFWTDRESLVEDIFAEFASDGSHAVEQVQDPQMRQKLEVFLKALRQGRESDLELDSSPDSTRFYLLGLAPNAARLSVRFFYQSSLSELLSNLRAHRRDLEIIREFESPVGKRRADSDFPAYWEFLRETVRQGDDPSPLLGGAMLRSILEATPYPESLFTAILRRVHIERSVNYIKAAAIKSVLVRNHKKSIHIMLDQENKESSYLLGRLFAILEKIQEEGHREQTGRSLDKTIRETYFSTACSTPAAVFPRIEQLSTHHRRHLNPGRKVQFDRMIADVKWPQEPSVGIKKSHNLEEQGLFILGYYHQRRSLFSKVEADSAVATA

SEQ ID NO: 3151 - protein, 596 aa, Bacteroides plebeius DSM 17135
MILKALYDYYHRSQELARPGMEYRELAFLIVIDEQGNFVRLEDCRIDDKSCKSFLLPKAVSRSSSPVANICWDNCAYVLNYSEANLPLRNPPADPLKLAAKEEALKKEREKNWKNYTTFCNKVEELHGALPGNIPLMALHLFYGKGNEIILSALQKDPLWGELCKNLTRNISFRINGALTIIPEDKDVVNFYLDSLSVCHADRQTHTCLITGEEGPLVELTTATPILGSQATAKLVAFQVGSGYDSYGKEKAYNAPISREAEFAYTTALTHLLRKNSRNMFRVATRTYVFWASVASEVGLEAESCFFSLMNLQGNETDNPDRGVIQVEKVFKSIFSGEIKTQTNDCFFILGLAPNAARLAVVYWKEIPIKDFAENILRHFEDMEIVDYRMEKRPYKGVYSMLSAVALEGKVGDVQPNLPEAVIKSIFQYLPYPYSLYSACLRRIRAEQKLTQTRIALIKAYLNRQPNNYHKLTVMLDKSNNNVGYVCGRLFATLEYLQKKSYGIDSIRQRYLNAASTTPAAVFGNLLNLSVHHEEKLNSPSIIFFRKLKNEIIDLLLAEGFPTHLNIQDQGRFFVGYHHQMAEFYKASEKNEDIVE

SEQ ID NO: 3152 - protein, 584 aa, Tyzzerella nexilis DSM 1787; identical to SEQ ID NO: 3143

SEQ ID NO: 3153 - protein, 628 aa, Holdemania filiformis DSM 12042
TSDMGWIQNLCLVYDQNLEEIKAETKGLLPIGYIEQAAQLEVWIDQGCFEYARVLPKSESMTRIPCTIESSSRAGKNPAPHPLFDKLKYIAKDFDQYSEEGGSYSQYRLFLEAWCKSSYAYPLVRELFEYLEAGTLIQDLVEEKILVLDEQGKLIEKWKGLENKPAIFQMVTGTQADAFVRFVVDGVQLWKDPNLVESFTHFYQDQLRNKERIDLDLITGQQMPVTMRIPSKVRNSADMSKLISSNDSQGFTYRGRFVNPEESMSMGYESSQKAINALKWLINKQGRTFGEAVFVSWGSNITSLIEFNESADLFDLDENLPEFQFDTYEKFSKALNQAMKGYLSKPLIANEEVMTLGLEAATPGRLSIIYYQQTSSSQLFRNVLFWHKTISWYKTLFYKHAETGKTISYQTIGSPDMNKIIKTLYGESVNPKLLASSAKRLVKCIQEGQPLPRDFMQKAVVKALNPYGKSADEYNQILEVCCAVIRKYYIDEARINGKEEEMPVRTDLECKDISYLCGRALAVMNFIEDKAKPENEKKRETNAMRYMGQFSRYPQSTLISLQSKLQPYLLRLKTDYYEYLLSDILSQIDPKQFEDAPLSGKFVLGFHAQLHDLKYGYKKDQAKAEKED

SEQ ID NO: 3154 - protein, 587 aa, Bacteroides coprophilus DSM 18228 = JCM 13818
MILKALYDYYNRSLLENPNSLPLYGWMNSRISFVIIIQKNGNFVRLEDNRDETGKGKIFVLPYGVHTNSITPFLFWDKCMYAIDYSKASIPLSDVESQDKKKVEKWEKSYASAHEKHLAFVSLCKKVYDNTLDEDFKAVVEFYKKNQLPLLRNDILWQQIEKDPDVNVSFKLEGAISLIASKPILSNYVEKDTSQKGICLITGNKTDIVRKVTPTPILNCKSSASLVSFQTNQGYDSYGKSQAYNAPISYEAEFAFSTAIKRLIEEKSQNKFTIGKANYTRTFLFWSSSNSDASKAMENGIFTLFAHNELEDEDPNKRIELVKNVFMSIYNGKLSANKDDKFFILGLAPNAARIAVVYWSEIPLREFAKVISQHFKDMAIIGTRKEKKPYIGLYSILESVSLEGKLSNVTPNLPEAVVKSIFQGLPYPNSLFQACIRRIRAEQSINIVRAAIIKAYLNRLNNNNKKINIMLDKENQNEGYLCGRLFAVLENLQYAANKQDSIRSNYMNAASSTPASVFPTILKLSNSHYSKLVKDKKGLAVFFDNKKKEIMAMIQDFPNALNLGDQGRFFLGYYHQKNDKEINTTEE

SEQ ID NO: 3155 - protein, 608 aa, Clostridium methylpentosum DSM 5476
MGLLQAAYRTYEAYSDRAGSLRDEEKEALTPISHIVINAQIEITLSKEGVFQSARAVPKGENKTIVPATIESANRVGDNCRAHPLCDQLRYLAPFGGDKFVAYLSQLEEWAESDFSHPTVRAVFTYIKGGTILRDLANADLIVLDECGVPGDGKVEGTEYAKCLVRWRVIPDHPSACWQNPSLFDCFARLYASKYQEEPKDLCMISGQTDMVCEMHPKGVVALSYGAKLISANDSSGFTYRGRFTEARQASSIGYTASQKAHSALRWLSVNHGVIWGGRTFLCWNPEGKPVPSLNVLWTSEEEEKSDFVSYQNQLKKTLGGYENQLKPEDDVVVAALDAATTGRLSVTYYQELKSSDFFAHIERWYTTCCWDCDFYGIQSPPVRRIVTFAYGTERGDRMDVEDKLLREHAQRVLSCMIDCRPIPKDLVRALVTRAGNPLVYNHRNRESLLTITCALIRKYRNDDACKADREHHWKENEEEWKLALDTTNNDRSYLFGRWLAVMEQVERNTYDKKEGREPNAIRMQSVFVRRPLYASRIITEQLKPYFEKLHPNTRIRYRRIIEEIVDMLDSKDLELEKSLEDTYLLGYYHQRSALFRKKDKALETEED

SEQ ID NO: 3156 - protein, 592 aa, Neisseria flavescens NRL30031/H210
MILASLDRYYRRLAAETDEMGNPKVPPYGFSEEKIGWILVLDKEGRLKTVVPNLTADKKPQPKLMSVPRPEKRTSGIKPNFLWDKTAYALGVEANKNKAEAKEKPFTPSEKTFDAFKQYHLDLLQNSADEGLQALCRFLQNWQPAHFAAANLPAEMLDANIAFSLEKPTALIHKREAAQILWAGCLKSDEALEGLCLISGDTAPIARLHPAIKGVFGGQSSGGSIISFNKEAFVSFGKEQGANAPVSEQSAFAYTTALNYLLRRENNHCLTIGDASTVFGAEADDNATAQAAEGFFAHIFTPPDGEQESTKVFNVLEQIANGRPLQDIAPELSPNTRFYILGLAPNAARISVRFWLDTTFGQLAENLAQHWQDLALEPCAWKTPPSIWRLLLQTAVLGKSENIPPVLAGEMTRAVICGTPYPLSLLSQLITRIRADGDVNGLRVAMMKAVLQRRFRKGFIKEGVPMSLNNESPNRAYLLGRLFAVLERIQYQALGELNAGIADRYYGSVSAVPFSVFPRLLSGAKHHLSRLRKDKAGMAVNLDKDLGEIIAKLHETFPRHLSIDEQGRFAIGYYHQKQSYFAKKETAETIEN

SEQ ID NO: 3157 - protein, 590 aa, Clostridium asparagiforme DSM 15981
MILQSLVHYYEALERADRITRPGWCNAKVSFGLELSGNGELLAIIPLKQPVQRGKKTVMLPVDMKVPQFLSRSSGVSANFLCDNSSYLLGIDNKGKTERSRECFLAAKEKHLKILENVNSPAAVAVKYFFQQWSPDQAAESPVLIPYLEEIMAGANLVFFHDRDFAQEDPDIQEAWESFSAGNGRKADGVCLVTGQKAEIARIHGMIKGLPGAQSSGAALVSFNASAFESHGKSQSFNAPVGIYATYAYTTALNYLLANKQHTSSIGDTTIVYWSEEAEEVYQNIFSMAADPTIDNQEILDGVFKNLESGKAVAVGDVETKISLDQPFYILGLTPNAARIAVRFFYRDTFGGILKNLKRHYDEMEIVRPSNDSIEYLGLWRMLQETVNKKSRDKNPVSNMAGAVYRAIISGSRYPNSLYQEVIGRIRADQDNPDNRIYKITRGRAAIIKAYLMRNGTIKKEEITVGLNENCSNPAYVLGREFAVLEAIQEEANPGINATIKDRYFNAACATPAIIFPVLFKLKNSHIRKLNSRNKVIYYETLLEDLQGKLLLKDDQKTACPRRLTLEEQGMFILGYYHQTQKRYEKKEDK

SEQ ID NO: 3158 - protein, 625 aa, Bifidobacterium pseudocatenulatum DSM 20438 = JCM 1200 = LMG 10505
MSLSNNLLLINESVHNAAGKIPRSGDGSTLDIRKALIPPGHTTLPTLLTLGVNENGEILRLLREKQTIVIPCTESSMGRTIKPVPHPLFDQLQYLDLHFDKEKTSMYLEQLAAWKGDNVKLNAIYRCVSEHSISEEAARFNVEITEKDRKAGVCFEVEIGLQNSDVSNDPDIQAQWISYLYHDRQKKGKDMFGEDLYAPILNFPKKIVSVNGNAKLLSANDSTNFTYRGRFASKEEALQVDGETSQKIHSTLQWLVNNHGTITDTQAIVICSVKNPNEKPKLDPQEGSYDFGSLFSSDVDEPEAPRNDIADALTATNFQYAQVFSKVLRGYGNANKLKKHADPMMIVILDAATSGRLSVTYYRELSKDEYVESILRWHVDAAWPLKMYDKEKKKFVAYEGAPPFADIISCAYDVSDRSSKAYKRFAKNTKKQLIECMFGGESLPRFILDATYHRVTKPMGYDAPGAWLRDFEIACSLWKKHYIDDARKQNKQEDTISMYLEPTRNDRDYLYGRLLALADRFENGVLYKQGISDTRPTNAVKLMSNFVAKPFTTWGTLWKQLMPYLKSANGAPWFQNSVDEVMALFKEGDFEDNRALSPLFLLGYSCQRRESMRKAQEASQKSKEN

SEQ ID NO: 3159 - protein, 654 aa, Clostridium hylemonae DSM 15053
MNWTNELLDLYEKNQDIAGEVTYKTIKGKKGEEHIPLILLPVFHTTVTAQIEVTIDESGEFLSAKAVDKAENLTMIPVTEKSLSRTAGTEPHPLCDNLKYLAGDYMVYYRQGKKQKDYSENYRLYMEALQRWHESPFTHKKVDAIYAYVCKGCMIKDLATQGVMALDDEGKMTGDEKIQNVAQADAFVRFRVESILDAGADILADTSGQYCAECWLDKTLQEAYIQYYTSMLPEKDLCYLTGKREAISYLQPKKIRNEGDGAKLISANDESNFTFRGRFSDKTQAFAIGYETSQKIHNALKWIIRKQGYSWDGLYAVIWESGMNPLPTWSADTDTITDEYFNQKDWDEDELPESETGEVQASGFCSAMRGYGKKFGDTSRIVFLAFDAATTGRLAMTEYKTFESSRFLENLTYWYETCRWQQVKYKEGHKYDYLGMAGVNEIAEALYGTEQNGKLTLNNKRMYAQVCKRILPCISERRKIPVDMVRQAVQKASSPVVYEKRYNWEAVLGIACAMVKKERREQKKEDWNMALDKECKNRDYLYGRLLAVADRIERRTFDREEDAGRETNADRLMNAFSQHPYRTWQTIEQRIHPYLKKLDIRERNYYKKMLDEICEMFNIDSFADNSRLEGIYLLGYHSQLNEMRYQKTEEIKED

SEQ ID NO: 3160 - protein, 639 aa, Roseburia inulinivorans DSM 16841
MLEKTYDACEAIVGKKVNEDPILLPISHSTANAQIEVTIDLKGKFMPALSGIIPKDGEDKITIIPVTEDSASRSNGSCPHALCDKLCYVAGDYSLYTNEDKTEYYNDYINSLRKWTSSEFSNKWLQCVYLYLKKATLIQDLIKAKLLVLAEDGFLSENENKIQSVAQKDAMVRFAVWDNGEKHELWKEPEMYHSFIEYYKTNLHNCNIDYVTGEKIQCSEKHPSKIRNSGDKAKIFSANDTSGFTYRGRFANREQVASIGYETSQKAHNALRWLLARQGKYIDGEMTVVWKLPQNLKEKDSNLALDVVDLFGDTQETFLADFDWAAECRDEDDIELDRKFAEKLNQAMAGYRAKLQPDDEVIILSVDAATTGRLAVTYYQEVPGNEFIDRVLHWHQNCTWPRWIKLHETKKWVFINNTAPSPNEIALAAYGTEQEKGYLACSDKLKKTTIRRILPCIIGLSPKIPADIVKAAVNRASNPQAYSSFVWQNCVAPVACAMIKYNEFDGKVNSMELEKDRSYLFGQLLAILEKVEERALYLQESKTDDRLTNAKKMWNVYTRRPAITYERLYSHIVRAYLKRLNPGARAKIENEIMQIINVLRETDGFNNNPLNERYLLGYYEEREKLMKSKGEKSNEGGEE

SEQ ID NO: 3161 - protein, 615 aa, Porphyromonas uenonis 60-3
MILQALYNYYEAMRKAHRIATPGLEVKPIRWVIVIREDGSFVRLKDLKDPSDKKSKGQDYLVPAGLKRSGKCPPAQPFWDNRKYILGYEESAEGVSPCTDRLEDFKRVMAEIAEHYPDNASFKAVCRFYDHYLGAETPLPEEAQTERILASDWMTFQLQGDTELLATQDDAYDLAAQAYSTEDNLGRCLITGEEKPLAAFHARIVAPGSQAGATIASFNDPAYLSYGKKQGENAPISKYASFAHTTALNELLRNEQTRYTLGDISYVFWNSDLDDPSINETFRTVTFEGVRDDDTQEQSDTDDEQPKRKGKSKKKAPNPTQDTYKVLEQFKTIRGNRGQGEHWEDARQFYVLGLTAGGRITIKYWQQGTVSEIFDRVYQHLVDMNIISWDGFVDEENPPLRSLYGIVKSVSTPSKSSTFATNLVQSIVESILSGNPYPMTLQQACVNRITQERTVSELRAAILKGCINRKARIYKQLKELDMALDKQNDNIAYLAGRLFAVLEQIQQASLGKGVNATIRDRFYASASTRPNMVMGRLIALSNHHLSKLRKEKPGLAVNLEKLLGEIFALIPAEAPTFPATFSLDEQSLFAVGYYHQKVDTYRKEETTNPTEETEQ

SEQ ID NO: 3162 - protein, 627 aa, Porphyromonas endodontalis ATCC 35406
MILQALYQYYQQMHAVGADIAPPGMEKKAIPFIIELTPEGEVIQVTETMDSENKKKTFLVSRSATRSGKNAFQVAQVMWDHLGYVLGVSKDGTEKEEQVAPMQNESFIKKVDELRELYPENPHIAAVARFYHDGHALRLIEDETIIKDIQKTTGANISFRVRDLEDDRLVASIQDVQSYMNRAAESKDTDNSNTSVCLVTGEKSTIARLHPSVKLAGAQATASLISFQKSSGFDSYGKEQGFNAPISGHAAESIATALNNLLAKDKNTNYRVGDTAFVFWSNLADENLLSSYRTATFNGISSSSEEEEENLDLENPEEEKSKKSRRKKKNIPSTIAPDRESYRVLQTLKAACGYNGGKVHEDNGRFYILGLAPNAARISIKLWAEGSIPEIVGNTLQHQYDMNIISEKGNVDAETPPLRSIYQIVKTVSSSDKSDKWSSNLIQSIVESIVENKPYPQSLQQACLERIRRGNRITELRAAILKAYINRKKQQEYITMSLDPNQTNKAYLAGRLFALFESIQQCALGGNLNRTIRDAYYGTASTTPRTIFGRLDALSKVHLSKLRKEKPGLAVLKEKQLEEIYNLIPGGAPEMPTHFSLDDQSIFAVGYYHQRVEAWRKKEETEDHLEE

SEQ ID NO: 3163 - protein, 573 aa, Bacteroides dorei 5_1_36/D4
MILKALYDYYHRSGDDVAPFGLEYKEIGFIIVIDRCGKFLRFEDRRIDKKSAQQFLVKKSVSRSSAPVANYLYDNCKYVFGYSDKGDMEKIRKYFEVFKAKVKDIYDAFPDNEDIKAVYAFYQQDPSIIVGAMQKDSLWDDIAKNLNKKYSTFSFLIEGDTKIVASKTELINLFEENHGVVGNLCLITGRYSKVVEITTATKILGSQETAKLVAFQVNSGYDSYGKSKGYNAPISEEAEFAYTTALNHLLRSDSHNKFMVGSRTYLFWASSNSEASKESENSLFSLLGRIEEENDDPNRRIKLVYDTFQSIYNGKLSANDDDKFFILGLAPNSARIAVVYWNEMPLREFAGLISKHFTDMEMVDTRKDKKPYLGLHSILGNVTLGGKSSDATPNLPDAVVRSIFQGLPYPASLFQACIRRIRAEQSVNIVRAAIIKAYLNRLNENNNHKKLDVMLDKENQNQGYLCGRLFAVLDKIQEDANGIHSIRERYMNAASATPSMVFATVLNLSTHHIEKLNPGGQVFYEKLKQEIISKLDAKGFPPHLNLQDQGRFFVGYYHQRQDLFMNKENKEME

SEQ ID NO: 3164 - protein, 573 aa, Bacteroides sp. 9_1_42FAA
MILKALYDYYHRSGDDVAPFGLEYKEIGFIIVIDRCGKFLRFEDRRIDKKSAQQFLVKKSVSRSSAPVANYLYDNCKYVFGYSDKGDMEKIRKYFEVFKAKVKDIYDAFPDNEDIKAVYAFYQQDPSFIVGAMQKDSLWDDIAKNLNKKYSTFSFLIEGDTKIVASKTELINLFEENHGVVGNLCLITGRYSKVVEITTATKILGSQETAKLVAFQVNSGYDSYGKSKGYNAPISEEAEFAYTTALNHLLRSDSHNKFMVGSRTYLFWASSNSEASKESENSLFSLLGRIEEENDDPNRRIKLVYDTFQSIYNGKLSANDDDKFFILGLAPNSARIAVVYWNEMPLREFAGLISKHFTDMEMVDTRKDKKPYLGLHSILGNVTLGGKSSDATPNLPDAVVRSIFQGLPYPASLFQACIRRIRAEQSVNIVRAAIIKAYLNRLNENNNHKKLDVMLDKENQNQGYLCGRLFAVLDKIQEDANGIHSIRERYMNAASATPSMVFATVLNLSTHHIEKLNPGGQVFYEKLKQEIISKLDAKGFPPHLNLQDQGRFFVGYYHQRQDLFMNKENKEME

SEQ ID NO: 3165 - protein, 604 aa, Shuttleworthia satelles DSM 14600
MGLFQQALATYENNLDLVGEYEGDREPLAPVGHIVTNANLEVTIDKNGYFISVAERDSNLGKVIIPVTEKSASRTSGIAAHPLCDKVEYLTVMEGVANEKHQAFCEQLDAWRNSEWTDLKVEAVYQYISRQTLIPDLIKSGIVKIDKEGNVNKTCLDMLVIWRVLGAGDEPCVWKDIGLMKKYSCFAESIMKSKKEYCMVTGNYAKSANLHMRGVFSYKSQARLISSNDTDNFTYRGRFCTADEAMTVSYEASQKVHNALKWLITNQGVVIGKRSFLCWSPEGVKVPSLEKSVLDFFGIPDETSTEPSNYQKQLSDALWGYKTETKKLPASEVVIVEFDAAIPGRLAITAYREMATMDYFEHLVKWDQSCCWYFDLKEVIRAPSIESIVEFAYGNEQDRTGKGKIRIAEKVLKAQCDRLAHCRMGETFFPVDIVQSLEQRASSLIRYGRNTRRNLLSIACAVIRKYHIDHGGKEISMELDQMRCDRSYQFGRLLAVYEKIERDTYEQGTMREPSAIRLQSVYSRQPLHYAGELDRQMERAYFPRLKSNGIKIFYKNLIAQILEQIYESPKEEWNKPLGDTYLMGYYLQRKSLYSAKKNDEEVEG

SEQ ID NO: 3166 - protein, 611 aa, Kingella oralis ATCC 51147
MILASLARYYRRLAAETDEMGNPKVPPYGFSEEKIGWILVLDKEGRLKTVVPNLTADKKSQPKLMSVPRPEKRTSGIKPNFLWDKTAYALGVEANKNKAEAKEKPFTPSEKTFEAFKQYHLDLLQNSDDEGLQALCRFLQNWQPAHFATENLPAEMLDANIAFSLEKPTALIHKREAAQSLWAGCLKSDEALEGLCLISGEESPIARLHPAIKGVYGGQSSGGSIISFNQEAFASFGKEQGANAPVSEQAAFAYTTALNYLLRRDNDHCLNIGDASTVFWAEAATVEQAQAAENMFSCAVNPPDTHDSPDDEQEAQKVFYILEQVAKGRPLHKVAPELSPDTRFYILGLAPNAARISIRFWLDTSFGQLAAHLAQHWQDLALEPKAWKTPPSVWRLLLETAVKFKNGEGRYDKPKAENILPVLAGEMTRAVISGTPYPLSLLSQLIARIRADGDANGLRIAMIKAVLQRRFRKGLINEEVPMSLNTESPNTAYQLGRLFAVLERIQYQALGELNAGIADRYYGSASAVPFSVFPRLLAGAKHHLSRLRKDKAGIAVNLDKDLGEIIGRLPETFPRHLSIEEQGRFAIGYYQQKQSYFAPKQPAETDETQGE

SEQ ID NO: 3167 - protein, 619 aa, Selenomonas flueggei ATCC 43531
MSWMEQLVQTYDENERFAGRDDVEGMKVALSPIGYSIHDAWLEVVLRENGEFIDAFELPKEERATPMPCTPYPRTSKAVPHPLFDKIAYVSKDYHKFIENPKKKDMESYRAYKKLLTKWVQQEDSPLIVRAVYAYISQHDLIHDLLERKIATKGKITSKLSSVVRFRIEGRIDPWRDKEVQDSYKKIYSSLFYENASKSLCYGSGKMMVTIEKPDTRGIRTHGDGTRLISSNDEDNFTFRGRFVLGKECLSIGEETVQKSMNALRWLVENQGKNVDGRVFLVWGRNSVSIPSVFDDTEGLIHKRRPMEAAQPDTLKMWAQNLHKALDGYRHDFRRAKTSQVNVIILDAVTDKGRLSICYYGEMAGEDFIERIEKWHTAGQWYQRNQDTRDKKNPGWYPPYFGVPSPRKLVYAYRGDNISDKQMKMELHRIFFSIVQGVPLPADMERMAFSRVVKRAICDPLEKWEHLILEPACSIICNRLNRKKEVYTVALNERKTNRSYLFGRLLAVADQMERETFTAEEKGSRITNAMRYMNIFSSRPVSTWETIQKKLLPYQAKREKYGGKEIALIDEIISMFDDGDFCSNAPLEVEFLLGLSCQRHALRKEREENKKDAMREENK

SEQ ID NO: 3168 - protein, 611 aa, Clostridiales bacterium 1_7_47FAA
MLIKALCDYYDALGKNGKVLPKGYSNVKIHYLVSLSLNGEIDEIINWQETERTEDGKGKMKERFVPRTIVMPERTEKPGIEANVVEHRALYIFGLNFDKDVFTPEDRTGKAKKSHEAFRDKNLAFLEGLDSPVVNAYRAFISGWRPEEETENLYLVELGKAYSAAGFAFCLSGRPDVLLHRDQKLLEKWEECKRKGDSKGGHAVAAQCAISGEEAPIARIHSKIKGVYGGLATGSVLIGFNNPSESSYGNDQSYNSNISENAMRRYSEALNYLLGSRKHKVMLDDMTVVFWASDDNETCNDLMAALLFDNPDSMDAQRTEEMLQDLMKDARAGIVRTGQIADMEKIHKNVDFYIVGLKPNSSRLAVKFLYHKRFGEILQNVAYHQLDLQMQEKGKPISLWRIGKSLISPKSKNETVDVALMTKILEAVVYGTRYPDSLLQSAIRRVKTDSGENMNYVHAGIIKACINRGKRLRGEKEEITLSLNKENKNPGYLCGRLFAVLERLQQDASNNSLNRTIKDAYFASASSKPAQIFPKLLRLAQNHLGKVKAPVYYNIMLQEIMDKLVGEFPDTLLLQDQGRFMIGYYQQYQSFFLTNEDKKNENKINEEQEER

SEQ ID NO: 3169 - protein, 592 aa, Neisseria flavescens SK114
MILASLARYYRRLAAENDEMGNPKVPPYGFSEEKIGWILVLDKEGRLKTVVPNLTADKKPQPKLMSVPRPEKRTSGIKPNFLWDKTAYALGVEANKNKAEAKEKPFTPSEKTFDAFKQYHLDLLQNSEDEGLQALCRFLQIWQPAHFAAENLPAEILDANIAFSLEKPTALIHKREAAQSLWAGCLKSDEALEGLCLISGDTAPIARLHPAIKGVFGGQSSGGSIISFNKEAFASFGKEQGANAPVSEQSAFAYTTALNYLLRRENNHCLTIGDASTVFWAEADDNATAQAAEGFFAHVFTPPDDEQESAKIFNVLEQIGKGRPLQEIAPELSANTRFYVLGLAPNAARISVRFWLDTTFGQLAENLAQHWQDLALEPCAWKTPPSIWRLLLQTAVLGKSENISPVLAGEMTRAVICGTPYPLSLLSQLITRIRADGDVNGLRVAMMKAVLERRFRKGFIEEGVPMSLNNESPNCAYLLGRLFAVLERIQYQALGELNAGIADRYYGSASAVPFSVFPRLLSGAKHHLSRLRKDKAGMAVNLDKDLGEIIAKLPETFPRHLSIDEQGRFAIGYYHQKQSYFAKKETAETIEN

SEQ ID NO: 3170 - protein, 626 aa, Paenibacillus sp. oral taxon 786 str. D14
MSWLLHLYETYEANLDQVGKTVKKRDREYTLLPVSHTTQNAHIEVTIDEDGDFLEARVLEKESTLIPCTEESASRSGSKVAPYPLHDKLSYVAGDFVKYGGQIKNPDEVPFDKYIRNLEEWANSPYATEKLKCIYTYLRKGRLIEDLVAAKIIRLDENQHLIEKWDEKYTAKFGEKPPIFSSGAAETSSAFIRFNVLSPDSPEEVWKDQAMFDSFIAFYNQKLGETDVCFVTGEMRPSTERHANKIRHAADKAKLISANDNSGFTFRGRFKTSKEAVSISYEVSQKAHNALKWLIHRQGKTMDERVFLVWGNDNDPVPNTDEDIVDMMRHSGREIEREPDTDKPYADQVRRAIDGFRNDLTYQAEVNILVLDSATTGRMAVLYYRHLNKELYLNRLEEWHNSCAWEHRYRKEEEQLITFYGAPATKDIAFAAYGPRASEKIIKGTMERMIPCIVDRRAVPRDIVRSAFHRASNPVSMERWEWDKTLSIACALIRKMLLEKGEEWNVPLNTESRERSYLFGRLLAVADVLERGALGKDETRSTNAIRYMNSYAQNPGRTWKTIQASLQPYQAKLGTKATYLSRMIDEIADQFEEGDFNNLPLTEQYLLGFYSQRRELYKKKEEDTNE

SEQ ID NO: 3171 - protein, 476 aa, Bacteroides sp. 4_3_47FAA
MILKALYDYYHRSGDDVAPFGLEYKEIGFIIVIDRCGKFLRFEDRRIDKKSAQQFLVKKSVSRSSAPVANYLYDNSKYVFGYSDKGDMEKIRKYFEVFKAKVKDIYDAFPDNEDIKAVYAFYQQDHSFIVGAMQKDSLWDDIAKNLNKKYSTFSFLIEGDTKIVASKRELINLFDENHGVAGNLCLITGRYSKVVEITTATKILGSQETAKLVAFQVNSGYDSYGKSKGYNAPISEEAEFAYTTALNHLLRSDSHNKFMVGSRTYLFWASSNSEASKESENSLFSLLGRIEEENDDSNRRIKLVYDTFQSIYNGKLSANDDDKFFILGLAPNSARIAVVYWNEMPLREFAGLISKHFTDMEMVDTRKDKKPYVGLHSILGNVTLGGKSSDATPNLPDAVVRSIFQGLPYPASLFQACIRRIRAEQSVNIVRAAIIKAYLNRLNENNNHKKLDIMLDKENQNQGYLVPCKFTHPIFM

SEQ ID NO: 3172 - protein, 619 aa, Neisseria sicca ATCC 29256
MILASLARYYRRLAAETDEMSNPKVPPYGFSEEKIGWILVLDKEGRLKTVVPNLTADKKPQPKLMSVPRPEKRTSGIKPNFLWDKTAYALGVEANKNKAEAKEKPFTSSEKTFDAFKQYHLDLLQNSEDEGLQALCHFLQNWQPAHFAAENLPAEMLDANIAFSLEKPTALIHKREAAQTLWAGCLKSDEALEGLCLISGDTAPIARLHPAIKGVFGGQSSGGSIISFNKEAFASFGKEQGANAPVSEQSAFAYTTALNYLLRPENGHSLIIGLDRIRAALRGAKKQNESQDFDKRPSIGSTSTVFWAEADDNATAQAAEGFFAHVFTPPDDEQESAKVFNVLEQMGKGRPLQEIAPELSPNTRFYILGLAPNAARISVRFWLDTTFGQLAKNLAQHWQDLALEPCAWKTPPSIWRLLLQTAVLGKSENISPVLAGEMTRAVICGTPYPMSLLSQLITRIRADGDVNGLRVAMMKAVLERRFRKGFIEEGVPMSLNNESPNRAYLLGRLFAVLERIQYQALGELNAGIADRYYGSASAVPFSVFPRLLSGAKHHLSRLRKDKAGMAVNLDKDLGEIIAKLPETFPRHLSIDEQGRFAIGYYHQKQSYFAKKETAETIEN

SEQ ID NO: 3173 - protein, 576 aa, Marvinbryantia formatexigens DSM 14469
MILQALVNYYETLQSAGKIAQQGWCQAKVSFALNLDEGGRLKGIISLKTENTVGKKKVVLPAVKMVPEMVTRSSGISANFLCDNSKYLLGIDAQGTGKRVLECFEAAKNRHLEILKSAEGKFASAVKAFFSTWEPQRAKEYPALQEMWEEITGGGNLIFVMDDEDAQDDEEIRRAWKEFLDGESSGREGICMVTGKKTEIARIHSTIKGVQGAQSSGAALVSFNGLAFESYGKEQSYNAPVGKYAAFAYTTALNYLLAQRDYVFRFGDTTVVFWAEDGEEAYQEVFGWSLEPPKDNQEEIKNIFKNLRLQKAINIEGIELNKNQRFYILGLAPNAARLSVRFYYEDSFGNLLENMQKHYQRMELVKPSWEEREYLGTGAMLYETVNQKSKDKKPVPNLPGALLRAILSDSRYPENLYSSTLIRIRAEQGKVTWGRAAIIKAYLIKNHQLEKEENFVGLNEETNDTAYVLGRLFAVLEAVQEEANPGVNATIRDRYFNAACATPGAVFPILMKLKNSHIRKIERQKIGKKVYLENLLTQLMGKIEDFPKRLTLEEQGHFILGYYHQVQKRYEKREEA

SEQ ID NO: 3174 - protein, 293 aa, Cardiobacterium hominis ATCC 15826
MMTVTDGEENQKVFDILQQIAKDRSLKEIAPNLHEDTRFYILGLEPNVSRISIRFWLNTTFGQLAQNLTAHWQDLAIEPCPWQTPPSIWRLLIQTALLGKTENISPILAGEMTRAIINGTPYPMSLLSQLLARIRADGDANGLRIAMIKAILARKFRKGLIKEGVPMSLNKESTNRAYLLGRMFAVLERIQYQALGDINASIADRYYGSASAVPFSVFPRLLVGARHHLSRLRKDKPGLAVNLDKDLGEIIAALPEHYPRHFSIDEQGRFSIGYYQQKQSYFSPKEAVTTTEE

SEQ ID NO: 3175 - protein, 599 aa, Jonquetella anthropi E3_33 E1
MILQALYEYEQRRQKVGTGIPTGCGDVEFKFLVEIDSTGRFHQFYDMQEEQVGPKGKSFLKGKRYFVPDTVSRTSGVKAKVLWDNAKYLLGAEIDKEKKIHTAQDDQGLRQRLDAFIQETKDCLKRSKDRTLSKEIQAIINFYENPEGLDAALKDLTLGNVLEAGGNLTFRLIDGDLPVPAQEAARNLAAFEPSEEGVCLITGQRAPLARIHSDFLIRGGKQTGASLVSCQKDSGYDSYYKEQGYNAPVSQAAAFDYASGLKQLLASEKNKAIIGKDTYVFWSVPKDAPIGGENPASEGNFRAVLRGDPDKQVGRLKVVFDHIRQGTDLVVEKGRFCLLGLTANSARIAVRLWRVDSTEHFAANLRRHLEDTAIDAYGGQVVNFPLDRILWAMALDGKIESLPPNIPSGLLSSVVDGVPYPLAGFQRAIVRIRAEQEVRPELASLLRGTLNRWRTSAGEQKEVFGVKLDDASQDPSYVLGRVFSILESIQRIAQGELNKSITSRFLGAAASTPGIVFPKLFKLSVHHLQKISQDRLPRAVWWKNKLASVMEGVGEFPRQLNLYEQGKFFLGYYHQNQDVSAKKEDLQLNNDEERKEQQR

SEQ ID NO: 3176 - protein, 579 aa, Selenomonas sputigena ATCC 35185; identical to SEQ ID NO: 3041

SEQ ID NO: 3177 - protein, 573 aa, Bacteroides sp. 3_1_33FAA; identical to SEQ ID NO: 3164

SEQ ID NO: 3178 - protein, 585 aa, Neisseria lactamica ATCC 23970
MILHALTQYYQRKAESDGGIAQEGFENKEIPFIIVIDKQGNFIQLEDTRELKVKKKVGRTFLVPKGLGRSGSKSYEVSNLLWDHYGYVLAYAGEKGQEQADKQHASFTAKVNELKQALPDDAGVTAVAAFLSSAEEKSKVMQAANWAECAKVKGCNLSFRLVDEAVDLVCQSKAVREYVSQANQTQSDNVQKGICLVTGKAAPIARLHNAVKGVNAKPAPFASVNLSAFESYGKEQGFIFPVGEQAMFEYTTALNTLLASENRFRIGDVTAVCWGAKRTPLEESLASMINGGGKDKPDEHIDAVKTLYKSLYNGQYQKPDGKEKFYLLGLSPNSARIVVRFWHETTVAALSESIAAWYDDLQMVRGENSPYPEYMPLPRLLGNLVLDGKMENLPSDLIAQITDAALNNRVLPVSLLQAALRRNKAEQKITYGRASLLKAYINRAIRAGRLKNMKELTMGLDRNRQDIGYVLGRLFAVLEKIQAEANPGLNATIADRYFGSASSTPIAVFGTLMRLLPHHLNKLEFEGRAVQLQWEIRQILEHCQRFPNHLNLEQQGLFAIGYYHETQFLFTKDALKNLFNEAKTA

SEQ ID NO: 3179 - protein, 651 aa, Peptoniphilus lacrimalis 315-B
MSFLTALYKSYVYGEENDLIGLKEDGDNLILPIYHNSMKSNGKNIVEVFLDKDSNLLDARFLKEDEIVIFPVTEDSVARSSGVSPHPIFDNFDYIIQDESKKSLAYIEGLESWISYSNNEFLIVVRNFIEKDNSFDQIIKKLFYEYKLGKNKEVIQVDRSEKKEKETSYDFSKVFMTFKIRNFVENKDVNLTENRNLQDEFIKYIKDLNKKDQSIPKIICNISGKEDYLCLKHRPLIGSAKLISQITANNENFKGRFENPDETIKIGKETSQKIILMVKSLLDGKNTCRWLGEMTYVISWFSDDITNNRELNLAKEIQISYENTSKLSPRQMRKNKTYFGDENKTVLNLYDKTTEDIVKSFTSGRKRFVDGSNYYMTIIDKVSNGRVAVKYFREIETSRLKDNLVRWQQKYHWIRYDEQKRSYEFTPSPSNIIRSAYGIEREKGLEVSKKSFEKDQYGNILAAIVEGRDMPKNIVYALEMNIRNRLNYDKCWAQVKNCALAILKDKEGIENNMLDRKDTDRSYLYGRLLALYEILEKSTYDSDTERVTNAEKLWTSFVNKPVTMNFRLRNLMLPYEKKLGLSEGYKKELLTTIKEEISQIINLLSENYDYKSSKSNSPLGPGFIFGYEAELKFINYKFLKFKENQKATNTN

SEQ ID NO: 3180 - protein, 691 aa, Pyramidobacter piscolens W5455
MSWLQKLYDTYDNCAEVLKSNREIVDAPMLAPVGQMVQSVQVELTLDTGGKIIDARVIEEREEQNTFIPCTEDSQNRTSGACAHVLFDKLKYMAGDYYDYLWLKSNEEPSDKLRKKNEESRQEFHEARTLYMQRLNELAARCDGIVKKHLDVIVTYLKRNTLVSDLIARNILRGSIPEHIVAVQVPRKEIVKYPLYNRKIVPDVSEAFVRIRVHYPGEVRDKIWEVPAFWQSYKEYYLEKLEAERGTDLCYVQGWEIVPGLKHLCRIPFTNSKSKLISSNDSENFTYRGRFATSKQAMCVGYETSQKAFNALRWLVQKQSWHEKGQIYVIWGTKNQRIPAFDDDSADLLTEDPTDNSTFDGDINTREGFAKRLILVMQGYKKELDGASQVVVLGLNSATDGRLAVTYYQEVSGSDFLNRIENWHNTCQWLHTYKRDKKGEKKMHAFFGAPAPLDIIKAAYQISPADPRPKPQHPIPDHLLHATMDRLIPCILESRPLPGDLVKTLFRRASNPAAVKEDLDREMIMTITCALVRKYYNDRGQKEEITVALQPDYPDRSYQFGRLLAYAENIEGYVNKLDGENRQTNAERLMHQFSKRPMKTWQILESQLQPYTGKLQSSRFGLKARLMAEINEIVSGLSEWTDDLDKPLTELFILGYRCQLEKLQKDMKAAAEAKAQKEREKRAAEQQDSEE

SEQ ID NO: 3181 - protein, 596 aa, Neisseria subflava NJ9703
MILASLARYYRRLAAETDEMGTPKVPPYGFSEEKIGWILVLDKEGRLKTVVPNLTADKKPQPKLMSVPRPEKRTSGIKPNFLWDKTAYALGVEANKNKAEAKEKPFTPSEKTFDAFKQYHLDLLQNSEDEGLQALCRFLQNWQPAHFAAENLPAEILDANIAFSLEKPTALIHKREAAQTLWAGCLKSDEALEGLCLISGDTAPIARLHPAIKGVFGGQSSGGSIISFNKEAFASFGKEQGANAPVSEQSAFAYTTALNYLLRQRNQEANNHCLTIGDASTVFWAEADDNATAQAAEGFFVHVFTPPDDEQESAKIFNVLEQIGKGRPLQEIAPELSPNTRFYILGLAPNAARISVRFWLDTTFGQLAENLAQHWQDLALEPCAWKTPPSIWRLLLQTAVLGKSENISPVLAGEMTRSVICGTPYPLSLLSQLITRIRADGDVNGLRVAMMKAVLERRFRKGFIEEGVPMSLNNESPNRAYLLGRLFAVLERIQYQALGELNAGIADRYYGSASAVPFSVFPRLLSGAKHHLSRLRKDKAGMAVNLDKDLGEIIAKLPETFPRHLSIDEQGRFAIGYYHQKQSYFAKKETAETIEN

SEQ ID NO: 3182 - protein, 592 aa, Neisseria mucosa ATCC 25996
MILASLARYYRRLAAENDDMGNPKVPPYGFSEEKIGWIWVLDKEGRLKTVVPNLTADKKPQPKLMSVPRPEKRTSGIKPNFLWDKTAYVLGVEANKNKAEAKEKPFTSSEKTFDAFKQYHLDLLQNSEDEGLQALCRFLQNWQPAHFAAENLPAEMLDANIAFSLEKPTALIHKREAAQTLWAGCLKSDEALEGLCLISGDTAPIARLHPAIKGVFGGQSSGGSIISFNKEAFASFGKEQGANAPVSEQSAFAYTTALNYLLRRENNHCLTIGDASTVFWAEADDSTTAQAAEGFFAQVFAPPDDEQESAKVFKVLEQMGKGRPLQEIAPELSPNTRFYILGLAPNAARISVRFWLDTTFGQLAANLAQHWQDLALEPCAWKTPPSIWRLLLQTAVLGKSENISPVLAGEMTRAVICGTPYPLSLLSQLITRIRADGDVNGLRVAMMKAVLQRRFRKDFIEEGVPMSLNNESPNRAYLLGRLFAVLERIQYQALGELNAGIADRYYGSASAVPFSVFPRLLSGAKHHLSRLRKDKAGMAVNLDKDLGEIIAKLPETFPRHLSIDEQGRFAIGYYHQKQSYFAKKETAETIEN

SEQ ID NO: 3183 - protein, 678 aa, Dethiosulfovibrio peptidovorans DSM 11002
MSWMGKLYDTYERAMELNLPQEEKPIPEGHVVQNAHINIVLDSEGNFKRASVIGKVPVVLPATEKSAGRTSGEAPHPLADKLQYVAGDYAELGGKKPSYFDGYLEQLKNWRDFLKDHKDIAFSKVNAVYSYVGKGCVIDDLVKESVVWLDSKGKLACSTDQLSDEDQKKASLLRFLPKEKGEFEQGSALVCWTVEISHDLQSNTWKDLEIQRAWRDYLLSQETIKGLCYVTGKDVAIALNHPARLRNSGDKAKLISSNDKDGFTFRGKFFDSKKTIEKEGYQAANVGSSVSQRAHSALRWLIDRQGFKNGDQIVIAWAISGKKVPPPMESLPEFDFDDLGEGACETSDVDIRDMSPDLSSDLGQGFARKLTLYMNGYRSSLSPDESVVIMSIDSATPGRMGITYYRECFAHEYVDRVAQWHSDFAWLQRKGDGGTGRGKYEDWEEFAPAPPLIVGCSYDESLKGNTKFKGFTYERILPAIVESRNIPYDIVASSVRKACAPRRASKKGGADYKEWEKTLGVACALYRGFFRRHENTDKRRYYPVGLDVENRSRSYLFGRLLAIADGIESFALIKSNETRPTSAERLMQRFASHPCSTWRTIELSLQPYMQRLLRSGHGGFITNRKRDLDSVMELFDGADFSSDAPLEGEFLLGFHCQRLELLRKKDKSATDNSEGGNK

SEQ ID NO: 3184 - protein, 592 aa, Clostridium sp. M62/1; identical to SEQ ID NO: 3124

SEQ ID NO: 3185 - protein, 640 aa, Filifactor alocis ATCC 35896
MSVLTNLLRCYEYSEKEGLVGEYNGNDAVLLPLYHQSITSKKNNVLKVTLDEEGQLLNAEFAVDGEVYLFPITEDSVARSSGVAPHPLEDKMQYCISKIADKKKIEAYRKEFDNFYDYAEHPKVKLFLNAVKLFLSNEKNYALILSKLPLKDIVETGKGKIKYTSEKNKKTEYDFKDTFVCFEVRCHNGSYLKVNTFSEMQEEFVSYIDDRYEREGTLSICNISGTKETITEKHRGLMGTAKVISVSNNKETYFGRFHNGSDIIRVGRKSSEKIHLMLKFLLENRNSHIHLADTLFLVNWFSGDIKNTMAFDLTGSDMDDDMEEEGKNPVSESNKEISRAFIRGTGKLNPEEQYYIMLVDKSSNGRMSIRYYKEMPNSQLIENLQSWQKKYIWEQWKQAKETYVEYVPSLHYILLASYGIERNKILVIDDGKFKKDQFQNLVTALVEGKSVPSNIKNALAQNIRNRQKYSEKWRFMLLVSLAILSEGRKEYQEMREESHQTRSYLYGRLLAIYEGLEEAVLRDQQRSSLASSDDSSKKSKIRATNALRYWNSFVNKPDTTMKTLELATKYCASYILSSNKPDYLVGVLIKTEKAKSEIFELLDTQENRKYKTNTQLDNDFIFGYYAQKKDLYTKKENDDE

SEQ ID NO: 3186 - protein, 593 aa, Oribacterium sp. oral taxon 078 str. F0262
MILQELVKYYEALAERGEIALDGWSKEKVSYSLELDREGKPLKILSLGVEEENGKGKTVRKPKLMEVPERVSRTSGVSANFLCDNAKYMLGISGDASDRKSQECFTATKEKLMDILQDCDGPAASALKKFFQSWDPSRAEELSELKDKEYRDEITKAGNLVFSIEGEYAQEIPELKQAWESWRKKKENGRERGRCLVTGELSEIAKTHTSIKGIKNAQSSGAALVSFNAPAFSSYGKEQSFNAPVGRHAMFAYTTALQFLLSQKEQKVQLGDLCLLFWAESGEEEYGEIFSSCMGGREDNQEIVRNVLRNIAGKQGVDYKGVHLDPEQNFCILGLSGNAGRLAVRLFLKNSFGNILRNFQRFYEELEIAGPKWEEEQPALWKLLGETVNQNSRDKSIPPALGSECLRAILMHGKFPASLYHGILIRIRADQGENKINGRRAALIKAILLRNYGELYLGKGEDFVALNENCRDRAYILGREFAVLEKIQEAANPGINATIRDRYFNSACGTPAMVFPLLFRLKESHLRKIRNGNPGMAVFYERILTELQGMLEVSDLVGAFPSRLSLNEQGMFILGYYHQRQKFYEKKEGGEVR

SEQ ID NO: 3187 - protein, 634 aa, Selenomonas noxia ATCC 43541
MSWMEQLVQTYNENERFAGRSGVGGMKALLPPVGHIIQNAQIEIAVNGEGKLLHCEVLLKEDQPTLIPCTPDSASRSGKGVFPHPLHDNLSYIARDYGKYATVEQDEKKNPYKQYVKQLKLWAESKYSDPKVWAVYRYVSEHDMIQDLVDKKVLHKDKAGGIIEKWENKDKEKPLIFQATSASVLKCVVRFRVELQGDTCPELWKDTVLQKKYQGFIFQQLSNTGKKLCYASGEYIHIIGKHAKGIRFAGDGAKIISSNDNSGFTFRGRFADSNECISIGYESSQKAMNALSWLIREQGYNVNGRVFLAWGRYQQDLPSTFDNTVRLIQRRWNASSAIPITMREWSDSLKESIQGYRHAFKKPERSQVNVMVLDAATTGRLSICYYDEMAGEDFLKRIEKWHVVSAWWQRGCDEKKKKWYPHYYGVASPRKLISAYRGDNISDAQMKMELHRIFFSIIQGAPLPSDMERTAFQRVVKRAVCDPLEEWEHLILEPACSIISNRLNYKKEVYTVALNKEKTNRSYLFGRLLAVADQMERATFTKEEKGSRTTNAMRYMMKFSSRPSSTWKTLQEKLLPYQEKREKYGAKEKDLMDEIINTFHDEDFCSDAPLNVEFLLGLSCQRYAMKQDNKNEEN

SEQ ID NO: 3188 - protein, 581 aa, Neisseria polysaccharea ATCC 43768
MILHALTQYYQRKAESDGGVAPEGFENKEIPFIIVVDKQGKFIQLEDTRELKNKKKVARTFLVPKGLGRSGSKSYEVSNLLWDHYGYVLAYAGEKGQEQADKQHASFTAKVNELKQALPDDTGVTAVAAFLSSAEEKSKVMQAANWAECAKVKGCNLSFRLVDEAVDLVCQSRGVWEYVSQANQTQSDNVQKGICLVTGKPAPIARLHNAVKGVNAKPAPFASVNLSAFESYGKEQGFIFPVGEQAMFEYTTALNTLLASKNRFRIGDVTAVCWSAKRTLLEESLASLINGGGKDNPDEHIDAVKTLYKSLYNGQYQKPDGKEKFYLLGLSPNSARIVVRFWHETTVAALSESIAAWYDDLQMVRGENSPYPEYMPLPRLLGNLVLDGKMENLPSDLIAQITDAALNNRVLPVSLLQAALRRNKAEQKITYGRASLLKAYINRAIRAGRLKNMKELTMSLDRNRQDIGYVLGRLFAVLEKTQDEANPGLNATIADRYFGSASSTPIAVFGTLIRLSKHHLSKLNTEKYRGKRIFLEKLFQEIIGKIDNFPNHLDINHQVLFGIGYYHQKQDFFQSNSTETN

SEQ ID NO: 3189 - protein, 579 aa, Desulfonatronospira thiodismutans ASO3-1
MILQALNDYYERLRADPETEVSDFGFSQEKLAFSLVLSEQGSVVQLRDLRQFEGKRSFPKPAVVPKLPKERSGTNAPSYFMWDKSKYVLGCELDSDGNEIFFKNQFDSFAEVHREILGDNKDSGAKALLNFIDQRIFGQVPEWATKELLSTGFICFELDGQRGFLHERSAIRNAWQEYLRKNQSEIRGQCLITGQHDCSIPSTHPQMKNVPGAQPAGAALVSFNAPAFGSYGKGTSNHNAPVSERAAFGYTTALNVLLAPGSRRKVQLGETTVVFWTDIPGVAEEFFGLSVGVKEAEDHEMAQEVDQYLRAVVKGYYPHELGKRDTPFYVLGLSPNAARLSVRFWHVGTVGKMAENIGNHYKALRLQRSFENEPEYPRPWWLLKELAPQRDSRHIPPLLGGQFIRAIVHNQPYPRTLLTTVMGRIRADRQVNYLRACIIKAYLTRNAQKEISMGVDKENTNIGYRLGRLFAVVDYIQNDAAPGANVTVRDRFFGAAAATPRRIFPVILKNAQHSLAKIRKEKPGWAITLDKSVQTILGDVDPRKGFPATMTLEQQGMFVLGYYHQRQDLYTKQEDKTEE

SEQ ID NO: 3190 - protein, 654 aa, Peptoniphilus harei ACS-146-V-Sch2b
MSFLTALYNSYNFGLENNLIGDLNDKSNLILPIYHNSMKSNGKNIVEILINDKSELVDANFLDDGDLVIFPVTEDSVARSSGVAPHPLFDNFDYVIQDKTKKSESYIIQQESWLNSDRDDFVQIIHDYITKEKVFEDILSKLYKDYKITKDKVVEYVDNSEKKPKTVTVDFSKVFLTFAVENYDGKKNLSLSENKNLQEKFIRYTEESFARDKDSEKIICNISGKEDFLCLKHKPLIGSARLISQITANNENFLGRFDKPDETIKIGKESSQKIIQMAKALLSGENTSRWLGEFTYVLSWFSDDIQNKTEMDVTKKLEESIEESNKASSQNRQLFMLSEDDLKEISKETSMTIGDKTSEDIVRSFTSGRIRFNEDSKYYIAIIDKVSNGRVALKYFKEMDSSILKENLVKWQGKCNWPRYTKEIGRHLYTPSPFALIQTAYGVEREKGLEVSKKSFSTDQYKNIIMAIVEGRDMPQNIIRAMELNIRNRLSYDKSWQQVKLCALAILKDKEGIKSNMLDRKETDRSYLFGRLLALYERLEKLTYDMDNERVTNAEKLWTSYVNKPVTMNLRLRNLIRPYEDKLLNNESKRGIYFKIKRNIGEVTNLISENYDYKLKETNRPLGSGFIFGYEAQMADLFTKKEDKENLESEEKND

SEQ ID NO: 3191 - protein, 632 aa, Porphyromonas asaccharolytica PR426713P-I
MILQALYNYYEAMNKLQLIAPPGREYKAIAWAIIIKEDGSFVRLKPLKDTSDKNSNGKEYLVIPAVGRTSGIEANHLWDKKMYILGIDKGSKTKRSQDALNLFVKIVNSFAELYPENKSFKAVQQFYSKGIHKSPEVLESFKDVNETDWISFQLKGSTSIIASDNDALSWAEEQLSSGKITGLCLITGLEGPLVEKHTPIQLPDSKRGDGTPLVSFNQPAFCSYGRGVKDLDNAPISKYAAFAYATAFNSLCDNPSTHYDLGSIRYVFWNSDVLNESINNTFRDVTFVDHRNKQDEEEESTIEEDKPKQRNRSKDKALAPTQETHKLLEQFKAIRGNRGEGQHWKDERQFYIIGATGGGRGAIKYWQQGTVSEIFDKVYQHLVDMNIISWTGNVDEENPPLRSLYKIVSTVSPVSTSPSSQKFQLNLVQSIVESILNGTPYPLTLQQACIRRIPQILRQKPNKEKKEYKKRFDLCVAILKGCINRKARVYKHLKELDMALDKQNDNIAYLSGRLFAVFEQVQRAALGKGVNATIRDRFYASASTRPNTVMGPLFRLSNHHLSKLYKETPGLAVFFDKLLNEITELITTKEKAFPATFSLDEQSLFAVGYYHQKVYTYNKKEDADNPTEEIEQ

SEQ ID NO: 3192 - protein, 626 aa, Clostridium sp. HGF2
MSWASKLLETYDICQSEVGKESETGMLLPLSHLTTKAQIEVVLDENGKFIHAIEIPNDDAVTVIPVTEDSASRSSGITPHPLHDKLIYISKDYAEYTGKRNDPHVLAHQSLLKQWIDSSYTHSSIIPIYQYLEQGTLISDLISCDILKLNGEQLDKKYKIQKTVVQTEAFVRFKIRGIQKRIVEPWCDKMLFDAYHNFYTSQHTDEDLCYITGKMMYCTEKHPAKLRQGKDKAKLISTNDANGFTYRGRFVSKKEAISVGYETSQKIHNALRWLIQKQAYKQNGQTILVWNAHCDNIMTAFALDESLFPALPDKVDTEEDYAQRVNKAIDGYRQNISDHNDNIVIMAMDAATIGRFSITYYQEIDASTYYKHLQNWFTYCSWPQYSKADHMSDVMTPIPREIISCAYGTLRGAFFEVDDQLMTLQMGRLLPCISEGKPIPDDFIIRLNNQIKTMSTNTKYNWNKCIGILCAVFKKYCYDREGVNWSVNIMENKKLAKSNIPYLLGRILAIYDAIEQYALNIQKEDRPTNAMRLYAPFQEHPFVTLTTLDKKIRPYVEKLGRKCDYLLSMKQDLMEELYTEMDIEAVEHIQNLNAYFVIGFDCQRNEIKRINTERKEKNKQKEESKL

SEQ ID NO: 3193 - protein, 645 aa, Selenomonas sp. oral taxon 137 str. F0430
MSWMEQLVQTYNENEQFAGKVGAAGMKALLPPVGHIVQNALIEMTLSGDGRLIHAEVVSDKGQQPTLIPCTPDSASRTSSPSPHPLHDNLSYIARDYHSFVPAKKKDQKSAYEQYKELLSAWAQSEDTDPKVRAVYRYITEHDAIHDLIAKKVLYCNEKGEILQKWTDKEQEKPPIFKAAAGDVLKSMVRFRVELDGDDCPELWRDTNLQKKYRQFFAHHFSDMEQKLCYATGEMLPVTDKHGKGIRFAGDGAKIISSNDSQGFTFRGRFADADECLAIGYETSQKAMNALMWLIRSQGYVVDGRVFLAWGRHAQEIPSAFDDTARMTRRRRAAGAAPSMPVTMKDWAASMKRTLEGYRAEFKRAETSQVNVMILDAATPGRLSICYYSEMAGEDFIKRIEKWHSCGRWLQHGYDKETGKSYAYFGVPVPKRLVEACHGENIGDNQLKMELERIFCAIVQGQALPLDMAKMVLSRTVKRAAIDDYFGWHRRLLEPACSIICNRLNHMKEEYTVALDEEKKDRSYLFGRLLSVADQMERATFSREELASRTTNAMRYMEIFSVRPASTWMTLRKKLLPYEQKRERYGGKERKLIDKICWLFDDKDFSSDAPLDVKFLLGFSCQNYAMDLERKENRQKAEEKREENV

SEQ ID NO: 3194 - protein, 628 aa, Streptococcus pseudoporcinus SPIN 20026
MDFFTSLLKAYEGAEKEDYVDNPAKSGPVLLPIYHTSLKSNGKNVITVKLDCYGQLLSADFLGDKEVIVFPITSDSVARAGKNPTPHPLVDKFSYFVSKVNQDQYNTYHKQLDNWVTACEDGQVKDYLKLIQHAILQEDFSEKIINSLMSEPYQRNGLVLTYDLEAKKSKTMDLSACFLEFSIVDFIGYKTISVTNFTELHQAYIDYIESHQENLILCNISGRKEVLATKHRGLIGNAKLISVSNNNEAYKGRFKERNDVFSVGNQTSEKIHLMAKYFLENENTHTWLGSGQHLINWFSDDLINESQLTVTNPVTSLFNYEDDANNKTEFTVSQKDNDISNSFIRGVKKFSDASSYYAAILNKTNDGRIALKYFRQLQASQLLKNLEQWQACYSWERRRKDGTYNDYTPSLMQIILAAYGVDRERFIELDNDHFKSEQFQKLLTNLIDGKPLPSSIVKKLEENIKQRQKYSKHWYQVQQVSLGILHKQNGEELSPMLDHTNQNRSYLFGRLLAIFELIETLRYKLDNSDSGRITNAERYWTAYTGQPTKLMMLLENKIKPYEETLKLNSRGPWSKLNKEKEEIMQLLTPLLETESMEKPLDYQFIFGYYAEKKFYYTKQEIVTNEGEE

SEQ ID NO: 3195 - protein, 637 aa, Parascardovia denticolens DSM 10105 = JCM 12538
MSLWSNLIQTYDAIQSVAGQEEATDNGEEGVGNVLLPLNCTILKTQICVTIDSDGELIRIEKGAKPKQIVIPCSEQSSGRTSKPVPHPLCDQLQYLDREIGGEKVDLYLDQLSRWKADNVYLNAIYWYVLKHSISEDAKQYGTDLLEKDNKGRFKDEKTGVRFAVEVPGGGDPHVENSDEIRKLWRTYLKKNVDQNGRDMLGLPFVSQAANFPKNIVKTAANSKLVSANDNANFTFRGRFAGRDDALRIDADTSQLIHLTLKWLVNTHGTLTDTQAIVLWAVQTPNEKIVEPSANSLDAVEALLADDEGIHNIQDALVETDYDYARQFGGLLRGFGNPKVLSNHYKTIVLVILDAATSGRLGVTFYREFEESQYFEQLMQWHVDMAWPLSRFDKANQKVVTYIGAPSYRDIINSAYSVEGDRSSKNYQRFSRIVKQQLIECMFGNRRMPKAILESAFHRATRPMSFGPDNLKEWWRSFEVTCSLWKKSFIDDALQSSNPMSSERKEKMMQLDTSRKDRDYLYGRLLALADRFENNVLYKQGIQGTRPTNAVKLMSNFVAKPSTTWLTLYKQLVPYIGASNGAPYFQNDIDDVVALFDGDDFEDNSPLSPAFLLGFSCQRRYSMEKAKERKEAATVNS

SEQ ID NO: 3196 - protein, 600 aa, Pseudoramibacter alactolyticus ATCC 23263
MLINALCDYYQLLIQAGKLPKPGYTEIEITHTICLTPDGKIDRIIDNRREEVIANSKRKRAIIPGRSFPDMPTASAVKAIILDYRPVYIFGLFYDKAKGQFTSRPQKKNGKISDKEQKSHDAFVKMNLDIIDGLDSPVINAYRAFLQSWQPEVEIQNPALLGIAKEFNQSRFDFCLADDPIHTLQKDPLMIAKWEQMRQAPKANTMMGKDAVDGEEQVLARIHDKIKHIAGGQMSGTVLVGFNNASEESYGNKQSFNSGIGERTMKRYTAALNYLTANSNHKITIGETSVLFWAMTDDDRPVDLMTLLINAEAAHMSPEAADALIGQLFSDLREGAVSGERLSRNAGIDPSILFYIAGIKPNASRLSIKFMERQATGQMLAHVAKHQADLQIGPERQLIPLWRIARSMVPEKSSQAQPSPALVAKLFDAIVKGTPYPENLLATMIRRVKTERQVSHTRAAMIKACINRRMRMNNEKNEEVLQVALDTTNSSPAYVCGRFFAVLEKIQQDASGGKLNRTIKDAYFASASSNPAMVFPKLIKLSQSHLKKLGEGSRVYYQRLMTEIIALISGEFPKTQSLQDQGKFMIGYYHQNAKLYEKRQ

SEQ ID NO: 3197 - protein, 673 aa, Selenomonas artemidis F0399
MSWIEQLVQTYNENEQFAGRDGVTGMTALLPPVGHIVQNAQIEITVDVDGKLIHAEVVSDKWEQPTLIPCTPDSASRTFSPSPHPLHDNLSYIARDYHAFVPAKKKDQKSAYEQYKELLGAWARSEDADPKVRAVYRYITEHDAIHELIAKKVLYCNEKGEILQKWTDKEHEKPPIFKAAAGDLMKSMVRFRVELDGDDCPELWRDTALQKKYRQFFAHHFSDIEQKLCYATGKMLPVTDKHGKGIRFPGDGAKIISSNDSQGFTFRGRFADADECISIGYETSQKAMNALMWLIRNQGYLHKEEKGGEEKEREDEQKDSFNRVHSVGGRVFLAWGRYAKKIPSAFDDTARMMRGRRAADAASTIPVTMKDWATSMKRTLDGYRAEFKRAEKSQVNVMILDAATPGRLSICYYDEMAGEDFIERIEKWHTRGRWLQHSYDKAAEKPYTYFGVPIPKRLVEACYGENIGDNQLKMELERIFYAIVQGRVLPLDMMRIAFGRTVRRAALDEYYEWCRRQLEPSCSIICNRLNHVKEEYTVALDREQRDRSYLYGRLLAVADQIERSTFNTEDLKNGRTTNAMRYMDRFSVRPAATWGTLRKKLIPYERKIERYGGKERRLLNEITALFEDQDFSSNAPLDVKFLLGFSCQNYAMELARSAHKKKDGEKAAHQPDV

SEQ ID NO: 3198 - protein, 571 aa, Desulfovibrio desulfuricans ND132
MILQALNQYYDRLRADPEADVPEFGFGRQGVHFCLSLDRSGNLAGRPMDLRDEKGRPDRIEVPGPVVRTVGVASNFAWDNTGYVLGDDGGDNPERTARTHAAFKSLADEVLDGVDDEGARALLAFLADWDPARAQELPGWEDMVGLNVVFMLDGEPGFLHDRPAFRQAWREHLAANDEFETGRCLVTGEVGPIPPTHAKIKGVPGAQTAGASLISFNIDAAESYGKKQNLNSPVLERAAFGYATALNHLLAPDSPRKVQVGETTVVFWSDAPGEAEPFFGHAMGGKRAEDDGLTARLEGYLSAVARGKYPEALGRAETPFYVLGLSPNAARLSVRFWHVGTVGEMAENVGEHYRTLALQRRFDSEPEHPSPWQLLKELAPQRDAKNMSPLLFGQLVRSVVQGLPYPQTLLSAAIGRIRADKEVNYLRAAMIKAFLVRNRKQEIPMTLDTTNTNIGYRLGRLFAIVERIQEEAVPGANATVKDRFFASAAATPARIFPIIVKNAQHGLAKIRKDKPGWAVNLDKAIQEIVGGIDAATGFPASMASEKQGMFILGYYQQRQDFYTKKEKNTED

SEQ ID NO: 3199 - protein, 867 aa, Clostridium symbiosum WAL-14673
MSWMQKLCEAYDAGIVCDQSKESVRLVPLGFVRKKVKYHVVLSQDGQFVSADELMDENQFLEIPSTPQAESRTGDNGTPFPLVEQLKYLIFEDENSKRFSQYMEQLRAWCGQPDAPDCLRVVYTYLDGHTLLTDLESQPNLKVKYYKNAERREGTGEDAKAMVCFSVQMQDESADDLWLRADVKQSWERFLADKLPGARAFCYVEGKMLPAMENHPKLQGNAKLISAKDSEFPFQYKGRFVEDRSAAVISFDASVRAHNALIWLIARQGMQKYGMTWVVWNTNGAVMKAPIDEKNGFMDDEEEEEDSEPIIDTFESYAREVRAAARGYGGRLHDYNKQRTDFAVILGLEAATDGRMSVTYYQECSGNEYVKRLEEWYTDCCWWSYSWKKKTKEIASPGPEQIAVAVMGPDAVNVAKRDKKCEKSHTKLMRKLHSRILVCIADRQPFPIDVVLSAFYRVCAPLAFVSGKDRQWSRTAWETSVDTACAMISCFQKRSRGEICEIFPPELQAESKRRDYLYGRLFAVADFMEEKSTDKGRDYPTNAIRLMCQFVKRPFETWPKIHEKLVPCFKSLGPDSKRYQILFAKIEGQFTEEDRYERGELSLEFLQGLSSQRQMLFQKWEPTEKKEDGGGVPYKLPRRRSELYGCLLAIADVAEQEASEGERTGMTNAMQMMQVFAARPYESWGRLHDKLQPYLEKLGKKADYYQRLIGFVEMQFSQADRETAVPLDAGYLHGYYCMRQTFYQKTQFSREPQEWEEAGDRRSALYGRQLGIADRIERRRFIREAEDIDRRSTNELRFMPVFARKPAATWENLKVKLKPYLRYAENLSGEDLATLEQLEAQLQQNGWNTDIPLGSVYLHYYYEERNR

SEQ ID NO: 3200 - protein, 576 aa, Clostridium sp. D5
MILQALVKHYETLADEDKVTRQGWCHAKVSFGINLSKDGDIKGIIPLKREDERGKKTVWLPSQIKVPEMVARSSGVSANFLCDNSKYLLGIDAEGTSQRVLNCFQAAKEKHLSLLANVHNEMAEAVKRYFEKWKPENAADNQELQEVWDEITEGGNLIFCMSGDYAQDDCEIKKVWEQALEAGSEQVTGTCLVTGEKAEISRIHNTIKGVPGAQSSGAALVSFNAPAFESYGKEQSYNAPVGKYAAFAYTTALNYLLAQRNYTFQFGDTMVVFWAEDGEEVYQDLFCWSVDPKPDNQETIRGIFDAVKKQEAIDIGGIKLNTEQDFYILGLAPNAARLAVRFFYQNSFGNILKNIARHYERMKIVRPSWEEREYLGIGQMLQETVNQKSKDKKPVPNMAALVLQAVLSGGRYPANLYSNTMIRIRAEQGKVTWGRAAIVKAYLIRNCAWGKGDEFMGLNEESNDAAYVLGRIFSVLEAVQEEANPGINATIRDRYFNAACTTPESVFPILMKLKNSHIKKIDRTKEAAKVYYEKLLTTLMGKLDQYPKRLTLEEQGRFMLGYYHQVQKRYEKREDK

SEQ ID NO: 3201 - protein, 639 aa, Ruminococcus albus 8
MGWTNELLEVYEKVSDPNRTRAAGEPVMLPVSHSTANAQIELTVDENGNFKDAYAVSKENSVTVIPVTEDSGARSSGITPMPFADKLVYIAGDYGKFAEGKRADNSGYFSAYMEQLRNWCESDYSCPEVCAVYKYLEKGELMNDLVNKGVLEVGAETGRLTDKKINGIAGQDAFVRFKVSGANGVCETWKSKAIQDSFIKFNSRVMGGTGLCYATGEESALTYKHPSKIRNSGDKAKLISSNDESGYTYRGRFSNKEEAFAVSYDYSQKVHNALKWLVENERVTKTDEKGKTVTYNPLSFDSLTLVVWNSALGFVPSITESAGDMFGDNWDMFGNEEEGYSAKKVFAELLHEKLMGGKVEFDDESKVMIMGLDAATTGRLSIAVYTELAESQFAEALEKWHNETLWLRFDGKLKKSLYNSCSLPQIANCLYGTEQSGRLECDKKVLKDTILRLLPCVTEKRSLPRDIVRILYNRASSPQSFEKDYVHRIILENACALIRKAQLDSGNTHYYKGEINMAYDPNCNDRSYLFGCLLAIADKAESDTYDESEKRVTNARRLWSAFAARPCQTWKIIEERLEPYLEKDQRKMTRYTKAINDIMGRMSPEEFSDNSKLSPMYLIGFHHYNALLWGAKAENKEEE

SEQ ID NO: 3202 - protein, 624 aa, Kingella denitrificans ATCC 33394
MILASLARYYRRLAAENDEMGSPKVPPYGFSEEKIGWILVLDKEGRLKDVIPHLSEDKKPQPKYMSVPKVGGSDSNSIKPKFLWGNSQYILGITAKETKDPSRTTRCYNSFRSYHLGLLKDSQDEGLLALRKFLETWQPDMFQNQPCKKEILDTNMVFKLSGTSGYIHQRKDALKLWIQEIENEEITDGFCLISGEQLKIAEKHPVIKGVNGGKAEQMIVSFNKEAFASFGKEQGANAPVSEQSAFAYTTALNYLLRRENNHCLTIGDASTVFWAEADDNATAQAAEGFFAQVFMPPNDEQESVKIFNVLEQIGKGCPLQEIAPELSPNTRFYILGLAPNAARISVRFWLDTTFGQLAENLAQHWKDLHIEPSAWKKGKEPPVWRILLETTPKRKDAEGRLKKSESKDIPPQLAGEYMRSVLTGRFYPKTMLTRMIGRIRSDGYISGLRVAVIKAVINRNSLYREELKMGLNEETHDIPYRLGRLFAIIELAQSSALGELNAGVRDKFYGGASSSPHSTFPLLLDNYRTHISALRKGRKAKWVKGDPKKLANWLEGKVGEIIGVFDAETPFPRHLSLEEQGRFVVGYYQQRFKKYNKQEDGNIPEDIEQANYLADEADSENEEN

SEQ ID NO: 3203 - protein, 635 aa, Lachnospiraceae bacterium 6_1_37FAA
MSWPNELYQVYENNWGKDDEKVLLLPIYHSTVNAQVEVTLSEDGEFYSAVPVMDKKDSVTVIPVTEDSGARSSGITPHPFADKLIYIAGDYKEFVSGKHTENEKYYQAYLDQLRKWNDSQNSHPAVRAVYIYLCKRRLMHDLIGGRCLKIDEKTGKLSQNNKILGISQEEVFVRFRVNYKDVLGRESRTWKDFSLYESFILYQSENQDRLQLCYATGKNTSCTYKHPSKIRNAGDKAKLISSNDERGFSYRGRFDSKEQALSVGYEFSQKMHNALKWLIEKQGIAIGSMIVLTWASNMQTLPDIIGNPEDDLEDEWDMLEENESDDIKSTLVSDTMPLYRERLRKAVWGAKKQNEIKSQIDHREKAMIMVLDAATTGRVSIGMYEELGISEFYQNVERWHFETAWNCFSGKARKNEIRSFSLYEIADYAYGTEQGDFIKCKPEVRNQAILKLIPCVITGRRIPKEIVRNLFHKACKPTVYQNCYNWRKVLEAACGMIRKLMIEEKKARGEKEEYEMALDYECADRDYLYGRLLAVAEIAERVTYKKEEARTTNASRYFEAFSNRPYQIWGIIYKRLIPYLNGMPYTQKQYYENLISEIENQFTIADFENNSKLKPLFLLGYHCQLKNMSSKKSVS

SEQ ID NO: 3204 - protein, 594 aa, Eggerthella sp. HGA1
MILQALVGFYEQLAKEHPEKIARVGWCSRQVAFMLVLSSEGELVNVIPSDEKRGWTMMVPEQVKRTVGVAANLLCDNATYLLGIDAKGKPERARQCFEAARERHLAFLQGVGSPSAAAIRRFFETWNPEDALSRVAVTDAGEALLAGGNLVFRVDGKNALDDPAIRSAWEKACEKPSEGAAVMTCLVSGKQAPIARLHPAIKGVVGAQAMGASLVGFNARAFESYGHDEEQGLNAPVSEYATFAYSTALNYLLSDRKHHMRIGDTTVVYWADKHDQACVDIMSDFLNPQTGGGDDKDNESGKGDPDRVIDAVMQRLAQGLPIGEVDPDANFYVLGLAPNAARLSVRFFQRDTFGAMLDNLYQHYERLDIARAPYEKKYLVPYRLLVETENPNAKQPAATSLLGGALLRSILGNQRYPEALFEQTILRVRATQDNEERRTRKVTRGRAAIIKAYLIKNCNRSEEEVTVGLNEERSDAPYVLGRLFSVLESIQEAASPGLNSTIKNKYYDSASATPSVIFPIVIGLCDKHLTKLSRDSKGLAVHYEKMRGELLGKLDAFPKRLSLEEQGDFILGYYHQNQKRFEKRDAESDQIQEA

SEQ ID NO: 3205 - protein, 646 aa, Ruminiclostridium papyrosolvens DSM 2782
MGWINKLYDTYENCISEVGKPRTDGKTPLLPVAHSTQNAQIEVVIDIKGIFRRARILEKEEQVTIIPVTEDSATRSGKYPPPHPLCDKLQYVAGDFSENVEKEKGEDFFNKYIEQLEDWCSSVHKNKKVCAVFEYLKKKKLIKDLAEHKVLSCDDSGNLTKDIKLGTVSQIDAFIRFRVEDTENPSSETAVWLDNEIYKSYIEYYLNKEKSTDLCYVKGEGIPYSEKHPSKVRNSGDKAKLISANDESGFTYRGRFGDKKQAVIVSYEVSQKAHNAIRWLIDIQGYRFGNPKDGEEVIVAWGTNKQKVPPLLVDTDDIFGEEEDSLPIVSTHKEYAQRLNKAIAGYGCEIDSNTDIVIIGLNSATTGRLSITYYKELNGLDFLNRIEKWHNTCSWRHSYKRIQDGTDEKGKNKYKTIDFIGAPAPKEIIRIAFGVERNERLEVDDKLMKSTIERLLPCIIDGARLPYNIVNSAVNRASNPISMNSFNWEKTLSIACSLVKKYRNDKYEKEEWDMALDENQNDRSYLFGRLLAIAQEIESWAISTTGEKRDTNAERLMHQFKLHPYKTWGIITNKLRPYITRLGDKGKKNIELMTKVNSMIPYEDFISSESLKDSYILGYYCQRQVFIDEMNRRVAEKKEKKLENIN

SEQ ID NO: 3206 - protein, 576 aa, Rubrivivax benzoatilyticus JA2 = ATCC BAA-35
MILQALHAYYERKMRDPDPSRRLPALGLEDKEIPFILELAPDGKLLGITDTRTQQGKKKVARKFLVPQSVKKTSGVAANLLWDSAEYVLGLDTKGKPGRVAEQVAAFRQRVDALERVAPGDAGLVAVQRFLAGEPLLAAQTMPYWEEIAASNPYLTFRLTSDADLVCQRDAVTSAIRALELPEAPPDGAMTCLITGAVAQPERLHIAIKNVWGAQTSGANIVSFNQDAFRSFGKDQGANAPVSPGAAFAYATALNHLLAKGSSQRMQVGDASTVFWAQSEADSDVEDGFAALFSDLKDDPDAHTSQVRALFESIRSGRFDGAAGDRRFFVLGLAPNAARLAIRFWHAEALRDVAQRVQRWFDDLEMVRGPHDPQYPSLFRLLTAVAIQGKAENVPPTLGGDVMRAILTGGPYPAALLNAAVQRWRAERGSPAEVHRLSYLRAAVIKACLSRSHERSPKEVPTAMLDKLNPNAAYRLGRLFAVLEKIQEEASPGLNTTIRERYYGAASSTPLAVFTTLLRLKNHHLAKLVNRGRATNFEKLIGEITGDISDFPPHLNLPDQGRFALGYYHQRQDFFI

SEQ ID NO: 3207 - protein, 443 aa, Lachnospiraceae bacterium 2_1_58FAA
MEHPEIRDNWEEITDGSNLIFGMDMDYAQDDTEVKVAWDSHNSGESKDVQGICLVTGERAEIARIHRGIKGVPGAQSSGAALVSFNAPAFESYGKEQSYNAPVGTYGEFAYTTALNYLLSNRTYSLQIGDTMVVFWAESAETDYQAVFMGCMDSPTDNQEELKSLFERIRLGQPVIYQGNELDPEQRFYVLGLAPNAARLSVRFFYENSFGNILKNIFAHYKRMELIRPKWEQKEYLSVREMLFETVNKKSTDKKPVSNMAAMTFRAILSGSRYPERLYSDTLIRIRAEQDEGKLNWRRIAIIKAYLMRNRNWEKGEDYMGLNEESNDIAYVLGRLFFVLEAIQIEANPDIQATIRDRYYNSACGTPASVFPILIKLKNSHLKKIGREKDGAKKYYEKLLAELMWKIDCQKGFPKRLSLEEQGMFAIGYYHQKQKKYEKREEK

SEQ ID NO: 3208 - protein, 575 aa, Acetonema longum DSM 6540
MILQALKEYYDRKASDPESDIAPEGWEKKEIPFIIVLDHAGNLMQIEDTREGEGKKKRAKAFLVPQAEKKTSGIAANLLWENAGYVLGIATKGNNERAIKQKNAFIDRLTNELGDIKVVQAVIAFLTNVTEERLSQEECWQEISASNPNLSFRMSADSFLICRHPDVVSRLSSTSQSSNDISGTCLVTGKNARIKVLHTSIKGVYGAQTAGANIVSFNLDAFKSYGKEQGFNAPVGAEAEFSYTTAINTLLGRDSKQRLLIGDASTVFWSKKQSSFESEFSSFFEEPEKDNPDAGTQNVKALFESIHSGAYREDDGKTPFYILGLAPNAARIAVRFWQIGTIAEIAVRIHQYFKDFAIVKPPREPEYYSIWRILVNIATQDKSENIPPNLAGDFMRSILTGMPYPATLLQAVLRRIRSDTENRVKPVRAALIKAYLNRYYQFYPDQNQREVQMELDISQPSIGYQLGRLFATLEKIQEEANPGINATIRERFYGAACATPVTVFTNLLRLKNHHLAKLDNKGRVVNFERLLGEIIGNLKDFPAQLDLHEQGRFAIGYYHQRQDFFTSKGVAESDK

SEQ ID NO: 3209 - protein, 587 aa, Prevotella dentalis DSM 3688; identical to SEQ ID NO: 3073

SEQ ID NO: 3210 - protein, 594 aa, Neisseria macacae ATCC 33926
MILASLARYYRRLAAENDEMGNPKVPPYGFSEEKIGWILVLDKEGRLKTVVPNLTADKKPQPKLMSVPQSFKRPGTTPKPFFLWDKTSYALGVEANKNKAEAKEKPFTSSEKTFDAFKQYHLDLLQNSEDEGLQALCRFLQNWQPAHFAAENLPAEMLDANIAFSLEKPTALIHKREAAQTLWAGCLKSDEALEGLCLISGDTAPIARLHPAIKGVFGGQSSGGSIISFNKEAFASFGKEQGANAPVSEQSAFAYTTALNYLLRRENNHCLTIGDASTVFWAEADDSATAQAAEGFFAQVFTPPDDEQESAKVFNVLKQISNKGRPLQEIAPELSPNTRFYILGLAPNAARISVRFWLDTTFGQLAENLAQHWQDLALEPCAWKTPPSIWRLLLQTAVLGKSENISPVLAGEMTRAVICGTQYPLSLLSQLITRIRADGDVNGLRVAMMKAVLERRFRKGFIEEGVPMSLNNESPNRAYLLGRLFAVLERIQYQALGELNAGIADRYYGSASAVPFSVFPRLLSGAKHHLSRLRKDKAGMAVNLDKDLGEIIAKLPETFPRHLSIDEQGRFAIGYYHQKQSYFAKKETAETIEN

SEQ ID NO: 3211 - protein, 663 aa, Haemophilus haemolyticus M21127
MSCMQKLYWTYENILEQCVTDDAEPLTPVGHTIQNAHIIIVIDGQGNFQTARVMPPKTAILLPATESSENRTSGEAPHPLADKIQYVAKDYVDYGGEKKAYFDGYLKQLKAWCESPFAHPKVQAVLNYVAKGRVVADLVEAGIFQLGSGNKVLNKWEAEGDAPSIFSALPKTKGEIEFGSALVCWQVEIAGDVHSQTWTDKTIQQSWADYAASEKAEKGFCLVQGEEAVISTMHPAKLRHTGDKAKLISSNDTGGYTFRGRFATAEEAASVSADVSAKAHSALRWLISRQGIRNGDQVTVSWAISGKPVPSPMKDISSEIDWDNLDISAVGNPDEIAKQTSSENSEPSPDWSANIGRAAAQIIKKKLHGYQAELKAHEQISLIMLDSATPGRMALTYYQEFLPADYFANLDAWIDDFSWYQRYSIEVPNGKKTDKRTQWRFLPPSPYSIADAVYGKSLSDTLKKQLYARLLPVIAGGTSMPIPDDLVHQSFQAACNPNRCENWEWQRNIGVACALYKGWRARHHDLSQRRIYPMSLDTQNRSRDYLYGRLLAVAENTESYALYLAGEKRATTAERYMQRFAEHPFATWRNIELALKPYQERLRNNGKDTGAQAIGEIMELFAIDDFTCDDKLSGEFLLGYHCQKMEIARRITELSANKSKIHE

SEQ ID NO: 3212 - protein, 585 aa, Haemophilus haemolyticus M19107
MILHALTQYYQRKAKSDGGVAPEGFENKEIPFIIVIDKQGKFIQLEDTRELKNKKKVARTFLVPKGLGRSGSKSYEVSNLLWDHYGYVLAYAGEKGQEQADKQHASFTANVNELKQALPDDAGVAAVAAFLASAEEKSKVMQAANWAECAKVKGCNLSFRLVDEAVDLVCQSKAVQAYVSQANQAQSDNIPKGICLVTGKPEPIARLHNAVKGVNAKPAPFTSVNLSAFESYGKEQGFIFPVGEQAMFEYTTALNTLLAGENRFRIGDVTAICWSAKPTPLEEHLASLINGGGKDNPDAHIDAVKSLYKSLYNGKYTEPDGKEKFYLLGLSPNSARIVVRFWHETTVDALSESIAAWYDDLQMVRGENSPYPEYMSLPRLLGNLVLDGKMENLPSDLIAQITDAALNNRVLSVSLLQAALRRNKAEQKITYGRASLLKAYINRAIRAGRLKNMKELTMSLDRNRQDIGYVLGRLFAVLEKTQAEANPGLNATIADRYFGSASSTPIAVFGTLMRLLPHHLNKLEFEGRAVQLQWEIRQILEHCQRFPNHLNLEQQGLFAIGYYHETQFLFTKDALKNLFNEAKTA

SEQ ID NO: 3213 - protein, 592 aa, Haemophilus haemolyticus M21639
MILASLARYYRRLAAENDEMGNPKVPPYGFSEEKIGWILVLDKEGRLKTVVPNLTVDKKPQPKLMSVPRPEKRTSGIKPNFLWDKTVYALGVEANKNKAEAKEKPFTPSEKTFEAFKQYHLDLLQENDDEGLQALCRFLQNWQPAHFTVENLPAEMLDTNIAFSLEKPTALIHKREAAQTLWAGCLKSDEAFEGLCLISGDTAPIARLHPAIKGVFGGQSSGSSIISFNKEAFASFGKEQGANAPVSEQSAFAYTTALNYLLRRENNHCLTIGDASTVFWAEADDNATAQAAEGFFAQVFTPPDDEQESSKVFNVLEQVGKGRPLQEIAPELSPNTRFYILGLAPNAARISIRFWLDTAFGQLAENLEQHWQDLTLEPCAWKTTPSIWRLLLQTAVLGKSENISPVLAGEMTRAVICGTPYPLSLLSQLITRIRADGDVNGLRVAMMKAVLQRRFRKGFIEEGVPMSLNNESPNRAYLLGRLFAVLERIQYQALGELNTGIADRYYGSASAVPFSVFPRLLSGAKHHLSRLRKDKVGMAVNLDKDLGEIIAKLPETFPRHLSIVEQGRFAIGYYHQKQSYFAKKETAETIEN

SEQ ID NO: 3214 - protein, 592 aa, Haemophilus haemolyticus M21621
MILASLARYYRRLAAENDEMGNPKVPPYGFSEEKIGWILVLDKEGRLKTVVPNLTVDKKPQPKLMSVPRPEKRTSGIKPNFLWDKTAYALGVEANKNKAEAKEKPFTPSEKTFEAFKQYHLDLLQNSEDEGLQALCRFLRNWLPENFAAEKLPVEMLDANITFSLEKPTALIHKREAAQTLCAGCLKSDEALEGLCLISGDTAPIARLHPAIKGVFGGQSSGGSIISFNKEAFASFGKEQGANAPVSEQSAFAYTTALNYLLRRENNHCLTIGDASTVFWAEADDNATAQAAEGFFAQVFTPPDDEQESAKVFNVLEQIGKGRPLQEIAPELSPNTRFYILGLAPNAARISVRFWLDTTFGQLAENLAQHWQDLALEPCAWKTPPSIWRLLLQTAVLGKSENISPVLAGEMTRAVICGTPYPLSLLSQLITRTRADGDVNGLRVAMMKAVLERRFRKGFIEEGVPMSLNNESPNRAYLLGRLFAVLERIQYQALGELNAGIADRYYGSASAVPFSVFPRLLSGAKHHLSRLRKDKAGMAVNLDKDLGEIIAKLPETFPRHLSIDEQGRFAIGYYHQKQSYFAKKETAETIEN

SEQ ID NO: 3215 - protein, 605 aa, Thiorhodococcus drewsii AZ1
MILQSLHALYDRLVEDPAYKVAPSGYSLQKISFEIVLALDGALIQIDDVRDHSGKKPIPIQRLVPGQSKSSGSGLNPCFLWDNAAYLLGYKADDPNLSADKRNHLRARAEKSQAAFRDRHLQVEQNIEDPGFSAICRFIEQWHPKHCREHPILAELGIGFGVFRIQGETCYVHQRRKISAWWQGQQQQNNADDSQHGMCLITGMMEPLAQLHEPAIKGISGAQSSGAKIVSFNCDAFSSYGKDKSWNSPVSESAAFKYCTALNSILSGPKSDKHRLHIGDTTAVFWTEQPTLIEDLLANLLGGDLPESTQDASALARIKALLHALREGSAGNLSNLGDDPETPFYLLGLAPNAARLSVRFWHVSTLRELFDRLHSHYEALRIVPQFGKDAKHPEREFPPIWMLLNETARESKDVPPLLGGALMRAIMTGSAYPNALASAVIGRIRADREINYYRAAILKAWLTRLPRQRQGEIPVSLDPDKPEPAYRLGRLFAVLEKTQQDALGSINATIRDRFYSAASATPGVVFPRLLRTYQHHLGKLNPGAKINRERLVQDIVAGLAAMPTHLGLQDQGLFAIGYYHQRKDLFTGRTTKNQTAPATQRTNPD

SEQ ID NO: 3216 - protein, 627 aa, Neisseria weaveri ATCC 51223
MILTSLARYYRRLATENDVAGNPKVPPYGFSEEKIGWVLVLDSDGLLVDVVPHLTGDKKPQPRLMSVPRPEKRTSGVKPNFLWDKTAYALGVEANKDKATAKEQPFVPSEKTFAAFRELHLEALKDTQDEGLLALRRFLERWQPEQFAHPPCLPDMLDANVVFRLDGTRGYIHQREAAQALWAGRLKNDEAEQGLCLVSGEQAPIARLHPAIKGVFGGQSSGGSIISFNKESFTSFGKEQGANAPVSEVSAFAYTTALNYLLRRENGHCLTIGDASTVFWAEAATPEQAEAAEGFFAAAMTPPDDEQENQKIFDILEQVVKGRPLREIDPNLDDQTRFYILGLAPNASRISIRFWLDTTFGKLAENIKKHRDDLSINPPAWGAKPPSVWQILLETTPKRKGADGRLKKSESKDIPPQLAGEYMRAILTGRHYPQTMLSRMISRIRSDGFISGLRVAVIKSVLKRNNLCKEEFDMGLNEETQDIPYRLGRLFAIIELAQSSALGELNAGVRDKFYGGASSSPHSTFPLLLDNYRTHISGLRKGKKAKWVTGDSKKLANWLENKVGEIVSVFDAETPFPRHLSLEEQGRFVIGYYQQRFKKYSKQEGGDVPEDIELANHLKTESDSEDE

SEQ ID NO: 3217 - protein, 627 aa, Neisseria weaveri LMG 5135
MILTSLARYYRRLATENDVAGNPKVPPYGFSEEKIGWVLVLDSDGLLVDVVPHLTGDKKPQPRLMSVPRPEKRTSGVKPNFLWDKTAYALGVEANKDKATAKEQPFVPSEKTFAAFRELHLEALKDTQDEGLLALRRFLERWQPEQFAHPPCLPDMLDANVVFRLDGTRGYIHQREAAQALWAGRLKNDEAEQGLCLVSGEQAPIARLHPAIKGVFGGQSSGGSIISFNKESFTSFGKEQGANAPVSEVSAFAYTTALNYLLRRENGHCLTIGDASTVFWAEAATPEQAEAAEGFFAAAMTPPDDEQENQKIFDVLAQVVKGRPLREIDPNLDDQTRFYILGLAPNASRISIRFWLDTTFGKLAENIKKHRDDLSINPPVWGAKPPSVWRILLETTPKRKGADGRLKKSESKDIPPQLAGEYMRAILTGRHYPQTMLSRMIGRIRSDGFISGLRVAVIKSVLKRNNLCKEEFDMGLNEETQDIPYRLGRLFAIIELAQSSALGELNAGVRDKFYGGASSSPHSTFPLLLDNYRTHISGLRKGKKAKWVTGDSKKLANWLENKVGEIVSVFDAETPFPRHLSLEEQGRFVIGYYQQRFKKYSKQEGGDVPEDIELANHLKTESDSEDE

SEQ ID NO: 3218 - protein, 578 aa, Desulfovibrio sp. 6_1_46AFAA
MILSQLAAFYQRMLEETDAELPRPGYSRELIGFVLVLTPEGELRHILPRLDDKGKARPMLVPAPRKQPGSGISPNLFWDNTGYLLGVDNKGKAERSAKTFAAFRQAHAALARDTGNARLEAVAAFLEAWRPEMFAGLDIGDLILDKNGIFQIEGDQGFLHEQPDIRTIWEEQRRPSGENGLTGVCLVTGKSAPIARIHPPIKGVSGANPTGAALVSFNCDAFESYGKNQSYNAPVSSEAAEAYTAALNFLLRKDSGHCLRLGSTSLVFWTEQPGPAEKIFASCLFYEDGEAVECGADTAEDRELLGRARAVLRAARDGKKPADSDLAALREAETRFFLLGLKPNQARLGVNLWQISSFGQLLNNLSRHYRDLALAPQYAGDPPLPPLWMLLRELAPQGKTENIPASLGDALSRAVLSGGRYPENLPAIVLQRIRADKKISYLRTALLKAFLLRNHPSQGAWTMELDDNRKDTPYLLGRLFALLEKTQSDAVGAVGASIKDRYIGAASTTPLLVFPQLLRLAQHHIGKAGYGKYNEDKIAGVMRGIDVFPPHLTLPEQGDFFIGYYHQRVANYQKKEKE

SEQ ID NO: 3219 - protein, 528 aa, endosymbiont of Tevnia jerichonana (vent Tica)
MIEAAVLFVDEEGLLLEQWEGEGEIPKIFKVLPKTKKLTDQGTALVTWSVEIAGDAHANTCDDQSLQQSWINYETSRGGLEGLCFISGERQSVAYSHPAKLRHSGDNAKLISANDLTGFTFRGRFTDTKKSIEQQGNQAASIGFMPTQKAHNALRWLIARQGFHNGEQRYVTWAVSGKPIPKPTESSWNLMSEELVLEDELPLSEADNAPDHTRNLGAAFAGQLNKYMAGYRARLNPTEDIVVMGIDSATPGRMSVIYYRELIASEFLDRLTRWHSEFAWHQRHKRELPASGNRKPKTETIWPICSPAPRNIAETAYGVTLTDELKKSVVERIMPCIIDAAPFPHDLLDSCVRRVSNRVSYKSDDFWRWQQDLGITCALYRGYFMRHPKPNLRKEYSMSLEENNHSRDYLYGRLLAIAECIEEIALSVGGENRTTTVARLMQRFADRPYSTWRNIELALLPYMQRLQVSRTEFLVDIKRELDRVLAAFATDDFTSERPLSGEFLLAYHCQRLEFPNKQTQSDSNKESN

SEQ ID NO: 3220 - protein, 611 aa, Candidatus Arthromitus sp. SFB-mouse-NYU; identical to SEQ ID NO: 3104

SEQ ID NO: 3221 - protein, 626 aa, Erysipelotrichaceae bacterium 2_2_44A
MSWASKLLETYDICQSEVGEESETGMLLPLSHLTTKAQIEVVLDENGKFIHAIEIPNDDAVTVIPVTEDSASRSSGITPHPLHDKLIYISKDYAEYTGKRNDPHVLAHQNLLRQWVDSSYTHTSLVPIYQYLEQGTLLFDLISCDILKLDGEQLDKKYKIQKTVVQTEAFVRFKIRGKQKRIVEPWCDKMLFDAYHNFYTSQHTDEDLCYITGKMMYCTEKHPAKLRQGKDKAKLISTNDANGFTYRGRFVSKKEAISIGYETSQKIHNALRWLIQKQAYKQNGQTILVWNAHCDNIMTAFALDESLFPALPDKVDTEEDFAQRVNKAIDGYRKNISDHNDNIVIMAMDAATIGRFSITYYQEIDASTYYKHLQNWFTYCSWPQYSKADYMSDVMTPIPREIISCAYGTLRGAFFEVDDQLMTLQMGRLLPCISEGKPIPDDFIIRLNNQIKTMSTNTKYNWNKCIGILCAVFKKYCYDREGVNWSVNIMENKKLAKSNIPYLLGRILAIYDAIEQYALNIQKEDRPTNAMRLYAPFQEHPFVTLTTIDKKIRPYVEKLGRKCDYLLSMKQDLMEELYTEMDIEAVEHIQNLNAYFVIGFDCQRNEIKRINTERKEKNKQKEESKL

SEQ ID NO: 3222 - protein, 677 aa, Aggregatibacter actinomycetemcomitans serotype d str. I63B
MSWMQKLCRTYEYVQEQGLEDEDLALPFHMSKAVHLKVILNNKAELVGVERFEGKKQVPIQVTEKSSKRAGSTIAPYALHDGLQYIAKTAKEYLTIEYLSKVAEKENGKKWKNFLAGTDEDKRNFADTEKTRYKTSFKAYEEQLSAWAEASHLQEIKIVLQYIQKGSLIEDLLEKKVFTLENNILLAGKDDPFNFTIVWAVEIPNDLHSNLWSKSSIKEQWIKYQESQSGQEDEKPELCYITGESSYLANAYPKIEGNAKLVSANDTDGFTFLGRFLIDKQAAALGREVSQKAFNMLKWLIKRQGIRNGDQVTVAWAISGKAVPSPMKDLSDEIDWDNLDISADESAVENSDRFSSPTSSETPDWSTNIGKPAAQIIKKKLHGYQEELKNHEQISLIMLDSATPGRMALTYYQEFLPADYFANLDAWVDDFSWYQRYSVGVQNGKKTDKRTQWRGVPPSPYSVADAVYGKSLSDTLKKQLYARLLPVIAGGKSVPIPDDLMQKSFQVACNPNGSENWEWQRNIGVACALYKGWRARHHDLSERRTYSMALDKENRSRDYLYGRLLAVAENTESYALYLVGEKRATTAERYMQRFAEHPFATWRNIELALKPYQDRLRNNGKDTGAQAIGEIMDLFENQDFSSDDKLSGEFLLGYHCQKMDIARRIAEISANKSKTDE

SEQ ID NO: 3223 - protein, 221 aa, Aggregatibacter actinomycetemcomitans serotype e str. SC1083
MGTAPEGFENKEIPFIIVIDKQGKFIQLEDTREQERKKKIGRKFLIPKDQHTTGKNAYKVSNILWDHYGYVLAFPKEVEGISKKTPEEIEAEKKKNYILANNQHISFIAKVDELKQALPDDTGISAVAAFLASSEEKHKVMQSKNWAECSKIKGCNLSFRLAEETAALVCQSQVVQDYLRQTNQDNSDNAPKGICLVTGKPASIARLHNAITRSHLRVAVC

SEQ ID NO: 3224 - protein, 592 aa, Aggregatibacter actinomycetemcomitans serotype e str. SC1083
MILASLARYYYRLAAENDEVGNPKVPPYGFSEEKIGWILVLDKEGRLKTAVPHLTADKKPQPKLMSVPRPEKRTSGVKPNFLWDKTAYTLGVEANKNKAEAKEEPFTSSEKTFAAFQQYHLELLQNSEDEGLQALFLFLQNWLPENFAAANLPSEILDANIAFSLEKPTALIHKRDAAQILWAGRLKSDEAVEGLCLISGENAPIARLHPAIKGVFGGQSSGGSIISFNQEAFASFGKEQGANAPVSEQSAFAYTTALNYLLRRENGHCLTIGDASTVFWVEAANNATAQAAEGFFAQVFTPPDDKQESTKIFNVLEQIAKGRPLRDIAPELSPDTRFYILGLAPNAARISIRFLLDTTFGQLAGNLAQHWQDLAIEPRAWKTPPSIWRLLLQTAVLGKSENISPILAGEMTRAVICGTPYPLSLLSQLIARVRADGDVNGLRVAMMKAVLQRRFRKGLIKEEIPMSLNTESENNAYLLGRLFAVLERIQYQALGDLNAGIADRYYGSASAVPFSVFPRLLSGAKHHLSRLRKDKGGAAVNREKELGEIIAKLLETFPRHLSIEEQGRFAIGYYHQKQSYFAEKESAETIEN

SEQ ID NO: 3225 - protein, 114 aa, Aggregatibacter actinomycetemcomitans serotype a str. H5P1
MSWMQKLCRTYEYVQEQGLEDEDLALPFHMSKAVHLKVILNNKAELVGVERFEGKKQVPIQVTEKSSKRAGSTIAPYALHDGLQYIAKTAKEYLTIEYLSKVAEKEMEKNGRIF

SEQ ID NO: 3226 - protein, 525 aa, Aggregatibacter actinomycetemcomitans serotype a str. H5P1
MQEIKIVLQYIQKGSLIEDLLEKKVFTLENNILLAGKDDPFNFTIVWAVEIPNDLHSNLWSKSSIKEQWIKYQESQSGQEDEKPELCYITGESSYLANAYPKIEGNAKLVSANDTDGFTFLGRFLIDKQAAALGREVSQKAFNMLKWLIKRQGIRNGDQVTVAWAISGKAVPSPMKDLSDEIDWDNLDISADESAVENSDRFSSPTSSETPDWSTNIGKPAAQIIKKKLHGYQEELKNHEQISLIMLDSATPGRMALTYYQEFLPADYFANLDAWVDDFSWYQRYSVEVQNGKKTDKRTQWRGVPPSPYSVADAVYGKSLSDTLKKQLYARLLPVIAGGKSVPIPDDLMQKSFQVACNPNGSENWEWQRNIGVACALYKGWRARHHDLSERRTYSMALDKENRSRDYLYGRLLAVAENTESYALYLVGEKRATTAERYMQRFAEHPFATWRNIELALKPYQDRLRNNGKDTGAQAIGEIMDLFENQDFSSDDKLSGEFLLGYHCQKMDIARRIAEISANKSKTDE

SEQ ID NO: 3227 - protein, 465 aa, Aggregatibacter actinomycetemcomitans serotype d str. I63B
MILASLARYYRRLAVENDEVGNPKVPPYGFSEEKIGWILVLDKEGRLKTAVPNLTADKKPQPKLMSVPRPEKRTSGVKPNFLWDKTAYALGVEANKNKDEAKETPFTSSEKTFAAFQQYHLDLLQDSEDEGLQALYRFLQNWQPENFAAANLPPEMLDANIAFSLEKPTALIHKRDAAQTLWAGRLKSDEAVEGLCLISGENAPIARLHPAIKGVFGGQSSGGSIISFNKEAFASFGKEQGANAPVSEQSAFAYTTALNYLLRRENGHCLTIGDASTVFWAEAADNATAQAAEGFFAQVFTPPDDEQESAKIFNVLEQIAKGRPLEEIAPELSPDTRFYILGLAPNAARISIRFWLDTTFGQLAENLALHWQDLAIEPRPWKTPPSVWRLLLQTAVLGKSENISPVLAGEMIRAVICGTPYPLSLLSQLIARVRADGDVNGLRVAMMKAVLQRRFRKVLSKKEFL

SEQ ID NO: 3228 - protein, 127 aa, Aggregatibacter actinomycetemcomitans serotype d str. I63B
MNLNHESPNRAYLLGRLFAVLERIQYQALGDLNAGIADRYYGSASAVPFSVFPRLLSGAKHHLSRLRKDKGGMAVNLDKDLGEIIAKLPETFPRHLSIEEQGRFAIGYYHQKQRYFTEKEPAETIEN

SEQ ID NO: 3229 - protein, 114 aa, Aggregatibacter actinomycetemcomitans serotype e str. SCC393
MSWMQKLCRTYEYVQEQGLEDEDLALPFHMSKAVHLKVILNNKAELVGVERFEGKKQVPIQVTEKSSKRAGSTIAPYALHDGLQYIAKTAKEYLTIEYLSKVAEKENGKNGRIF

SEQ ID NO: 3230 - protein, 398 aa, Aggregatibacter actinomycetemcomitans serotype e str. SCC393
MQEIKIVLQYIQKGSLIEDLLEKKVFTLENNILLAGKDDPFNFTIVWAVEIPNDLHSNLWSKSSIKEQWIKYQESQSGQEDKKPELCYITGESSYLANAYPKIEGNAKLVSANDTDGFTFLGRFLIDKQAAALGREVSQKAFNMLKWLIKRQGIRNGDQVTVAWAISGKAVPSPMKDLSDEIDWDNLDISADESAVENSDRFSSPTSSETPDWSTNIGKPAAQIIKKKLHGYQEELKNHEQISLIMLDSATPGRMALTYYQEFLPADYFANLDAWVDDFSWYQRYSVEVQNGKKPTNAPNGAVFRRRLTALPMPCTANPFPTRSKTTLRPPTARHRRRQIRADSGRLNAKKFSGSLQPEWQRKLGMAKKHRRCLRPLQRLARPSSRFIRKENLFHGFR

SEQ ID NO: 3231 - protein, 130 aa, Aggregatibacter actinomycetemcomitans serotype e str. SCC393
MALDKENRSRDYLYGRLLAVAENTESYALYLVGEKRATTAERYMQRFAEHPFATWRNIELALKPYQDRLRNNGKDTGAQAIGEIMDLFENQDFSSDDKLSGEFLLGYHCQKMDIARRIAEISANKSKTDE

SEQ ID NO: 3232 - protein, 465 aa, Aggregatibacter actinomycetemcomitans serotype a str. H5P1; identical to SEQ ID NO: 3227

SEQ ID NO: 3233 - protein, 127 aa, Aggregatibacter actinomycetemcomitans serotype a str. H5P1; identical to SEQ ID NO: 3228

SEQ ID NO: 3234 - protein, 592 aa, Aggregatibacter actinomycetemcomitans serotype f str. D18P1
MILASLARYYRRLAVENDEVGNPKVPPYGFSEEKIGWILVLDKEGRLKTAVPNLTADKKPQPKLMSVPRPEKRTSGVKPNFLWDKTAYALGVEANKNKDEAKETPFTSSEKTFAAFQQYHLDLLQDSEDEGLQALYRFLQNWQPENFAAANLPPEMLDANIAFSLEKPTALIHKRDAAQTLWAGRLKSDEAVEGLCLISGENAPIARLHPAIKGVFGGQSSGGSIISFNKEAFASFGKEQGANAPVSEQSAFAYTTALNYLLRRENGHCLTIGDASTVFWAEAADNATAQAAEGFFAQVFTPPDDEQESAKIFNVLEQIAKGRPLEEIAPELSPDTRFYILGLAPNAARISIRFWLDTTFGQLAENLALHWQDLAIEPRPWKTPPSVWRLLLQTAVLGKSENISPVLAGEMIRAVICGTPYPLSLLSQLIARVRADGDVNGLRVAMMKAVLQRRFRKGFIEKGVPMNLNHESPNRAYLLGRLFAVLERIQYQALGDLNAGIADRYYGSASAVPFSVFPRLLSGAKHHLSRLRKDKGGMAVNLDKDLGEIIAKLPETFPRHLSIEEQGRFAIGYYHQKQRYFTEKEPAETIEN

SEQ ID NO: 3235 - protein, 677 aa, Aggregatibacter actinomycetemcomitans serotype f str. D18P1
MSWMQKLCRTYEYVQEQGLEDEDLALPFHMSKAVHLKVILNNKAELVGVERFEGKKQVPIQVTEKSSKRAGSTIAPYALHDGLQYIAKTAKEYLTIEYLSKVAEKENGKKWKNFLAGTDEDKRNFADTEKTRYKTSFKAYEEQLSAWAEASHLQEIKIVLQYIQKGSLIEDLLEKKVFTLENNILLAGKDDPFNFTIVWAVEIPNDLHSNLWSKSSIKEQWIKYQESQSGQEDEKPELCYITGESSYLANAYPKIEGNAKLVSANDTDGFTFLGRFLIDKQAAALGREVSQKAFNMLKWLIKRQGIRNGDQVTVAWAISGKAVPSPMKDLSDEIDWDNLDISADESAVENSDRFSSPTSSETPDWSTNIGKPSAQIIKKKLHGYQEELKNHEQISLIMLDSATPGRMALTYYQEFLPADYFANLDAWVDDFSWYQRYSVEVQNGKKTDKRTQWRGVPPSPYSVADAVYGKSLSDTLKKQLYARLLPVIAGGKSVPIPDDLMQKSFQVACNPNGSENWEWQRNIGVACALYKGWRARHHDLSERRTYSMALDKENRSRDYLYGRLLAVAENTESYALYLVGEKRATTAERYMQRFAEHPFATWRNIELALKPYQDRLRNNGKDTGAQAIGEIMDLFENQDFSSDDKLSGEFLLGYHCQKMDIARRIAEISANKSKTDE

SEQ ID NO: 3236 - protein, 398 aa, Aggregatibacter actinomycetemcomitans serotype e str. SCC393
MCLISGENAPIARLHPAIKGVFGGQSSGGSIISFNKEAFASFGKEQGANAPVSEQSAFAYTTALNYLLRRENGHCLTIGDASTVFWAEAADNATAQAAEGFFAQVFTPPDDEQESAKIFNVLEQIAKGRPLEEIAPELSPDTRFYILGLAPNAARISIRFWLDTTFGQLAENLALHWQDLAIEPRPWKTPPSVWRLLLQTAVLGKSENISPVLAGEMIRAVICGTPYPLSLLSQLIARVRADGDVNGLRVAMMKAVLQRRFRKGFIEKGVPMNLNHESPNRAYLLGRLFAVLERIQYQALGDLNAGIADRYYGSASAVPFSVFPRLLSGAKHHLSRLRKDKGGMAVNLDKDLGEIIAKLPETFPRHLSIEEQGRFAIGYYHQKQRYFTEKEPAETIEN

SEQ ID NO: 3237 - protein, 185 aa, Aggregatibacter actinomycetemcomitans serotype e str. SCC393
MILASLARYYRRLAVENDEVGNPKVPPYGFSEEKIGWILVLDKEGRLKTAVPNLTADKKPQPKLMSVPRPEKRTSGVKPNFLWDKTAYALGVEANKNKDEAKETPFTSSEKTFAAFQQYHLDLLQDSEDEGLQALYRFLQNWQPENFAAANLPPKCWMPTSHFLWKNRPHLSINATPRKPCGQVV

SEQ ID NO: 3238 - protein, 397 aa, Aggregatibacter actinomycetemcomitans serotype b str. SCC1398
MILHALTQYYQRKAKYDGGVAPEGFENKEIPFIIVIDKQGKFIQLEDTRELKNKKKIARTFLVLKGLGRSGSKSYEVSNLLWDHYGYVLAYAGEKGQEQADNQHASFIAKVDELKQALPDEIGISAVAAFLASSEEKNKVMQSENWAECTKIKGCNLSFRLAEETVALACQSQAVQNHLRQINQDNFDNAPKGICLVTGKFASIARLHNPIKGVNAKPSPFTSVNLSAFESYGKEQGFIFPVGEQAMFEYTTALNTLLAGENRFRIGDVTTVCWSEKPTPLESRISRLMNGGGKDNPDAHIDAVKSLYKSLYNGKYTEPDGKDKFYLLGLSSNSARIPVLLRLKKLITQILMTVKKKKLRKNAAAWDANSPYLMVYTAATALFPHTLPNKQDFPKKI

SEQ ID NO: 3239 - protein, 630 aa, Neisseria shayeganii 871
MILTSLARYYRRLSSETDVAGHPKVPPYGFSEEKIGWVLVLDADGLLVDVVPHLTDDKKPQPRLMSVPRPEKRTSGVKPNFLWDKTAYALGVEANKDKATAKEQPFRPSEKTFAAFRELHLEALKDTQDEGLLALRRFLERWQPEQFAHPPCLPDMLDANVVFRLDGTRGYIHQREAAQALWAGRLKSDDAEQGLCLVSGEQAPIARLHPAIKGRTLTLAGGQSSGCSIVAFNQDSFKSYGKEKGANAPVSEQAAFAYTTALNYLLRNDDHCLTIGDASTVFWAEAATSEQAEAAEGFFAAAMTPPNDEQENQKIFDILAQMAKGRPLREIDPNLDDQTRFYILGLAPNASRISIRFWLDTTFGKLAENIKKHRDDLSINPPAWGAKPPSVWRILLETTPKRKGADGRLKKSESKDIPPQLAGEYMRAILTGRHYPQTMLSRMIGRIRSDGFISGLRVAVIKSVLKRNNLCKEEFDMGLNEETQDIPYRLGRLFAIIELAQSSALGELNAGVRDKFYGGASSSPHSTFPLLLDNYRTHISGLRKGKKAKWVTGDSKKLANWLENKVGEIVSVFDAETPFPRHLSLEEQGRFVIGYYQQRFKKYSKQEGGDIPEDIEQANHLNTESDSEDE

SEQ ID NO: 3240 - protein, 585 aa, Neisseria sp. GT4A_CT1
MILHALTQYYQRKAESDGGVAPEGFENKEIPFIIVIDKQGKFIQLEDTRELKNKKKVARTFLVPKGLGRSGSKSYEVSNLLWDHYGYVLAYAGEKGQEQADKQHASFTANVNELKQALPDDAGVAAVAAFLASAAEKSKAMQAANWVECAKVKGCNLSFRLVDEAVDLVCQSKAVQAYVSQANQAQSDNIPKGICLVTGKLAPIARLHNAVKGVNAKPAPFTSVNLSAFESYGKEQGFIFPVGEQVMFEYTTALNTLLAGENRFRIGDVTAICWSAKPTPLEEYLASLISGGGKDNPDAHIDAVKSLYKSLYNGKYTEPDGKEKFYLLGLSPNSARIVVRFWHETTVAALSESIAAWYDDLQMVRGENSPYPEYMPLPRLLGNLVLDGKMENLPSDLIAQITDAALNNRVLPVSLLQAALRRNKAEQKITYGRASLLKAYINRAIRAGRLKNMKELTMSLDRNRQDIGYVLGRLFAVLEKTQAEANPGLNATIADRYFGSASSTPIAVFGTLMRLLPHHLNKLEFEGRAVQLQWEIRQILEHCQRFPNHLNLEQQGLFAIGYYHETQFLFTKDALKNLFNEAKTA

SEQ ID NO: 3241 - protein, 677 aa, Aggregatibacter actinomycetemcomitans D17P-3
MSWMQKLCRTYEYVQEQGLEDEDLALPFHMSKAVHLKVILNNKAELVGVERFEGKKQVPIQVTEKSSKRAGSTIAPYALHDGLQYIAKTAKEYLTIEYLSKVAEKENGKKWKNFLAGTDEDKRNFADTEKTRYKTSFKAYEEQLSAWAEASHLQEIKIVLQYIQKGSLIEDLLEKKVFTLENNILLAGKDDPFNFTIVWAVEIPNDLHSNLWSKSSIKEQWIKYQESQSGQEDEKPELCYITGESSYLANAYPKIEGNAKLVSANDTDGFTFLGRFLIDKQAAALGREVSQKAFNMLKWLIKRQGIRNGDQVTVAWAISGKAVPSPMKDLSDEIDWDNLDISADESAVENSDRFSSPTSSETPDWSTNIGKPAAQIIKKKLHGYQEELKNHEQISLIMLDSATPGRMALTYYQEFLPADYFANLDAWVDDFSWYQRYSVEVQNGKKTDKRTQWRGVPPSPYSVADAVYGKSLSDTLKKQLYARLLPVIAGGKSVPIPDDLMQKSFQVACNPNGSENWEWQRNIGVACALYKGWRARHHDLSERRTYSMALDKENRSRDYLYGRLLAVAENTESYALYLVGEKRATTAERYMQRFAEHPFATWRNIELALKPYQDRLRNNGKDTGAQAIGEIMDLFENQDFSSDDKLSGEFLLGYHCQKMDIARRIAEISANKSKTDE

SEQ ID NO: 3242 - protein, 127 aa, Aggregatibacter actinomycetemcomitans D17P-3; identical to SEQ ID NO: 3228

SEQ ID NO: 3243 - protein, 465 aa, Aggregatibacter actinomycetemcomitans D17P-3
MILASLARYYRRLAVENDEVGNPKVPPYGFSEEKIGWILVLDKEGRLKTAVPNLTADKKPQPKLMSVPRPEKRTSGVKPNFLWDKTAYALGVEANKNKDEAKETPFTSSEKTFAAFQQYHLDLLQDSEDEGLQALYRFLQNWQPENFAAANLPPEMLDANIAFSLEKPTALIHKRDAAQTLWAGRLKSDEAVEGLCLISGENAPIARLHPAIKGVFGGQSSGGSIISFNKEAFASFGKEQGANAPVSEQSAFAYTTALNYLLRRENGHCLTIGDASTVFWAEAADNATAQAAEGFFAQVFTPPDDEQESAKIFNVLEQIAKSRPLEEIAPELSPDTRFYILGLAPNAARISIRFWLDTTFGQLAENLALHWQDLAIEPRPWKTPPSVWRLLLQTAVLGKSENISPVLAGEMIRAVICGTPYPLSLLSQLIARVRADGDVNGLRVAMMKAVLQRRFRKVLSKKEFL

SEQ ID NO: 3244 - protein, 606 aa, Neisseria wadsworthii 9715
MILASLARYYRRLAAENDDRTGEPKVPPYGFSEEKIGWVLVLDSDGLLVDVVPHLTDEKKPQPRLMSVPRPEKRTSGVKPNFLWDKTAYALGVEANKDKAAAKEQPFRPSEKTFAAFRDLHLQALKDTQDEGLLALRRFLERWQPVQFAHPPCLPEMLDVNVVFRLDGTRGYIHQREAAQALWAGRLKSDEAEQGLCLISGEQAPIARLHPAIKGVFGGQSSGGSIISFNKESFTSFGKEQGANAPVSEVSAFAYTTALNYLLRRENGHCLTIGDASTVFWAEADTPEQATAAEGFFAAAFTPPDDEQESKKVFNILEQITKGRPLQEAAPELSPDTRFYILGLAPNASRISIRFWLDTTFGKLAEHLAQHWKDLALEPCAWKTPPSIFKLLLETAIKFKNSEGRYEKPKAETISPVLAGEMTRAVIGGTPYPMSLLSQLIARIRADGDANGLRVAMIKAVLQRRFRKGLIKEEIPMSLDTESRNTAYLLGRLFAVLERIQNQALGDLNAGIADRYYGSASAVPFSVFPRLLSGAKHHLSRLRKDKAGMAVNLDKDLSAVIAGLPETFPRHLSMEEQGRFAIGYYHQKQSYFAKKDPVETQSHEGE

SEQ ID NO: 3245 - protein, 612 aa, Thiorhodospira sibirica ATCC 700588
MILQALSRYYQRLVEQQIKDIAPFGYSPEKISFEILLTRDGAVAQINDIRDTSQKKPQPKILLVPAAFKRPGTGAKPFFLWDKTSYVLGVSNTSKRADKEHEAFVELHETVLAGADDPGLKALLSFLRGWSPEQFEERGFPADMVDANLVFRMDGEHCYLHDRPAARAVRARLLAGDEGQETSANSAVCLVNGDVAPVARLHPAIKMNRSDAQSSGVSIVSFNKSSFESYAKSQGENAPVSTRAAFAYTTVLNYLLRQGEHNRQRLRVGDASVVFWAEAADAQRASAAEDLFATLLSPPADDASEAARVRAVLDRIAKGRPVADLAPNLEPGTRMYVLGLAPNASRLSVRFWQVDTLGVLIGRIAQHAEDLHLEPLPWRTEPSVWRLVLATAPSRDGRAKSEDVSPLLAGEFMRAILSGGRYPRSLLANTLMRLRADGNINGLRVALCKAVLAREQRRGIRTSKEEIPVSLDKQSTQPGYLLGRLFAVLESVQRAALGSQINATIRDRYYGAASATPAAIFPVLLRNTQNHLSKLRKERRGHAVNLEKDIHEIIGGLPEQFPRSLKIEDQGRFAIGYYHQSQSYFTRRDEAGDAPAAESAEPTDIETAGAEQ

SEQ ID NO: 3246 - protein, 640 aa, Paenibacillus lactis 154
MSWLTNLNKTYEQHENLIGRFEKKKNGREYALIPVSHTTQTAHIEVVLDGNGNYLSAKVVDKEDSSTIIPCTEASASRTSAPVPYPLFDKLVYVAGDYERYCDKPKGTPYEDYLSQLQSWCESPYKHPRVESVYRYIAKGTLLTDLIRDKILWTDEAGELLSSWPPSPDQQNAEKPDIFKVIASDQSSAFVRFSVDIPGEPESRLWRDPSVQEAFIGFYETSLKELDLCYVSGEMRPYAEKHASRIRNSGDKSKLISANDSSGFTYRGRFRTSRDVATVSYDVSQKAHNALKWLIERQGIQVDGRVFLVWGTEQLDLPDPLEGTFSLYRDEDEEAGGGDSTLKEYAEQFRRAIKGYRFDGDYKSNAIIMVLDAATPGRMSIVYYRDLNKEKYLERLQAWHETCYWQHRNGRDQNNMPRTYIGAPATRDIAFAAYGPRANDKLIKGLMERMLPCIVDGRKIPLDIVRSAVIRASNPVGMEDWEWEKTLSVACALVNKTFEKEGFDVSLNTETSDRSYLFGRMLAIADVLERRALGKDEKRATNAIRYMNAFAQRPGCTWTIIQSNLQPYQARMGTEAGYLNRLLDEVGAKLSLEDFTDKPLSGLYLLGFYSQRNDLYTSKKVKEAEANAEESSENNDQGEI

SEQ ID NO: 3247 - protein, 592 aa, Aggregatibacter aphrophilus F0387
MILASLARYYRRLAAENDDMGNPKVPPYGFSEEKIGWILVLDKEGRLKTAVPNLTADKKPQPKLMSVPRPEKRTSGIKPNFLWDKTAYALGVEANKNKAEAKEKPFTPAEKTFDAFKQYHLDLLQNSEDEGLQALCRFLQNWQPAHFAAENLPAEMLDANIAFSLEKPTALIHKREAAQSLWAGYLKSDEALEGLCLISGDTAPIARLHPAIKGVFGGQSSGGSIISFNKEAFASFGKEQGANAPVSEQSAFAYTTALNYLLRRENNHCLTIGDASTVFWAEADDNATAQAAEGFFAHVFTPPDDEQESAKVFNVLEQIGKGRPLQEIAPELSANTRFYILGLAPNAARISVRFWLDTTFGQLAANLAQHWQDLALEPCAWKTPPSIWRLLLQTAVLGKSENISPVLAGEMTRAVICGTPYPMSLLSQLNTRIRADGDVNGLRVAMMKAVLERRFRKGFIEEGVPMNLNNESPNRAYLLGRLFAVLERIQYQALGELNAGIADRYYGSASAVPFSVFPRLLSGAKHHLSRLRKDKAGMAVNLDKDLGEIIAKLPETFPRHLSIDEQGRFAIGYYHQKQSYFAKKETAETIEN

SEQ ID NO: 3248 - protein, 582 aa, Clostridium citroniae WAL-17108
MILQALVKHYETLAEQGKVSRQAWCRAKVTYALDIDTDGNLLGIISLKQEEERGKKTVWVPQMVEVPEMAARSSGVSANFLCDNSKYLLGIDNDGSGKRVLECFQAAREKHESVLEEVQSEAAVAVKHFFKNWDPMKAKEHPELLEKWEDITAGGNLVFYVGTMYAHEDPDIRNAWEKSLQAEGNGTQEICLVTGKRAEISRIHTVIRGVQGAQSSGAALVSFNAPSFESYGKEQSFNAPVGKYAMFAYTTALNYLLSQRKYIFMLGDTTILFWAEDGEEIYQDLFMGSMEPTEDNQEVLRGIFSNLQEGRGIDVDGIQVNPEQKFYILGLAPNAARLSVRFFYQNHFGTILSNIKKHYEQMEIVRPNWDKIEFPGVWRVLFETVNQKSKEKKPQPNMAASVFESVLSGKKYPESLYSNVMIRIRAEQGRITRGRAAIIKACLIRNHGKQWTEEGSFVGLNEQCKDVAYVLGREFAVLEAIQEDANSGINATIKDRYFNSACAAPASVFPILLKLKNSHIRKLEAGRRIFYEKMLTGLQGMIEVENDQPAAFPRRLSLEEQGMFILGYYHQVQKRFEKKEEK

SEQ ID NO: 3249 - protein, 609 aa, Olsenella sp. oral taxon 809 str. F0356
MMLRDLCDLFDLKRQTDPDAIPPRRWCRTSVGYELTLDRDGTIVSCVPLASEGQKLPKLVVPMAYVTRSGQKPVPGFLCDDAQHVFGVGKNKFREELRLMHEQLAKDVLSEVDDDGARAYLSMLRHYGAGMLPRLCAEAMGEDVRPGSNEKENPNLKSNLVFRFLPDGSLLHERTAIVAAWDRYAEAAEQESEQCTCLVLGKVAPRAKLFPQVSGLAGAQSAGAALVSCNADAFSSYGQKIATVGSISREAAEKAGGALNYVLKDDSHHMRLGDDYVCFWTNSSDSIADACLSFIFDSDGIGGSNAIISGRGENVEVRDAVQEALQQMIHGLPPVDVPADTKYHVMGIAPYQARLAVRFYQTGSFGDLERNVSLFLRDTQMVGVRLCSLKRYLEQAAVQVESKNLPRSLITSCVRALLDGTAFPDSLAKEIILRTRADHGSRNTFDMGRRAAILRAYLLRKSRNAGQVVREDAERRLTVALNEENENQGYLLGRLFALLDKVQVDAVGDINAGIRERYMGAASTTPARVFPQLLKLSQHHISKSSWGSRIDVLVQRVISKVDDSGFPKTLSYDDQGEFYIGFYQQREALYKKSEKGDKTAKVDVTERID

SEQ ID NO: 3250 - protein, 623 aa, Selenomonas infelix ATCC 43532
MSWMEQLVQTYDENERFAGRDGIDGMRAMLPLVGHIIQNAQIEITLSADGELIQAEMIPKEQQRTLIPCTPDSASRTSSPSPHPLHDNLSYIARDYYEYVKKRPKGQKKPYPMYKELLGSWVAADANPKVQAVYFYISNHDVLHDLIEKNVLTGDDRNISKSMVRFRVVIDGDDCSELWRDIQIQKSYQKFFRQKLSQTKGQLCYATGKMLLSTEKHGKGIRFPGDGAKIISSNDKEGLTFRGRFINGDECISIGYETSQKAMNALTWLVQNQGYKARKTSREGRVFLAWGRCGTFVPSVFDDTAHLTRRRRPAEVARPSSMKGWAESLTHALMGYCHEFKQAKMSQVNVMILDAATKGRLSICYYSEMAGEDFIERIERWHSLGRWRQHGYDREKDETFVYFGVPTPEMLVKACHGEKVGDSQMDQAVERIFYAILQGKPLPVDMERIVMRRAVKRSVCDSYYDWNRQIIEPACSIIARRLNHTEEVYTVALDETKTDRSYLFGRLIAVADQMERLTFSPEEKGSRTTNAMRYMEIFSSRPNATWMTLQKKLLPYQRKREMYGGKERKLISKIGSMFNDDDFLSDRPLDGKFLLGYYCQQYAMEQKREENRKKKEFSTEEDV

SEQ ID NO: 3251 - protein, 581 aa, Alloprevotella rava F0323
MILKALYDYYQRKSEELPAFGCELKEIGFILVIDKDGNFLRFEDRRIDKKSASSFLVKKHVGRSSAPIANLLYDNCSYVLGYSTEGDINSNAKYISIFKAKVEELYTKLPNNSAVSAIWKFYQKNPAENLLKVQADPLWPEIEKNLNKKYSTFSFLLEGETTIVAAQKDVINADEEKEGNEKEQLCLITGNHGKAVDVTTATMIAGSQATAKLVAFQVNSGYDSYGKQKGFNAPISQKAEFAYTTALNHILSANSRNKFLVGNRTYLFWGSSNSNGNQETESSIFAMFGFNDSEEEDPNARINQIRKVFEGIYSGSIKTDLDDRFYIAGLAPNAARIAVVYWAELPLKDFAHTILRHFEDMDIVDTRKEKKPYMGLKSILATVTLGGKSSEATPNLPDAVIKSIFQGLPYPDTLYHSCLRRIRAEQSVTITRAAILKAYLNRKYTNQKPIQIMLDKENTNQGYLCGRLFAVIDKLQNDANHIHSIRERYMNAASSTPATVFATILNLSAIHANNLNNEGSRIFYDKLKQEIISKINADGFPSHLDLQDQGRFFVGYYQQMQSFFLTGTGTGTETETKQTEE

SEQ ID NO: 3252 - protein, 634 aa, Selenomonas noxia F0398; identical to SEQ ID NO: 3187

SEQ ID NO: 3253 - protein, 591 aa, Clostridium clostridioforme 2_1_49FAA
MILQALVEYYEALERKGKITSPGWCRAKVAYGLDISEQGELKSVIPLKQERQKGKKTVTVPQNLTVPQMVSRSSGVSANFLCDHSGYMLGIDNKGKPERSRECFECAKKKHKDILEHISSPAARAVCRFFDRWAPDQAAENPCLIPELEEIISGSNLVFMMDGEYVHEDPDIRQCWEEYSRQSGTGHVGVCLVTGRREEIARIHGTIKGVQGAQSSGAALVSFNAPAFESYGKEQSFNAPVGTYAAYAYTTALNYLLGDRTHGTTIGDTAVVYWSEEGDERYQNIFACVSEPTMENQEIVDGVFKNLAEGKAVAAQDVQDSLDMDRKFYILGLAPNAARLAVRFFYQDSFGNILKHIKEHYDRMEIVRPAADAVEYLGMWRMLQETVNKKSRDKKPVPSMSGAVYRAIISGSRYPASLYQAVLGRIRAEQDDGDSRIYKITRGRAAIIKAYLLKNGNEKEEITMALNEDSNNTAYILGREFAVLEAIQEDANPGINATIKDKYFNSACATPAAIFPILFKLKNSHIKKMNNGAKEIYYEKILGDLQGRLTVAEGQKAACPRRLTLEEQGMFILGYYHQTQKRYEKKIKEEA

SEQ ID NO: 3254 - protein, 569 aa, Desulfovibrio carbinoliphilus subsp. oakridgensis
MILSSLAAYYDRLSREPEPVVPLSGFSRQKIHFALHIDADGRLAEPPVFDLRQTDGKKATPQELVVPEAVKRSVGVAANFLWDNTGYVLGADDKGKPERTAKTFAAFKARCHAIGDGLDDAGMAAVLAFLDAWDPADAPDLPRWEEMVKGCNLVFRLAGGGLGYVHERPAVRQAWLDHLAGASKERRGMCLVTGQDAPIAKLHPKIQGVRDAQSVGALLVSYNQHSFESYGKEQSYNGPVGEPAAFAYTTALNHLLRKGSRQRVQIGDATTVFWTERTSEVEGLLGFLFDPTADDGSQAEVRLFLEAVRDGKHPAFDAEILQSGFFILGLAPNAARLSVRFWHQDTVDGVCQTVGRHFAALNLERTWDTEPEFPGLWQLLRETAPQNDLKNVNPALAGALMRSILTDAPYPASLPAAVIARIRADQTVNYLRAAMLKAYLVRNTPKEVSVSLDQTSADIGYRLGRLFAVLEKAQQEAIPGANTTIRDRYYGSASATPAAVFPQLMRLAQHHIEKAEYGGVSDRRIEEILGAVQTFPKHLSLDEQGMFAIGYYHQRRENYKKTAKTKGED

SEQ ID NO: 3255 - protein, 592 aa, Aggregatibacter actinomycetemcomitans RhAA1
MILASLARYYRRLAAENDEVGNPKVPPYGFSEEKIGWILVLDKEGRLKTAMPHLTADKKPQPKWMSVPRPEKRTSGVKPNFLWDKTAYALGVEANKNKAEAKEKPFTSSEKTFTAFQQYHLELLQNSEDEGLQALYRFLQNWLPENFAAANLPPEMLDANIAFSLEKPTALIHKRAAAQTLWAGRLKSDEAVEGLCLISGENAPIARLHPAIKGVFGGQSSGGSIISFNKEAFASFGKEQGANAPVSEQSAFAYTTALNYLLRRENGHCLTIGDASTVFWAEAADNATAQATEGFFAQVFTPPDDEQESAKIFNVLEQIAKGRPLQDIAPELSPDTRFYILGLAPNAARISIRFWLDTTFGQLAENLARHWQDLAIEPRAWKTPPSIWRLLLQTAVLGKSENISPILAGEMTRAVICGTPYPLSLLSQLIARVRADGDVNGLRVAMMKAVLQRRFRKGLIKEEIPMSLNTESENNAYLLGRLFAVLERIQYQALGDLNAGIADRYYGSASAVPFSVLPRLLSGAKHHLSRLRKDKGGAAVNREKELGEIIAKLPETFPRHLSIEEQGRFAIGYYHQKQSYFAEKESAETIEN

SEQ ID NO: 3256 - protein, 584 aa, Thermanaerovibrio velox DSM 12556
MILQALCEYYERSLADPERKVPPEGWEWKGIHFLIVVDTEGNFIRVEDTRELSGKKLVAKKFLVPSLGESKGSAIKANLFWENAEYFLGVPTKENSKPERVKKQHQAFIERMKSFFEKEKIGEPAKNVLNVFSKNLLDELSKSSVWDDLKKPESLMTFKIEGLGVITDLPEIRKAQVVDEKGLPEGICLVTGEKAPIKQLHPPILGVKGANSTGASLVSVNNKVENGRNGGPTPAFASFLKQQGFNAPVSVRAALAYTRALNLLLDPASKNKTNLGETTIVFWAQKEDPAYCNLEQSFSWLVGEDPKDDPDRSVAAVKALYESVFSGRIPATEQDRFYVLGLSPNAGRISVRLWRSGKARDFADKIIKHFEDVQIIHGPNEKEHLPLSRLLKATALDYTMDNVPPNLPGAVLASILDGTPYPRSLLQQCIRRIRAERKVTRERAGILKACINRQQANSREKEVLKVSLDRSNPNVAYRLGRLFAVLEKIQEEANPGINATIRDRYYGAASSMPVVVFPQLLKLKNYHMAKLTNPGRKVNLEKEIGEIMDGIATMPSTMSLDQQAHFAVGYYHQMQAFYNKNKGE

SEQ ID NO: 3257 - protein, 599 aa, Jonquetella anthropi DSM 22815
MILQALYEYEQRRQKVGTGIPTGCGDVEFKFLVEIDSTGRFHQFYDMQEEQVGPKGKSFLKGKRYFVPDTVSRTSGVKAKVLWDNAKYLLGAEIDKEKKIHTAQDDQGLRQRLDAFIQETKDCLKRSKDRTLSKEIQAIINFYENPEGLDAALKDLTLGNVLEAGGNLTFRLIDGDLPVPAQEAARNLAAFEPSEEGVCLITGQRAPLARIHSDFLIRGGKQTGASLVSCQKDSGYDSYYKEQGYNAPVSQAAAFDYASGLKQLLASEKNKAIIGKDTYVFWSVPKDAPIGGENPASEGNFRAVLQGDPDKQVGRLKVVFDHIRQGTDLVVEKGRFCLLGLTANSARIAVRLWRVDSTEHFAANLRRHLEDTAIDAYGGQVVNFPLDRILWAMALDGKIESLPPNIPSGLLSSVVDGVPYPLAGFQRAIVRIRAEQEVRPELASLLRGTLNRWRTSAGEQKEVFGVKLDDASQDPSYVLGRVFSILESIQRIAQGELNKSITSRFLGAAASTPGIVFPKLFKLSVHHLQKISQDRLPRAVWWKNKLASVMEGVGEFPRQLNLYEQGKFFLGYYHQNQDVSAKKEDLQLNNDEERKEQQR

SEQ ID NO: 3258 - protein, 628 aa, Cardiobacterium valvarum F0432
MILASLARYYYRLAAENDEMGNPKVPPYGFSEEKIGWILVLDSEGNLQDVVSNLSADIKPRPKLMIVPRPDKRTSGIKPNFLWDKTAYALGVEANKNKAEAKKKPFIPAEKTFAAFKQYHLELLQDSADEGLLAIYHFLQNWQPEHFAAQHLPLEMLDTNIVFSLEMPSAFIHEREAAQTLWLNLLKSNEGDEGLCLVSGETAPIARLHPAIKGVLGGQSSGGSIVSFNNEAFTSFGKVQGANAPMSEASAFAYTTALNYLLRLENGHSLVIGLGRIRAALQAAKNQDKSQDIDKRPSVADTSTIFWAEAADRTSAQAAEDFFAEIASPDDDEESAKVFAVLEQVAKGRPLQEVAPELSPDTRFYVLGLAPNASRLSIRFWLDTTFGQLAQNLAQHWQDLAIEPRSWRTPPSIFKLLLETAIKFKNSEGRYEKPKAETISSMLAGEMVRAVISGTPYPLSLLSQLIARIRADGDVNGLRVAMIKAVLQRRFRKGFIQEGVPMSLHTESKNPAYLLGRLFAVLERIQHQALGELNAGIADRYYGSASAMPYFVFPRLLVGVRNHLSRLRKDKAGMAVNLDKDLCVIIKTLPEVFPRHLSIEEQGRFAIGYYQQKQSYFEKKDTAETIDD

SEQ ID NO: 3259 - protein, 598 aa, Flavonifractor plautii ATCC 29863
MILQALTQYYETLVQAGVLAGPGWGPVKASYALSIAADGTLEQVTSIQTEQLRGKKTVLAPQVLTLPAPVKRTVGIAANFLCDNSGYILGADNKGNPQRSLACFAACKALHTSVLGGVASPSAQALLAFFRTWIPEYTLEHPALAEYREDILSGANLLFRYNGSYIHEDPEIRRAWERRYRADTDSPRGICLVTGEEGPVESVHPAIKNVSGAQSSGAALVSFNAPAFCSYGKEQNLNAPTGKYAAFAYTAALNYLLADREHVYRLGDATVVCWARGGGDAYQAFFGGALLGAPTPYSAADLRGMTAQLCQGIPVDFQEDKLDPNMDFYILGLSPNAARLSVRFFLHNTFQGFLDHIQAHYDRLEIAQSNDNKFDNIPLWRLLYATVRSQTKYEPSSYKEAKQNLEKYLPPELSGEILRSILMNTRYPATLLNGITLRIRAEHEITRSRAAAIKACLLQNYRCLPIYSTLREVLTVELNDSCNYQPYVLGRLFAVMEQIQLASADWKLNRTIKDSYFTSAATTPKNIYAKLFPLSEYHMKKLLRDKPGLANILGKEKGSLIGKLTAPIPPRFMPEETDCFYIGYYHQSNQKKEEKEHV

SEQ ID NO: 3260 - protein, 649 aa, Eubacterium infirmum F0142
MSILTNLLKTYEYCQENNLVDNYSENDTVLLPIYHQSIKAQNMNLLEVTLDGNGNVLQTKFPEEITYIFPVTEESVARSGKNPPPHPLEDKMQYCIFEIADSLKYDAYLKAFNAFYDYLKPGEVKEFLASIRLFITSKNSYNELLETIPLSDLVKHDGGKIEYKASNGRTKKYNFENTFICFKVRNSKTGGYRDVNSFCDLHSAFIKYIDDISQGKSGQCNISGDDQILTEKHRGLLGTAKIISVSNNVETYLGRFRTGSDIIRVGRKTSEKIHLMMKYLLENKNSCKSLAENLFLVNWFMDDVKNENGFNLTDNETWFDGINLKELENIFDETAKLPVSTDNAKIGDAFSKGSNKLSPKSNYYLMLIDKSSNGRISIKYNREMTKSQLVDSLESWQRKYVWERYDNINKNYICFVPNFYSMLISAYGVERDKWLVLDNENFKKDQYQNLILSMLDNKSVPMNIKKALSKSIRNRHCYNNQWNFVLNTALAVLSEGRKEFISMRPQEEQTRSFLFGRLLAVYEKIELDVLSKNVNSKDKKNKDEADDEGSNEKNRTTNASRLWNTYINKPDSTVVTLEQRTKVYANKLMSSEKQFGSYVKTEKAKEEITKLFEEKGFWTVKKNTPLDDDFIFGYYSQKKDLYSRKNEEV

SEQ ID NO: 3261 - protein, 586 aa, Geobacter metallireducens RCH3; identical to SEQ ID NO: 2977

SEQ ID NO: 3262 - protein, 583 aa, Leptonema illini DSM 21528
MILQRLNQYYERKLAEEDIAPPGYEYREIPYLIILTNKGAFVRFESQYLDEKRKRSRRYLVPKSVERSSNTNPNLLWDNAKYILKEPDKQAAFLVRLKSFRAYCDDDALDALIRLLGNNGDGWQKDPLYSEIIAEKNDPALTFKLDNDSDIICVRRRIMDSRFTNPYDFDEQFDNPSLPVDGFCIVDGNNASIAKIHPTITGVRETNQNRGNIVSFNKDKGAFDSFGKQQGFNAPISKKAAFAYTTALNTMLSSERRQRMYVGDTTIVFWGEKGSKLEEDGFLGLFTDPEHEKGRQKEAELQRLESLRFLLESPKSGKRPLDEETTGFYVLGLGPNSARISIRFWYEGSVAQTAANLRQYFQDLQIVKPEFESGFLSLKRLLRSTAVREEEKNIVPELSSRLFQAILRSEPFPRIVLDRALARIKADHSEFAERNLFPRVALIKAYLNRMGRTGRIPGFQEVTTDMDEENQNIGYNLGRFFAVLERAQEAANPGINTTIRDRYFTSACTRPGTVFPVLVNLSMHHVSKAGGGLEVYFEKLKAKVLGNVSRFPLVLSLEDQGHFALGYYHQRQAFFTKKEGGKE

SEQ ID NO: 3263 - protein, 710 aa, Desulfosporosinus youngiae DSM 17734
MNWVSSLCALYDANAERAGKAEMWKGKSLVLFPVGYDTMEAQIEIHIDQEGNYLGARILEKEEAETLVPYPESRTSGIKALPLFDSLAYVAGDLSEAVTFYFPDAKNEKERQRKLVRLKESFPLYLADLKVWCESPFSHPKVKAIYRYVAKQTVAGDLIGSQVLGADENGIVSDKVKIQKASLDKAFVRFRVFMNDELLPEDILGDPNNAYDSAVWLDRTVQSSFIDYYLSTFQTTDLCYLTGEHMPRAKTHPLKIRGKWDTKAKLISANDDANFTYRGRFNTKDKETGYNEALSIGYVTSQKAHNALKWIIRRQGFSRDGVCIVAWENALRDLPDFYASAADILSRVTEEAGNEAEFEFEEESLPEEDEGDVPETNYASAAKFNAALDGYASKLSGISKMVVLALDSATPGRLAMTYYKELEASRYLKNLRLWHDSCAWKHEYIQDKKLKVYEGMVSLREIALAVYGTEQGEDNNSQLKLAKNSDNKAPLLVAVFERLRPCIIDGGAIPRDMVRAAVLKASNPLAYKAKFHYNKVLHIACSMVKRLYWEKLQRKESEGVILGMELDKTNRDRSYLYGRMLAVAERVERATYEKGETRITNAERYMQAFSRSPFRTWNVIWKNLQPYLAKLNPASREYYKNLLSGEITGLFKYKDRVSNEALDGKYLIGYDCQRTDLKRWPKEQSAPVGAILSPEETDEDYDDGEGEEPR

SEQ ID NO: 3264 - protein, 117 aa, Candidatus Arthromitus sp. SFB-3
MKLSSILKTITPYGKSQNTPKTLINSLFKSILTGGVYPISIYNKILERIRAESGEDFAINHTRISFIKGYLKRYYRLNNLKDKEEEVTVSLNKESTNIAYNLGRIFAILEKIQMDSS

SEQ ID NO: 3265 - protein, 40 aa, Candidatus Arthromitus sp. SFB-1
MLNVNEFPAVFSSDEQGMFILGYYHQREDIYTSKKDKEEN

SEQ ID NO: 3266 - protein, 405 aa, Candidatus Arthromitus sp. SFB-1
MRLKDDMKCIHEQGEVKKAFALYRQNKFENVEEVRGTCLINGDSNAPIAKIHKTIKGVSGSSISGAMIVSFNASSFESYGKSQGYNASISTENEFKYTTALNKLLSTDDNNMYLSGNTIVFWSSKLGAEEEQIIPAFMKDDDEVEDDNGETGGAKYNQEGIDKIESIIKLIKQGKTVNVDRINLDDSVNMYVLGLYGSRSRIFVRFWFKNSLGDFIKLTNKHFEDTKLKKKRKFSKKDFIYEEVGVKLSSILKTITPYGKSQNTPKTLINSLFKSILTGGVYPISIYNKILERIRAESGEDFAINHTRISFIKGYLKRYYRLNNLKDKEEEVTVSLNKESTNIAYNLGRIFAILEKIQMDSSNGATNIREKYLSSASSTPKSIFPNLLNLAQYHIAKIKKKMEKL

SEQ ID NO: 3267 - protein, 611 aa, Candidatus Arthromitus sp. SFB-4; identical to SEQ ID NO: 3104

SEQ ID NO: 3268 - protein, 611 aa, Candidatus Arthromitus sp. SFB-5; identical to SEQ ID NO: 3104

SEQ ID NO: 3269 - protein, 611 aa, Candidatus Arthromitus sp. SFB-co; identical to SEQ ID NO: 3104

SEQ ID NO: 3270 - protein, 611 aa, Candidatus Arthromitus sp. SFB-mouse-SU; identical to SEQ ID NO: 3104

SEQ ID NO: 3271 - protein, 593 aa, Treponema saccharophilum DSM 2985
MILQALYDYAQRKGDELPEDGFEDVEIKYLIKIREDGSLVDLVSTIEDKKGHVYSKVPMRVARTSSPKASLLLDNAEYVLGIPKQIKETEQNYEAKQKKANEKALICNELFVKEIEGLPNEILNEKEIKAVIAFYRSNRQNGFDKISACEKWEECQKTTGNISFVLNGEMSIIPQLESIRKYQRKITAAKSESDDENSEIVKGVCLITGEESVIARLHSATSIRNSQATAPLVGFNKDSFLSYGKKQSYNAPVSIKAEAGYTKALNYLIHSKDNKFLLGEDTIVFWAEKRDAETFESSFSAFFTTDFDAPDRNVREVKNLFAAVQTGKLESIDSNFYVLCLSPNSGRISVRFWETGKVETFAKRIKQHFDDFEIIKPAFDEKEYLNLYQILSSTALEHKMENVAPNLIGSVMQSILKKLPYPATLQQQCIRRIRAEQSVTRERAAILKAYITRLNRQKNIKEVSVALDRNNTNKGYLLGRLFAAFEKVQQESADTELNSTITDRFYGAASTNPVTVFTQLMRLNRNHMSKLKSKNRGLQINRDKEIGEIMNAIDSFPAHLDLNEQSYFAIGYYHEKQSFFDKQSKSENSEGEK

SEQ ID NO: 3272 - protein, 613 aa, Thiorhodovibrio sp. 970
MILQALAAYYERQQTASSGGDRVAPAGFEYKEIPFVIELDHAGDFVSLADTRGRDGNIKTAQRFLVPQAEKRTVQVKANLLWDTAEYVLGIPDQKKLDERQKKGKADDYLSRVKDMHRAFIARLDELPESTQEDAGVQAVRTFFRGDRRDDRLGAIQALPAWEDIAKTNPFMGFRLHGDLDLVCQRPDVVAALRQSPAQPEEAGAVCLLSGKPGLIERLHPPIKGVWGAQTSGANIVSFNLGAFRSYGKLQGANAPISKAAASAYTSALNHLLRKESSQRVQVGDTSTVFWAEQPNALETALPDIFGEPPKDDPDQGTRAIAELYRAVSSGHFALGTGEDRFHVLGLAPNAARISIRFWETAPAIELAQRIRQHFEDLRIARGPNDPEYLSLFRLLVSCAQQGKADNIPPHLGGDVMRAILTARPYPTTLLHAAVQRCRAEQRVTYPRAAAIKAWLCRDQRRAGADSFNPATEPTPMLDVANPSPAYRLGRLFATLERIQEEASPGINATIRDRFYGAASGTPVSVFPTLMRLKNHHIGKLTKGRAVNMERLIAEILEGLADFPSQMAMPDQGRFAIGYYHQRQAFFTKRTPKTGTTDPNIDDPHIDHKETDS

SEQ ID NO: 3273 - protein, 569 aa, Desulfovibrio sp. U5L
MILSSLAAYYDRLSREPEPVVPLSGFSRQKIHFALHIDAHGRLAEPPVFDLRQMDGKKTTPQELVVPEAVKRSVGVAANFLWDNTGYVLGADDKGKPERTAKTFEAFKTLCHAVGDGLDDADMAAVLAFLDAWNPADAADLPHWEEMVKGCNLVFRLAGGGLGYVHERPAVRQAWLDHLAGASKERRGMCLVTGQDAPLARLHPNIKGVRDAQSSGASLVSYNQEAFTSYAKEQSYNAPVGEPAVFAYTTALNHLLRKGSRQRVQIGDATTVFWTERTSEVEGLLGFLFDPTADDGSQAEVRLFLEAVRDGKKPQFDPEELQSGFFILGLAPNAARLSVRFWHQDTVERVCQTVGRHFAALNLERTWDTEPEFPGLWQLLRETAPQNDLKNVNPALAGALMRSILTDAPYPVSLPAAVIARIRADQTVNYLRAAMLKAYLVRNTQKEVSVSLDQTSADIGYRLGRLFAVLEKAQQEAIPGANTTIRDRYYGSASATPAAVFPQLMRLAQHHIEKAEYGGVSDRRIEEILDAVQTFPKHLSLDEQGMFAIGYYHQRRENYKKTAKTKGED

SEQ ID NO: 3274 - protein, 586 aa, Thiothrix nivea DSM 5205
MILQALYDYYQRKSASPDSALAPAGFEYKEIPFILEISADGKLVQIEDTRTGDGKKKRAKSERVPQGVKKTSGVAANLLWDNAEYVLGVDTKGKPERVKEQQAAFAERIRQLNIADQDEGIAAVLAFLGNPDAEVLQRQPQWEEIAATNPNLTFRLQGQPHLVCQSRQVQTALMNTVSDEGAKATCLLTGDQAEIERLHPSIKGVWGAQTAGANIISFNLDAFTSYGKSQSFNAPVSKEAAFAYTTALNHLLGKDSTQRMQVGDASTVFWAEKEHPLEDDFTALWGAADNNKDDPDRNTNAVKALYKAVEEYGRTPALGEETRFFILGLAPNAARISIRFWHTGTVREVSQRIVEHFELLRIERSERDAEFLPLWLLLRSIALLGKSENVPPNLAGEVIRCILEGLPYPQTLLASAVRRIRAEQEVTYPRAALIKAYLNRLNPTEKLAVSLDLANMNVGYRLGRLFAVLEKIQEEAQPGINATIRDRYYGAASATPVTVFSTLMKLKNHHLSKMDNKGRVNNLEKLLGEIMAGIADFPAHLSLPDQGRFAIGYYHQRQDFFKKREKATETETTQTEIETGAQGELL

SEQ ID NO: 3275 - protein, 583 aa, Rhodanobacter thiooxydans LCS2
MILQALNRYYERSESLPRVGWVRRGVDYVVILNAQGECVNLEPIGEIKKGKTVPSERLVTAIGKQAMKHTNSGKDANLLWDNASFAFGTGNRGAAKLASFIDTLEAWLPSLDDAGIEAVGRFCRGLQAEPASASTLIDRFGARDDFEKRDPVLTFRLMGDVEDVHHRPAVRLAYESALASSRFESSLLGNCLVTGVAGVPIAPNESVIKGVWGGQPAGCNIVSFNARAFESYGKRERNGENAPVSIQASFAYTTALNHLLSSSQRIQVGDASTVFWAEESHGLENALSDLFGDPPKDDPDRNTRVVGALYTAVQSGKFAKGGPETRFHVLGLAPNAARISIRFWETATALELARCIKQHFDDIEVVHADYEPRYLSLFRLLTGVALLNKADNIPPNLGGEAMRAILNGLSYPVTMLNQAVMRCRAEQQVTYARAAAIKACLNRQIRFRRSHEKEFLPMLDPDNTNPGYRLGRLFAALEKIQEDASPGLNATIRDRYYGAASSTPAGVFSTLLRLSKHHLGKLARGLAVAREKLIGDIMGGFEVESFPPRVLSLADQARFALGYYHQRQAFFTKSETRNQEESQ

SEQ ID NO: 3276 - protein, 582 aa, Eubacterium cellulosolvens 6
MILESLVKYYEALANAGELSRPGWSQVDVSYALDIDINGNLKQVISLKKQEGKKLVPLKMAVPSPVKRSSGINPNYLCDNSLYLLGMGNVKTDEGEDEKKLKKKKERIKECFFAAKELHAKKMPKGEDVTEAVMQFFNRWDPDKGDESVALQELKDEIIKGGNIVFLFDGKFVHEYDSVKKYLEKTDEDSSAEKCRCSVTGKLDKLATLHPQTKRVRNAQPAGASLVSFNGSAFESFGKEQGANAQTGEYAAFAYGEALNYLTERITFKNYLGNTALLFYAISGENVYQDAFSAIFLGDDDYYDQQDLVKVVEKICDGSVVDFNDQKLDPNMDFYLLGIAPNNARLSIRFFERGTFGQFINNIKCHQTRLAIEGGGNGQTFLPTWQLLQETCREGGEVSPILAGEVTRSIIENTRYPATLINAIDVRIRADHNVGRRRAQIIKAYYLKNDNKDVPKEVLTVGLNKESDNIPYSLGRLFAVLERIQEVANPELNATIKDKYFGGASATPATILPKLIDLSQKHLRKLNPGNKIYYDKILGEILDKIQVEGGYPKTLNMPERGAFQLGYYHQKQELFKSKKGEE

SEQ ID NO: 3277 - protein, 599 aa, Opitutaceae bacterium TAV1
MILHVLDSLYDRLSGDSDYGIASPGYSTQKISFSVVIRPDGSLVAIEDARDISGKKPVARQLLVPGDAKPPGQGINPCFLWDNSGYMLGYKKEDPKPERTAETFSEFRKKHLALEQEIDAPEFSAVCRFLEKWSPEAAIAQREQLDECASTGFGIFQLQGVSGYVHETSSIRSWWDRQQGRKSDGIAGQCLVSGEETTLAALHDPAIKGVAGAQSAGAKIVSFNCTAFTSYGKDQGYNAPVSARVAFRYTNALNALLSGPQSPRHRVQIGDATTVFWTEIPTITESVLAAFLSGDFEEEASADSKGGKREKHTPPQDDGLVKKLKSFMDVLRQGGGALPSLGDEPATKFYILGLSPNASRLSLRFWYADTLGAMIAHLKAHYDDLAIQRARETDPEFPALWMLLRQTARESKDIPPLLSGPLMRAILTGGMYPNAYYNAVINRIRADREISYLRAAIIKAFLNRNHRYTLPMSLDPERKEPAYLLGRLFAALEKTQRDALGDINAGIRDRFYSAASATPGSVFPRLMRTYQHHLAKLEGGIKVNREKLVQEIYNGLKDIPKHLPLEAQGLFAVGYYHQTRDFYTKRDAGQPAASVAPAV

SEQ ID NO: 3278 - protein, 639 aa, Parascardovia denticolens IPLA 20019
MSLWSNLVQTYDAIQSVAGQEEAAGNEGEGVGNMLLPLNCTILKTQICVTIGSDGELIRIEKDARPVEIVIPCSEQSLGRTGKNPGPHPLCDQLQYLDREIDGEKVKRYLEQLARWKGDNVSLNAIYRYVSAHSISEDAKQYDIDLLAKDGKGKFKDGKTGVRFAVEVPGGGDPHVEKSDEIRRLWQAYLRKSTDQNGHDMLGLPFVSPAENFPKNIVKTAANSKLMSANDNVNFTFRGRFTGRDDALHIDADTSQLIHLTLKWLVNTHGTLTDTQAVVLWAVQKPNEKIIEPSANSLDVAEALLADDEGVHNIQDALVETDYDYARQFGGLLRGFGNPEVLRRHHKTIVLVVLDAAVNGRLGVTFYREFEESQYLEQVMQWHVDMAWPLSRFDKTNQKAVTYIGAPSYKDIINSAYSVEGDRSSKNYQRYSRIVKQQLIECMFGNSRMPKAILESAFHRATRPMSFGSDNLQEWWRSFEVACSLWKKSFIDDALQSNNPMSPERKEKMMQLDTSRNDRDYLYGRLLALADRFENNVLYIQGNQGTRPTNAVKLMSNFVAKPSTTWLALYRQLVPYINASNGAPYFQNDIDDVVALFEGNDFEDNSPLSPAFLLGFSCQRRYSMEKAKERKEAAKVKLK

SEQ ID NO: 3279 - protein, 643 aa, Pelosinus fermentans B4
MSWMQKLYETYENCASAKDTSLLSICHTTQKAQIEIIIDNAGNFNRARVIAKDQARTIIPCTESSGGRAGIKPEAHPLCDKLQYLAGDFAIYGGEVTKGYAKNPTEPYEKYTELLQQWCDSEFTHPKAKAVFEYVKKGNLIKDLVESKVLFLDDNKKLLKEWRGDTKQEVPEIFKVTQNSIQGDAFARWIIEIPTDPQSAVWTDESLFDSWTRFYLSTKKTSGLCLVTGVNIALSDQHPAKIRNDGDKAKLISSNDISGFTFRGRFLSAEQACGVGFEVTQKAHNALRWLINRQGYRRGDLAIVAWSTVGKKIIDPLADPYSIFNIDEMESDSEILAATTQELAIKLNKKIAGYQGEIGNTAGVVVMGLDSATPGRMAMTFYRELTDSDFLHRIEDWHKSCCWIHNYHSKEIIDKKTGKKQKIKVRLVGAPTPNDIVEAAYGSKVDDKLRKTTVMRILPCIIDGEKIPRDLVESVVRRAINRGAMEAWEWNKTLSIACALYRKYQEKENYEMALDEKRAKRDYLYGRLLALADGLEEWALRQGGENRQTNAARLMQRFADHPFTTWPTIELALLPYKARLGKKTAKIEGLISKVTAMFEPDDFISDKKLSGEFLLGYHCQREARWYEKSIDKEIISEIEEEIV

SEQ ID NO: 3280 - protein, 643 aa, Pelosinus fermentans A11; identical to SEQ ID NO: 3279

SEQ ID NO: 3281 - protein, 643 aa, Pelosinus fermentans A12; identical to SEQ ID NO: 3279

SEQ ID NO: 3282 - protein, 643 aa, Pelosinus fermentans DSM 17108; identical to SEQ ID NO: 3279

SEQ ID NO: 3283 - protein, 643 aa, Pelosinus fermentans B3; identical to SEQ ID NO: 3279

SEQ ID NO: 3284 - protein, 626 aa, Methanofollis liminatans DSM 4140
MIIQSLCRHYDILGRDENVDIPRLGYSSAKVSFALVISPDGVLSNIVDLRSDEKKPKPKNMDVPIQKSRSSGVVPYFVCDNAKYVFGVEKMKRGDFEKKFSSSSPENDPAEYTILEENDKDVTLVHRRSRECFEEFRARQHEILDGLDDPGARGFLTFLDGWKPEEFLENSKTRQYKDDLLAGGNCVFECNGDFLHRKGAVRNAWENYSQNESGDVFVAQCLVTGEVGPISQVHNKIQGVVGAQSAGASLVSFNNEAFCSYGKSQSLNSPISESSMFKYTTALKYLLAGQSNRIRIADTTVVFWAETGDKSCEDLVRFFFDPQEAEKIEDQNAEGSRVRDTATIKQIGDILTKVRSGTKIHQEDIGTDPETNFYILGLSPNNARLAVRFWYVDTVEDLIAKVARHHLDMEIVRDDSGPRYFSVYRLLNETVPQSSDRKVVSPLLGGLLMRSILTGTAYPMPLYSAILSRVKVEGSINVVRAGLIKAYLLRLSRSGLTNLKMDVITVSLNEDSSNVPYRLGRLFAVLEKVQSDTNREMKSTINSKYFSSASSTPAVVFPVLLKLAQHHIAKSDWGFKSSQSIEEILAGVDEFPAYLNLEDQGMFMLGYYHQRKAFYKKKETVSSEEA

SEQ ID NO: 3285 - protein, 636 aa, Brevibacillus sp. CF112
MSWLLNLYETYEANLNVVGKVERKSNDQEYMLLPVSHTTQNAHIEVDITEDGHFHSATVVEKSDASTVIPCTEDSASRSGTKIAPYPLHDKLSYVAGDYKAYGGEVKKEEAFPHYIKQLEEWASSPYAVDKVKSIYHYLRKGRLIQDLVEHGILYVDEDQRLLSKWDKNAEARYGAKPPIFSVVAGEQTSAFVRFNVYSPTKVLTKVWNDQQVYDSFIQFYSSKLGGEDFCYVTGKKLPATDKHANKIRNAADKAKLISANDNSGFTFRGRFAQSHEAASISYEVSQKAHNALKWLIHRQGKIIDQRVFLVWSNTELDIPGVTEDLFSIDPTPPPVKDKIAYTNRELAVEVAKALDGYRNKLSGLRDRKDNVNILVLDSATTGRMAVLYYRNMDKEQYFDKLVNWHSTCTWLHTYRKNDNGEFVQFIGAPALKDIAFAAYGPRASDKVVKGVMERMLPCVLDGRNIPLDIIMSSCRRAANPVSMEKWEWEKTLSITCALINKQEEQEGFKVALDESINDRDYLFGRLLAVADVLERRALGADDRASNAVRYMNEFSRHPERTWRTIQACLQPYQARLGRQAFYFNRLIDEIGSRIPIEQFNNKPLSGKFLLGFYSQRHDLYTKKSTTDTEETEATH

SEQ ID NO: 3286 - protein, 648 aa, bacterium
MSWIHRLYETYENCQSMIGKIEDDSKVPLLPICHTTQKANIEIVIDGEGNFKRARVISKELARTIIPCTENSGGRTSGESPHPLCDKLQYIAADYKNFGGDKKHYYEGYLTQLKEWCNSPCHGHFKVKGVLKYVNNGCVIKDLVAHKILFVGDDGKLLKKWDGNKNEKPSIFNLFQNETWQADAFVRWEVEIAGDDCPKVWEDSELWDCWINYYSSKKNIKTLCYITGIESFVADQHPAKLRNDGDKAKIISSNDWEGFTFRGRFTDTKENNKYQACGINFLVSQKAHSALRWLISRQGYRNYDQAFVAWSIAGKQIPKPWEDPFEMLGVEGLVNDNIGAHDTAQQLALKLKNKISGYKSDLGKTDSIVVIGLDSATPGRMAITYYRELTASDFLKRLEYWHESCAWVHAYKFIEEKQGNKKKNKHIHFVGAPAPKDIAEAVHGNKVNDKLKKATIERILPCIIDGRQIPVDIVESIIRRASNKISMDNWEWNKTLSIACALFRKLNEKEGYEMALNETRTTRDYLYGRLLAVAEHVEDRALYIAGEKRDTTAAKMMQRFSERPFSTWKIIEEALTPYKTRLQAKRSGFLHEKKILLDAIHDLFQEGDYENDKQLTGEYLLGYHCQRSALRPEFNETEDVHSETEKNI

SEQ ID NO: 3287 - protein, 200 aa, bacterium
PPLWRLLCQTATLGKSENVSPVLAGGMTKAMLSGRPYPQSLLSVVLGRIRAEKDVGYFRASLLKAFLVRNKQMEVSMSLDLNRKDMPYLLGRLFAVLEKAQSDAISGANATIKDRFFSSAPATPARIFPMLIKNAANHTAKLRKDQDKKGWAFHLEKMMQDIVDELRDFPSTLLAEEQGLFMIGYYQQMKDFYTKKNEEK

SEQ ID NO: 3288 - protein, 589 aa, bacterium
MIKELSELGKKLRSAKESLELIHNAIKDEPVSIEIVISKEGAFQKFEVFEKKMTRAEAITAKKGKARLLLDKAEEVIGYGGESSAKKHGLFKEKLEKYKDLPELLPVISFYYDNKVDGVEKALIEFEKSIPDEKVRNENICFRVESEASRIHEKPAVLNKIIELYDSSQLKKEKKKCSICGMADNPVVDEPHGMIKKVPDSQMSGCALVSYNENAFESYELSGNQNSSICTNCAKLYVESLNWLLASGNEIEVTTKTGKLKKEFRYTNRKNLGPDTAMVFWTRDNEKVDELDFLEAPDSAEVAKLIDSVKSGNEKSGKYLETDKFYACSLSGAAARISVRDWIETSLSGLRESIAGWFSDISMASYDKDSGKLEVRYSRIYDLARSCQRRNSDGSSDTNDTTLPRVATSLWNAALKGSRPPLWILAKVIQRVSKDDITTERAALIKLILNRNNKGGNHMITEALRKENQPVAYVFGQIFAKLESIQYYALGDRNAGIRERFFTYAMTLPGAAFGKLFDLNSKHYKKLKNEKPGLAVNLDKELQELVKAIDINKMPATFTLEEKGQFAIGYYHQRQEQFAGNKNDKVEEE

SEQ ID NO: 3289 - protein, 627 aa, bacterium
MILTALHQYYQRLAARPDATTGLPKVPPYGFSEEKIGWVLVLSKDGKLVDVVPNYTDDRRPQPKLLKVPQPAKKSMNISANFLWGNTQYVLGITNKILKKPVSDYFQAFKALHLEKLEATEDAGLKALVKFLESWQPEQFNSPPCKPEMLDANLVFKLDGEMGYLHERETAQKLWSSMIEPEENSSVLHCLVTGDKASVARLHPPIKGGFLTKHGGQSSGVSIVSFNEDAYTSYGKEKGENAPVSEAAAFGYTTALNYLLRRENNQCVSIGDTSTVFWAVANDPHQAEQAEKTFSWMVNMPADDGEETAKLKPVLDAISQGKPLSEINHDLDPATRFYVLGLAPNASRLSIRYWLDTSFGELSEHIAKHWQDLQLQPPAWGAKPPSVWSLLIQTTPRRKNKEGKFEKSKSEDIPKQLAGELMRSILTGQVYPKSLLAKLVGRIRSDGDVGRLRVALIKAVLQRNSRIFGNTKELPMALNRDEPDIAYRLGRLFAVLEIAQRAALGNLNASIRDRYYSGASTTPNSIFPMLMKNYKNHHSDLRKGKKAEWVKDAPKTAGWLEKEIGQITSNFDSSSPFPRTMNLEQQGRFVIGYYHQRFTKHKDAPEEIVIAASIDTTETPDNQPVGE

SEQ ID NO: 3290 - protein, 545 aa, Acidocella sp. MX-AZ02
MNPDGTIAKVEDLNDYTKKKPQARRLAVPQEVIRTSGVCSNFLWDKTAYTLGIGRDKDKKSVRFFEKEHAEFARLHHERLAGTNDAGLAALLTFIDSWRPETFSEDGRFTPDMLDKNVVFGLAGGPLEYLHERSAAQRLIGVPAQVWKASICLVTGEKQPIERLHPAIQGVDGAQSSGARLVSYNADAFTSYGADSGANAPTSVQAAFRYGTALNRLLDRDSRNRLKIGDTTIAFWADADGGGEASARAAEEAMAMFMEPPDDPSEANKLRETLADIRAGRLPGAFPALEPNTRFYILGLAPNAARLAVRFWLEDSFGNFFERLGSHFEALRIEPEPWTRTPSINYLLVRTTALQEKWDNVPPLLAAETTRAVLSGQPYPRTLLAAVIMRLRAGDTFTGWHAAIIKACINRRSKETLPVARDTEYPDSAYQLGRLFAVLEAAQYAALGKVNATIADRYYGAASATPARVFGTLLRNARNHISDAMKRGKGKWVERRLDDIFAHLPTEFPKTLSLEAQGRFAVGYYHERAWRGPGDASPQEEDNKE

SEQ ID NO: 3291 - protein, 611 aa, Thermaerobacter subterraneus DSM 13965
MFEELVVLGRHLEEDGVLLPPGFHGDYTQPIKWIVHLWPDRVYLEAAEIYVPRPYDAGRTRGIRAYLLTDEAAYALAVSKEKDGGDDKRAREKHAAFRKLVDAFRAWDGLQDPALREVLEWLCRALDDGLVHQDPRYPQILAKDWVSFVPEEGPLRGRHLFEHPDAKAFWLVELERRTDVGGASKKFRLSGQCAVCGDVRPLVKRIPLGVKLPGLRPIPLHSLNRDAFTSFYGGGGTSKRSHLSVCLRCGDTAARAFNHLSTSDQHHRELVRDGQKREGLGNQIAVFWLKAPAPVPVQVGDRVVDVADLTEVDWGSILMETHASESAPEPMPSQLLELLRVPWKPSDAALRLDDYAFYLAVVSPNVARVALREWIQVSLEEFKEHLRRYLEAVRIVSPFGDPPWPLAIGSLIDGLGTQNPQMVRGLLRTAFTGTRPPAGLLVRGVAVLRNPRVLQDLRETTRLHAVASVLKLSLWYGKEGVERMSALDTTLNSPAYLCGRLLAILEEAQLRAANFNLNRTLVGRFYGAASTAPAATFGGLLRLATTAHLPKTDQELNRLVEEVAASLDKAGGFPRTLSLVEQAEFGLGFYHQRAAFRDQRRKIKDEGGREW

SEQ ID NO: 3292 - protein, 613 aa, Xanthomonas translucens pv. graminis ART-Xtg29
MILSALADYYQRLLDDPTSGIAAPSYSQEKIGYAIVLTADGSVVAVEDEHDYDGKKRIAKALSVPQPEKRTVAVKSNFLWDKTSYALGASASSKRSEQEHAAFKALHQQALAGSDDPGLLALLAFLDTWSPTQFSEHPHFARHGEALLDTNVVFRLDGDTGYLHQRAAARAAWERQQGQGANSAFGICLVSGERAPLARLHPAIKGVNGAQSSGASIVSFNLDAFTSYGKSQGENAPVSEQAAFAYTTALNHLLRRDPRNRQRVQIGDATVVFWAQAKTTAQADGAEDLIADFLRGGEAGDPGIADGQATQRLQLALEQVRQARPLREVDATLDDEARIFVLGLAPNASRLSIRFWETQTLAGFARRLADHYHDLALQPPAWKRQPTPQFLALQTAPVYGEHGKPKAEDVSPLLAGELTRAILAGTRYPRSLLGAIVMRFRADGQVNPLRVALCRAVLAREARLDTQQGLSSTKGEPPVSLDTANTDPGYLLGRLFSSLENLQRAALGSQINATIRDRYYGAASATPASIFPILLRSAQNHFGKLRKDKAGLAVNLEKEIGQIIDALPTSFPRTLPIEEQGRFAIGYYHQTQARFVRNDGQDAPDTATEGDHA

SEQ ID NO: 3293 - protein, 643 aa, Prevotella sp. oral taxon 473 str. F0040
MILQALYQLYQSLEANGKTTPEGMQWKPIPFVITITPEGLYVGIEDTRDKKEAPKGKLFLVAKDKKRTGSKSYETANLLWDHSGYVLNIPTDESERKAELAPLQHEAFLKLVNQLAEQHPQHEGVRAIRAFYAQQEHLKVPRELFTNPKETSPNIVFKLSNATDANEVIASDTNLVWGELAAEQSAGNEQVGRCLITGEVLPLARLHDTIKLPGGQANPSLISFNLSAFNSYGKEQGSNAPISQKASNAAMAAINVLLDKDAATNYKLGNTTFLFWSTLTHNQVVVEQEQNWGVSLDELMASYKEATFSGLINQEEEEEDAQENPSTTSKTKKKTKKEKADPTAESERVLKALRVMTSAKDGHISWQNQERFYLLGLIPNAKRVCVKLWMEGTVSEIVGNTIQHLKDLNIVSFKNRNPDEERPPLRSVYSLVRAVSTADSADKWSPILVQSIVESLIKGLPYPQSLQMACLDRVHHDGRSKYPVTELRAAILKAYINRKYKQPILAMALDLNNSHPAYVAGRAFALLERIQELAIPGVKANITDRYYRMASATPNMVFGRLFQLAQHHLTKIKRDSGGLGYYFERELGKVVNLLPGGQSALPAHFTPDEQSIFAVAYYHQKNYRDEKAEEKAAAKEVAEASEG

SEQ ID NO: 3294 - protein, 465 aa, Aggregatibacter actinomycetemcomitans Y4; identical to SEQ ID NO: 3227

SEQ ID NO: 3295 - protein, 677 aa, Aggregatibacter actinomycetemcomitans Y4; identical to SEQ ID NO: 3241

SEQ ID NO: 3296 - protein, 623 aa, Selenomonas sp. oral taxon 138 str. F0429
MSWMEQLVQTYDENERFAGRDGIDGMRAMLPLVGHIIQNAQIEITLSADGELIQAEMIPKEQQRTLIPCTPDSASRTSSPSPHPLHDNLSYIARDYYEYVKKRPKGQKKPYPMYKELLGSWVAADANPKVQAVYFYISNHDVLHDLIEKNVLTGDDRNISKSMVRFRVVIDGDDCSELWRDIQIQKSYQKFFRQKFSQTKGQLCYATGKMLLSTEKHGKGIRFPGDGAKIISSNDKEGLTFRGRFINGDECISIGYETSQKAMNALTWLVQNQGYKARKTNREGRVFLAWGRCGAFAPSVFDDTAHLTRRRRPAEVARPSSMKGWAESLTHALMGYCHEFKQAKMSQVNVMILDAATKGRLSICYYSEMAGEDFIERIERWHSLGRWRQHGYDREKDETFVYFGVPTPEILVKACHGEKVGDSQIDQAMERIFYAILQGKPLPVDMERIVMRRAVKRSVCDSYYDWNRQIIEPACSIIARRLNHTEEVYTVALDETKTDRSYLFGRLIAVADQMERLTFSPEEKGSRTTNAMRYMEIFSSRPNATWMTLQKKLLPYQRKREMYGGKERKLISKIGSMFNDDDFLSNRPLDGKFLLGYYCQQYAMEQKREENRKQKEFSTEEDV

SEQ ID NO: 3297 - protein, 683 aa, Neisseria sp. oral taxon 020 str. F0370
MSWMSKLYQTYEYAQKQNLDDEDLALPFHMPKAAHLKVVLNDKGELVCAERFDGKKQVPIQVTEKSSKRSGSTIAPYALHDNLQYIAKTAEQYLTIEYLSKVAEKKAPQKGGEKWKAFLSDNDDGRRKFADSEKEKFRNSFECYEKQLSDWADFSGLKEIQAVLQYIRKGSLIKDLLSHQVFTIEEDILLSKKDDPFGFTIVWAVEIPGDPHAELWSKNSVQADWIRYQESMSEQDSTQKDLCYITGEQEFPVAAYPKIQGNAKLISANDTGGLTFLGRFLTDKQAVILGRDVSQKAFNVLKWLIKRQGFKFGDQVTVAWAISGKRIPSPLQDTFVELDLDNLGSSIGKTEAKKQPENQEGGIDWSDNIGKAAAEIIKRKMRGYRADLEKHEQISLLMLDSATPGRMALTYYQEFLPDDYFANLDAWVDDTAWYQRHSINKKQTVWPILPPSPYAVYETVYGKRGSDTLKKQLYARLLPVIAGGSSVPLPYDLVQKSFQAACNPSGCEHWEWQRNIGVACALYKGWRARHHDSSQKRIYSMDLDLENRSRDYLFGRLLAVAEKLESTALRIADEERATTAERYMQRFAVHPLSTWLQIETNLVKSYKDRLRNNRYMGFLRNREKEIDEIMSALNELRDQTGCSLDTKLDGEFLLGYHSQKMAYRNKVNAQVQSDMQDDQAESN

SEQ ID NO: 3298 - protein, 614 aa, Xanthomonas translucens DAR61454
MILSALADYYQRLLDDPASGIAAPGYSQEKIGYAIVLTTDGSVVAVEDEHDYDGKKRIPKSVSVPASFKRPGIGTNPFFLWDKTSYALGASASSKRSEQEHAAFKALHQQALADSNDPGLLALLAFLDTWSPTQFPEHPHFARHGEALLDTNVVFRLDGDTGYLHHRAAARAAWERQQGQGANGAFGICLVSGERAPLARLHPAIKGVNGAQSSGASIVSFNLDAFTSYGKSQGENAPVSEQAAFAYTTALNHLLRRDPRNRQRVQIGDTTVVFWAQAKTTAQADGAEDLIADFLRGGEAGDPGIADGQATQRLQLALEQVRQARPLREVDATLDDEARVFVLGLAPNASRLSIRFWETQTLAGFARRLADHYHDLALQPPAWKRPPTPQFLALQTAPVYGEHGKPKAEDVSPLLAGELTRAILTGTRYPRSLLGAIVMRFRADGQVNPLRVALCRAVLAREARLDTQQGLSSTKGEPPVSLDTANTDPGYLLGRLFSSLENLQRAALGGQVNATIRDRYYGAASATPASIFPVLLRSAQNHFGKLRKDKAGLAVNLEKEIGQIIDALPTSFPRTLPIEEQGRFAIGYYHQNQARFVRNDGQDAPDTATEGDHA

SEQ ID NO: 3299 - protein, 666 aa, Photobacterium marinum
MSWLTRLYQTYEAAQALDLPQSEQIMPICHTPQNAHIHITINEQGEFLRASVLEKTQIILPATEESAGRAGSKPPPHPLCDKLQYVAADYKAYGGAKPSFYDKYCQLLDSWVSSSFTHLKARAVYRYIRKGRVMADLIAAGICFADDDEQLLTSWQDSEQPQPLLFKMLPKEKGHIEQGSALVCWSVECVGDKCPETWKDRSLQQAWIDFDIHNGGSAELCLVTGKEAAAAVNHPAKIRHTGDKAKLISSNDKSGYTFRGRFFDSHQAANVSFEVTQKAHNTLRWLIERQGYRNGEQVIVAWAVKGSLILQPMEDPELEEQDYDTFEAGWGWGDDDLAAQVISSSPDTPEVPDRVEHTRDLGQRFGHLFRHKLKGSHSAVSLTVTDTIVVMGLDSATPGRMGITYYRDFLSYEYLSNLEAWHRDCAWWQRASKEKQEAGKPKWYRCAPSTWAILQAVYGDIIKSNESLKKNLSERLLPCITERRSIPVDMMRRATQRAAQRHSFKIDEQWQWEQNLGVACALYRGYAIRQLGRKYAMALETDNHSRDYLYGRLLAIAENVEQFALDKAGEKRLTNAARLMQRFADRPFSTWKTIELSLQPYWHRLQGTYGGFVYNRKKALDEVLGAFDSESFSSDKALSAEFLLGFHSQRLELMVKKAETELTEQE

SEQ ID NO: 3300 - protein, 61 aa, Aggregatibacter actinomycetemcomitans serotype b str. SCC4092
MILHALTQYYQRKAKYDGGVAPEGFENKEIPFIIVIDKQGKFIQLEDTRELKNKKKSPALF

SEQ ID NO: 3301 - protein, 257 aa, Aggregatibacter actinomycetemcomitans serotype b str. SCC4092
MQSENWAECTKIKGCNLSFRLAEETVALACQSQAVQNHLRQINQDNFDNAPKGICLVTGKFASIARLHNPIKGVNAKPSPFTSVNLSAFESYGKEQGFIFPVGEQAMFEYTTALNTLLAGENRFRIGDVTTVCWSEKPTPLESRISRLMNGGGKDNPDAHIDAVKSLYKSLYNGKYTEPDGKDKFYLLGLSSNSARIPVLLRLKKLITQILMTVKKKKLRKNAAAWDANSPYLMVYTAATALFPHTLPNKQDFPKKI

SEQ ID NO: 3302 - protein, 471 aa, Aggregatibacter actinomycetemcomitans serotype a str. A160
MHSNLWSKSSIKEQWIKYQESQSGQEDKKPELCYITGESSYLANAYPKIEGNAKLVSANDTDGFTFLGRFLIDKQAAALGREVSQKAFNMLKWLIKRQGIRNGDQVTVAWAISGKAVPSPMKDLSDEIDWDNLDISADESAVENSDRFSSPTSSETPDWSTNIGKPAAQIIKKKLHGYQEELKNHEQISLIMLDSATPGRMALTYYQEFLPADYFANLDAWVDDFSWYQRYSVEVQNGKKTDKRTQWRGVPPSPYSVADAVYGKSLSDTLKKQLYARLLPVIAGGKSVPIPDDLMQKSFQVACNPNGSENWEWQRNIGVACALYKGWRARHHDLSERRTYSMALDKENRSRDYLYGRLLAVAENTESYALYLVGEKRATTAERYMQRFAEHPFATWRNIELALKPYQDRLRNNGKDTGAQAIGEIMDLFENQDFSSDDKLSGEFLLGYHCQKMDIARRIAEISANKSKTDE

SEQ ID NO: 3303 - protein, 592 aa, Aggregatibacter actinomycetemcomitans serotype a str. A160; identical to SEQ ID NO: 3234

SEQ ID NO: 3304 - protein, 569 aa, Mannheimia haemolytica serotype 6 str. H23; identical to SEQ ID NO: 3079

SEQ ID NO: 3305 - protein, 585 aa, Rhodopirellula europaea SH398
MILQRLSEYYDVIDADPEIEIAQEGFAPQKVTFEIVLSRDGSIAAINDLRSTEGKRKVPQSLRLPFEGRTSGVKAMFLWDKAEYLLGYLSPELRDVPDGESESDAKKRLKKIDRVSKCFEASKETHLGFADSIDNDDYAVLCQYYSNWERSKLTVDQQTLIDELGTGFGVFRIDGNRQRLHDSNQLRRFWSGHQMKRGGDEVSGTCLVTGDRTPLARLHGSIKGVRDAQSSGASIVSFNKPSFESFGKTQSFNSPVGEQAAFKYTTALNHLLDRKNNRTIQVGDATCVFWSEAKDTIAEDVFSFGLDPARFEDESRATEIGNVLSQAVDGNAVLPEPGAAFHVLGLSPNASRLSIRFWISGTVIEMVGRVAEHQRRLDIVRSGKDSDWIPLWMILAQTARESKEVPPLLGGALLRSVLTGGRYPEALLTTILRRIRAEQEIRHVKAAMIKAILNHNHQKEIPVMLDPVRPDPAYQLGRLFACLERAQEDALPGLNATIKDRYFGAASATPGTVFPRLIRMNQHHIGKLEGGKKVVAEKRIQEIMGRLHDFPSHLGITDQGLFSIGYYHQRQDFFTKKETTPENVQ

SEQ ID NO: 3306 - protein, 596 aa, Ruminiclostridium cellobioparum subsp. termitidis CT1112
MILQSLVRYYEILAEDENSDIPRLGYSRTGVSYALNISKEGELLGVIPLKIPSGNGKKLVPQRIIVPEQEKKSVGIKSNFLCENSSYTLGIDNNGKPDRTKKCFEAFRELHNKILNNVECTEAKALLNFVNKWDVNNASSHIALKDYLEDLYTGANIVFRLDGVGDIHKNKTILKAWEEYKNNSEGSKKMWCLDCGEYANVARLHPNIKGVRGAQSVGAAIVSFNDRAYESYGREKEQGLNAPVSEYAAFAYTTVLNSMLSDNQHKQYLGDTTVVFWAESPQRYYQDFASMFIDPDELKDGDNSKFERDKGAVDEVKAIFEKISNGAVIGDYSSGFNKNVKFYILGLAPNAARLSIRFFTVNSFGDFIEKVSRHYEDLRMEKQFQDEQDLFSLWRLLNETVSPKSNDKSASPILAGAVLRAILTGSHYPAALFNSIMLRIRAEHSINHHKAAIIKAYLLRNSNKFKEVLTVSLNEQSNNRAYVLGRLFAVLEKAQQDASESKLNSTIKDRYFTSACATPASVFPILLRLSQHHISKSSKDGYGKANDKKMSKILDILDIEKNPFPAHLLLEEQGVFVLGYYHQKNALYKKNDEKEN

SEQ ID NO: 3307 - protein, 241 aa, Exiguobacterium sp. S17
MSVWQQLYETYNQHLDEVGKPESRWEGKTFTLLPISHTTQTAHITVNITPSGEFHSAEVIEKGNGNTLIPSTEDSSSRAGSVVAPYPLHDKLPYVAGDYEAFGGGYKKDNAHLAYIDNLKKWSESSHGFDRLKSIYSYLQKGRLIEDLVNEKVLFAETDGTLKWTWKEKEVKPLIYSVVTGGLEGAFIRFHVHSSEQLNQEPWRDPAFYQSFIDYYAEQAGESTLCFVTGQQKVGSTKQRE

SEQ ID NO: 3308 - protein, 595 aa, Pseudomonas stutzeri B1SMN1
MILSALNDYYQRLLEQGADGVSPFGYSQEKISYEILLSPDGEVVDVNDIRQVAGNKPIPRSLSVPQPEKRTSGTKSNFLWDKTSYVLGVSSKDGGRTALEHAAFKELHLQALADEDDAGLQSLTKFLKQWEPQKFRPPTFSEEMLDTNVVFRLDGQQQYLHESPAAQTVRAKLLASGDSRNGLCLVTGQQQPLARLHPAVKGVNGAQSSGASIVSFNLDAFTSYGKSQGENAPISEQVAFAYTTVLNHLLRRDEHNRQRLQIGDASVVFWAQSADTQQSMQAETTFWSMLEPPSDDGQEAEKLRNVLSAVAQGRPLRELDPQLEDRTRLFVLGLAPNASRLSIRFWESGDLESFARRLGEHFLDLHIEPPPWKTAPAIWRLLYATAPSRDGKAKAEDVPAHLAGEMARAILTGRRYPQSLLATLIMRMRADGDISGVRVALCKAVIAREARLGGNKTNPEELPMSLDKEAANPGYRLGRLFAVLEGAQRLALGDRINATIRDRYYGAASATPATIFPMLLRNAQNHLAKLRKDKPGLAVNLERDIAEIIGGLQSQFPRSLRLEDQGRFAIGYYHQSQARFTRTPDPENLEQGAPA

SEQ ID NO: 3309 - protein, 638 aa, Desulfovibrio alkalitolerans DSM 16529
MLVQTLAAYADSYLADDLAAIAFEEKPVRYLVELDDAGRFCGIRERVRQETRRVGKKEKSVEVVETLRVPRSPVNRNSGVHPLLGCDALPYLFGPRLGVWTAEGKGDKEGRNHAGFVELIQVVAEQTGDAALAACAAFYADPAAVERAAAEVAALKPPPGALASLSVRPARLDSDDPGGPVVGRPVVRRYWTAHYERASGERHAKGGEGMCLISGESGPLAVTHDLIKGAGNLGGQAGVALMSFDKAAFRSYGWEKNANSPVSPGRASAYVLALNDLLRPGAHRRGMSPSVSLHTRSDYGGMAFLYWTREPTDVLPIQILQEPDPDNVKRLMDTPHRPSQMPHGLAGRGNEFYLLAVSGNGGRLVVRDWYPESLEQVTDNVRQWFSDLAMADVFKGGERARPPSIYALLSAVSPPGREPNDKANAAISLAFMRRALHGLPFGHSVLAAALNRLRREQGKARLAADRVALVRLCVNDIAKTKKGGPIMAECLDNDQNDAAYLCGQLLAEYEALQYQALGEVNVTVGDRYYAMASTRPLLAFKRLEDLSRAHLKRLRSDKKAAGIALQQRITALVKRIGESACGNFPAALSLEEQGRFVIGYHHQKADNARKAKEAKAAKEAAKAADAAAESAVPTDAKN

SEQ ID NO: 3310 - protein, 642 aa, Desulfovibrio sp. X2
MLVQALAAYADSYLADDLAAIAFEEKPVRYLIELDDAGGFHGIRERVRQETRLVGKKEKSVEVVDTLRVPRSPVNRNSGVHPLLGCDALPYLLGPRPGVWTAEGKEEKEGRNHAGFVEFVRAVAEETGDPSLAACAAFYADPEVVERAAAEVAALKPPPGALACLSVRPEQLDSDDPGGPVVDRPAVRRYWTAHFERASGERHAKGGEGMCLVSGEHGPLAVTHGLIKGAGSLGGQAAGVALMSFDKAAFRSYGWEKNANSPVSPGRASAYVLALNDLLRPGAHRRGMSRGVSLHMRSDYGGMAFLYWTRDPTDALPIQILQAPDPDNVQRLLDTPHHPSQMPHGLAGRGNEFYLLAVSGNGGRLVVRDWYPESLEQVTDNVRQWFTDLAMADVFKGGERARPPSIYALLYAVSPPGREPSDKVNARPSLALMRRALHGLPLGRSILAAALNRLRREQGDNRLAADRLAIVRLCVNDIAKTKQGGPVMAECLDNDQNDAAYLCGQLLAEYEALQYQALGDVNVTVGDRYYAMASTRPLLAFKRLEDLSRAHLKRLRRDKKAAGIALQQCITSLVKRIGQSACGNFPAALSLEEQGRFVIGYHHQKADNARKAREAKAAKEAGKASPDSGGSPDIVDSTPAMP

SEQ ID NO: 3311 - protein, 631 aa, Streptococcus agalactiae CCUG 39096 A
MDFFTSLLKTYEKAELADLVDHQKRNNEPVLLPIYHTSLKSNGKNIISVKLDKDGQFHKAEFMTDKQMIIFPVTADSVARSGSNPAPHPLVDKFAYYSAEMGQSQYDSFHKQLNNWIDYCEEGDVKRFLTIVQQFILKPEFLTLILDSLIGPDYQNNQLKVTFCDATGKEKLIDLSACFLEFSIDQFQGFKNESVSTFKTLHQSYISFVEANRENLGICNISGREEQLTDKHRGLMGNAKIISVSNKREAYKGRFREREDVFSVGYETSEKIHLMIKYLLENKNTSTWLGSSQYLINWFSDDLTNDSRLDIVSPIFDDGLEEDDDEDMPSVIALATEENKRIGKSFIKGQKLFANDATYYIAILNKTSNGRIALKYFRQIQASQLLTNLDKWQEKYSWESRSKSGKSRLRTPAFHDILNVSYGVDRDRFLELDNDNFKSDQVQKLVTSLIDGKPMPQSIVKKLGNNVKERHRYRKHWYQVEQVCLAILHKQNGEEFSPMLNHTNQNRSYLFGRLLAIFELIETLRYSLEGNGSDRITNAERYWTAYTGQPTKLMMLLENKIKPYEETLKLNRRGSWKKLEKEKEEILELLNPLLETETMEKPLDYRFIFGYYAEKNYYYPKQNTEVTESEE

SEQ ID NO: 3312 - protein, 631 aa, Streptococcus agalactiae GB00003; identical to SEQ ID NO: 3311

SEQ ID NO: 3313 - protein, 631 aa, Streptococcus agalactiae str. Gottschalk 1005B; identical to SEQ ID NO: 3311

SEQ ID NO: 3314 - protein, 631 aa, Streptococcus agalactiae GB00202; identical to SEQ ID NO: 3311

SEQ ID NO: 3315 - protein, 631 aa, Streptococcus agalactiae GB00219; identical to SEQ ID NO: 3311

SEQ ID NO: 3316 - protein, 631 aa, Streptococcus agalactiae GB00264
MDFFTSLLKTYEKAELADLVDHQKRNNEPVLLPIYHTSLKSNGKNIISVKLDKDGQFHKAEFMTDKQMIIFPVTADSVARSGSNPAPHPLVDKFAYYSAEMGQSQYDSFHKQLNNWIDYCEEGDVKRFLTIVQQFILKPEFLTLILDSLIGPDYQNNQLKVTFCDATGKEKLIDLSACFLEFSIDQFQGFKNESVSTFKTLHQSYISFVEANRENLGICNISGREEQLTDKHRGLMGNAKIISVSNKREAYKGRFREREDVFSVGYETSEKIHLMIKYLLENKNTSTWLGSSQYLINWFSDDLTNDSRLDIVSPIFDDGLEEDDDEDMPSVIALATEENKRIGKSFIKGQKLFANDATYYIAILNKTSNGRIALKYFRQIQASQLLTNLDKWQEKYSWESRSKSGKSRLRTPAFHDILNVSYGVDRDRFLELDNDNFKSDQVQKLVTSLIDGKPMPQSIVKKLGNNVKERHRYRKHWYQVEQVCLAILHKQNGEEFSPMLNHTNQNRSYLFGRLLAIFELIETLRYSLEGNGSDRITNAERYWTAHTGQPTKLMMLLENKIKPYEETLKLNRRGSWKKLEKEKEEILELLNPLLETETMEKPLDYRFIFGYYAEKNYYYPKQNTEVTESEE

SEQ ID NO: 3317 - protein, 631 aa, Streptococcus agalactiae GB00247; identical to SEQ ID NO: 3311

SEQ ID NO: 3318 - protein, 631 aa, Streptococcus agalactiae GB00300; identical to SEQ ID NO: 3311

SEQ ID NO: 3319 - protein, 631 aa, Streptococcus agalactiae GB00535; identical to SEQ ID NO: 3311

SEQ ID NO: 3320 - protein, 631 aa, Streptococcus agalactiae GB00555; identical to SEQ ID NO: 3311

SEQ ID NO: 3321 - protein, 631 aa, Streptococcus agalactiae GB00601; identical to SEQ ID NO: 3311

SEQ ID NO: 3322 - protein, 631 aa, Streptococcus agalactiae GB00651; identical to SEQ ID NO: 3311

SEQ ID NO: 3323 - protein, 631 aa, Streptococcus agalactiae GB00653; identical to SEQ ID NO: 3311

SEQ ID NO: 3324 - protein, 631 aa, Streptococcus agalactiae GB00864; identical to SEQ ID NO: 3311

SEQ ID NO: 3325 - protein, 631 aa, Streptococcus agalactiae GB00893; identical to SEQ ID NO: 3311

SEQ ID NO: 3326 - protein, 631 aa, Streptococcus agalactiae GB00909; identical to SEQ ID NO: 3311

SEQ ID NO: 3327 - protein, 631 aa, Streptococcus agalactiae GB00911; identical to SEQ ID NO: 3311

SEQ ID NO: 3328 - protein, 631 aa, Streptococcus agalactiae GB00914; identical to SEQ ID NO: 3311

SEQ ID NO: 3329 - protein, 631 aa, Streptococcus agalactiae GB00933; identical to SEQ ID NO: 3311

SEQ ID NO: 3330 - protein, 631 aa, Streptococcus agalactiae FSL S3-014; identical to SEQ ID NO: 3311

SEQ ID NO: 3331 - protein, 631 aa, Streptococcus agalactiae FSL S3-137; identical to SEQ ID NO: 3311

SEQ ID NO: 3332 - protein, 631 aa, Streptococcus agalactiae FSL S3-442; identical to SEQ ID NO: 3311

SEQ ID NO: 3333 - protein, 631 aa, Streptococcus agalactiae CCUG 29376; identical to SEQ ID NO: 3311

SEQ ID NO: 3334 - protein, 631 aa, Streptococcus agalactiae CCUG 47293; identical to SEQ ID NO: 3311

SEQ ID NO: 3335 - protein, 631 aa, Streptococcus agalactiae LMG 15090; identical to SEQ ID NO: 3311

SEQ ID NO: 3336 - protein, 631 aa, Streptococcus agalactiae BSU454; identical to SEQ ID NO: 3311

SEQ ID NO: 3337 - protein, 631 aa, Streptococcus agalactiae BSU248; identical to SEQ ID NO: 3311

SEQ ID NO: 3338 - protein, 631 aa, Streptococcus agalactiae MRI Z1-198
MDFFTSLLKTYEKAELADLVDHQKRNNEPVLLPIYHTSLKSNGKNIISVKLDKDGQFHKAEFMTDKQMIIFPVTADSVARSGSNPAPHPLVDKFAYYSAEMGQSQYDSFHKQLNNWIDYCEEGDVKRFLTIVQQFILKPEFLTLILDSLIGPDYQNNQLKVTFCDATGKEKLIDLSACFLEFSIDQFQGFKNESVSTFKTLHQSYISFVEANRENLGICNISGREEQLTDKHRGLMGNAKIISVSNKREAYKGRFREREDVFSVGYETSEKIHLMIKYLLENKNTSTWLGSSQYLINWFSDDLTNDSRLDIVSPIFDDGLEEDDDEDMPSVIALATEENKRIGKSFIKGQKLFANDATYYIAILNKTSNGRIALKYFRQIQASQLLTNLDKWQEKYSWESRSKSGKSRLRTPAFHDILNVSYGVDRDRFLELDNDNFKSDQVQKLVTSLIDGKPMPQSIVKKLGNNVKERHCYRKHWYQVEQVCLAILHKQNGEEFSPMLNHTNQNRSYLFGRLLAIFELIETLRYSLEGNGSDRITNAERYWTAYTGQPTKLMMLLENKIKPYEETLKLNRRGSWKKLEKEKEEILELLNPLLETETMEKPLDYRFIFGYYAEKNYYYPKQNTEVTESEE

SEQ ID NO: 3339 - protein, 631 aa, Streptococcus agalactiae STIR-CD-14; identical to SEQ ID NO: 3311

SEQ ID NO: 3340 - protein, 631 aa, Streptococcus agalactiae STIR-CD-25; identical to SEQ ID NO: 3311

SEQ ID NO: 3341 - protein, 631 aa, Streptococcus agalactiae str. Gottschalk 998A; identical to SEQ ID NO: 3311

SEQ ID NO: 3342 - protein, 631 aa, Streptococcus agalactiae str. Gottschalk 999B; identical to SEQ ID NO: 3311

SEQ ID NO: 3343 - protein, 590 aa, Phaeospirillum fulvum MGU-K5
MSILAALSKAYDRLAEDHKVPPFGYSSEKIGFLISLNEDGTPAGSPIDLRLGTGKKLAPRMLDVPQPSKRTSGIAPNFLWDKTSYVLGVTAGDGKRLADEHSAFVKRHNDALAATDDPGLRALLAFLRDWTPDTFAALGWPEEMKDQNVIFAFGRDYLKDQYLHDRAAARAVWADLASSGTQQTQAVCLVSGKTAPIARLHPAIKGVWGGQSSGVSIVSYNKDAFESYGHEQGDNAPVSEAAAFAYTAVLNRFLESDSRNRLQIGDASTVFWADASDAPTAELAENAFLAMLGGIDEDKQAGEVRAILDKIRQGLPVHDFAPHLSEGVRFYVLGLAPNAARVSIRYWFEDDFGHLAENYRRYVEDIRIAPPPRDPYPPLWRYLQETAVLGKRENVPPNLAGELLRAILTGTRYPLTLLSNILMRLRSDKSVTALRVALLRAVLIRNYGYTDKEAPVAFDPDNTNKGYLLGRLFAVYEHVQSAALGRNVNATIKDKYYGAASAQPRKVFAILESGSANHLSKVGKARPGARVNLEKEIGAIMGLMSPGNDPFPPSLSAEQQALFGLGYYHQRNQFFVAKDHDSSAQKETAV

SEQ ID NO: 3344 - protein, 569 aa, Mannheimia haemolytica D38; identical to SEQ ID NO: 3079

SEQ ID NO: 3345 - protein, 569 aa, Mannheimia haemolytica MhBrain2012; identical to SEQ ID NO: 3079

SEQ ID NO: 3346 - protein, 569 aa, Mannheimia haemolytica MhSwine2000; identical to SEQ ID NO: 3079

SEQ ID NO: 3347 - protein, 565 aa, Mannheimia haemolytica D193
MPSYGFSEEKIGWVLELDSKGNLVNVISNLTEDKKPKPKLMSVPRPEKRTSGIKPNFLWDKTAYVLGIESNPDKATAKDQPINFAEKTFEAFKQYHLDLLADSNDEGLMAIRNFLQQWQPTHFAESICPREILDANVVFKLVGTSGYIHQREAAQTLWTSLLINQSDNAEKGLCLISGKLSPIQRTHPPIKGVFGGQSSGGSIISFNKESFTSFGKEQGSNAPVSFAYTTALNYLLRTEKHRLTIGDASTVFWAEADNTTQAEAAEGFFAALMTPPDDEQENQKIFEELQKISKGRPLAEISPELSENTRFYVLGLAPNAARISVRFWLDTTFGQLAKNLSEHWQDLALEPCPWKTPPSIWRLLLQTASLGKSENISPVLAGEMARAVISGHLYPMSLLSQLVTRIRADGDINGLRVALMKAVLQRKFRKGFIKEGVPMSLNKESDNQAYLLGRLFAVLERIQSQALGELNAGIADRYYGSASAVPFSVFPRLLSGAKHHLSRLRKDKGGMAVNLDKDLGEIIASLPENFPRHLSIDEQGRFAIGYYHQKQSYFAKKETTESIEN

SEQ ID NO: 3348 - protein, 631 aa, Streptococcus agalactiae MRI Z1-038; identical to SEQ ID NO: 3311

SEQ ID NO: 3349 - protein, 705 aa, Aggregatibacter sp. oral taxon 458 str. W10330
MSWIQKLYRTYNEIEKNTNLSDLEKEKLAPLWHSPQTAHIQITLDGDGKFLGAKVLTDKPIIMLPVTESSEGRTSGLAPHALADSLQYIAKDLGLTYQKEVITESEGKNGKKKKTKTKQEDLIFNLYADQLDKWCTAIDNKKVLAIQKYIHKGTVLTDLIERKVIPVDDNGELLTNWSEKENKDKQKPELFNVLTKEQGKFEIRKALVVWSVQIPGDVVSETWKDKEVQQSWGNYYQQTLKSQFCTVTGDEQKIRESHPAKLLYSGDKAKLISSNDKEGFTYLGRFEEANQATTISAEVSHKAHAALRWLIDRQTTARNNEQVTVAWAISDKPVPSPMKDISSEIDWDNLDISAVENPDEFSSQTSSEQLSPDWSVNIGRAAAQIIKKKLHGYQAELKDHEQISLIMLDSATPGRMALTYYQEFLPADYFANLDAWIDDFSWYQRYSIEVQNGKKNDKRTQWRFVPPSPYSIAEAVYGKSLSDTLKKQLYARLLPVIAGGTSVPIPEDLVRQSFQAACNPNGCENWEWQRNIGVACALYKGWRARHHDLSQRRTYPMSLDTQNRSRDYIFGRLLAIAEHLERTALRIANETRATNAENYMQRFVMRPFHTWEQLETNLKPYKDRLRKDYPVRISEKFVLTSPIGFLNNRENEINQLICVLDDLKQEGCDLDKPLEPEFLLGYHSQKMAYRNKSNQPEQEVTETHE

SEQ ID NO: 3350 - protein, 592 aa, Aggregatibacter sp. oral taxon 458 str. W10330
MILASLARYYRRLAAETDDMGNPKVPPYGFSEEKIGWILVLDKEGRLKTVVPNLTADKKPQPKRMSVPRPEKRTSGIKPNFLWDKTAYALGVEANKNKAEVKENPFTPSEKTFEAFKQYHLDLLQNSEDEGLQALCRFLQNWQPAHFATENLPAEMLDANIAFSLEKPTALIHKREAAQSLWAGCLKSDEALEGLCLISGDTAPIARLHPAIKGVFGGQSSGGSIISFNKEAFASFGKEQGANAPVSEQSAFAYTTALNYLLRRENNHCLTIGDASTVFWAEADDNATAQAAEGFFAHVFTPPDDEQESVKVFNVLEQMGKGRPLQEIAPELSPNTRFYILGLAPNAARISVRFWLDTTFGQLAENLAQHWQDLSLEPCAWKTPPSIWRLLLQTAVLGKSENISPVLAGEMTRTVICGTPYPLSLMSQLITRIRADGDVNGLRVAMMKAVLQRRFRKGFIEEGVPMSLNNESPNRAYLLGRLFAVLERIQYQALGELNAGIADRYYGSASAVPFSVFPRLLSGAKHHLSRLRKDKAGIAVNLDKDLGEIIAKLPETFPRHLSIDEQGRFAIGYYHQKQSYFAKKETAETIEN

SEQ ID NO: 3351 - protein, 624 aa, Atopobium sp. oral taxon 810 str. F0209
MIIKDLYDLYERYVADPEMQSEVPLEGMSVEKVFWEIVLSEDGELKNVRSLSWGDGKNGNEYRVMHVPRPLNERRSSDVTPYFLCDTAEYLFGLGGAKKKHSKSRELHENVLKGCNDFAADAVRRFFSQNLPMGEWDAKRLEDTLSFRKASNKSNLLVFYIENSVGEGVFVHECPSVIDAWNCYRAENPESNTIGQCSVTGEKVALAHVFLPLTGFPGAQPARASLISFNCESFCSYGEKIKEHTIGVSERVAFGAGSTLRKLLSDPEHNVRFGDKTDKRTTNTIFVFWSDRPAPDEDALFRAFIQPPSEDDATIKRVQDALDNIKNGNSFGESFDANVRYYVLGISPNAARLSVRFFETATFGKLAVYHGQYLQDIDMIGVRTTSLLQLIRQCAVQGKYKNIPSTLVNPCMQAMLTGSRFPRSLLSTLLSRMRTDHGSYELNGKPYEVTGQRVSLIKACLVRARRFSGVSLTRENEVDMSLNRENNSIGYLLGRLFAVMEKAQEDAVKPDTDDELNATIRDKYIGSASVTPARVMPTLMHGCQNHLSILRKKRPGLNYILERELDEIVGGKLSDEPYPRTLSMEEQGEFFIGYYQERREGFRSSHKQDDGASDETTSNDSSEN

SEQ ID NO: 3352 - protein, 587 aa, Clostridium sp. ATCC BAA-442
MILQALTEYYQSLVQAEKIAAPGWKSSDISFVLCISDEGELEQVISIKNQVSQGKKTVLRPQSMILPVPADGRTSTAVRPNFLWDKSDYLLGISKGGTQRGIKYFNGAKEYHEAILSGVVSPAATALLAFFQQWDPEKAPEHPALQDAMEDILKGANMVFRYSGGYIHEDPEIRDAWQRHYADQSTGIEMTCLVTGKQAAVARIHPKIKGIINGEAMGNTLVGFNSPSVCSYGKEQSYNAPVSQQAAFAYTAALNYLLADREHVYRLGDATVVCWARGGGDAYQAFFGGALLGAPTPYSAADLRGMTAQLCQGIPVDFQEEKLDPNMDFYILGLSPNAARLSVRFFLHNTFQGFLEHIQSHYRRLEIIRPSYDKFETLPIWKLLDETVNQNARDKSPAPDLAGEVLRAVLNDTRYPATLLNGVALRIRAEREVTRGRAAILKAYYTKLAESTGREHPDIPEEVLQVSLNPDATNVPYLLGRLFSVLEAVQAAANPGINATIRDKYFSGASATPAAVFPVLVNLAQKHLKKLNAANRGLSIAYEKQMTELLSKLGTEYPAHLNLPQQGSFQLGYYFQTQARYQKKEEK

SEQ ID NO: 3353 - protein, 458 aa, Clostridium sp. KLE 1755
MSTAKNKDLCYFTGNIELTAKTNPVKIRGEWDTKASLISSNDDSNFTYRGRFKTKDKNNGYNEALSVGYETSQKIHNALKWIIRRQGFIRDGVCLVTWESDLKELPQFYESAVGLLTALSNKDESLWDSEDVLFGESEADHSDTNYATARDLNLAIDGYAKNIEDTSHMVILALDSASPGRLAITYYRELETSAYLKNIRQWQESCCWRQEYFDKDKKYRRYEGIDSIKEIAKAVYGTEKEKLLTLPSNSDGKCPLLISVFDRLRPCIIDGEPIPPDIVRTAVMKASNPLAYEREFNYLRVLHTACSLIKKYYLEKGVIFNMVLDELCTDRSYLFGRLLAVAEKIERCTFDKGETRTTNAERYMRQFSQTPFRTWKIIRRNTQTYLNRLKPGSREYYKDLYGKIEGQFEPGCFEAKNALDGKFLLGYDCQREVLKFRKKDNVIVSDEEEITTISEEEE

SEQ ID NO: 3354 - protein, 650 aa, Clostridium sp. KLE 1755
MNWIAELCDLYDKNQHLAGRMGEDHIVLLPPYHTTVAAQITVTIDGDGNFLRAETVPDEDKLTIIPVTEKSASRTAGIEPHPLCDNLKYLAADYNQFVKGKDCSKNHLLYMEQLKKWADSSYCHSKVKAVYQYLEKGTLMKDLNNQGIFIQDESGKISEKAKIQIVAQTDAFIRFQIDTGEVLPEDALMDDSGSLSVKCWKDCSLQQNYIEYCRSQQKETGLSYLTGDLTQISWLQPKKIRNEGDGAKLISANDESNYTYRGRFANKEEAFSIGYEDSQKAHNALKWLLRKQGTNYGSLYLVTWESDLKTVADWQSSSDELCIQAEALPDEVSEEEEEFSDEVWDEEEEQYKGTGEAGAMRFRQAIKGYRKNLTQTSNTMIMAFDAATTGRLAMVECRSYDSSRYLDSLQSWYERCEWRQPKSSKERGRYIYYGMVGIKDAAELLYGTEQNGYFSLSGKEERYKDVVKRWMPCILDKKEVPADMVRLAVQRASSPVSFESRFLWERILALACSLVKQQIEKRYGEVYTMALDKKCRKREYLFGRLLAVADRIEYRTFDKEDGRETNAKRYMSAFSQHPYRTWKVLEEKLEPYFMRLKAPERLVYQRLLDDICNLFEIEDFENDTALNGLYLLGFHNQSYALKEKKKEEEE

SEQ ID NO: 3355 - protein, 864 aa, Clostridium symbiosum ATCC 14940
MQKLCEAYDAGIVCDQSKESVRLVPLGFVRKKVKYHVVLSRDGQFVSADELMDENQFLEIPSTPQAESRTGDNGTPFPLVEQLKYLIFEDENSKRFSQYMEQLRAWCGQPDAPDCLRVVYTYLDGHTLLTDLESQPNLKVKYYKNAERREGTGEDAKAMVCFSVQMQDESADDLWLRADVKQSWERFLADKLPGARAFCYVEGKMLPAMENHPKLQGNAKLISAKDSEFPFQYKGRFVEDRSAAVISFDASVRAHNALIWLIARQGMQKYGMTWVVWNTNGAVMKAPIDEKNGFMDDEEEEEDSEPIIDTFESYAREVRAAARGYGGRLHDYNKQRTDFAVILGLEAATDGRMSVTYYQECSGNEYVKRLEEWYTDCCWWSYSWKKKTKEIASPGPEQIAVAVMGPDAVNVAKRDKKCEKSHTKLMRKLHSRILVCIADRQPFPIDVVLSAFYRVCAPLAFVSGKDRQWSRTAWETSVDTACAMISCFQKRSRGEICEVFPPELQAESKRRDYLYGRLFAVADFMEEKSTDKGRDYPTNAIRLMCQFVKRPFETWPKIHEKLVPCFKSLGPDSKRYQILFAKIEEQFTEEDRYERGELSLEFLQGLSSQRQMLFQKWEPTEKKEDGGGVPYKLPRRRSELYGCLLAIADVAEQEASEGERTGMTNAMQMMQVFAARPYESWGRLHDKLQPYLEKLGKKADYYQRLIGFVEMQFSQADRETAVPLDAGYLHGYYCMRQTFYQKTQFSREPQEWEEAGDRRSALYGRQLGIADRIERRRFIREAEDIDRRSTNELRFMPVFARKPAAAWENLKVKLKPYLRYAENLSGEDLATLEQLEAQLQQNGWNTDIPLGSVYLHYYYEERNR

SEQ ID NO: 3356 - protein, 657 aa, Clostridium sp. ATCC 29733
MQKLCETYDRCADQVGVVQAGRVPLLPAYHTTQLAQIELVLDTEGNICPGRSSVIEGKGEQTTIIPCTESSAGRTSGLEPHPLFDKLQYLAGDFAACVPGKKSGYELYMEQLDRWCEDPACHPFVVAVRQYLKKGRLIADLAADGILWLDEQAHLLQKWGGAKEELPPIFRACTGGKQMDAFVRFTVLPADGSFSPDSRLWASAAVRQCYIDWQNRAPQERDICFVAGREMPVSVMSPKKIRNPGDGAKLVSSNDASGFTYRGRFRDAREAFSLGRETTEKAHSALRWLISRQGYKNGDQVVLTWRDSGGKLPSVCADSMDIAGEVPESPSRRADTGDWWAAQLNRALAGYSGVPDGGENAMILGLDSATPGRLSVFYYREMPAEDFLERIRRWHTSCTWLHRYRSRPTGELDKKGKPKYEPATFVGAPSPIDIVETAYGRNVDDKLRKSALERLLPCIIEGAQLPSDLVHCAARRASNPIAMEGWEAGKTLSIACALIRKLKNDRINGWNTTGEYKEEWTMALDTQKTDRSYLFGRLLAYARQIESRALFLMEEKRATNAERLQQAFASHPRRTWKIIDGQLKPYLLRYKGQTFEYEKGIFQIIDMFEEGDFNDEPLDETYLLGYSSQMNHFIQTSKKSGKSEEKSPAESQSEDKQ

SEQ ID NO: 3357 - protein, 634 aa, Porphyromonas sp. oral taxon 278 str. W7784
MILKALYDYYQAMAEQGKVVSPGMEWKAIPFVIVIDEDGTFRRVIDTRDKEHKQGREYLVAKAKGRSGSKSYAISQILWDHSGYVLGLPTDDSEEKQVMAPKQHDAFKQELAKFRELFPENKGFKAIELFYEKYDEKKEGESSDLFEEEVKDLSNIIPDEILLEIKKKVGANISFLLSTEFPPNKLISSHEDIQSHQAGSSEEDGEEKGRCLVTGEQGSIARLHGGISLFGAQANATLISFQKFSGYDSYGKEQGLNAPISQTASDAIISGLNMLLGKDKNTNYRIGETTFIFWNTLQDDELLKVYQEATFTGLPSDSDREEEEEAAKERDPEKETKVVIQALRSALVSKNAYIDREHSDRFYILALAPNAKRVSVKLWMEGTVSEIVGNTLAHLDDMNIIRFDGLLDEEIPPLRPIYRIMKAIYTATDSTKWPRQVVQELLESIIKGLPYPPALQMACLERIHHDHTSKYPVTELRAALLKAHINRKHRKNPQIKQLTMALDKSNSNPAYLAGRLFALLERIQEKAIPGVKANITDRYFRTASATPGIIFGRLLQLSAFHLSKIKKEHGGLGYYFDRQIQEVLELLPGGQATFDKFFSPDQQSIFAVGYYHQKAYRDQKAESAAIEEEQETEN

SEQ ID NO: 3358 - protein, 639 aa, Selenomonas sp. oral taxon 892 str. F0426
MSWMEQLVETYDENERFAGRGGIDGMKALLPPVGHIIQNAQIEITLNADGELIQAEVIPKEHQSTLIPCTPGSASRTGNPAPHALHDNLSFIAKDYCIFVNSKDSEKPYIAYKEQLGIWVASNPNLKVQAVYRYISSHDVIHDLIEKKVLFQDTAGKLLEKWTDKETPKPLIFSAVSGDILKAMVRFRVVMDGDDCPELWNDTCLQKDYQTFFQQQFSQTEEQLCYATGKKLPPTDKHGKGIRFPGDGAKIISSNDMTGFTFRGRFADADECISIGYESSQKAMNALMWLARNQGYTHDGRVFLAWGRCGQTPPSVFDDTARLTRRRRPAGTERPSSLKGWAESLTKALAGYQHEFKQAEMSQVNVMILDAATKGRLSICYYSEMAGEDFIERIERWHSLGRWRQHGYDSDKDESFVYFGVPAPKRLVEACHGVSVGDSQMKLELERIFHAILQGMPFPVDMERMLIGRAVKRAVCDAYYGWRRQILEPACSIIARRLNHKKEEYTVALDETKDDRSYLFGRLIAVADQMERATFSRDEMGSRTTNAMRYMEIFSSRPASTWLTLQKKLLPYQQKREMYGGKERKLISKIGSMFHDDDFLSDRPLDGKFLLGYYCQQYAMELEREENRKKKEALQEEEV

SEQ ID NO: 3359 - protein, 593 aa, Treponema lecithinolyticum ATCC 700332
MILQALYEYAKRKGDALPEDGFEWIEIKYLIKIREDGSFVDLVSTIEDKKGKNYLLPQRVGRSGSDACKKSCLLWDNIGFVLREPKEIKDDEKKQKEANAYAENQNNAFIKKIESLPEDVKEDRGVAAVLKFYTSNKANGFDKVRSSEYWEECKKSNGNFSFILNAETDLVAQTPAVKEYQRNRMLQNENTEDSEKEQENISGICLLTGEKGLIARLHTATPISGAKSNAKFVGFQKNCGYDSFGKEQAYNAPVSQKAEAAYTKALNYLIKSDKNHFTLGKDTIVFWAEKENKEYDFEGVFSVFFSKDFDSDDPDKSVKEVKNLFAAIYTGKVERIDSNFYVLCLSPNAARISVRFWETGKVKNFAKRIQQHFIDFDIIRAPDAPEYLNLYQILSATALEHKMDNVAPNLIGPVVQSILKGTPYPVSLLQQCIRRIRAEQKVTRERTAILKAYINRYNRFHSMNEEVTVALDRNCKNKGYLVGRLFAVLEKVQQDTHPGLNATITDRYYGAASTNPVTVFPQLLKLNQHHLSNYANKKTKSDRENELSEIINALDAFPAHLTLEEQARFAIGYYHEKQSFFEKNNKSEGETHE

SEQ ID NO: 3360 - protein, 586 aa, Oscillibacter sp. KLE 1745
MILQALTDYYRVLEQAGKIDAPGWAPVKVSYALLLSENGTLEQVIDIQTEQPRGKKMASAPQILSLPAPVKRTVGVAANFLCDNAGYLLGIDSKGKPQRTRECFEASRSLHEQLLAGVDSPAARAVAAFFRSWDPETAREHPALAEHLEDILSGGNLIFRTLDGYVHRDPSVRRAWDASYQTKGDGPQGICLVTGQPGPVESVHPAIKNVAGAQSSGAALVSFNAPAFCSYGKEQNLNAPTGKYAAFAYTSALNALLADREHVFRVGDATVVCWARSGERGYQDVFQTFFSDFYDETDLKGLVGALCQGNPVVYDETKLDPSMDFYILGLSPNSARLSVRFFLHNTFGGFLRNVQAHYDRLEIVRPAYDKFETLPLWKLLSETVNQNARDKSPAPDLAGEVLRAVLTNTRYPATLLNGVALRIRAEREVTRGRAAIVKAYYQKLAETTKHENPDIPEEVLQVSLNPDASNVPYTLGRLFSVLEAIQASANPGINATIKDKYFNSAAATPAVIFPILLNLAQKHLKKLRGSNAGLVVFYEKQLTELCSRIGEQYPAHMNLPQQGSFQLGYYCQTQARYQKKEEAKDV

SEQ ID NO: 3361 - protein, 586 aa, Oscillibacter sp. KLE 1728; identical to SEQ ID NO: 3360

SEQ ID NO: 3362 - protein, 582 aa, Myxococcus sp. (contaminant ex DSM 436)
MMLTALNDFARERGLTDDPLYEVKPVDFFVRISAKGKFVALESTAGEDGRGKPMPVPRLPQRSVNIAAGFFADNPKYVLAYEKEEPKTKAGGVEKRLARLEAFLKSVREVAAETKDPEARAVEAFLANEAERRKVLAERDAEEWTGSEMLVFVVGDATTPVHQNPWVRACWARRSGEQRAQGRKALCLVTGREGVVAVTHPKLKNIPEAQSSGAALVSFNAPAFSSHGLEQGDNAPISQEAALGYVLALNDMLRRTEQRRFRQGIQLADGSVMVFWTRASASEESLLLSWADPTEADLQRFAESPLRGLEPGKLDDRAFYAVTLAGNAGRVAVRDWFESRVGEVKQNIRRYFEDLRIGNAPAGPIPVYRLLKAVEAPSGRGLSPDVATRMFGAALRGQPFPRQLLAASLDRLRLPPSDERFEREQLRLRVALIKATLLRLPRSGTAPLEVTVSLDKSNDSQPYVLGRLFAVLERLQGAALKDLNATIRDRYFGAASRNPVTVFPRLIQLSVHHASKAGENGRWLERVKGEVMALLPSESPFPPVLDLKDQGLFAVGYYHQREAFFTKREATATPAEAEASST

SEQ ID NO: 3363 - protein, 610 aa, Oribacterium sp. oral taxon 078 str. F0263
MILQELVKYYEALAERGEIALDGWRYERVAYSLELNAEGKLLKILSLGSEDKIKKRSVRELPLMKVPQKEGAQNHRKAAIFLCDNAEHMLGFSDGTSDGKGQEYFAATKEELMDILRDCDGPGASALKKFFQSWDPSRAEEFLKKKDSKITKAGNLIFSIEGKYAQDIPELQQAWESWRKKQEKKKGEEKKQGKKKQGKKKQGEIKEYGRCLVTGEFSEIARTHTLIKGIKKTHPNGAALVSFNAPAFYSYGKEQSFNAPVGKRAMFSYTTALQFLLTKTEQKVKFGDLLCLIFWAESGEKEYGGFFSSCLEGKEDNQEITGNVLRNVAGKQGVDYKGVHLDPEQNFCILGLSGHEGRLAVRLFLKNSFGDILRNFQRFYEELEIAGPEWAEEQPALRKLLEETVNQNSRDKSIPPALGSECLRAILVHGKFPASLYYGILIRIRADQGKNKINRRRAALIKAILLRNYGELYLGKGEDFVALNENCRDRAYILGREFAVLEKIQGAANLTVNATIRDRYFNSACGTPAMVFPLLFRLKESHLRKIRNENPGLAVFCERILTELQGMLEVSESVGAFPSRLSLNEQGMFILGYYHQRQKFYEKKEGGEVR

SEQ ID NO: 3364 - protein, 306 aa, Streptococcus iniae IUSA1
LIADTKKDSSGFEIGKTNQNIGQSFIKGVRQFSDASNYYLAILNKTSNGRISLKYFREMTTSQLLKNLDRWQEWYSWEATKKGGGTYLKTPSFDEMIKAAYGVDRGFLEIDNDSFKSAQYQALITALLDGQEVPRALVKKLESNLKERHRYPKQWYQLQQVSLAVLHKQNGREFTPMLDHENKDRSYLFGRLLAIYELLESRRYFIDGGSQERITNAERYWTAFTGQPAKMMGLLENKIRPYRDILKIKRPGLLRKLEIEKEEIMALLTPQFMDKDFGQALEYKFIFGYYAQKRVFESKQEKESEE

SEQ ID NO: 3365 - protein, 588 aa, Youngiibacter fragilis 232.1
MILLALKEYYDRKICDGSIAKDGWINGSIDFLIDLDEDGNATDISDLRELDGKRYISKRLDVPNIGKQALKHSNSGKDANFLWDNASFVLGLGEKGDSRLESMLAVIEEFSPDTTDIGVRSVKTFLEKGLRDRTHFHNILNHSEFGELFASGSPKLSFRVPATGFRTVFDSPEVSEALVNVGQQSGTGESHIGTCLITGKQNCIIEATHSVTKGVWGAQTSGACVVSFNKDSFNSYNKIQSYNAPIGKTAASQYTKALNTLLESKKQTMHIGDTTAVFWSERKSMFEDSFSLFFNEPDKDDPEKGTEKIKELLSSFQTGTYSVDNGDDRFYILGLSPNAARVSIRFWHVGTIAEYSDRIRQYFEDFKIIKPASEPEYYSIWRILVNTAVQDKSENIPPNVAGDLVKSILEGTPYPETLLQAVLRRIRSDKDNRVKPVRAAIIKAYLNRYYKFHTNTNYKEVSLSLDENQKSTGYQLGRLFAILEKIQEEANPGTNTTIRERFYGSACSSPVTVFPNLMRLKNHHLAKMDSKGKVVYFEQLLGNVIENLSDFPSHLPLHQQGLFAVGYYHQRQDFFTKKSEKKESQEGK

SEQ ID NO: 3366 - protein, 579 aa, Rhodobacter capsulatus DE442; identical to SEQ ID NO: 3020

SEQ ID NO: 3367 - protein, 579 aa, Rhodobacter capsulatus R121; identical to SEQ ID NO: 3020

SEQ ID NO: 3368 - protein, 579 aa, Rhodobacter capsulatus B6
MSLLASLVRAYERMPDAPPYGYSTEKIGFCVVLTAAGEVVDVADLRDTDKKRSPRMLMVPQAVKRTVGIAPNFLWDKSAYVLGVTAGEGKRTAEEHAKFRERHLTALAGAEDPGLLALARFLQTWTPEAFGPPLWPEEAKDQNLVFRLTDELGYLHDRPAARALWARLGAEAASEAQVCLVTGASAPVARLHPSLKGVWGAQSSGASLISFNLDAFNSYGHEQGDNAPVSEGAAFAYTTALNRFLEKDSGHRLQIGDASTVFWADASEAEAAQAEGFFAAFFDTAATEKIEALNIGAQLARIRACEPLAEVAPQLASGVRFCVLGLAPNAARLSVRFWWEDDFGTLTAHYQRYLDDMRLDPPPRDDWPPLWRYLSELAPQGKRENVPPLIAGDWMRAILTGTAYPLTLLSTVLMRIRADGEINALRAAMLKSVLIRNFQSKEAPVALDPASKDTGYVLGRLFAAYENIQKAALGKGVNATIRDKFYGSASATPARVFGSLAANAFNHLAKIRKEKPAFAHYLQDELQQIANLLEVSAEPFPSSLSQESQAKFALGYYHQASFRKPADTEQEPHSEEQPQ

SEQ ID NO: 3369 - protein, 579 aa, Rhodobacter capsulatus Y262; identical to SEQ ID NO: 3020

SEQ ID NO: 3370 - protein, 603 aa, Xylella taiwanensis
MILSALTTYYQRLLDTPDSGIAQPGYSQEKISYAIILALDGRVVDVHDLCDGGSKKPIPVWMNVPHSEKRTVAIKPNFLWDKTSYALGISATGKRNEQEHAAFKALHQDILAGTEDDGLKALLAFLAHWTPERFQKEYTFIRQGKTMLDTNVVFRLDGAADYLHVQPAACAAWARRQNRTTESTNGMCLVTGEYAPIARLHPAIKGVNGAQSSGASMVSFNLEAFTSYGKSQGENAPISAQAASAYASALNQLLRRGRHNQQCLLIGDTTVVFWAESPAVNKAKKAEDEFSVFLNPNDKDERTTQKLWNLLEHIRQGQPLRDLDGDLDDDTRIFVLGLAPNASRLSIRFWETASLAAFAKRFSDHYNDLLLNPIPWCHTPSPQLLALQTAPIRNGKTKPEDIPPLLAGELTRAILTGTRYPHSVLGALVMRFRADRKISPLRVALCKAILARHARLGREQKNQTNKKEPPMSLDLHNHDPGYLLGRLFSMLEHVQSAALGMHINANICDHYYGAASATPLRIFPMLVRNSKNHLRKLRKEKPWLWITLDTEIVQIINLLQSAFPRHLKIEEQGWFAIGYYHQTQACFAHHNDQCVAHSEGKAA

SEQ ID NO: 3371 - protein, 628 aa, Bacillus sp. JCM 19047
MSWLLNLYQTYENNEGQVGKWEKKGEDREYTLLPISHTTQNAHIEVTVDENGHLLRAKALKKVSTLIPCTEESASRAGSKVAPYPLHDKLSYVAGDFQKYGGVIKNQDDVPYNAYMKNLKAWTESDFATHKVKAIYAYLEKGSLIEDLVNENVLVLKDGKLMEKWDKSLEEIYGEKPDIFSSGTTDQTSAFVRFNVYSPASKTAVWQDKDMYHSFISFYNERLGDEDICFVTGETAPSTERHANKIRHAADKAKLISANDTSGFTFRGRFNKSHEAVGISYDVSQKAHNALKWLIIKQGKAIDDRVFLVWENNGQSIPEPGADAYSLLFSDEDDEEEVEANTGEGFAQEVSKAIAGYRHDFDYKVDVNFLTLDSATTGRMAVLYYRNMNKELYLDRLEDWHNSCAWEHRYRKLDGKNIAFEGAPSTKDIAWAAYGPRASDKVIKGAMERLLPCIIDKRAIQRDIVKSACNRASNPVAMDKWEWEKTLSITCALIRKMYIDQEEVWDVALNEKTTDRSYLFGRLLAVADVLERSALGKDEKRATNAIRYMNSFSKNPARTWRTLQDSLQPYQAKLGTKVTRYSKLIDEIGDAMELEDFTNKPLEEIYLMGFYSQRRELYKKKTEEENEV

SEQ ID NO: 3372 - protein, 631 aa, Streptococcus agalactiae; identical to SEQ ID NO: 3316

SEQ ID NO: 3373 - protein, 631 aa, Streptococcus; identical to SEQ ID NO: 3311

SEQ ID NO: 3374 - protein, 591 aa, Enterocloster bolteae
MILQALVEYYEALERKEKITSPGWCRARVAYGLDISEQGELMGVIPLKKEQQNGKKTVWVPQDLTVPQMVSRSSGVSANFLCDHSGYMLGIDNKGKPERSRECFECAKKKHKDILGNISSPAARAVCRFFDCWAPDRAAENPYLVPELEEIISGSNLVFMIDGEYVHEDPDIRQCWEEYSCQSGTGPEGVCLVTGRREEIARIHSTIKGVQGAQSSGAALVSFNAPAFESYGKEQSFNAPVGTYAAYAYTTALNYLLSDRSHGTTIGDTAVVYWSEEGDERYQNIFACVSEPTMENQEIVDGVFKNLAEGKAVVAQDVKDSLDMEKRFYILGLAPNAARLAVRFFYQDSFGNILKHIKEHYDRMEIVRPAADAVEYLGIWRMLQETVNKKSRDKKPVPSMSGAVYRSIISGSRYPASLYQAVLGRIRAEQDDGDSRIYKITRGRAAIIKAYLLKNGNIREEITMALNEDSNNTAYILGREFAVLEAIQEDANPGINATIKDKYFNSACATPAAIFPILFKLKNSHIKKMNNGAKETYYEKMLCDLQGRLTVAEGQRAACPRRLTLEEQGMFILGYYHQTQKRYEKKIKEEA

SEQ ID NO: 3375 - protein, 591 aa, Enterocloster clostridioformis; identical to SEQ ID NO: 3253

SEQ ID NO: 3376 - protein, 626 aa, Clostridium innocuum; identical to SEQ ID NO: 3221

SEQ ID NO: 3377 - protein, 593 aa, Treponema saccharophilum; identical to SEQ ID NO: 3271

SEQ ID NO: 3378 - protein, 586 aa, Thiothrix nivea; identical to SEQ ID NO: 3274

SEQ ID NO: 3379 - protein, 590 aa, Phaeospirillum molischianum; identical to SEQ ID NO: 3117

SEQ ID NO: 3380 - protein, 583 aa, Leptonema illini; identical to SEQ ID NO: 3262

SEQ ID NO: 3381 - protein, 639 aa, Ruminococcus albus; identical to SEQ ID NO: 3201

SEQ ID NO: 3382 - protein, 628 aa, Streptococcus sanguinis
MDFFTSLLKAYEKAEEIGLVDQQNGDNPVLLPLYHTSLKSNGKNIISVKLEQDGSLYKAEIMDAENQTIIFPVTSNSVARSGSNPAPHPLVDKFSYYVPELSQSQYDDFHKQLASWITYCEEGEVKDFLMKIQQFILQTDFLSNILYSLYGEHYQREGLKITYSDSDGKNKTVDLSAYFLEFSIVQFHGFKDESVTSYEALHQSFISFITANQDNLGTCNISGRMEQITNKHRGLMGNAKIISVSNKGEAYKGRFKEREDVFSVGYETSEKIHLMIKYLLENKNSSTWLESSQYLINWFSDDLANESQLDIVKPAFNDLFEDDEDEKDSLVFIKPNEENKKIGSSFFKGRKLFGNDATYYVAILNKTSNGRIALKYFRQVQVSQLLKNMETWQENYSWEAKTKSGNYKLRTPTFNDIINVAYGVDRERYLELDNDSFKSEQYQQLVTALIDGRTIPNTIVKKLEDNIKQRQKYSKNWYQVQQVSLAILHKQYGREFTPMLDHQETDRSYLFGRLLAIYELFEAQRYALDGSSQERITNAERYWNAYTGQPAKMMNHLENKIKPYEQVLKLNRTGIWHKLEKERKEIIQLLTPLYANKEFTQPLDYKFIFGYYAEKQFYYTKQTKENEG

SEQ ID NO: 3383 - protein, 631 aa, Streptococcus pyogenes
MDFFTSLLKTYEKAELADLVDHQKRSNEPVLLPIYHTSLKSNGKNIISVKLDKDGQFHKAEFMADKQMIIFPVTADSVARSGSHPAPHPLVDKFAYYSAEMGQSQYDSFHKQLNNWIDYCEEGDVKRFLTIVQQFILKPEFLTLILDSLIGPDYQNNQLKVTFCDATGKEKLIDLSACFLEFSIDQFQGFKNESVSTFKTLHQSYISFVEANREKLGICNISGREEQLTDKHRGLMGNAKIISVSNKREAYKGRFREREDVFSVGYETSEKIHLMLKYLLENKNTSTWLGSSQYLINWFSDDLTNDSRLDIVSPIFDDGLEEDDDDDTPPVITLATEDNKRIGKSFIKGQKLFANDATYYVAILNKTSNGRIALKYFRQLQASQLLTNLNKWQETYSWESRSKFGKSRLRTPTFHDILNVSYGVDRDRFLELDNDNFKSDQIQKLVASLIDGKPMPQSIVKKLGNNVKERHRYRKHWYQVEQVCLAILHKQNGEEFSPMLDHTNQNRSYLFGRLLAIFELIETLRYGLDGNNNDRITNAERYWTAYTGQPTKLMMLLENKIKPYEEPLKLNRRGSWMKLEKEKEEILELLNPLLETETMGKPLDYRFIFGYYAEKNYYYTKQNTEVTESEE

SEQ ID NO: 3384 - protein, 631 aa, Streptococcus canis
MDFFTSLLKTYEKAELADLVDNQKRDNEPVLLPIYHTSLKSNGKNIISVKLDKDGQFHQAEFMADKQMIIFPVTADSVARSGSNPAPHPLVDKFSYYSAEVGQSQYDSFHKQLNNWIDYCEEGDVKRFLTIVQQFILKPEFLTSILDSLIGPDYQNNQLKITFCDATGKEKLIDLSACFLEFSIDQFQGFKNESVSTFKALHQSYISFVEANRENLGICNISGREEQLTDKHRGLMGNAKIISVSNKREAYKGRFREREDVFSVGYETSEKIHLMIKYLLENKNTSTWLGSSQYLINWFSDDLTNDSQLDIVSPTFDDGLEEDDDDDTPPVIALATEDNKRIGKSFIKGQKLFANDATYYVAILNKTSNGRIALKYFRQLQASQLLTNLNKWQEKYSWESRSKSGKSRLRTPTFHDILNVSYGVDRDRFLELDNDNFKSDQVQKLVTSLIDGKPMPQSIVKKLSNNVKERHRYRKHWYQVEQVCLAILHKQNGEEFSPMLDHTNQNRSYLFGRLLAIFELTETLRYGLDGNDSDRITNAERYWTAYTGQPTKLMMLLENKIKPYEEPLKLNRRGSWKKLEKEKEEILELLNPLLGTETMEKPLDYRFIFGYYAEKNYYYTKQNTEVTESEE

SEQ ID NO: 3385 - protein, 630 aa, Streptococcus dysgalactiae
MDFFSSLLKTYEKAELADLVDNQKRDNEPVLLPIYHTSLKSNGKNIISVKLDKDGQFHKAEFMADKQMIIFPVTADSVARSGSNPAPHPLVDKFAYYSAEVDQSQYDSFHKQLNNWIDYCEEGDVKRFLTIVQQFILKPEFLTLILDSLIGPDYQNNQLKITFCDVTGKEKLIDLSACFLEFSIDQFQGFKNESVSTFKALHQSYISFVEANRENLGICNISGREEQLIDKHRGLMGNAKIISVSNKREAYKGRFREHEDVFSVGYETSEKIHLMIKYLLENKNTSTWLGSSQYLINWFSDDLTNDSRLDIVSPIFDDGLEEDDDDDTPPVIALATEDNKRIGKSFIKGQKLFANDATYYVAILNKTNGRIALKYFRQLQASQLLTNLDKWQEKYSWESRSKFGKNRLRTPTFHDILNVSYGVDRDRFLELDNDNFKSDQVQKLVTSLIDGKPMPQSIVKKLGSNVKERHRYRKHWYQVEQVCLAILHKQNGEEFSPMLDHTNQNRSYLFGRLLAIFELIETLRYGLDGTDSDRITNAERYWTAYTGQPTKLMMLLENKIKPYEEPLKLNRRGSWKKLEKEKEEILELLNPLLETETMEKPLDYRFIFGYYAEKNYYYTKQNTEVTESEE

SEQ ID NO: 3386 - protein, 631 aa, Streptococcus dysgalactiae
MDFFTSLLKTYEKAELADLVDHQKRNNEPVLLPIYHTSLKSNGKNIISVKLDKDGQFHKAEFMADKQMIIFPVTADSVARSGSHPAPHPLVDKFAYYSAEMGQTQYDSFHKQLNNWIDYCEEGDVKKFLTFVQQFILKPEFLTLILDSLIGPDYQHNQLKITFCDATGKEKLIDLSACFLEFSIDQFQGFKNESVSTFKALHQSYISFVEANRENLGICNISGREEQLTDKHRGLMGNAKIISVSNKREAYKGRFREREDVFSVGYETSEKIHLMIKYLLENKNTSTWLGSSQYLINWFSDDLTNDSRLDIVSPIFDDGLEEDDDDDTPPVIALATEDNKRIGKSFIKGQKLFANDATYYVAILNKTSNGRIALKYFRQLQASQLLTNLDKWQETYSWESRSKFGKSRLRTPTFHDILNVSYGVDRDRFLELDNDNFKSDQIQKLVASLIDGKPMPQSIVKKLGNNVKERHRYRKHWYQVEQVCLAILHKQNGEEFSPMLDHTNQNRSYLFGRLLAIFELIETLRYGLDGNNNDRITNAERYWTAYTGQPTKLMMLLENKIKPYEEPLKLNRRGSWMKLEKEKEEILELLNPLLETETMEKPLDYRFIFGYYAEKNYYYTKQNTEVTESEE

SEQ ID NO: 3387 - protein, 614 aa, Xanthomonas translucens; identical to SEQ ID NO: 3298

SEQ ID NO: 3388 - protein, 592 aa, Neisseria flavescens; identical to SEQ ID NO: 3156

SEQ ID NO: 3389 - protein, 592 aa, Neisseria flavescens; identical to SEQ ID NO: 3169

SEQ ID NO: 3390 - protein, 585 aa, Neisseria lactamica; identical to SEQ ID NO: 3178

SEQ ID NO: 3391 - protein, 585 aa, Neisseria lactamica
MILHALTQYYQRKAESDGGIAQEGFENKEIPFIIVIDKQGNFIQLEDTRELKVKKKVGRTFLVPKGLGRSGSKSYEVSNLLWDHYGYVLAYAGEKGQEQADKQHASFTAKVNELKQALPDDAGVTAVAAFLSSAEEKSKVMQAANWAECAKVKGCNLSFRLVDEAVDLVCQSKAVREYVSQANQTQSDNVQKGICLVTGKAAPIARLHNAVKGVNAKPAPFASVNLSAFESYGKEQGFIFPVGEQAMFEYTTALNTLLASENRFRIGDVTAVCWGAKRTPLEESLASLINGGGKDKPDEHIDAVKTLYKSLYNGQYQKPDGKEKFYLLGLSPNSARIVVRFWHETTVAALSESIAAWYDDLQMVRGENSPYPEYMPLPRLLGNLVLDGKMENLPSDLIAQITDAALNNRVLPVSLLQAALRRNKAEQKITYGRASLLKAYINRAIRAGRLKNMKELTMGLDRNRQDIGYVLGRLFAVLEKTQAEANPGLNATIADRYFGSASSTPIAVFGTLMRLLPHHLNKLEFEGRAVQLQWEIRQILEHCQRFPNHLNLEQQGLFAIGCYHETQFLFTKDALKNLFNEAKTA

SEQ ID NO: 3392 - protein, 592 aa, Neisseria mucosa; identical to SEQ ID NO: 3182

SEQ ID NO: 3393 - protein, 592 aa, Neisseria mucosa
MILASLARYYRRLAAETDDMGNPKVPPYGFSEEKIGWILVLDKEGRLKTVVPNLTADKKPQPKLMSVPRPEKRTSGIKPNFLWDKTAYALGVEANKNKAEAKEKPFTSSEKTFDAFTQYHLDLLQNSDDEGLQALCRFLQNWQPDNFATENLPAEMLDANIAFSFEKTTACIHKREAAQTIWANCLKSDEAEEGLCLISGDTAPIARLHPAIKGVFGGQSSGGSIISFNKEAFASFGKEQGANAPVSEQSAFAYTTALNYLLRRENNHCLTIGDASTVFWAEADDSSTAQAAEGFFAQVFTPPDDEQESAKVFNVLEQIGKGRPLQEIAPELSPNTRFYILGLAPNAARISVRFWLDTTFGQLAENLAQHWQDLALEPCAWKTPPSIWRLLLQTAVLGKSENISPVLAGEMTRAVICGTPYPLSLLSQLITRIRADGDVNGLRVAMMKAVLQRRFRKGFIEEGVPMSLNNESPNRAYLLGRLFAVLERIQYQALGELNAGIADRYYGSASAVPFSVFPRLLSGAKHHLSRLRKDKAGMAVNLDKDLGEIIAKLPETFPRHLSIDEQGRFAIGYYHQKQSYFAKKETAETIEN

SEQ ID NO: 3394 - protein, 581 aa, Neisseria polysaccharea; identical to SEQ ID NO: 3188

SEQ ID NO: 3395 - protein, 619 aa, Neisseria sicca; identical to SEQ ID NO: 3172

SEQ ID NO: 3396 - protein, 630 aa, Neisseria sicca
MILASLARYYRRLAEENDEMGNPKVPSYGFSEEKIGWILVLDKEGRLKTVVPNLTVDKKPQPKLMSVPRPEKRTSGIKPNFLWDKTAYALGVEANKNKAEAKAKPFTPSEKTFDAFKQYHLDLLQNSDDEGLQALCRFLQNWQPAHFAAENLPAEMLDANIAFSLEKPTALIHKREAAQTLWAGCLKSDEALEGLCLISGDTAPIARLHPAIKGVFGGQSSGGSIISFNKEAFASFGKEQGANAPVSEQSAFAYTTALNYLLRRENNHCLTIGDASTVFWAEADDNATAQAAEGFFAQVFMPPNDEQESVKIFNVLEQIGKGCPLQEIAPELSPNTRFYILGLAPNAARISVRFWLDTTFGQLAENLAQHWKDLHIEPSAWKKGKEPPVWRILLETTPKRKDAEGRLKKSESKDIPPQLAGEYMRSVLTGRFYPKTMLTRMIGRIRSDGYISGLRVAVIKAVINRNSLYREELKMGLNEETHDIPYRLGRLFAIIELAQSSALGELNAGVRDKFYGGASSSPHSTFPLLLDNYRTHISALRKGRKAKWVKGDPKKLANWLEGKVGEIIGVFDAETPFPRHLSLEEQGRFVVGYYQQRFKKYNKQEDDNIPEDIEQANYLADEADSENEEN

SEQ ID NO: 3397 - protein, 594 aa, Neisseria macacae; identical to SEQ ID NO: 3210

SEQ ID NO: 3398 - protein, 624 aa, Kingella denitrificans; identical to SEQ ID NO: 3202

SEQ ID NO: 3399 - protein, 611 aa, Kingella oralis; identical to SEQ ID NO: 3166

SEQ ID NO: 3400 - protein, 626 aa, Methanofollis liminatans; identical to SEQ ID NO: 3284

SEQ ID NO: 3401 - protein, 575 aa, Acetonema longum; identical to SEQ ID NO: 3208

SEQ ID NO: 3402 - protein, 627 aa, Neisseria weaveri; identical to SEQ ID NO: 3217

SEQ ID NO: 3403 - protein, 627 aa, Neisseria weaveri; identical to SEQ ID NO: 3216

SEQ ID NO: 3404 - protein, 632 aa, Porphyromonas asaccharolytica; identical to SEQ ID NO: 3191

SEQ ID NO: 3405 - protein, 627 aa, Porphyromonas endodontalis; identical to SEQ ID NO: 3162

SEQ ID NO: 3406 - protein, 599 aa, Vibrio metschnikovii
MILSALNQYYDRLNSGNQSKVPTFGFSEEKISYVLVLSEQGELVDIVPNLTDEKKPKPKLMNVPRPEKRTSGIKPNFLWDKTAYVLGISLPKGKKNEAIFDFSLPTFEAFREWHLSLLEHSEDKGLKALAIFLQNWQPENFGNSILTQDVLDANIVFQLDGMRQYIHESDEAKTIWGSLLQSDDVKQATCLITGKKAPISRLHPAIKGVAGGQSSGVSIVSFNKESFESFGKGQGDNAPVSEQAAFAYTTALNYLLRRENDQVVNLGDTIVVFWALAESEHKAKSAEAFFLRGFNPPMPSDDSEVAALGAELEKLVKGRPLPEISPDLDPNTQFFILGLAPNAARLSIRFWLQTDLGHIQQRFAEHFQDLALNRQPWKTAPSVWRLLLQLAPHRDGQKPKIDDAPAHLAGELMRAILTGQRYPRAILAQLLARFRADGDISELRVAMVKAVLQRELRLLGKEEISMSLDESNTNPAYLLGRLFAVLESIQRNALGDKVNATITDKYYASASTVPYSIYPRLLSGSKHHLSKLRKEKPGLAVTLEKELGNIMGMLSTEFPRHFSIEHQGRFSIGYYHQKNARFSQSEQIKTDESMTEGND

SEQ ID NO: 3407 - protein, 586 aa, Geobacter metallireducens; identical to SEQ ID NO: 2977

SEQ ID NO: 3408 - protein, 596 aa, Neisseria; identical to SEQ ID NO: 3181

SEQ ID NO: 3409 - protein, 584 aa, Ruminococcus gnavus; identical to SEQ ID NO: 3143

SEQ ID NO: 3410 - protein, 646 aa, Ruminiclostridium papyrosolvens; identical to SEQ ID NO: 3205

SEQ ID NO: 3411 - protein, 596 aa, Ruminiclostridium cellobioparum; identical to SEQ ID NO: 3306

SEQ ID NO: 3412 - protein, 651 aa, Peptoniphilus lacrimalis; identical to SEQ ID NO: 3179

SEQ ID NO: 3413 - protein, 581 aa, Coprococcus eutactus; identical to SEQ ID NO: 3145

SEQ ID NO: 3414 - protein, 551 aa, Halanaerobium saccharolyticum; identical to SEQ ID NO: 3121

SEQ ID NO: 3415 - protein, 127 aa, Aggregatibacter actinomycetemcomitans; identical to SEQ ID NO: 3228

SEQ ID NO: 3416 - protein, 465 aa, Aggregatibacter actinomycetemcomitans; identical to SEQ ID NO: 3243

SEQ ID NO: 3417 - protein, 677 aa, Aggregatibacter actinomycetemcomitans; identical to SEQ ID NO: 3241

SEQ ID NO: 3418 - protein, 465 aa, Aggregatibacter actinomycetemcomitans; identical to SEQ ID NO: 3227

SEQ ID NO: 3419 - protein, 114 aa, Aggregatibacter actinomycetemcomitans; identical to SEQ ID NO: 3225

SEQ ID NO: 3420 - protein, 525 aa, Aggregatibacter actinomycetemcomitans; identical to SEQ ID NO: 3226

SEQ ID NO: 3421 - protein, 677 aa, Aggregatibacter actinomycetemcomitans; identical to SEQ ID NO: 3222

SEQ ID NO: 3422 - protein, 592 aa, Aggregatibacter actinomycetemcomitans; identical to SEQ ID NO: 3224

SEQ ID NO: 3423 - protein, 221 aa, Aggregatibacter actinomycetemcomitans; identical to SEQ ID NO: 3223

SEQ ID NO: 3424 - protein, 114 aa, Aggregatibacter actinomycetemcomitans; identical to SEQ ID NO: 3229

SEQ ID NO: 3425 - protein, 398 aa, Aggregatibacter actinomycetemcomitans; identical to SEQ ID NO: 3230

SEQ ID NO: 3426 - protein, 130 aa, Aggregatibacter actinomycetemcomitans; identical to SEQ ID NO: 3231

SEQ ID NO: 3427 - protein, 677 aa, Aggregatibacter actinomycetemcomitans; identical to SEQ ID NO: 3235

SEQ ID NO: 3428 - protein, 592 aa, Aggregatibacter actinomycetemcomitans; identical to SEQ ID NO: 3234

SEQ ID NO: 3429 - protein, 397 aa, Aggregatibacter actinomycetemcomitans; identical to SEQ ID NO: 3238

SEQ ID NO: 3430 - protein, 587 aa, Aggregatibacter actinomycetemcomitans
MILHALTQYYQRKAKYDGGVAPEGFENKEIPFIIVIDKQGKFIQLEDTRELKNKKKTARTFLVPKGLGRSGSKSYEVSNLLWDHYGYVLAYAGEKGQEQADKQHASFIAKVDELKQALPEDTGISAVAAFLASSEEKHKVIQSENWAECSKIKGCNLSFRLAEETAALVCQSQAVQDYLRQTNQDNSDNAPKGICLVTGKPASIARLHNAIKGVNAKPSPFTSVNLSAFESYGKEQGFIFPVGEQAMFEYTTALNTLLAGDNRFRVGDVTTVCWGEKPTPLETRVPWMINGGGKDNPDAHIDAVKSLYKSLYNGKYTEPDGKDQFYLLGLSPNSARIVVRFWHETTVAALSESIAAWYEDLQMVRNTKGKYPDPEFMPLMKLLCNLVLEGKAENLPPDLIAQVTDAALNNHTLPVSLLQIALRRNKAERKITYGRASLIKAYINRAIRAGRLKNMKELTMSLDRNRQDIGYVLGRLFAVLEKTQVEANPGLNVTIADRYFGSASSTPIAVFGTLMRLLPHHLNKLEFEGRAVQLQWEVRQILEHCQQFPNHLNLEQQGLFAIGYYHETQFLFTTDALKNLFNEAKTA

SEQ ID NO: 3431 - protein, 592 aa, Aggregatibacter actinomycetemcomitans; identical to SEQ ID NO: 3255

SEQ ID NO: 3432 - protein, 577 aa, Clostridium ultunense; identical to SEQ ID NO: 3120

SEQ ID NO: 3433 - protein, 257 aa, Aggregatibacter actinomycetemcomitans; identical to SEQ ID NO: 3301

SEQ ID NO: 3434 - protein, 61 aa, Aggregatibacter actinomycetemcomitans; identical to SEQ ID NO: 3300

SEQ ID NO: 3435 - protein, 582 aa, Ruminococcus lactaris; identical to SEQ ID NO: 3149

SEQ ID NO: 3436 - protein, 585 aa, Haemophilus haemolyticus; identical to SEQ ID NO: 3212

SEQ ID NO: 3437 - protein, 663 aa, Haemophilus haemolyticus; identical to SEQ ID NO: 3211

SEQ ID NO: 3438 - protein, 592 aa, Haemophilus haemolyticus; identical to SEQ ID NO: 3214

SEQ ID NO: 3439 - protein, 592 aa, Haemophilus quentini; identical to SEQ ID NO: 3213

SEQ ID NO: 3440 - protein, 592 aa, Haemophilus haemolyticus
MILASLARYYRRLAAENDEMGNPKVPPYGFSEEKIGWILVLDKEGRLKTAVPNLTADKKPQPKLMSVPRPEKRTSGIKPNFLWDKTAYALGVEANKNKAEAKEKPFTPSEKTFDAFKQYHLDLLQNSEDEGLQALCRFLQHWQPAHFAAENLPAEMLDANIAFSLEKTTALIHKREAAQTLWAGCLKGDEALEGLCLISGDTAPIARLHPAIKGVFGGQSSGGSIISFNKEAFASFGKEQGANAPVSEQSAFAYTTALNYLLRRENNHCLTIGDASTVFWAEADDNATAQAAEGFFAHVFTPPDDEQESAKVFNVLEQMGKGRPLQEIAPELSANTRFYILGLAPNAARISVRFWLDTTFGQLAENLAQHWQDLAVEPCAWKTPPSIWRLLLQTAVLGKSENISPVLAGEMTRAVICGTPYPLSLLSQLITRIRADGDVNGLRVAMMKAVLERRFRKGFIEEGVPMSLNNESPNRAYLLGRLFAVLERIQYQALGELNAGIADRYYGSASAVPFSVFPRLLSGAKHHLSRLRKDKAGMAVNLDKDLGEIIAKLPETFPRHLSIDEQGRFAIGYYHQKQSYFAKKETAETIEN

SEQ ID NO: 3441 - protein, 678 aa, Dethiosulfovibrio peptidovorans; identical to SEQ ID NO: 3183

SEQ ID NO: 3442 - protein, 592 aa, Aggregatibacter aphrophilus; identical to SEQ ID NO: 3247

SEQ ID NO: 3443 - protein, 597 aa, Aggregatibacter aphrophilus
MILASLARYYRRLAAENDEMGNPKVPPYGFSEEKIGWILVLDKEGRLKTVVPNLTADKKPQPKLMSVPQSFKRPGTTPKPFFLWDKTSYSLGVETNKNKAEAKEKPFTSSEKTFDAFKQYHLDLLQNSEDEGLQALCRFLQNWQPAYFAAENLPAEMLDANIAFSLEKPTALIHKREAAQTLWAGCLKSDEALEGLCLISGDTAPIARLHPAIKGVFGGQSSGGSIISFNKEAFASFGKEQGANAPVSEQSAFAYTTALNYLLRQRNQEENNHCLTIGDASTVFWAEADDNATAQAAEGFFAHVFTPPDDEQESAKVFNVLEQIGKGRPLQEIAPELSANTRFYILGLAPNAARISVRFWLDTTFGQLAENLAQHWQDLALEPCAWKTPPSIWRLLLQTAVLGKSENISPVLAGEMTRAVICGTPYPMSLLSQLITRIRADGDVNGLRVAMMKAVLERRFRKGFIEEGVPMSLNNESPNRAYLLGRLFAVLERIQYQALGDLNAGIADRYYGSASAVPFSVFPRLLSGAKHHLSRLRKDKAGMAVNLDKDLGEIIAKLPETFPRHLSIDEQGRFAIGYYHQEQSYFAKKETAETIEN

SEQ ID NO: 3444 - protein, 686 aa, Pasteurella bettyae
MSWIQKLYRTYNEAEKNSNLSDLDKLAPLWHSPQTAHIEIILDQNGNFISAEVLRDKPIIMLPVTETSEGRTSGLAPHALADSLQYIAKDLGLTHIAEITKELEDKNGKKKIVKEKKEELIFNLYAKQLDEWCACTDNPKILAIQKYVHKGTVLSDLIKSQVVPVDNNGNILEKWNKSDNITQCKPALLEVLGQNAEIRKALVVWSVTIPNDLCPQTWKDKNVQKSWGEYYQTTLTSQFCSVLGEEQQTRDSHPAKLIYSGDKAKLISSNDTSGFTYLGRFENANQAASISAEVSHKAHAALRWLIERGQGIRNENQVTVAWALSGKEIPSPMEDSHFYLDDDIDISASNEEDIVSATPISTKDWSVNLGAKAAEILKKKLRGYQAKLEQYDQITLLIVDGTTPGKGRMALTYYQEYLPETYFANLDAWIDDFSWYQRHTIEKQNEKLSKKSGNKKTIWVGIPPSPFAIGQAVYGKALSDTLKKQLYARLLPVISGGKSIQIPYDLVQKSFQIACNPDGSEHWEWERNIGIACALYKGWRARHHISSQRRTYTMALDKTIKSRDYLYGRLLATAENIESYALYLAGEKRSTTAERYMQRFAERPFSTWRNIELALRPYQERLRNNDKDTGSQAISKIMELFNPADFTCDDKLTGEFLLGYHSQKMEITSKISEYSKTKTEKSEKTD

SEQ ID NO: 3445 - protein, 611 aa, Candidatus Arthromitus sp. SFB-mouse; identical to SEQ ID NO: 3104

SEQ ID NO: 3446 - protein, 602 aa, Actinobacillus minor
MILHALTQYYQRKAAFDGAAPEGFEDKEIPFVIVIDKQGKFIQLEDTREVQGKKKVGRKFLVPKGLGRSGAKSYEVSNILWDHYGYVLAAAKEVEGVAKKNAEEIAAETEKNHILAVNQHQSFVAKVGELQQALPDDAGISAVAAFLANRQEIEKVMQSENWAECFKTKGCNLSFRLVEETRDLVCQSKLLQAYLSHHKQESAASEQTGICLVTGKKTNIARLHNAIKGVNAKPSPFTSVNLAAFESYGKQQGFIFPVGEQAMFEYTTALNMLLDSENRFRIGDVTAVCWAEKPTPLETKLVICLNGKKDNPDAHIDEVKGLYKSLYNGKYKEPNAKDKFYLLGLSPNSARIVVRFWHETTVANLSENLIKWYDDLQMVRSEKSPYPEFMPLPRLLANLVLEGKLENLPSDLITHITQSALDNKPLPVSLLQIALRRNKAEQKITYGRACLIKAYLNRAVRAGSLKNTKELTMSLDRERSDIGYVLGRLFAVLEKTQSEANPSLNATIGERYFGSASSTPVAVFGTLMRLSPHHLSKLEHEGRAVHLKWEIGQILEKCQRFPSHLNLEQQGLFAIGYYHETQFLFTKDALKNLFNQAKSAKE

SEQ ID NO: 3447 - protein, 587 aa, Prevotella dentalis; identical to SEQ ID NO: 3073

SEQ ID NO: 3448 - protein, 558 aa, Parabacteroides
MIAELVELGKRIRKGHDALKEEKCSWYIVINKYGTFLGLTPCDVTIEAEKLPAKKGRARLLLDKPEETLGFKGSKDKYEKYLAKLEDYKEVQELSPIFSFYNKPEEIEKALKAFSNLSPAKQKGNMTFMIDSTLLVSLECVKDAVKKKYEDTLCSKKQENLCAVCGTNTYPILDESHGSVKLPKGQTSGSMLVSYNNNAFESYNLKGNLNSGICTNCARNYIEGLQYLVGNGHEITTEKGEKIFRFSNRQKISDDTIALFWTKEPNEDIDPFSDICQPTEERVRKLFSSIATGEYQRVNTEVENYFYSCTISSAAARIAVRDWMAISVSQYQKNLKQWFDDIETVKDGEISYPGINSILNSCIKKKTKQTQSDAKAKARIGAILWHAALTNTSLPLMILQSVLDQIEHEKTTKFNKTFSVEKSTVIRLVLNRNIKNTYYMNKELDEQNESKAYLCGRLFAFICKLQFKAQGEVNSSIKDRFFASASKTPSRVMGILLTQYVPVYQKKTKGAYSKSITEIAVRIGNFPDKLTLTQRGEFALGYYYQYAVKQNENNNNNN

SEQ ID NO: 3449 - protein, 622 aa, Xanthomonas citri; identical to SEQ ID NO: 3116

SEQ ID NO: 3450 - protein, 654 aa, Peptoniphilus harei; identical to SEQ ID NO: 3190

SEQ ID NO: 3451 - protein, 606 aa, Acetobacter
MTEQIQQGILQALVRFYDRMQNAPALGWSQVKFGWAIVLNESGHPVDVMDLRDQSGKKPANRFFMVPAEVKRTAGISPNFLWDKSSYVLGKTAGAGKRTAQEHAAFVKKNLERIAGVEDAGLLALKAFLENWSPERFESEPFQTDMLDANIMFRLDGDARYIHERPAARKLIEARALEADGPEDRIFCLVTGENSKPARLHPAIKGVEGAQIAGASLVSFNCDAFTSYGKAQGENAPTSEGAAFRYGAALNSMLQRGSLNRVARPIGDTTVVFWAEASDRQAAEAADAFGAIALSSDNKDDAEVEKVSETLKRVSRGEALHTIRPDLGEGTRFYVLGLAPNAARLSVRFWLCDTLDAFARNLAMHYQDIAVEPAPWRNLPSPFLLAVKTTAMLEKADNIPKRLVADILNAILTGRAYPRTWLSSVIMRLRAGDDPTGWHAAAARAVLQRMKRKINPTISEKESVPVSLNRDYPNIGYQLGRLFAVYELAQRAALGGVNTSMRDKYFGAASATPASVFPVIIRNGQNHLGVVRKKLAGWSVIIEKELEEIFNKISPEEPSSFPRSLHLEQQGEFALGYYHQRSAKLAGQKSNQSLPEIENDQEDEDA

SEQ ID NO: 3452 - protein, 579 aa, Selenomonas sputigena; identical to SEQ ID NO: 3041

SEQ ID NO: 3453 - protein, 565 aa, Mannheimia haemolytica; identical to SEQ ID NO: 3347

SEQ ID NO: 3454 - protein, 594 aa, Mannheimia haemolytica; identical to SEQ ID NO: 3086

SEQ ID NO: 3455 - protein, 594 aa, Mannheimia haemolytica
MILSALTRYYYRLAAQEDRLTGESKVPSYGFSEEKIGWVLELDSKGNLVNVISNLTEDKKPKPKLMSVPRPEKRTSGIKPNFLWDKTAYVLGIESNPDKATAKDQPINFAEKTFEAFKQYHLDLLADSNDEGLMAIRNFLQQWQPTHFAESICPREILDANVVFKLVGTSGYIHQREAAQTLWTSLLINQSDNAEKGLCLISGKLSPIQRTHPPIKGVFGGQSSGGSIISFNKESFTSFGKEQGSNAPVSEQAAFAYTTALNYLLRTEKHRLTIGDASTVFWAEADNTTQAEAAEGFFAALMTPPDDEQENQKIFEELQKISKGRPLAEISPELSENTRFYVLGLAPNAARISVRFWLDTTFGQLAKNLSEHWQDLALEPCAWKTPPSIWRLLLQTASLGKSENISPVLAGEMARAVISGHLYPMSLLSQLVTRIRADGDINGLRVALMKAVLQRKFRKGFIKEGVPMSLNKESDNQAYLLGRLFAVLERIQTQALGELNAGIADRYYGSASAVPFSVFPRLLSGAKHHLSRLRKDKGGMAVNLDKDLGEIIASLPENFPRHLSIDEQGRFAIGYYHQKQSYFAKKETTESIEN

SEQ ID NO: 3456 - protein, 569 aa, Mannheimia haemolytica; identical to SEQ ID NO: 3079

SEQ ID NO: 3457 - protein, 625 aa, Streptococcus constellatus
MDFFTSLLKAYEKAEEIELVDQQNGDNPVLLPLYHTSLKSNGKNIIAVKLDQDGSFYKAEVMDDNQMIIFPVTANSVARSGSNPDPHPLVDKFSYYIPEVSQSQYDDFHKQLASWIAYCEEGKVKDFLMKIQHFILQTDFLSSILRSLYGDHYQREGLKITYSDSDGKNKTVDLSAYFLEFSIVQFHGFKDESVTSYKALHQSFISFMTANQDNLRTCNISGRMEQITNKHRGLMGTAKIISVSNKGEAYKGRFKEREDVFSVGYETSEKIHLMIKYLLENKNSSTWLGSSQYLINWFSDDLVNESQLDIVKPIFNDLFEDDEEESLVPIKPNEESRQIESSFIKGQKLFGNDATYYIAILNKTSNGRIALKYFRQVQVSQLLKNLETWQEDYSWEAKTKSGNYKLRTPTFNEIINAAYGVDRERYLELDNDSFKSDQYQQLVTALIDGRSIPNSVVKKLEDNIKQRQKYSKHWYQVQQVSLAVLQKQYGREFTPMLDHQETDRSYLFGRLLAIYELFEAQRYALDGSSQERITNAERYWNAYTGQPAKMMKHLENKIKPYEEVLKLNRPGIWHKLEKERKEIIQLLTPLYANKEFTQPLDYKFIFGYYAEKQFYYTKQTKENEG

SEQ ID NO: 3458 - protein, 488 aa, Centipeda periodontii
MSWMEQLVQTYDENERFAGRDDVDGMRALLPPVGHIVQNAQIEMTLSADGELIQAEVIPKELQSTLIPCTPESASRTNRPSPHPLHDNLSYVARDYYDFAKKPPKGETVPYLLYRKLLGTWADSDTNSKVQAVYRYISSHDVIRDLIEKKVLYQDDTGKLIEKWTDKEAPKPAIFSAVPGDILKAMVRFRVVVDDDDCPELWKDTQLQKSYQEFFHQQFSHMEEQLCYATGKILPATDKHGKGIRFPGDGAKIISSNDMSGFTFRGRFVDSDECLSIGYETSQKAMNALMWLARNQGYTHDGRVFLAWGRCGQTPPPVFDDTARLTRRRRPAGTARPSSLKGWAESLTKALAGYRHAFKQAEMSQVNVMVLDAATKGRLSICYYSEMAGEDFIDRIEKWHSLGCWRQHGYDSEKDESFAYFGVPTPKRLVEACHGVNVGDSQMKLELERIFYAILQGNPLPVDMERMVMGRAVKRAVCDKYYDWRRQL

SEQ ID NO: 3459 - protein, 602 aa, Desulfallas gibsoniae; identical to SEQ ID NO: 3084

SEQ ID NO: 3460 - protein, 600 aa, Pseudoramibacter alactolyticus; identical to SEQ ID NO: 3196

SEQ ID NO: 3461 - protein, 619 aa, Selenomonas flueggei; identical to SEQ ID NO: 3167

SEQ ID NO: 3462 - protein, 623 aa, Selenomonas infelix; identical to SEQ ID NO: 3250

SEQ ID NO: 3463 - protein, 634 aa, Selenomonas noxia; identical to SEQ ID NO: 3187

SEQ ID NO: 3464 - protein, 612 aa, Thiorhodospira sibirica; identical to SEQ ID NO: 3245

SEQ ID NO: 3465 - protein, 576 aa, Marvinbryantia formatexigens; identical to SEQ ID NO: 3173

SEQ ID NO: 3466 - protein, 571 aa, Legionella drancourtii
MILQALKDYYDRKVADPDGGIAPEGFEYKEIPFVIVVDEQGDLVQIEDSREQDGKQLRAKAFLVPQAEKRASGVKANLLWDNAEYIFGLSLHSKPERVAQMHNDFVNRIKMLGVEHDIGVNAVLLFLSSGLLLSALEQSKYAAEIKEANPFMAFRLNGDNILVCERKEVVAKIKSVPIIGNQGVCLISGETEVLANLQPAIKGVRGANTMGGNLVSFNLDAFNSFGKTQGANAPIGAKSAFAYTTALNYLLRKDSLQKIQVGDASTVFWSEKKSHFEDDFSSLFDGSHKDDPDHLTNKVKALFKSVEMGVFPVEDNKNHFFVLGLSPNAARISVRFWQVATIAEFSQRIVRHFQDLELVHAPHQHDYLPLWELLRATALLGKSENIMPNLSGEWMSSILAGLPYPETLFQAVLRRIHAERTVSYPRAMILKGCLNRKARFKNQTQEEVTVALDKENKKPGYRLGRLFATLEKIQEEANPGINAPIRNRYYSSASSTPASVIPILMRLKNHHLAKLEKGRTIFFERLLGEILSEVNTFPSQLNLQDQGLFAIGYYHQRQAFFTKSEYSNQEE

SEQ ID NO: 3467 - protein, 611 aa, Thermaerobacter subterraneus; identical to SEQ ID NO: 3291

SEQ ID NO: 3468 - protein, 628 aa, Cardiobacterium valvarum; identical to SEQ ID NO: 3258

SEQ ID NO: 3469 - protein, 605 aa, Thiorhodococcus drewsii; identical to SEQ ID NO: 3215

SEQ ID NO: 3470 - protein, 599 aa, Opitutaceae bacterium TAV1; identical to SEQ ID NO: 3277

SEQ ID NO: 3471 - protein, 615 aa, Porphyromonas uenonis; identical to SEQ ID NO: 3161

SEQ ID NO: 3472 - protein, 40 aa, Candidatus Arthromitus sp. SFB-1; identical to SEQ ID NO: 3265

SEQ ID NO: 3473 - protein, 405 aa, Candidatus Arthromitus sp. SFB-1; identical to SEQ ID NO: 3266

SEQ ID NO: 3474 - protein, 666 aa, Photobacterium marinum; identical to SEQ ID NO: 3299

SEQ ID NO: 3475 - protein, 598 aa, Flavonifractor plautii; identical to SEQ ID NO: 3259

SEQ ID NO: 3476 - protein, 678 aa, Haemophilus sputorum
MSWMQKLYQTYEYVQEQGLDDEDLALPFHMSKAVHLRVVLNDKAELVHAESIKRQLPIQAPENVLNKAGSTIAPSALHDSLKYIAKTAEKYLTIEYISEVAKKRAPQKGGKKWQEFLVGSEDKKRQFLDKQKQEYKESFIAYEEQLFNWVQFSNLPELKIVLQYIQKGSLIEDLLAKQIFSFKDNILSSGKNDPFSLTVIWAVEIPNDLHSDLWNKPRIQNQWIEYQESLIQKGRHKSLCCITGDLDYPTEAYPKINGNAKLVSANDDTGFTFRGRFYGDKDNGAKSELGSQAVILGKNASQKAFSVLKWMINRQGIRNGKQVILAWSSNCISDEDKLLSDLYQDDVVYTSLFAKDNIDHSADLGLKTVEQLKKKFHGYKEKLAANEQISLLMVDEPSKTGGRMSLTFYQEKLRDDYFRDLDEWQDDFAWYQKYKSSWIFAAPSLERIAEVVLTKTEFGDKDRKSRRQLYARLLPVISGGKSVQIPYDLVQKSFQVACNPFANHRPEDGEKIRSENWQRNIGVACALYKGWYARKYTLQRRYSMSLDTKNRSRDYLYGRLIAQAESMEWYALYLQNGKKTPTRATNAERYFQQFAQRPYSTWRNLESEKLVPYRNYLTSQGKDFYKDAISEIVELFEVNDFTRDDKLSGEFLLGYHCQKMEIARRIAELSANKSKTDE

SEQ ID NO: 3477 - protein, 590 aa, Enterocloster asparagiformis; identical to SEQ ID NO: 3157

SEQ ID NO: 3478 - protein, 710 aa, Desulfosporosinus youngiae; identical to SEQ ID NO: 3263

SEQ ID NO: 3479 - protein, 582 aa, Enterocloster citroniae; identical to SEQ ID NO: 3248

SEQ ID NO: 3480 - protein, 628 aa, Streptococcus pseudoporcinus; identical to SEQ ID NO: 3194

SEQ ID NO: 3481 - protein, 643 aa, Pelosinus; identical to SEQ ID NO: 3279

SEQ ID NO: 3482 - protein, 601 aa, Verrucomicrobiae bacterium DG1235; identical to SEQ ID NO: 3150

SEQ ID NO: 3483 - protein, 583 aa, Rhodovulum sp. PH10
MSALASLVRAYGRMADRNEVPPFGYSTERIGFVISLDADGVPSGIPSDLRTQEGRKVLGRPLAVPQAVKRTSGKAANFLWDKTAYVLGVTAGEGKRTAEEHAFFVEQHRDWLAGTDDEGLVALLRFLDWWRPEEFDALGWPADMKDENVVFALERERLDRYLHDRPAARNVWAGRLGATGATRAACLVTGEHGPVARLHPSIKGVWGAQTAGASIVSFNLEAFTSYDHEQGDNAPVSEAAAFAYTTALNRFLERGSRHRLQIGDASTVFWAEADDPQAATDAEDLFAAAFAEGVDENAASERVRAVLDAIRNGRPVADIAPGLPADVRFYVLGLSPNAARLSVRFYFEGDFGEIGRRWLEHVARLRVVPPPQETAPSMWRMLIETATLRRSENIQPNLAGEWLRAILAGAPYPLTLLSTLIMRMRADHDVNAMRVAILKSVLIRNFGMEVPVALDPTFDDPGYLLGRLFAVYEQVQSAALGGINATIKDKFYGAASAQPRKVFHLLESGSANHLSKLGKQKPGLRVVLEKQIGSIMEVMSPADDPFPASLPDRSQALFGLGYHHQRNEFYRKADKPAAEEARA

SEQ ID NO: 3484 - protein, 592 aa, Clostridiales; identical to SEQ ID NO: 3124

SEQ ID NO: 3485 - protein, 583 aa, Rhodanobacter thiooxydans; identical to SEQ ID NO: 3275

SEQ ID NO: 3486 - protein, 545 aa, Acidocella sp. MX-AZ02; identical to SEQ ID NO: 3290

SEQ ID NO: 3487 - protein, 599 aa, Jonquetella anthropi; identical to SEQ ID NO: 3175

SEQ ID NO: 3488 - protein, 599 aa, Jonquetella; identical to SEQ ID NO: 3257

SEQ ID NO: 3489 - protein, 585 aa, Rhodopirellula europaea; identical to SEQ ID NO: 3305

SEQ ID NO: 3490 - protein, 645 aa, Eubacterium sp. 3_1_31
MSWAVKLCETYDNCLDKVGIADNNHRILLPIGYTTVSAHIECTLFQDGSIQAVLIPKANAKTMIPSTIDSSCRSGKDANKVPHPLFDKLYFMAKNLAQYSDEKKLYDSHAIYMQQLQAWIQSAQGKLGTSLLKSLYTYLDKGTLLHDLVQQDILIVDENGKLSKKRMVDTDGIDIFKLVTEQSSAVLRFIVEDEDGHFHKLWMEADLIKSFSAYYEPMIEQKGLCYISGEHTSLSTKHPNKIRNVADKAKLISSNDTTNFTYLGLLTDSAQCAGIGYEASQKIHNALKWLIERQGKLYGSGELAIVAWGLKKVELINPLDNIFDFDDEKEIKIDIQEDYAYALNKALSGYYTKRFQDPDEDVVIMALDSATTGRLSISYYSELKGSAFLQRIGKWYASCAWQNVIRFEKQIDAKGKEIYQRIRYTGTPSIKSIIHCAYGNSIKKEIEKATTKELLSCIMDGRKLPYALVDHICQRLYKPYTMSSGEYDADLHIGCAVLRKYLNDIASEKEVWIMGLDKQKMDISYLWGRLLAYAQEVEKEALETMGVRDRETNAERYMRRFQLRPLETWEQLYLRLQPYQVKLRKNKNYRFKVLNEEMNELANTLLNEEKYQLDGALDKCFILSYCAQLDELRYKTNKQEESEDK

SEQ ID NO: 3491 - protein, 626 aa, Firmicutes; identical to SEQ ID NO: 3192

SEQ ID NO: 3492 - protein, 579 aa, Desulfonatronospira thiodismutans; identical to SEQ ID NO: 3189

SEQ ID NO: 3493 - protein, 635 aa, Lachnospiraceae bacterium 6_1_37FAA; identical to SEQ ID NO: 3203

SEQ ID NO: 3494 - protein, 645 aa, Erysipelotrichaceae bacterium 5_2_54FAA
MSWAVKLCETYDNCLDKVGIADNNHRILLPIGYTTVSAHVECTLFHDGSIQAKLIQKADAKTMIPSTIDSSCRSGKDANKVPHPLFDKLYFMAKNLAQYSDEKKLYDSHAIYMQQLQAWIQSAQGKPGTLLLETLYTYLDKGTLLHDLVEQDILIVDENGRLSKKRMIDTDSIDIFNLVTEQSSAVLRFIVEDEDEHFHKLWMEADLIKSFSAYYEPMIEKKGLCYISGENTSLSTKHPNKIRNVADKAKLISSNDTTNFTYLGLLTDSAQCAGIGYEASQKIHNALKWLIERQGKLYGSGELAIVAWGLKKVELINPLDNIFDFDDGNEIKIDIQEDYAYALNKALSGYYTKRFQDPDEDVVIMALDSATTGRLSISYYSELKGSAFLQRIGKWYASCAWQNVIRFEKHMDAKGKEIYQRIRYTGTPSIKSIIHCAYGNSIKKEIEKATTKELLSCIMDGRKLPYALVDHICQRLYKPYTMSSGEYDADLHIGCAVIRKYLNDIASEKEAWIMGLDKQKKDISYLWGRLLAYAQEVEKEALETMGVRDRETNAERYMRRFQLRPLETWEQLYLRLQPYQVRLRKNKNYRFKVLNEEMNELANTLLNEEKYQLDGALDKCFILSYCAQLDELRYKTNKQEESEDK

SEQ ID NO: 3495 - protein, 576 aa, Clostridium sp. D5; identical to SEQ ID NO: 3200

SEQ ID NO: 3496 - protein, 569 aa, Desulfovibrio sp. U5L; identical to SEQ ID NO: 3273

SEQ ID NO: 3497 - protein, 606 aa, Neisseria wadsworthii; identical to SEQ ID NO: 3244

SEQ ID NO: 3498 - protein, 630 aa, Neisseria shayeganii; identical to SEQ ID NO: 3239

SEQ ID NO: 3499 - protein, 613 aa, Thiorhodovibrio sp. 970; identical to SEQ ID NO: 3272

SEQ ID NO: 3500 - protein, 691 aa, Pyramidobacter piscolens; identical to SEQ ID NO: 3180

SEQ ID NO: 3501 - protein, 569 aa, Desulfovibrio carbinoliphilus; identical to SEQ ID NO: 3254

SEQ ID NO: 3502 - protein, 593 aa, Oribacterium sp. oral taxon 078; identical to SEQ ID NO: 3186

SEQ ID NO: 3503 - protein, 443 aa, Lachnospiraceae bacterium 2_1_58FAA; identical to SEQ ID NO: 3207

SEQ ID NO: 3504 - protein, 592 aa, Lachnospiraceae bacterium 3_1_57FAA_CT1
MILQSLVQYYEALEQKGEITRPGWCIARVSFALELSPNGDLKRIISLKNEVTKGKKTVREPQNLKVPQMLTRSSGVTANFLCDNSSYFLGIDNKGKPERSRECFLCAKEKHLEILRETDCPAAEAVKRYFESWDPDKAEENCLVSEVLDEITAGANLVFWVEDEYVHTDTAVVEAWENYRQNLEEGITGTCLVTGEKTEIARIHGNIKGVQGAQSSGAALVSFNAPAFESYGKEQSYNAPVGNYAVYAYTTALNHLLADRRHVSMIGDTTIVYWSEDGEEAYQDIFLSMSEPTMDNCEIVDGVFKNLESGKAVNISGVAENLSLSQKFYILGLAPNAARIAVRFFYQDSFGNILKNLKAHYDRMDIIRPQTDGIKYLGVWRMLMETVNKKSRDKKPVPNMAGAVYRAIISGDRYPDSLFRSVMGRIRSEQDDSSIGIYKITRGRAAIIKAFLLRNTTCDKEEITMALNEDSKNTAYTLGRMFAVLEAIQEDANPGINATIKDRYFNSACATPASIFPVLLKLKNSHIRKLNNKGKEIYYEKLLGGLQDKITAAEDMNAAYPRRLTLDEQGMFILGYYHQTQKRYEKKDKEEQ

SEQ ID NO: 3505 - protein, 598 aa, Flavonifractor plautii
MILQALTQYYETLVQAGVLAGPGWGPVKASYALSIAADGTLEQVTSIQTEQLRGKKTVLAPQVLTLPAPVKRTVGIAANFLCDNSGYILGADNKGNPQRSLACFAACKALHTSVLGGVASPSAQALLAFFRTWIPEYTLEHPALAEYREDILSGANLLFRYNGSYIHEDPEIRRAWERRYRADTDSPRGICLVTGEEGPVESVHPAIRNVSGAQSSGAALVSFNAPAFCSYGKEQNLNAPTGKYAAFAYTAALNYLLADREHVYRLGDATVVCWARGGGDAYQAFFGGALLGAPTPYSAADLRGMTAQLCQGIPVDFQEDKLDPSMDFYILGLSPNAARLSVRFFLHNTFQGFLDHIQAHYDRLEIAQSNDNKFDNIPLWRLLYATVRSQTKYEPSSYKEAKQNLEKYLPPELSGEILRSILMNTRYPATLLNGITLRIRAEHEITRSRAAAIKACLLQNYRFLPIYSALREVLTVELNDSCNYQPYVLGRLFAVMEQIQLASADWKLNRTIKDSYFTSAATTPKNIYAKLFPLSEYHMKKLLRDKPGLANILGKEKGSLIGKLTAPIPPRFMPEETDCFYIGYYHQSNQKKEEKEHV

SEQ ID NO: 3506 - protein, 609 aa, Olsenella sp. oral taxon 809; identical to SEQ ID NO: 3249

SEQ ID NO: 3507 - protein, 578 aa, Desulfovibrio sp. 6_1_46AFAA; identical to SEQ ID NO: 3218

SEQ ID NO: 3508 - protein, 585 aa, Neisseria; identical to SEQ ID NO: 3240

SEQ ID NO: 3509 - protein, 673 aa, Selenomonas artemidis; identical to SEQ ID NO: 3197

SEQ ID NO: 3510 - protein, 683 aa, Neisseria; identical to SEQ ID NO: 3297

SEQ ID NO: 3511 - protein, 643 aa, Prevotella sp. oral taxon 473; identical to SEQ ID NO: 3293

SEQ ID NO: 3512 - protein, 645 aa, Selenomonas sp. oral taxon 137; identical to SEQ ID NO: 3193

SEQ ID NO: 3513 - protein, 623 aa, Selenomonas sp. oral taxon 138; identical to SEQ ID NO: 3296

SEQ ID NO: 3514 - protein, 613 aa, Xanthomonas translucens; identical to SEQ ID NO: 3292

SEQ ID NO: 3515 - protein, 579 aa, Selenomonas sp. CM52
MLQALVERYETECKEGRLPRDGWEKRNVSFALLLSKEGELLQVLPLIQKVLRGKKEVDRPQELIVPAGETRTVGIAPFFLCDNSSYFLGADMKGKPKRTAECFAAAKALHEEILDGAGSDAARAVIAFFGHWQGGETMLRTHPALAPYANEILAGANLVFRVASTFVHEEPAVREAWETHLDASGAEEKRRCLVTGAFAPIAVKHPALKGVTGAQATGAMLVSFNANAYESYGHDGEQGGNAPVSKKAAFAYGTALNALLADREHTKIIGDTTMVYWAEEESEAAQDLLCGMLFGDEDKMTDDLLDSVLKKVQAGAAIDYEGVAISYANPFYILGLAPNAARLSVRFFLQGSFGDFLKNLALHMEQMKIVRPSWETRGNVPLWELLRETVNPNAKVKMASPIMAGAMLRAVLTGGKYPVSVFQNILLRIHAEQGERKINARRAGFLKAYLMRNRGRKIAVALDENSTDVAYLLGRWFAVLEEVQEKANPEIKATIRDRFFDSACGTPAHVFPMLQKLALHHLKKLEKAPRVYLDKKLSEIMGKLDAKDMPRHLPLEEQGVFILGYYHQKQKRYEKKEEK

SEQ ID NO: 3516 - protein, 641 aa, Selenomonas sp. FOBRC6
MSWMEQLVQTYDENERFAGRENVEGMRALLPPVGHIVQNAQIEMTLNTDGELIQAEAIPKEERATLIPCTPDSASRTSSPSPHPLHDNLSYIARDYYDFAKKAPKGEEIPYLMYKKLLGAWAESASVSPKVRAVYRYISNHDVIHDLIEKKVLYQDSNGKLLEKWTNKDAPKPPIFNVVAGDILKAMVRFRVVLDGDDCPELWKDTALQKEYQRFFEQYFSEVEEQLCYATGKILSATDKHGKGIRFAGDGAKIISSNDMSGFTFRGRFVDGDECISIGYESSQKAMNALSWLTRNQGYTHDGRVFLAWGRCGQTPPPVFDDTARLTRRRCTAGTARPSSLKGWAESLTNALAGYRHAFKQAEMSQVNVMILDAATKGRLSICYYSEMAGEDFIERIEKWHRHGCWRQHGYDSEKGEPFVYFGVPTPKRIAEACHGENVGDAQMKLELERIFYAILQGNPLPVDMERMVLGRAVKRAVSDDYYSWRRQIVEPACSIIVRRLNLVKEEYTVALDETKDDRSYLFGRMIAVADQMERATYSREEMGSRTTNAMRYMEIFSSRPATTWKTLHKKLLPYQQKREMYGGKERKLISKIGSMFKEEDFLSDRPLDGRFLLGFYCQQYAMEQEREENRKKKAQQEEEV

SEQ ID NO: 3517 - protein, 645 aa, Selenomonas sp. FOBRC9
MSWMEQLVQTYNENEQFAGKVGAAGMKALLPPVGHIVQNALIEMTLSGGGRLIHAEVVSDKGQQPTLIPCTPDSASRTSSPSPHPLHDNLSYIARDYHAFVPAKKKDRKSAYEQYAELLGAWAQSEDAEPKVRAVYRYITEHDAIRDLIAKKVLYCNDKGEILQKWTDKEQEKPPIFKAAAGDVLKSMVRFRVELDGDDCPELWRDTNLQKKYRQFFTHHFSDMEQKLCYATGEMLPVTDKHGKGIRFAGDGAKIISSNDSQGFTFRGRFADADECISIGYETSQKAMNALMWLIRNQGYVVDGRVFLAWGRHAQEIPSAFDDTARMTRRRRAADAAPSMPVTMEDWAASMKRTLDGYRAEFKRAETSQVNVMILDAATPGRLSICYYSEMAGEDFIERIEKWHSCGRSLQHGYDKETEKSYAYFGVPVPKRLVEACHGENIGDNQLKMELERIFCAIVQGQALPLDMAKMALSRTVKRAAIDDYFGWHRRLLEPACAIICNRLNHVKEEYTVALDEEKKDRSYLFGRLLSVADQMERATFSREELASRTTNAMRYMEIFSVRPASTWMTLRKKLLPYEQKRERYGGKERKLIDKICWLFDDKDFSSDAPLDVKFLLGFSCQNYAMELERKENRQKVEEKREENV

SEQ ID NO: 3518 - protein, 527 aa, Oxalobacteraceae bacterium IMCC9480
MAQSFLVPQGLKKAYGVASNLLWDTVEYTMGIDTRGNPARVAGQYAAFLARLHALPESAQQDPGLIAILGFLARIDIAHLATFPMWAGILEANPLITFRLQGDLDLICQRPAIVAAITSMSADEDATTARGICLVTGNLAPIGRLHTAIKNVWGAQSSGANIVSFNKDAYCSFGNNGKQGANSPVSEYAVFAYTTALNALLEKNSGQRVQVGDASTVFWAEADHALESLVADAFGEAPKDDPARGTSAVQRVFEWAQSGKATTLDGDTRFFVLGLAPNAARISIRFWHVLPIRELATRMTQHYLDLEIVRGKFDAEYPSLFRLLSACATQGKAENIPPNLGGEVMRSVLTGSPYPATLISAAIRRCRAEQDVTYHRAAVIKACLNRSIRAGNLSTLPPQKEFTAMLDPDNQSTAYRLGRLFAVLEKIQEEASPGLNATIRDRYYGAASSTPVTVFTTLLRLHHHHLGKLGIGRRVNMEKLIGEIMLHIDQFPAQLPLAEQGRFAIGYYHQRQAFFSKPHSPEEGASA

SEQ ID NO: 3519 - protein, 580 aa, Nitrobacter sp. Nb-311A
MSILAALAKAYDRIKDAPLFGYSAEKIGFVISLSDDGAVVSVTDLRSEDRKKSHRLMQVPQPSKKSVNISPNFLWGNTSYTLGITARDDKKSKRLADEHAAFVRHHLEALNHADDVGLVALRRFLEHWTPTQFADLHWPDEVRDQNVVFALESERRNNVYLHDRLAAKSLWEKLNSPEEAAKAVCLINGDEATIARLHPSIKGVWGAQSSGASIVAFNQESFESYGHEQGDNAPVSEAAVFRYTTALNAFLAKGSRNRIQIGDASTVFWADASDAATAEMAEDAFAAMFEEVNEEVETRKVGDILERIRKGQPLKEAAPELSRGVRFHVLGLAPNAARLSIRFWFDNDFGVLAENYQQFVADMQIEPPPREPNPPLWRYLIETAVLGKRENVHPNLAGEWMRSILTGAAYPQPLLATVLMRIRADGEVNALRVAILKALVIRNFKNEREASVSLDLENKNKGYLLGRLFAAYEYAQARALGDKINATIKDKFYGAASAQPRKVFAILEKNSANHLSKVGRTSIGSLRFLQDAIGGIMEQMSPGDEPFPASLSAQEQSLFGLGYYHQRNEFFKPKTNQPAD

SEQ ID NO: 3520 - protein, 576 aa, Rubrivivax benzoatilyticus; identical to SEQ ID NO: 3206

SEQ ID NO: 3521 - protein, 631 aa, Streptococcus pyogenes
MDFLTSLLKTYEKAELADLVDHQKRNNEPVLLPIYHTSLKSNGKNIISVKLDKDGQFHKAEFMADKQMIIFPVTADSVARSGSHPAPHPLVDKFAYYSAEMGQSQYDSFHKQLNNWIDYCEEGDVKRFLTIVQQFILKPEFLTLILDSLIGPDYQHNQLKVTFCDATGKEKLIDLSACFLEFSIDQFQGFKNESVSTFKTLHQSYISFVEANREKLGICNISGREEQLTDKHRGLMGNAKIISVSNKREAYKGRFREREDVFSVGYETSEKIHLMLKYLLENKNTSTWLGSSQYLINWFSDDLTNDSRLDIVSPIFDDGLEEDDDDDTPPVITLATEDNKRIGKSFIKGQKLFANDATYYVAILNKTSNGRIALKYFRQLQASQLLTNLNKWQETYSWESRSKFGKSRLRTPTFHDILNVTYGVDRDRFLELDNDNFKSDQIQKLVASLIDGKPMPQSIVKKLGNNVKERHRYRKHWYQVEQVCLAILHKQNGEEFSPMLDHTNQNRSYLFGRLLAIFELIETLRYGLDGNNNDRITNAERYWTAYTGQPTKLMMLLENKIKPYEEPLKLNRRGSWMKLEKEKEEILELLNPLLETETMEKPLDYRFIFGYYAEKNYYYTKQNTEVTESEE

SEQ ID NO: 3522 - protein, 617 aa, Ruminococcus flavefaciens
MSWTDELYKIYEFNSDREFGENEPVMLPVAHSTANAQIEIMIDLEGNFKGAKTVEKPDAVTVIPATEDSATRSSGICAMPFADKLIYIAGDYSTYADGKKADNSGHFTNYMNQLRKWMAGEYSHPFVRALYKYLDKKCLISDLVSADVIKIDEVSGKFKEKEKISGIAQEDSFVRIIVFTNDSVVKTWKDRSLQDSFISFNSSLMGEKQLCYASGEYVPSTYKHPSKIRNSGDKAKIISANDESGFTYRGRFADKEQAVSVGYEYSQKIHNALRWLREKQGKNIDSLTVIVWASAMQVIPDTSESFFDDSFFDDLTDEKAADIPSTMPLYMEMLNKRIFGVRERLKPNTKVMIMGLDAATTGRINISMYSELESSQYLRNIEKWHSETAWLRFYGKSKMKMINSFSVYDIVRYAFGTEQGAFIDCDKKLMRDNILRLLNCITNGVKLPSDIVNALYQKASNPLAYENNYNHRSVLETACGMIRKNIIDGKGDVSMAYDPNITDRSYLYGCLLAIADKAESEAYDEQERNVRVTNARRYWNAFSQRPYMTWGIIEERLRPYMDKLGKAQVKYSKWINEITSKMDEKTFMNNNRLEPMYLLGYHHFTEYMYNGNNKEEK

SEQ ID NO: 3523 - protein, 647 aa, Peptoniphilus rhinitidis
MSFLTALYDSYNYGLENNLVGDLDNKSSLILPIYHNSMKSNGKNIVEILVNKKSELVDAHFLNENEIVIFPVTEDSVARSSGVAPHPLFDNFDYVIQEDTKKSNAYIEQQEFWLNSCEDDFVKIIHDFIIKEKVFEEILGKLFKEYKILKDKNVEFIDNSDKKSKKMNIDFSKVFLTFKIQNYDEKKDLSLSENKNLQQKFIEYTRKTFERDKDSEKIICNISGKEDFLCLKHKPLIGSARLISQITANNENYLGRFEKPDNTIKIGKESSQKIIQMAKSLLDGEKTSRWLGEFTYALSWFSDDIQNKSGLDPGKSVEIENVGGVLSLLGKKDGIKSSGILKKEKISDENSENIVKSFTSGKILFSNESKYYMAIVDKVSNGRVAVKYFREMDSSRLKENLVSWQNKYNWIKHTKDSEIKNYTPSPLMLILAAYGVEREKGLEVSKKKFVTDQYKNILASIIEGRDMPKNISYALEMNIRNRLNYDKSWAQVKLCALAVLKEKEGITSDMLDRKDTDRSYLFGRLLALYERLEKITYDTDNERVTNAEKLWTSYVNKPVTMNLRLRNLLRPYEDKLIVNESKRGIYFKIKRDIREVSNLLSENYDYKLKENNRPLGPGFIFGYEAQMKDLFTKREDKKDLESEEKHD

SEQ ID NO: 3524 - protein, 573 aa, Treponema primitia
MILQALKGYYDRKAADSESGISPDGWELKEIPFVVVLNENGSLIQIEDTREGEGTKRRGRYFSVPQGVKRSSGVAANLLWDTAGYVFGITDLEGLGEADKKRKLSRLIEQKKAFIDRIQNEIPDTPRKKALVAFLSGIEQSVLEKTLQWDDIYRTNPNISFRFDHELMLYCETEGIRTALVAKAGSKEYDGLCLVSGERDKISVLHTAIKGVWGAQSSGANIVSFNQDSFCSYGRRKQQGWNAPIGESAMFAYTTALNSLLSRDSKQRMQIGDTSTVFWSAKKTQFENDFTYFFAEPSKDNPDEGINHIRTLFDSPKNGYVEDPDSTNFFLLGLSPNAARISVRFWRRGTVGEFAGHIRQYFKDLEIVKPKNEPLYYSLWRLLVNASIQDKSDNIPPNIEGDVMRSILDGTPYPATLLQLVLRRIRSDTENRVKPVRAALIKAYLNRYYNKEVIQVALDTNESSDSYHFGRLFAVLEKIQEEANPGLNATIRERYYGAACGSPVTVFPTLLRLKNHHIAKLENKGRAINFERMITEITSHFNDFSSHLDLHDQGKFAIGYYHQRQDLFTSKKE

SEQ ID NO: 3525 - protein, 614 aa, Xanthomonas vasicola
MILSALADYYHRLLDDPTSGIAAPGYSQEKIGYAIVLDGGGRVVAVEDEHDYEGKKRIPKSVSVPASFKRPGIGTNPFFLWDKTSYALGVSASSKRSAQEHAAFKTLHQQALGGSEDPGLRALLTFLDTWSPAQFADHPQFSRYGEALLDTNLVFRLEGDTGYLHQRATARAAWERLQGQSADGVSGICLISGHFAPLARLHPPVKGVNGAQSSGASIVSFNLDAFTSYGKNQGENAPISEQATFAYTTALNHLLRRDPRNRQRLQIGDSTVVFWAQARTTAHAEEAEDLIADFLRGGETEGPGIADGQATQRLHLALEQVRQARPLREMDDALDDEARIFVLGLAPNASRLSIRFWETQTLAGFAARLAAHYQDLKLEPPAWKRPPTPQFLALQTAPVYGEHGKPKAEDVSPLLAGEVTRAILAGTRYPRSLLGGIVMRFRADGQVNPLRVALCRAVLAREARLNTQQGLSSTKGEPPVSLDTANTDPGYLLGRLFSSLENLQRTALGGQVNATIRDRYYGAASATPASIFPVLLRNAQNHFGKLRKDKAGLAVNLEKEVGQIIDALPASFPRSLPIHEQGRFAIGYYHQTQARFARNNGQDAPDTASEGEPA

SEQ ID NO: 3526 - protein, 614 aa, Xanthomonas vasicola
MILSALADYYHRLLDDPTSGIAAPGYSQEKIGYAIVLDGGGRVVAVEDEHDYEGKKRIPKSVSVPASFKRPGIGTNPFFLWDKTSYALGVSASSKRSAQEHAAFKTLHQQALGGSEDPGLRALLTFLDTWSPAQFADHPQFSRYGEALLDTNLVFRLEGDTGYLHQRAAARAAWERLQGQSADGVSGICLISGHFAPLARLHPPVKGVNGAQSSGASIVSFNLDAFTSYGKNQGENAPISEQATFAYTTALNHLLRRDPRNRQRLQIGDSTVVFWAQARTTAHAEEAEDLIADFLRGGKTEGPGIADGQATQRLHLALEQVRQARPLREMDDALDDEARIFVLGLAPNASRLSIRFWETQTLAGFAARLAAHYQDLTLEPPAWKRPPTPQFLALQTAPVYGEHSKPKAEDVSPLLAGEVTRAILAGTRYPRSLLGGIVMRFRADGQVNPLRVALCRAVLAREARLNTQQGLSSTKGEPPVSLDTANTDPGYLLGRLFSSLENLQRTALGGQVNATIRDRYYGAASATPASIFPVLLRNAQNHFGKLRKDKAGLAVNLEKEVGQIIDALPASFPRSLPIHEQGRFAIGYYHQTQARLARNNGQDAPDTASEGEPA

SEQ ID NO: 3527 - protein, 608 aa, Sphingomonas elodea
MTILQALNGYYKRLPGVAGQGWSSEKFGWCIVLNAEGQAVDVENLHDLSGKKPRPTLHLVPAALKRTVAIAPNFLWDKSAYVLGRTGGEGKRTADEHAAFVALHLERLAGQEDAGLVALRRFLEQWRPERFEDLPRGTPDLLDANILFRLEGERGYLHERSAARALVEAAAFAGDRPGSVCLVTGEVGPIARLHPTIKGVEGAQTAGAALVSFNLDAFTSLGKAQGANAPTSEAAAFRYGEALNQLLRRDSRKRLPRPIGDTTVVFWADASEVKAAEAADALAEDWLLGGADEVSDAQEAAKVREQLEKIAAGRPVAELRSDIDPDTRFNILGLSPNAARLSVRFWLSQGFGDFARALAQHYQDMRVEPLPHGWGAAPAVGRMLVNSTAAQRDYKNIPYALAGEVLRAVLSGGRYPQTLLATALMRLRAGDPKTADGRTGDIGWHAAVIRGVLVRAGRANPLVPEPGELPMSLQRDYQDAGYQLGRLFAVYELAQRSALGRVNASIRDKYFGAASAAPASVFPIIVRGGQNHLAKVRKEKPGWAALIERELEEIHGHLAPALPRSLTLQKQGEFAVGYYHQRAARLSDGKVEIDPAAFNDTTDSEGEA

SEQ ID NO: 3528 - protein, 605 aa, Pseudoalteromonas flavipulchra
MILSALNQYYDRLNNENQGKVPNFGFSEERISYVLILSKQGELVDIVPNLTDEKKPKPKLVQVPQSFKRPGKVKEPKPFFLWDKSAYALGVTASKSKTDELFEVSLPTFEGFKNQHLALLENADDVGLQALALFLKNWQPEKFKSSILTKEILDTNVVFQLDGARNFIHETTVAKSIWSSSRSSWVDPTGTNLSTCLVTGQLSPIARLHPAIKGVKGGQPAGVSIASFDKSSFESFGRKQGNNSPVSEKAAFAYTTALNYLLRRENDQVINLGDTSVVFWAQAESEQKAKSAEAFFIKGFNPPMPTDESEVAALGAELGKLVKGRPLAEISPDLDPNTQFFILGLAPNAARLSIRFWLQTDLGHIQQRFTEHFQDLALNPLPWKTAPSVWRLLLQLAPHREGQQPKIDDAPAHLAGELMRAILTGQRYPRAILAQLLSRFRADGDISRLRIAMVKAVLQRELRLLGKEEISMSLDESNSNPAYLLGRLFSVLENIQRNALGDKVNATITDKYYASASTVPYSIYPRLLSGSKHHLSKLRKEKPGLAVTLEKELGNIMAMLPTEFPRHFSIEHQGRFSIGYYHQKNARFSQSEQIKTDESTIEGND

SEQ ID NO: 3529 - protein, 630 aa, Lactobacillus suebicus
MQLYESLYNLYEQNKSLVLQPQIDRFDNEYCLLPPGDYVLKAAIQVTVDLNGKLQSIIKNERKIPVLASPQNNARTSNPAPLALFDKVEYLTDTSLLQLSAKTQEKNTNKRKIYSEQLHDWIDYASKNQKNDLVLEWLTAISEYLSKDTLISDIDKSIGLKSFKTANIVYFDIMDLSPHLWYQTALAESWWNFVCKTQSGTKGLDLITGNFTDNQATVYSKGLGGSANNSSKLISYNDNDGYTYHGILGNQELKTNGEAHYLAPMDATNAAKSENMLLFLRQTQSMPLVSGSSNNTTSIVIWSDNNEKVNHDTQLEVFAALGLNLSNTSKDNLDESTGQNDATAAMELLRGEPLGGEYNSHINLLTVNATSTGRLSVVDFQSITLNEFKTGFKNWQNRCNYRHIDDYKQPNLKQMSKMIYADKQTSSDKGASFVSRAYSQLLNCMLNNTKIPSYIIRLATKRYVDGVLNRGGGYVRRCSAQWNDILLTLVNAEKPERNDKLMSDKSIETRDYKFGKLLATIHLLENDALYKRSTGGIIRQTNAQKALGRLGDQPANTIKVLVKKVNPYFKDDPYLVKEIMKQLAGFDAEEMTNEPLKAIYLVAYGRTIDKHFEDLKRYKQETDKNIEQNG

SEQ ID NO: 3530 - protein, 594 aa, Halomonas
MILTALNDYYQRLADENKVPLPGFSSEKVSFCLVFSQDGKPLQIIDLRDTTGKKPRPSPCQVPVDKRRTSGIHAYPLWDKTAYALGVSAGEGKRLVDEHDAFKERQRALFGESDDPYLIAFLRLLDQWMPEQLIGLPGYSEEVLDTNIIFRLDGQRQYLHENHEARRLWGAALESGEGELGQCLITGEIAPLGTDHPAIRGVRDAQSSGASLVSFNSDAYESYGYSKNQNASISKSAIFGYSTALNYLLRGDTDNRQRLQIGDATVVFWARARDAAHAEAAEDFFAMLNEPPSDEQEAAKLGTLLTDISQGRPLQELDPLLEPDTQFFVLGLAPNAARLSVRFWYVDSLERLAQHYAQHHKDMLLEPIPWKGVMPGVRRLALQTAPIRGDWPKAEDVLPQLAGEMMRSVLTGCRYPQSLLNNIVMRFRSDGGITGLRVALCKAVLARDARLVANSNFNYQEVPVSLDQHCTNASYLLGRLFAELENAQREALGKEVNATIRDRYYGAASATPANVFPMLTRGVVHHFSRIRKDKRENVAYAIEKKMGEIMKKLPAEFPKHLSIQEQGKFAIGYYQQKWTRQQENADEASPGDME

SEQ ID NO: 3531 - protein, 631 aa, Streptococcus pyogenes
MDFFTSLLKTYEKAELADLVDHQKRNNEPVLLPIYHTSLKSNGKNIISVKLDKDGQFHKAEFMADKQMIIFPVTADSVARSGSHPAPHPLVDKFAYYSAEMGQIQYDSFHKQLNNWIDYCEEGDVKKFLTFVQQFILKPEFLTLILDSLIGPDYQHNQLKVTFCDATGKEKLIDLSACFLEFSIDQFQGFKNESVSTFKALHQSYISFVEANRENLGICNISGREEQLTDKHRGLMGNAKIISVSNKREAYKGRFREREDVFSVGYETSEKIHLMLKYLLENKNTSTWLGSSQYLINWFSDDLTNDSRLDIVSPIFDDGLEEDDDDDTPPVITLATEDNKRIGKSFIKGQKLFANDATYYVAILNKTSNGRIALKYFRQLQASQLLTNLNKWQETYSWESRSKFGKSRLRTPTFHDILNVSYGVDRDRFLELDNDNFKSDQIQKLVASLIDGKPMPQSIVKKLGNNVKERHRYRKHWYQVEQVCLAILHKQNGEEFSPMLDHTNQNRSYLFGRLLAIFELIETLRYGLDGNNNDRITNAERYWTAYTGQPTKLMMLLENKIKPYEEPLKLNRRGSWMKLEKEKEEILELLNPLLETETMEKPLDYRFIFGYYAEKNYYYTKQNTEVTESEE

SEQ ID NO: 3532 - protein, 597 aa, Chlorobaculum tepidum
MSGKRSYQSARLGERGGEKMILQALYDYYQRKAADPESGIAPEGFEWKEIPFIIVIDREGNFVSLEDTREGDGKKKKAKPYLLPKSVGRTGSNSYKTSFLLWDHYGYVLGHSRSESDKDQAMAEKQMPSFIEKLRSLPENVKGDDGVLAVIRFYEKGEYKKVKESDNWGECTKIIGCNMSFRLDGEVDLVPCRDAVKRYIETQIGESADDAVGLCLVTGKKAAIARIHSDTPINKDSKKFVSFQKNSGYDSYGKEQAFNAPISESAVFAYTTALNMLLGKNSKNKVQVGDATTVFWSEKQDVFEEDFPAFFGYSKDDPDADVRAVKALYEGIKSGHAQMDSKTRFYVLGLAPNSARISVRFWHTGTIAEFAGNIRQHFDDLEIIRSPKDSGHFSMFWLLSAMAHEGKVDNVPPNLSGQIFQSVITGGLYPATMLQQAIRRIRATQEVTRIQASILKACLNRFSRIYNTKAKEITVALDPTNNNPGYRLGRLFAVLEKIQEEASPGLNATIRDRFYGAASSTPVTVFPQLLKLKNHHLSKLDNAGRRVNFERMLAGVFEGIGNEMPSHLSMEDQARFAIGYYHQRQDFFKKKDSENNN

SEQ ID NO: 3533 - protein, 567 aa, Methylococcus capsulatus
MILQALYEYYGRKPELPALGFEEKEIPFLIVVDEQGRFVQLEDTREGEGKKKVPKRFFVPQAVKRTAGIAANVLWDNSSYVLGMDAKGKPERLKEQTRAFEQAIRDLGLEDDAGVSAVLAFLDSKEEKAKALEAASSWPEILEKGANLAFRLQSRSELVCQHEMVRTALTRRLTEANADPTVCLVSGEEDAPERLHPPIKGVWGGQPTGANIVSFNLDAFNSWGKSQGDNAPVGKRAAFAYTTALNHLLAKDSKQRLQVGDASTVFWAAQANPLEDLLADLFSEPPKDDPDRNTRAVESLYKAPHTGASVFDDDGTQFYVLGLAPNAARIAVRYWHVATVRELARHIKQHFRDLEIIHAPSEKPYLSLFRLLVCTATQGKSENIPPNLAGEFMKSILAGIPYPHSLLQAAIRRIRADREITYPRAALVKACLNRQTRYSNPDNVKELTVALDDTQTNIGYRLGRLFAVLEKIQEEANPGINATIRDRYYGAASSTPVAVFQTLMRLKNHHLAKLENRGRAVNLERLIGEIVDGIDAFPPILSLADQGHFTIGYYHQRQALFTKTDRS

SEQ ID NO: 3534 - protein, 544 aa, Xanthomonas citri
MGQDQLRAGRQCQQQAQRAGTRCIQDLAPAGARRQRRPRAACAIDVPRHLVARAIRRSSTVFPSRRGAIGYQPGVPPGGRHRLSASARHGARGMGATARGQSADGASGMCLVSGLRAPLARLHPPIKGFESTGSSIVSFNADAYISYRGSLLKVQSKHKENDSGANAPISKSAAFAYTTALNHLLRRDPRNRQRVQIGDTTVVFWAQARTTAHAEEAEDLIADFLRGGETEGPGIADGQATQRLHLALEQVRQARPLREMDDALDDDARIFVLGLAPNASRLSIRFWETQTLAGFAARLAAHYQDLKLEPPAWKRAPTPQFLALQTAPVYGEHGKPKAEDVSPLLAGELTRAILAGTRYPRSLLGGIVMRFRADGQVNPLRVALCRAVLAREARLDTQQGLSSTKGEPPVSLDTANTDPGYLLGRLFSSLENLQRTALGGQVNATIRDRYYGAASATPASIFPVLLRNAQNHFGKLRKDKAGLAVNLEKEVGQIIDALPASFPRSLPIHEQGRFAIGYYHQTQARFARNNGQDAPDTASEGEPT

SEQ ID NO: 3535 - protein, 469 aa, Streptococcus mutans
MEKKKQKIALKDIKLSFKILEFDGLRDVSVSNFNEMHHDFINYINNNSTEIGIGICNISGKEDRIIKNHRKPKGVFSNGKLISQNNKIAYLGDRFPNENASSDIIKIGYETSEKIHLMIKYLLENNNSHTWLGTSQYLINWFSDDLSNDSQLDIVKPEFDDLFEDDEEEKQVFIKPNEENKKIGSSFVRGQKLFSNNATYNIAILNENKGRIALKYFRQLQVSQLLKNLESWQENYSWEAKTKAGNYELKKTPTFNEIINAAYGVDRERYLELDNDSFRSDQYQQLVTALIDGKPLPNTIVKKLEDNIRQRQKYSKHWYQVQQVSLAVLQKQYGREFTPMLDHQETDRSYLFGRLLAIYELFEAQRYALDGSSQERVTNAERYWNAYTGQPAKMMTHLENKIKPYEEVLKLNKPGIWHKLEKERKEIIQLMTPMYAHKNFTQSLDYKFIFGYYAEKQFYYTKQAKENEE

SEQ ID NO: 3536 - protein, 591 aa, Chromobacterium violaceum
MILTELLDYYQRQAVLDTVPRFGFSSEKISYALLLNEAGQLADLPRDIRVAKGKRYEGRVLNVPQPEKRTAGIRANFLWDKTGYVLGVGAKSGGRVADEHAAFKALHAKWLADSEDEGLRALRRFLQDWRPEQFDAFPPELQESLRDANVVFRLDGRREYVHESPTAQQLRARMLAEGGGDTGMCLVSGETAPLARLHPAIKGVNGAQSSGASIVSFNLESFASYGKSQGANAPISEFAAFAYTAALNHLLRREEDNRQRLQIGDATVVFWARAASAEGAVAAEAAFADWLDPPADDASEAQRVLAALQDIADGRPAAELGLRLEPDTRLFVLGLAPNASRLSIRFWECGRLESFATRLAAHYRDLELAPLPWKRPPGVWRLLYAVAAQGKAENVPPQLAGELARSILGGGRYPRSLLVNAIMRMRADGELSGTRVALCKAVLGRDQRLGVAGINLELPVSLDIANRDPGYLLGRLFAELESIQRGALGEKINATIRDRYYGAASATPANVFPLLLRNAQHHLSRLRKDKPGLWKTLERDLADIIHGLDAPLPRNLGIAAQGQFAIGYYHQAHAYYHNKGGDAAASEETEE

SEQ ID NO: 3537 - protein, 612 aa, Thermus thermophilus
MPGSGKVGWRFPPKSTRSSTGWRKAMLRELKEAFHRFRKEGVLLPLAYKRKSVAWFIRLEGGKARLEGPYGKREGVEPIPAPDRQRSGKASEANLKPYLLVDDARYVLGLFEEGREDEAALLHKGFKELTEKAWRETQSPHVKVVLDLLSSPELGDLREEFRQKGGKPRDLLAFKVHGVLPTELEEVQAFWARHLAEEIQGGKGYCALCGTLGPVLRIFPREVVVLGQKCQLVSFNQKAFESFGKEQAANAPLCFTCASQVVDTLDYLIRSERHSRPLYREEEGGLRNQLAVFWLSEKVEVPLETPVDLETILGAVLSGALVHSPTPPADLTQLQELLATPWTGKAWPLNLDETRFHLAVLSANKGRLVVREWLAVSLSRLKETLGRFLEGTRLVRPWGEAPQPVPVGALVQALGDGNPGLVRGLLRTAYLGTPPPHALSLAIHLLRNPKTLTPEEREGWGRLHALVAALKLWLFYGKEEAKRMAELDKERKNPAYLSGRLLAVLEEAQKRASSYTLRRTLVDRFYGAASTTPAATFGVLLRLSTTAHLPKVGQELNQAVEEILSRLDEAGGFPRTLNLVGQAEFALGFYHQRAHFRANRAGKKGESAQGGS

SEQ ID NO: 3538 - protein, 612 aa, Desulfovibrio vulgaris; identical to SEQ ID NO: 3029

SEQ ID NO: 3539 - protein, 592 aa, Mannheimia succiniciproducens
MILSSLARYYQRLAKETDSVGNPKVPSYGFSEEKIGWVLVINQDGQLVDVVPNLSDGKKPQPKLLNVPRPEKRTSGVKANFLWDKTAYVLGVESNKDKATAKEQPFVISQKTFEAFKQSHLELFKDSQDLGLQAVCHFLEKWQPEHFSQPPCLTEMLDANLVFKLDGCSGYIHQREAAQTLWADLLKDDNAEQGICLISGANAPIARLHPAIKGVFGGQSSGGSIISFNKESFASFGKEQGSNAPVSEVSAFAYTTTLNYLLRRENNHCLSIGDTSTVFWAEADNSANAEAAEGFFASVFSPPDDEQESQKVFNILEQIAKGRGIKEVSPDLAPDTRFYILGLAPNAARISIRFWLDTTFGQLAEHLAQHWQDLAIEPCPWKTFPSIWRLLLQTAVLSKTENISPVLAGEMTRAVITGSLYPMSLLSQLIARIRADGDINGLRIAMIKAVLQRRFRKGFIQEEIPMSLNTESTNPAYLLGRLFAVLERIQTQALGDLNAGIADRYYGSASSVPYSVFPRLLSGAKHHLSRLRKDKAGMAVNLDKDLAEVIGALPDVFPRHLSIDEQGCFAIGYYQQKQRYFTKKETTESTEN

SEQ ID NO: 3540 - protein, 614 aa, Xanthomonas oryzae; identical to SEQ ID NO: 2999

SEQ ID NO: 3541 - protein, 631 aa, Streptococcus pyogenes
MDFFTSLLKTYEKAELADLVDHQKRSNEPVLLPIYHTSLKSNGKNIISVKLDKDGQFHKAEFMADKQMIIFPVTADSVARSGSHPAPHPLVDKFAYYSAEMGQSQYDSFHKQLNNWIDYCEEGDVKRFLTIVQQFILKPEFLTLILDSLIGPDYQNNQLKVTFCDATGKEKLIDLSACFLEFSIDQFQGFKNESVSTFKTLHQSYISFVEANREKLGICNISGREEQLTDKHRGLMGNAKIISVSNKREAYKGRFREREDVFSVGYETSEKIHLMLKYLLENKNTSTWLGSSQYLINWFSDDLTNDSRLDIVSPIFDDGLEEDDDDDTPPVITLATEDNKRIGKSFIKGQKLFANDATYYVAILNKTSNGRIALKYFRQLQASQLLTNLNKWQETYSWESRSKFGKSRLRTPTFHDILNVSYGVDRDRFLELDNDNFKSDQIQKLVASLIDGKPMPQSIVKKLGNNVKERHRYRKHWYQVEQVCLAILHKQNGEEFSPMLDHTNQNRSYLFGRLLAIFELIETLRYGLDGNNNDRITNAERYWTAYTGQPTKLMMLLENKIKPYEEPLKLNRRGSWMKLEKEKEEILELLNPLLETETMEKPLDYRFIFGYYAEKNYYYTKQNTEVTESEE

SEQ ID NO: 3542 - protein, 631 aa, Streptococcus pyogenes; identical to SEQ ID NO: 3108

SEQ ID NO: 3543 - protein, 593 aa, Nitrobacter winogradskyi; identical to SEQ ID NO: 2974

SEQ ID NO: 3544 - protein, 581 aa, Pelodictyon luteolum; identical to SEQ ID NO: 2975

SEQ ID NO: 3545 - protein, 642 aa, Chlorobium chlorochromatii; identical to SEQ ID NO: 2976

SEQ ID NO: 3546 - protein, 607 aa, Rhodospirillum rubrum; identical to SEQ ID NO: 2979

SEQ ID NO: 3547 - protein, 560 aa, Moorella thermoacetica; identical to SEQ ID NO: 2978

SEQ ID NO: 3548 - protein, 592 aa, Hahella chejuensis
MILSALNEYYQRLAECDEVPQYGFSREKVSYVIVLNEEGDIKDVADIRRTSGKKATPVSIEVPSPPKRASNIEPCFLWDKTSYVLGVSAKGSDRMAREHEAFKSTHFRLLAGSEDPGLKAVNLFLKNWSPDQFCPPHFKEEMRDANFAFQLDGHKQYVHERTAARDLMSKVKKNDDATEGRCLVTGVYGPLARLHPAIKGVNGAQSSGASIVSFNLDAFTSYSKSQGENAPVSEQAAFAYTTVLNHLLRRDEQNRQRLQIGDASVVFWALSENVGAAMAAENAFALLLDPPTDDGQETAKLHSILEKIAQGRPLSDVNPDLDESTRFYVLGLAPNASRLSIRFWHTGTLGVFARRMAEHYQDLDIHPRPWKTEPAMWRLLKALAVLGKTENIPSKLAGEMTRAILNGSRYPRSLLTGALMRMRADGDVSGLRVALCKAVISREYRLNANRSQTEEVPVSLDTENSNPGYRLGRLFAVLEKIQRSALGEKLNATIRDRYFGAASSAPGSIFPLLLRNAQHHLSKIRKEKVGLAKALERDVSEIIDGLGSSFPRSLRLDDQGCFAIGYYHQSHSRLNQKDSGEIEASHNEGEIA

SEQ ID NO: 3549 - protein, 604 aa, Methylobacillus flagellatus; identical to SEQ ID NO: 2982

SEQ ID NO: 3550 - protein, 631 aa, Streptococcus pyogenes
MDFFTSLLKTYEKAELADLVDHQKRSNEPVLLPIYHTSLKSNGKNIISVKLDKDGQFHKAEFMADKQMIIFPVTADSVARSGSHPAPHPLVDKFAYYSAEMGQSQYDSFHKQLNNWIDYCEEGDVKRFLTIVQQFILKPEFLTLILDSLIAPDYQHNQLKVIYFDATGKEKLIDLSACFLEFSIDQFQGFKNESVSTFKALHQSYISFVEANRENLGICNISGREEQLTDKHRGLMGNAKIISVSNKREAYKGRFREREDVFSVGYETSEKIHLMIKYLLENKNTSTWLGSSQYLINWFSDDLTNDSRLDIVSPIFDDGLEEDDDDDTPPVITLATEDNKRIGKSFIKGQKLFANDATYYVAILNKTSNGRIALKYFRQLQASQLLTNLNKWQETYSWESRSKFGKSRLRTPTFHDILNVSYGVDRDRFLELDNDNFKSDQIQKLVASLIDGKPMPQSIVKKLGNNVKERHRYRKHWYQVEQVCLAILHKQNGEEFSPMLDHTNQNRSYLFGRLLAIFELIETLRYGLDGNNNDRITNAERYWTAYTGQPTKLMMLLENKIKPYEEPLKLNRRGSWMKLEKEKEEILELLNPLLETETMEKPLDYRFIFGYYAEKNYYYTKQNTEVTESEE

SEQ ID NO: 3551 - protein, 661 aa, Deinococcus geothermalis; identical to SEQ ID NO: 2983

SEQ ID NO: 3552 - protein, 582 aa, Myxococcus; identical to SEQ ID NO: 2984

SEQ ID NO: 3553 - protein, 566 aa, Nitrosomonas eutropha; identical to SEQ ID NO: 2985

SEQ ID NO: 3554 - protein, 647 aa, Magnetococcus marinus; identical to SEQ ID NO: 2987

SEQ ID NO: 3555 - protein, 288 aa, Bifidobacterium adolescentis
MVVVILDAATTGRLGVTFYCELQKDEYIKRILQWHVDAAWPLTFFKKSIVEGAERVNVVQYEGAPSFTDIINCACGTSDRSSKSYKRFAKDVKERLIECMFGGAQFPMSILNAACHKVTKPMGYDNIRVWRRDFEIACSLWKKHYIDETRKQHRQEDVITMYLEPNRDDRDYLYGRLLALADNFEESVLRKQGVKDRPTNAIKLMSNFTAKPYTTWGTLWKQLTPYLKSANGGSWFRNEVDDVMALFKEGDFEDNKALSPMFLLGYSCQRRASKRKAQEISQKNNSNN

SEQ ID NO: 3556 - protein, 343 aa, Bifidobacterium adolescentis
MSLFGNLLTTYEMIQGASGQTPHSAEKDGDADAAKRALIPYGHTTLPVSLTVLVDANGCIRGVAKRKSTIIIPCTEESMGRTIKPVPHPLFDQLQYVDSGRSPEKTSMYLQQLAKWKGDDAKLEAVFKCVSEHSISEAAAHYGVELTDKDDKAGVCFEVQIGLEDSDLSNDVDIRNRWIAYLQRSQHRLGKDVFGEDLYTPTTNFPKKVVSSDANAKLLSANDSTNFTFRGRFSSKEQALLVDSASSQKINSTLRWLVNNHGTLTGNQAIVVWAIKRPEEKPVLNPQSGSFDFDDFLSPIADESKALHDDISDALNATNVQYAKIFSRVLRGYEGAEDLEDAQ

SEQ ID NO: 3557 - protein, 574 aa, Chlorobium phaeobacteroides; identical to SEQ ID NO: 2988

SEQ ID NO: 3558 - protein, 599 aa, Desulfovibrio vulgaris; identical to SEQ ID NO: 2989

SEQ ID NO: 3559 - protein, 607 aa, Desulfotomaculum reducens; identical to SEQ ID NO: 2991

SEQ ID NO: 3560 - protein, 571 aa, Chlorobium phaeovibrioides; identical to SEQ ID NO: 2992

SEQ ID NO: 3561 - protein, 595 aa, Pseudomonas stutzeri; identical to SEQ ID NO: 3308

SEQ ID NO: 3562 - protein, 646 aa, Roseiflexus sp. RS-1; identical to SEQ ID NO: 2993

SEQ ID NO: 3563 - protein, 651 aa, Alkaliphilus metalliredigens; identical to SEQ ID NO: 2994

SEQ ID NO: 3564 - protein, 687 aa, Actinobacillus succinogenes; identical to SEQ ID NO: 2995

SEQ ID NO: 3565 - protein, 607 aa, Gluconacetobacter diazotrophicus
MTIQKRPGPLEALVDFYARMDDAEDPGWGREKFGWCVVIDAEGQPIDVLDQHDHDGRKPRPRLFLVPAAVKRASGIAPNFLWDKTSYVLGRTAGAGKRTAQEHEAFVAFNLKRMAETSDVGLVAFRRFLERWTPAQFDTPLFPAEMLDANIMFRLEGDRDYLHRRPAAQRLVEAALDNGHERQSFCLVTGQRAAPARLHPTIKGVEGAQTSGASLVSFNLDAFCSYDRKQGDNAPTSQAAAFRYGAALNRLLTRDGPNRLRRPIGDATVIFWADGSDAQVAKKADAWIQEAIAPNLLDADAARRIGEELTALAQGRPLSQLRPDIPPDTRFYVMGLSPNAARLSVRFWLSDSLDVFAHRLAEHYEDTRIAPSPWSRPPTVNLLLARTVAAQDKYDNIPPLLAGEIMRAILTGTPYPRTWLAAILMRLRAGDDPATGWHAAALRAVLQRRRRLTKNASDNGDVPVSLNRDYPSIGYQLGRLFAVYELAQRAALGIGVKATMRDKYFAAASAAPASIFPVIIRNSQNHLSNVRKRTPGWAGVIERELDEIFGRITPSGPHVLPRALSLEHQGEFAIGYYHQRRERIGGRMAETALQDDEQDIEDNATHD

SEQ ID NO: 3566 - protein, 600 aa, Methylobacterium sp. 4-46; identical to SEQ ID NO: 2996

SEQ ID NO: 3567 - protein, 595 aa, Leptothrix cholodnii; identical to SEQ ID NO: 2997

SEQ ID NO: 3568 - protein, 553 aa, Pelodictyon phaeoclathratiforme; identical to SEQ ID NO: 3001

SEQ ID NO: 3569 - protein, 627 aa, Streptococcus equi; identical to SEQ ID NO: 3002

SEQ ID NO: 3570 - protein, 607 aa, Gluconacetobacter diazotrophicus; identical to SEQ ID NO: 3003

SEQ ID NO: 3571 - protein, 631 aa, Streptococcus pyogenes
MDFLTSLLKTYEKAELADLVDHQKRNNEPVLLPIYHTSLKSNGKNIISVKLDKDGQFHKAEFMADKQMIIFPVTADSVARSGSHPAPHPLVDKFAYYSAEMGQSQYDSFHKQLNNWIDYCEEGDVKRFLTIVQQFILKPEFLTLILDSLIGPDYQHNQLKVTFCDATGKEKLIDLSACFLEFSIDQFQGFKNESVSTFKTLHQSYISFVEANREKLGICNISGREEQLTDKHRGLMGNAKIISVSNKREAYKGRFREREDVFSVGYETSEKIHLMLKYLLENKNTSTWLGSSQYLINWFSDDLTNDSRLDIVSPIFDDGLEEDDDDDTPPVITLATEDNKRIGKSFIKGQKLFANDATYYVAILNKTSNGRIALKYFRQLQASQLLTNLNKWQETYSWESRSKFGKSRLRTPTFHDILNVSYGVDRDRFLELDNDNFKSDQIQKLVASLIDGKPMPQSIVKKLGNNVKERHRYRKHWYQVEQVCLAILHKQNGEEFSPMLDHTNQNRSYLFGRLLAIFELIETLRYGLDGNNNDRITNAERYWTAYTGQPTKLMMLLENKIKPYEEPLKLNRRGSWMKLEKEKEEILELLNPLLETETMEKPLDYRFIFGYYAEKNYYYTKQNTEVTESEE

SEQ ID NO: 3572 - protein, 629 aa, Desulfovibrio vulgaris; identical to SEQ ID NO: 3004

SEQ ID NO: 3573 - protein, 627 aa, Streptococcus equi
MDFFTSLLRAYEHAEDIGLVDNQEQSGTILLPIYHTNRRSNGKDTIVVQLDKTGQFMKAEYLADGETIIFPVTAESVARSGKNPAPHPLVDKLTYFVSEHNQEQYESYHQQLEGWINACQDKQVMSYLSLIQQFILKEDFLDLICQSLFGKRLSRNGLKVTYALSEEKEKTVDLSACFLTFQIAQFIGFKTVSVTNFTALHKDYIAYLMSKQTANTICNISGQKEVLATKHRGLLGNAKLISVSNHAEAYKGRFRERDDVFRVGNQTSEKLHLMAKYFLEHEQTHVWLGSGQHMINWFSDDLANDSQLNITQALLLDPFDDEETFLSTPMISEENKSINRSFITGQRQFSDSASYYIAILNKTNDGRIALKYFRQLQASSLLKNLAVWQENYSWELQRKGNQFVQKLPSFKEIILAAYGVDRDRSLELDNDNFRSDQYQRLVTSLIDGKPLPDTIVKKLEANIKQRQKYRKHWHQVEHISLAILHKQNGEEFTPMLDRDNTNRSYLFGRLLGIYELIEKSRNNSKGRAKDELKRITNAERYWTAYANRPASLMRNLEDKIYPYSEYLKINEAGLWSKLEKEREEIIALLTSSLETTDFNKPLDYRFIFGYYAEKKYFYTPKDESEDA

SEQ ID NO: 3574 - protein, 598 aa, Azotobacter vinelandii; identical to SEQ ID NO: 3008

SEQ ID NO: 3575 - protein, 578 aa, Lachnospiraceae; identical to SEQ ID NO: 3111

SEQ ID NO: 3576 - protein, 596 aa, Aggregatibacter aphrophilus; identical to SEQ ID NO: 3010

SEQ ID NO: 3577 - protein, 583 aa, Zymomonas mobilis; identical to SEQ ID NO: 3013

SEQ ID NO: 3578 - protein, 578 aa, Halothiobacillus neapolitanus; identical to SEQ ID NO: 3014

SEQ ID NO: 3579 - protein, 615 aa, Xanthomonas albilineans
MILSALADFYQRLLDDPESGIAAPGYSQQNIGYTVVLAADGRVVDVNDEHSTEGKKRLAMAMSVPQPEKRTAGIKSNFLWDKTSYTLGISASSKRSEQEHAAFIALHQQALAGSDDPGLRALLAFLQTWTPAQYTDHPQFVSHGEALLDANIVFKLQGDSGYLHQRTAARAAWDRQQGHGTDSPEGICLVSGRHAPLARLHPAIKGVNGAQSSGASIVSFNLEAFTSYGKSQGENAPVSEQAAFAYTTALNHLLRRDPHNRQRVQIGDTTVVFWAQAKTAEHAQNAEDVFADFMRVDEADDPSIADGQVTRRLELALEQVRQALPLRELDDTLDDDARIFVLGLAPNASRLSIRFWETQTLRQFVKRQADHYDDLTLVPAAWKRPPTPAFLALQTAPVYGEHGKPKAEDVSPLLAGELTRSILAGTRYPGSLLGAIVMRFRADGQLTPLRIALCRAVLARQARLNTQQGLPTDQKEPPMSLDTSNTDPGYLLGRLFFLFYNAQEKALGAVSSNIKDKYYGSASTTPRLVFPSLIKNFQNHISKLRKMGEGEKRIAGAIERDVEEIISHLKGPYPRSLKIESQGFFSIGYYHQSKARFVRKDGQDAHDTTSEGENV

SEQ ID NO: 3580 - protein, 591 aa, Acidaminococcus fermentans; identical to SEQ ID NO: 3016

SEQ ID NO: 3581 - protein, 618 aa, Meiothermus ruber; identical to SEQ ID NO: 3017

SEQ ID NO: 3582 - protein, 582 aa, Nitrosococcus halophilus; identical to SEQ ID NO: 3019

SEQ ID NO: 3583 - protein, 579 aa, Rhodobacter capsulatus; identical to SEQ ID NO: 3020

SEQ ID NO: 3584 - protein, 602 aa, Thermincola potens; identical to SEQ ID NO: 3021

SEQ ID NO: 3585 - protein, 621 aa, Meiothermus silvanus; identical to SEQ ID NO: 3022

SEQ ID NO: 3586 - protein, 607 aa, Syntrophothermus lipocalidus; identical to SEQ ID NO: 3023

SEQ ID NO: 3587 - protein, 620 aa, Truepera radiovictrix; identical to SEQ ID NO: 3024

SEQ ID NO: 3588 - protein, 590 aa, Sediminispirochaeta smaragdinae; identical to SEQ ID NO: 3025

SEQ ID NO: 3589 - protein, 598 aa, Desulfarculus baarsii; identical to SEQ ID NO: 3026

SEQ ID NO: 3590 - protein, 603 aa, Parvularcula bermudensis
MSILQALNSYYGRNPEIAKPGWSEEKFGWCIILKQDGTVFDIEPLHDASGKKPRLRTYTVPAAVKRTVGISPNFLWDKTAYVLGRTAGNGKRTADEHAAFVALHLEVLEDQKDEGLSALRRFLESWKPERFDAAPFKEEMLDANVMFRLEGERQFLHERDAAAALIEARVRTHDDAEGVFCLISGQIDHPARLHPTIKGVDGAQSSGAALVSFNLDAFTSLGKEQGDNAPTGEAAAFRYGAALNALLVRDGGNRLRRTIGDATVVFWADVSDVPGADDGAAAAADNWFADVAEPPTDESETARIRDDLKKIASGVSLSTLRPEIVEGTKFHVLGLSPNAARLSVRFWLTGDFGEFAAALVQHHKDLQIKPEPLGWTGPPSLSILLVRTTAAQGDFKNIPPNLAGEVMRAMLTGGPYPRTLLSAAIMRLRAGDSAATGWHAAVIRAVLNRQRRITSAQGEISMGLDRSHDNIGYQLGRLFAVYEMSQRAALGKVNATIRDRYFGAASATPASVFPLIVRGGQNHLSKVRKEKPGWATLIERELEEINSHFTPKPGGIWPRSLRLADQGEFAIGYYHQRATKLSNDTGEAIASDLADAAIEGTDA

SEQ ID NO: 3591 - protein, 589 aa, Ketogulonicigenium vulgare; identical to SEQ ID NO: 3027

SEQ ID NO: 3592 - protein, 589 aa, Rhodomicrobium vannielii; identical to SEQ ID NO: 3028

SEQ ID NO: 3593 - protein, 592 aa, Neisseria lactamica
MILASLARYYRRLAEETDEMGNPKVPPYGFSEEKIGWILVLDKEGRLKTVVPNLTADKKPQPKLMSVPRPEKRTSGIKPNFLWDKTAYALGVEANKNKAEAKEKPFTPSEKTFDAFKQYHLDLLQNSEDEGLQALCRFLQNWQPAHFAAENLSTEMLDANIAFSLEKPTALIHKREAAQTLWAGCLKSDEALEGLCLISGDTAPIARLHPAIKGVFGGQSSGGSIISFNKEAFASFGKEQGANAPVSEQSAFAYTTALNYLLRRENNHCLTIGDASTVFWAEADDNATAQAAEGFFAHIFTPPDGEQESTKVFNVLEQIANGRPLQDIAPELSPNTRFYILGLAPNAARISVRFWLDTTFGQLAENLAQHWQDLALEPCAWKTPPSIWRLLLQTAVLGKSENIPPVLAGEMTRAVICGTPYPLSLLSQLITRIRADGDVNGLRVAMMKAVLQRRFRKGFIKEGVPMSLNNESPNRAYLLGRLFAVLERIQYQALGELNAGIADRYYGSASAVPFSVFPRLLSGAKHHLSRLRKDKAGMAVNLDKDLGEIIAKLPETFPRHLSIDEQGRFVIGYYHQKQSYFAKKETAETIEN

SEQ ID NO: 3594 - protein, 655 aa, Ethanoligenens harbinense; identical to SEQ ID NO: 3031

SEQ ID NO: 3595 - protein, 613 aa, Ruminococcus albus; identical to SEQ ID NO: 3030

SEQ ID NO: 3596 - protein, 586 aa, Rhodopseudomonas palustris; identical to SEQ ID NO: 3032

SEQ ID NO: 3597 - protein, 562 aa, Bacteroides helcogenes; identical to SEQ ID NO: 3033

SEQ ID NO: 3598 - protein, 629 aa, Anaerolinea thermophila
MILQALYRYYEILRNDPETDIAEPGYSNAPVSHALNLSLQGELLDIVPLFVPVQKGKKTVESPRRMNVPAQVKRTVNISANFLWDTSAYVLGIADQEKGDDYALKRFEEFRRVNLEILSQVNNPIAQAIVSFLQKYSPLKALEHPVIFRHLEDLKKSSNLIFWVEGKNSLEDPQIKRAWEDYFSGKSDIEMQCLVTGEKEPIARLHPDIKGVRGAQTKGASLVSFNLDAFTSYGKDQGENSPVSRRAASGYAVALNYLLSDQNPHRKIYLGDTAVVYWAESPNKRYGSAFYSLLNPEFIEENSEIEGEPDKEKFHRDKTTEIEMGKLIAKVEQAKPLDVNALKEKLDSTTRFYILGLAPNAARLSVRFFLTEPFGVFTERIMQHYKDLEIVKEYENQPTYISPYRILAECVSPKLNRRDEEIQNAWSLLGGAFLRAILLGTPYPEGLYTAILNRIRHDTDETNENGIRRNIKINYIRAAYIKAHLLRKYRRQAQNPYQEALQMSLNESYKHPAYVLGRLFAWLERAQREALGQNINATIKDRYFTSACASPASVFPILLRLSHHWTEKAEYGKNLDRHIQSLLDMLEAQPFPARFNLEEQGVFVLGYYHQRAAFYAKNNQITDETSQEE

SEQ ID NO: 3599 - protein, 613 aa, Acidovorax avenae; identical to SEQ ID NO: 3035

SEQ ID NO: 3600 - protein, 654 aa, Syntrophobotulus glycolicus; identical to SEQ ID NO: 3036

SEQ ID NO: 3601 - protein, 588 aa, Rubinisphaera brasiliensis; identical to SEQ ID NO: 3037

SEQ ID NO: 3602 - protein, 608 aa, Nitrosomonas sp. AL212; identical to SEQ ID NO: 3039

SEQ ID NO: 3603 - protein, 603 aa, Marinithermus hydrothermalis; identical to SEQ ID NO: 3040

SEQ ID NO: 3604 - protein, 614 aa, Treponema brennaborense; identical to SEQ ID NO: 3043

SEQ ID NO: 3605 - protein, 615 aa, Porphyromonas asaccharolytica; identical to SEQ ID NO: 3042

SEQ ID NO: 3606 - protein, 592 aa, Desulfotomaculum nigrificans; identical to SEQ ID NO: 3045

SEQ ID NO: 3607 - protein, 607 aa, Methylomonas methanica; identical to SEQ ID NO: 3046

SEQ ID NO: 3608 - protein, 709 aa, Desulfotomaculum ruminis; identical to SEQ ID NO: 3048

SEQ ID NO: 3609 - protein, 384 aa, Bacillus coagulans; identical to SEQ ID NO: 3049

SEQ ID NO: 3610 - protein, 604 aa, Ramlibacter tataouinensis
MILQALHGYYQRLLERGEPGLSPFGYSPEKISYAILLAPDGRLVDVSSIRDHSGKKPVPRLLNVPQPEKRTVGIKPNFLWDKTSYVLGVSATSKRADKEHEAFKALHLQILAGTDDPALKALLAFLSIWNPERFKAPPFNEEMRDANLVFRLDGEAMYLHERPAAQLARARLLAGAGNEGSATGECLVTGEHLPLARLHPPIKGVNGAQSSGASIVSFNLESFGSYGKSQGENAPISEQAAFAYTTVLNHLLRRGEHNRQRIQVGDATVVFWAEAADADEAATAESLLGDMLNAPPDDSQEAGRVREALEKASKGRPLRDIDPKLHDETRMYVLGLAPNASRISIRFWQTGTLGDLAQRLAQHEADMRIEPVPWKTAPAARRLVLATVPNREGAMPKMDDAFNNLAGELMRAILSGGLYPQSLLANTLMRIRSDGNLSGMRAALCKGILARQRRLGINTNDEEVPVSLDKQSLNPAYRLGRLFAVLENVQRSALGNQVNATIRDRYYGAASATPASVFPMLLRNTQNHLGKLRKDKVGWAVTLERDIREIVEGLGERFPRSLRIEDQGRFAIGYYHQSQARFNKGDDANDSTPETDVADQGALA

SEQ ID NO: 3611 - protein, 630 aa, Streptococcus parasanguinis; identical to SEQ ID NO: 3050

SEQ ID NO: 3612 - protein, 579 aa, Myxococcus fulvus; identical to SEQ ID NO: 3052

SEQ ID NO: 3613 - protein, 583 aa, Zymomonas mobilis; identical to SEQ ID NO: 3051

SEQ ID NO: 3614 - protein, 626 aa, Treponema caldarium; identical to SEQ ID NO: 3053

SEQ ID NO: 3615 - protein, 611 aa, Candidatus Arthromitus sp. SFB-mouse; identical to SEQ ID NO: 3102

SEQ ID NO: 3616 - protein, 601 aa, Sphingobium sp. SYK-6; identical to SEQ ID NO: 3103

SEQ ID NO: 3617 - protein, 583 aa, Roseburia hominis; identical to SEQ ID NO: 3055

SEQ ID NO: 3618 - protein, 612 aa, Candidatus Arthromitus sp. SFB-rat-Yit; identical to SEQ ID NO: 3105

SEQ ID NO: 3619 - protein, 329 aa, Bacillus coagulans; identical to SEQ ID NO: 3057

SEQ ID NO: 3620 - protein, 611 aa, Pseudoxanthomonas spadix; identical to SEQ ID NO: 3058

SEQ ID NO: 3621 - protein, 709 aa, Desulfosporosinus orientis; identical to SEQ ID NO: 3059

SEQ ID NO: 3622 - protein, 585 aa, Sphaerochaeta pleomorpha; identical to SEQ ID NO: 3060

SEQ ID NO: 3623 - protein, 645 aa, Clostridium sp. BNL1100; identical to SEQ ID NO: 3061

SEQ ID NO: 3624 - protein, 571 aa, Desulfovibrio desulfuricans; identical to SEQ ID NO: 3198

SEQ ID NO: 3625 - protein, 585 aa, Thermus thermophilus; identical to SEQ ID NO: 3047

SEQ ID NO: 3626 - protein, 631 aa, Streptococcus dysgalactiae
MDFFTSLLKTYEKAELADLVDHQKRNNEPVLLPLYHTSLKSNGKNIISVKLDKDGQFHKAEFMADKQMIIFPVTADSVARSGSHPAPHPLVDKFAYYSAEMGQTQYDSFHKQLNNWIDYCEEGDVKRFLTIVQQFILKPEFLTLILDSLIGPDYQHNQLKVTFCDATGKEKLIDLSACFLEFSIDQFQGFKNESVSTFKALHQSYISFVEANRENLGICNISGREEQLTDKHRGLMGNAKIISVSNKREAYKGRFREREDVFSVGYETSEKIHLMIKYLLENKNTSTWLGSSQYLINWFSDDLTNDSRLDIVSPIFDDGLEEEDDDDTPPVIALATEDNKRIGKSFIKGQKLFANDATYYVAILNKTSNGRIALKYFRQLQASQLLTNLDKWQETYSWESRSKFGKSRLRTPTFHDILNVSYGVDRDRFLELDNDNFKSDQIQKLVASLIDGKPMPQSIVKKLGNNVKERHRYRKHWYQVEQVCLAILHKQNGEEFSPMLDHTNQNRSYLFGRLLAIFELIETLRYGLDGNNNDRITNAERYWTAYTGQPTKLMMLLENKIKPYEEPLKLNRRGSWMKLEKEKEEILELLNPLLETETMEKPLDYRFIFGYYAEKNYYYTKQNTEVTESEE

SEQ ID NO: 3627 - protein, 631 aa, Streptococcus mutans; identical to SEQ ID NO: 3106

SEQ ID NO: 3628 - protein, 677 aa, Aggregatibacter actinomycetemcomitans; identical to SEQ ID NO: 3062

SEQ ID NO: 3629 - protein, 591 aa, Aggregatibacter actinomycetemcomitans; identical to SEQ ID NO: 3063

SEQ ID NO: 3630 - protein, 635 aa, Tistrella mobilis; identical to SEQ ID NO: 3064

SEQ ID NO: 3631 - protein, 699 aa, Desulfosporosinus acidiphilus; identical to SEQ ID NO: 3066

SEQ ID NO: 3632 - protein, 570 aa, Pseudanabaena sp. PCC 7367; identical to SEQ ID NO: 3068

SEQ ID NO: 3633 - protein, 588 aa, Myxococcus stipitatus; identical to SEQ ID NO: 3074

SEQ ID NO: 3634 - protein, 654 aa, Desulfocapsa sulfexigens; identical to SEQ ID NO: 3075

SEQ ID NO: 3635 - protein, 652 aa, Dehalococcoides mccartyi; identical to SEQ ID NO: 3076

SEQ ID NO: 3636 - protein, 665 aa, Candidatus Endomicrobium trichonymphae; identical to SEQ ID NO: 3100

SEQ ID NO: 3637 - protein, 660 aa, Bibersteinia trehalosi; identical to SEQ ID NO: 3077

SEQ ID NO: 3638 - protein, 648 aa, Bifidobacterium thermophilum; identical to SEQ ID NO: 3078

SEQ ID NO: 3639 - protein, 594 aa, Mannheimia haemolytica; identical to SEQ ID NO: 3080

SEQ ID NO: 3640 - protein, 578 aa, Eubacterium rectale; identical to SEQ ID NO: 3110

SEQ ID NO: 3641 - protein, 613 aa, Ruminococcus champanellensis; identical to SEQ ID NO: 3113

SEQ ID NO: 3642 - protein, 587 aa, Faecalibacterium prausnitzii; identical to SEQ ID NO: 3112

SEQ ID NO: 3643 - protein, 595 aa, Eubacterium siraeum; identical to SEQ ID NO: 3114

SEQ ID NO: 3644 - protein, 524 aa, Clostridium saccharolyticum; identical to SEQ ID NO: 3109

SEQ ID NO: 3645 - protein, 580 aa, Desulfobulbus propionicus; identical to SEQ ID NO: 3034

SEQ ID NO: 3646 - protein, 642 aa, Desulfofarcimen acetoxidans; identical to SEQ ID NO: 3012

SEQ ID NO: 3647 - protein, 677 aa, Teredinibacter turnerae; identical to SEQ ID NO: 3009

SEQ ID NO: 3648 - protein, 569 aa, Desulfovibrio magneticus
MILTSLAVYYDRLSQEPEPAVPLSGFSRQKIHFALHIDADGKLAEPPVFDLRQTEGKKTAPQELVVPEAVKRSVGVAANFLWDNTGYVLGADDKGKPERTAKTFEAFKARCHEIGDGLDDAGMAAVLSFLDAWNPADAPDLPGWEEMVKGCNLVFRLAGGGLGYVHERPAVRQAWLDHLAGASRERRGMCLVTGQDAPIARLHPSIKGVRDAQSSGAALVSYNQESFTSYGKEQSYNAPVGEPAVFAYTTALNHLLRKGSRQRVQIGDATTVFWTERASEVEGLLGFLFDPTADDGTEDAVRRFLEAVRDGKKPRDDPEELQSGFFILGLAPNAARLSVRFWHVDTVAGVCAAVGRHFADLAMDRAFDNEPEFPGLWQLLREIAAQGELKNVNPALAGALMRSILTDAPYPASLPRAVITRIRADQTVNYPRAAMLKAYLVRNRQKEVSVSLDPNCTDVGYRLGRLFAVLEKAQQEAIPGANTTIRDRYYGSASATPAAVFPQLMRLAQHHIEKAEYGGVSDRRIEEILETVQTFPKHLSLDEQGMFAIGYYHQRRENYKKTAKTKGED

SEQ ID NO: 3649 - protein, 618 aa, Acidobacterium capsulatum; identical to SEQ ID NO: 3007

SEQ ID NO: 3650 - protein, 616 aa, Rhodobacter sphaeroides; identical to SEQ ID NO: 3005

SEQ ID NO: 3651 - protein, 632 aa, Streptococcus agalactiae; identical to SEQ ID NO: 3122

SEQ ID NO: 3652 - protein, 241 aa, Exiguobacterium sp. S17; identical to SEQ ID NO: 3307

SEQ ID NO: 3653 - protein, 596 aa, Neisseria sicca
MILHALTQYYQRKAKSDGGVAPEGFENKEIPFIIVIDKQGKFIQLEDTRELKGKKKVGRIFLVPHSVKRSSTKVVSNTLWDNYGYVLGYVADKNPEFVQNQHKSFIDKVNEFKKELPNDMGIAAVAEFLASAEEKSKVMQAANWAECAKVKGCNLSFRLVDETVDLVCQSKVVREYVSQANQTQSNNVQKGICLVTGKPASIALLHNDIKGIEKFENGSYKQAKPAPLISANLDSFKSYGKGKNKDNGLMYPIGEQAMFEYTTALNTLLASENRFRIGDVTAICWSAKPTPLEEYLASLISGGGKDNPDAHIDAVKSLYKSLYNGKYTEPDGKEKFYLLGLSPNSARIVVRFWHETTVAALSESIAAWYDDLQMVRGENSPYPEYMPLPRLLGNLVLDGKMENLPSDLIAQITDAALNNRVLPVSLLQAALRRNKAEQKITYGRASLLKAYINRAIRAGRLKNMKELTMSLDRNRQDIGYVLGRLFAVLEKTQAEANPSLNATIADRYFGSASSTPIAVFGTLMRLLPHHLNKLEFEGRAVQLQWEIRQILEHCQRFPNHLNLEQQGLFAIGYYHETQFLFTKDALKNLFNEAKTA

SEQ ID NO: 3654 - protein, 614 aa, Xanthomonas vasicola
MILSALADYYHRLLDDPTSGIAAPGYSQEKIGYAIVLDGGGRVVAVEDEHDYEGKKRIPKSVSVPASFKRPGIGTNPFFLWDKTSYALGVSASSKRSAQEHAAFKTLHQQALGGSEDPGLRALLTFLDTWSPAQFADHPQFSRYGEALLDTNLVFRLEGDTGYLHQRAAARAAWERLQGQSADGVSGICLISGHFAPLARLHPPVKGVNGAQSSGASIVSFNLDAFTSYGKNQGENAPISEQATFAYTTALNHLLRRDPRNRQRLQIGDSTVVFWAQARTTAHAEEAEDLIADFLRGGKTEGPGIADGQATQRLHLALEQVRQARPLREMDDALDDEARIFVLGLAPNASRLSIRFWETQTLAGFAARLAAHYQDLTLEPPAWKRPPTPQFLALQTAPVYGEHSKPKAEDVSPLLAGEVTRAILAGTRYPRSLLGGIVMRFRADGQVNPLRVALCRAVLAREARLNTQQGLSSTKGEPPVSLDTANTDPGYLLGRLFSSLENLQRTALGGQVNATIRDRYYGAASATPASIFPVLLRNAQNHFGKLRKDKAGLAVNLEKEVGQIIDALPASFPRSLPIHEQGRFAIGYYHQTQARFARNNGQDAPDTASEGEPA

SEQ ID NO: 3655 - protein, 614 aa, Xanthomonas vasicola
MILSALADYYHRLLDDPTSGIAAPGYSQEKIGYAIVLDGGGRVVAVEDEHDYEGKKRIPKSVSVPASFKRPGIGTNPFFLWDKTSYALGVSASSKRSAQEHAAFKTLHQQALGGSEDPGLRALLTFLDTWSPAQFADHPQFSRYGEALLDTNLVFRLEGDTGYLHQRATARAAWERLQGQSADGVSGICLISGHFAPLARLHPPVKGVNGAQSSGASIVSFNLDAFTSYGKNQGENAPISEQATFAYTTALNHLLRRDPRNRQRLQIGDSTVVFWAQARTTAHAEEAEDLIADFLRGGKTEGPGIADGQATQRLHLALEQVRQARPLREMDDALDDEARIFVLGLAPNASRLSIRFWETQTLAGFAARLAAHYQDLTLEPPAWKRPPTPQFLALQTAPVYGEHSKPKAEDVSPLLAGEVTRAILAGTRYPRSLLGGIVMRFRADGQVNPLRVALCRAVLAREARLNTQQGLSSTKGEPPVSLDTANTDPGYLLGRLFSSLENLQRTALGGQVNATIRDRYYGAASATPASIFTVLLRNAQNHFGKLRKDKAGLAVNLEKEVGKIIDALPASFPRSLPIHEQGRFAIGYYHQTQARFARNNGQDAPDTASEGEPA

SEQ ID NO: 3656 - protein, 614 aa, Xanthomonas vasicola
MILSALADYYHRLLDDPTSGIAAPGYSQEKIGYAIVLDGGGRVVAVEDEHDYEGKKRIPKSVSVPASFKRPGIGTNPFFLWDKTSYALGVSASSKRSAQEHAAFKTLHQQALGGSEDPGLRALLTFLDTWSPAQFADHPQFSRYGEALLDTNLVFRLEGDTGYLHQRATARAAWERLQGQSADGVSGICLISGHFAPLARLHPPVKGVNGAQSSGASIVSFNLDAFTSYGKNQGENAPISEQATFAYTTALNHLLRRDPRNRQRLQIGDSTVVFWAQARTTAHAEEAEDLIADFLRGGKTEGPGIADGQATQRLHLALEQVRQARPLREMDDALDDEARIFVLGLAPNASRLSIRFWETQTLAGFAARLAAHYQDLTLEPPAWKRPPTPQFLALQTAPVYGEHSKPKAEDVSPLLAGEVTRAILAGTRYPRSLLGGIVMRFRADGQVNPLRVALCRAVLAREARLNTQQGLSSTKGEPPVSLDTANTDPGYLLGRLFSSLENLQRTALGGQVNATIRDRYYGAASATPASIFPVLLRNAQNHFGKLRKDKAGLAVNLEKEVGKIIDALPASFPRSLPIHEQGRFAIGYYHQTQARFARNNGQDAPDTASEGEPA

SEQ ID NO: 3657 - protein, 614 aa, Xanthomonas vasicola
MILSALADYYHRLLDDPTSGIAAPGYSQEKIGYAIVLDGGGRVVAVEDEHDYEGKKRIPKSVSVPASFKRPGIGTNPFFLWDKTSYALGVSASSKRSAQEHAAFKTLHQQALGGSEDPGLRALLTFLDTWSPAQFADHPQFSRYGEALLDTNLVFRLAGDTGYLHQRAAARAAWERLQGQSADGVSGICLISGHFAPLARLHPPVKGVNGAQSSGASIVSFNLDAFTSYGKNQGENAPISEQATFAYTTALNHLLRRDPRNRQRLQIGDSTVVFWAQARTTAHAEEAEDLIADFLRGGKTEGPGIADGQATQRLHLALEQVRQARPLREMDDALDDEARIFVLGLAPNASRLSIRFWETQTLAGFAARLAAHYQDLTLEPPAWKRPPTPQFLALQTAPVYGEHSKPKAEDVSPLLAGEVTRAILAGTRYPRSLLGGIVMRFRADGQVNPLRVALCRAVLAREARLNTQQGLSSTKGEPPVSLDTANTDPGYLLGRLFSSLENLQRTALGGQVNATIRDRYYGAASATPASIFPVLLRNAQNHFGKLRKDKAGLAVNLEKEVGKIIDALPASFPRSLPIHEQGRFAIGYYHQTQARFARNNGQDAPDTASEGEPA

SEQ ID NO: 3658 - protein, 567 aa, Methylococcus capsulatus
MILQALYEYYGRKPELPALGFEEKEIPFLIVVDEQGRFVQLEDTREGEGKKKVPKRFFVPQAVKRTAGIAANVLWDNSSYVLGMDAKGKPERLKEQTRAFEQAIRDLGLEDDAGVSAVLAFLDSKEEKAKALEAASSWPEILEKGANLAFRLQSRSELVCQHEMVRTALTRRLTEANADPAVCLVSGEEDAPERLHPPIKGVWGGQPTGANIVSFNLDAFNSWGKSQGDNAPVGKRAAFAYTTALNHLLAKDSKQRLQVGDASTVFWAAQANPLEDLLADLFSEPPKDDPDRNTRAVESLYKAPHTGASVFDDDGTQFYVLGLAPNAARIAVRYWHVATVRELARHIKQHFRDLEIIHAPSEKPYLSLFRLLVCTATQGKSENIPPNLAGEFMKSILAGIPYPQSLLQAAIRRIRADRDITYPRAALVKACLNRQTRYSNPDNVKELTVALDDTQTNIGYRLGRLFAVLEKIQEEANPGINATIRDRYYGAASSTPVAVFQTLMRLKNHHLAKLENRGRAVNLERLIGEIVDGIDAFPPILSLADQGHFTIGYYHQRQALFTKTDRS

SEQ ID NO: 3659 - protein, 320 aa, Bacillus coagulans
MKECCEATRNELVQKIVQILERQNDPETTSMFTFLSDPDPVAVRRILSSPFKRAENHGSLDRICILALSANKARMVVRDYEEPPVWKVKNQIRQFFDAQQIVGAPKPASIYSLAACMYHDGRKEMQKEDVQDWMNWAIYGKRLSGRIIAKMVKRIQARGGMAWIHAAAIKSWLISQKKEEWTVDLDQARVTPAYLCGRLFAVLEAVPYEAVKGNETIASRFYAAASSTPRTIFGLLMRNSKWHLSKISKENKGYEVRYQQRIQLITGQLKEFPAVLDLQGQAEFALGYYHERQDIYKKKENMPADAANVSDLNKTVVEGE

SEQ ID NO: 3660 - protein, 631 aa, Streptococcus agalactiae; identical to SEQ ID NO: 3338

SEQ ID NO: 3661 - protein, 613 aa, Xanthomonas sp. SHU 199
MILSALADYYQRLLDDPDSGIAAPGYSQQNIGYTVVLAADGSVVSVQDEHRNEGKKRLAKAMRVPQPEKRTAGIKSNFLWDKTSYVLGVSASSKRSAQEHAAFKALHQPALADSDDAGLQALLAFLATWSPEQYADHPAFAPHGEALLDTNLAFRLEGDPGYLHERAAARTAWDRQQGQVGDGIRGLCLVSGTLAPLARLHPAIKGVNGAQSSGASIVSFNLDAFTSYGKQQGENAPISEQAAFAYTTALNHLLRRDPHNRQRVQIGDTTVVFWAQARTTTQAQNAEDVVGALMRGDDTEDPSIADGRATRRLELVMKQVRQARPLRDLEDGLDDDARIFVLGLAPNASRLSIRFWETQTLAGFAKRLADHYDDLSLLPPAWKRAPTPAYLALQTAPIYGEHGKPKAEDVSPLLAGELTRAILAGTRYPQSLLGSIVMRFRADGQLSPLRIALCRAVLAREARLSRQQGLSTDHKEPPMSLDTGNTDPGYLLGRLFASLENLQRAALGDRINATIRDRYYGAASATPASIFPVLLRSAQNHFGKLRKEKTGLAVNLEKEIGQIVDALPPSFPRSLPIQEQGRFAIGYYHQTQARFARNDGQDAPDTASEGETA

SEQ ID NO: 3662 - protein, 653 aa, Desulfitobacterium hafniense
MGWIDKLYETYENCRTEVGVTGADEETIPLLPIAHSTQNAQIEVVLDGGGNFRSARALDKGETVTIIPVTEDSATRSSGIAPHPLCDKLQYVAGDYKDYVQKKNSREFYKRYMEQLGDWSGSPYSHPKIRAVFDYLKKGTLIEDLVRQKILVCDDKDALAKGVKMGVGDQSDAFVRFRVEKEGEEESAVWLDHQVYESYINYYLSRQEEIDLCYVQGKAVPCSDKHPAKIRNTGDKSKLISANDSVGFTYRGRFNDKSQVVRVGYETTQKAHNALRWLIDRQGYKNGGDQVIVAWGTKERSLPPFLEDTEDFFMDDADNLFPEEAPPVTTEREFAHRLNKAIAGYGSDLDIGSKIVIMGLDAATVGRLAITYYREMDVWDFLNRIKAWHSSCIWKHSYKKIPDGFNEKGKPKFKYLTFIGAPAPKEITWATYGDKASDKLKKATVERLLPCILDGARMPYDLVGSAVNRLSNPLGMENWEWEKVLTITCALIRKYRYDQSGHKEVWEMSLDENQRDRSYLFGRLLAIAQQIEKDAQYWSGEKRTTNAERLMHQFKLHPYKTWGIITDKLSPYLERLGPKVKELSELMTKVNAMLPFEDFTSPKKLEDSYILGYYCQREVFIERIKQLKEEKEKKKLAAAAKSTEGENEHEQFS

SEQ ID NO: 3663 - protein, 632 aa, Streptococcus didelphis
MDFFTSLLKTYEKAELSDLVDHQKRDNESVLLPIYHTSLKSNGKNIISVKFDKAGQFHKAEFMADKQVIIFPVTADSVARSGSNPAPHPLVDKFSYYSAEMGQSQYDNFHKQLNNWIDYCEEGDVKRFLTLVQQFIVKPEFLTLILDSLIGSDYHNNQLKITFCDATGKEKLIDLSACFLEFSIDQFQGFKNESVSTFKALHQSYISFVEANRENLGICNISGREEQLTDKHRGLMGNAKIISVSNKREAYKGRFREREDVFSVGYETSEKIHLMIKYLLENKNTSTWLGSSQYLINWFSDDLTNDSRLDIVSPVFDDGLEEDDDDIPPIIALATEENKRIGKSFIKGRKLFANDATYYVAILNKTSNGRIALKYFRQLQASQLLINLDKWQENYSWESRFKSEKSRLRTPTFHDILNVSYGVDRNRFLELDNDNFKSDQVQKLVTSLIDGKPMPQSIVKKLSNNVKERHRYRKHWYQVEQVCLAILHKQNGEEFSPMLDHNNQNRSYLFGRLLAIFELIETLRYGLEGKDSDRITNAERYWTAYTGQPTKLMMLLENKIKPYEETLKLNRRGSWKKLEKEKEEILELLNPLLETETMEKPLDYRFIFGYYAEKKYYYYTKQNTEVTESEEE

SEQ ID NO: 3664 - protein, 623 aa, Calidithermus timidus
MLSQLVEYARQKGLGAEPGFTQKEIRWLVGVSSQGAFTELIPLNQAKPAPDLSQPEMIGMPNALRAMGYTAEQAAHFLADTCAVVFGLPERDKEGRVKNPEDHQKNLQKGETFRLLIGLAAKEVPLLLPIAQALSDPAQMAQMVQKLEAQTQKKGSDKLKPTDKISFFIQGQCVLDYPDWHGWWRGFRAQAFPAQKSTGGMRSFASGELVSPASTHPKVTKLGGSAFGHALVTYDKDAFESYGLSQGENAAVEELAATAYRAGLDALLEKAQILGEMKVVVWYDRAIPQEDDFFRDLFAPSSSEAEEAQALERARKVLQALKTGEAPPSLQGARFFAAALSPASGRVMVRDWQTGSLEDFITAVKTWFEHLAIVRRSGDRAASLPGLNRLFLSLQRPKSPEQKLDDYLKPIKTLQVPLWRAALNPSLPIPYGALARIMESHIAEVMKGDFTKALSAKESDAAALGRIYARMGLLKAYHIRKGGTIGMALDPNHPSPAYHCGRLMCLLAQIQEASAESEINAGVVQRYYGAASSTPAMVLGRLTRLSQHHLSKLAKDSPGLAYWFNTQLAEVWKVLGPTLPRTLSLEEQSLFALGYYQQLAASRVKKDDKPSGPETAQDPLFQG

SEQ ID NO: 3665 - protein, 589 aa, Actinobacillus capsulatus
MILSALTRYYYRLAAQEDRLTGEAKVPSYGFSEEKIGWVLELDSKGNLVNVIPNLTADKKPKAKLMSVPRPEKRTSGIKPNFLWDKTAYVLGVESNQDKATAKDQSIKFAEKTFEAFKQYHLDLLADSNDEGLMAISNFLQQWQATHFAESICPAEMLDANVVFKLVGTSGYIHQREAAQTLWASLLVNEDSEQGLCLISGEIAPIARLHPAIKGVYGGQSAGGSIISFNKESFTSFGKEQGSNAPVSEQAAFAYTTALNYLLRTEKHRLTIGDASTVFWAEADNTTQAEAAEGFFAALMTPPDDDQENQKIFDELQKISKGRPLAEISPELSENTRFYVLGLAPNAARISVRFWLDTTFGRLAKNLSEHWQDLALEPCAWKTPPSIWRLLLQTASLGKSENISPVLAGEMARAVISGHLYPMSLLSQLVTRIRADGDINGLRVALMKAVLQRKFRKGLIKQGVPMSLNKESDNHAYVLGRLFAVLERIQSQALGELNAGIADRYYGSASAVPFFVFPRLLRGAKHHLARLRKDKGGIAANLEQDLGEIISVLPETFPRHLSIEEQSCFAIGYYHQKFTKTETAKSMEN

SEQ ID NO: 3666 - protein, 585 aa, Neisseria lactamica
MILHALTQYYQRKAESGGGVAPEGFENKEIPFIIVIDKQGKFIQLEDTRELKNKKKIARTFLVPKGLGRSGSKSYEVSNLLWDHYGYVLAYAGEKGQEQADKQHASFTANVNELKQALPDDAGVAAVAAFLASSAEKSKVIQAANWAECAKVKGCNLSFRLVDEAVDLVCQSKAVQAYVNQANHAQSDNIPKGICLVTGKPAPIARLHNAVKGVNAKPAPFTSVNLSAFESYGKEQGFIFPVGEQAMFEYTTALNTLLAGENRFRIGDVTAICWSAKPTPLETHLASLINGGGKDKPDEHIDAVKSLYKSLYNGKYTEPDGKEKFYLLGLSPNSARIVVRFWHETTVAALSESIAAWYDDLQMVRGENSPYPEYMPLPRLLGNLVLDGKMENLPSDLIAQITDAALNNRVLPVSLLQVALRRNKAEQKITYGRASLLKAYINRAIRAGRLKNMKELTMSLDRNRQDIGYVLGRLFAVLEKTQAEANPGLNATIADRYFGSASSTPIAVFGTLMRLLPHHLNKLEFEGRAVQLQWEIRQILEHCQRFPNHLNLEQQGLFAIGYYHETQFLFTKDALKNLFNEAKTA

SEQ ID NO: 3667 - protein, 453 aa, Streptococcus mutans
MDFFTSLLKAYEKAEEIDLVDQQTGDNPVLLPIYHDNKVIKNNDMYIEILLDNEGAFYKARKFEIGENVIFPVTYESSNRTNTKIAPHPIVDSWYYVMYSELRKEKHQKYLENLDNWIIQTKNNKVEKFLKIIKKFVENPESVELVLNSAFGSDCQIQEEFVDNNGKIQEGSLIFGEKKQKIALKDIKLSFKILEFDGLRDVSVSNFNEMHHDFINYINNNSTEIGIGICNISGKEDRIIKNHRKPKGVFSNGKLISQNNKIAYLGDRFPNENASSDIIKIGYETSEKIHLMIKYLLENNNSHTWLGTSQYLINWFSDDLSNDSQLDIVKPEFDDLFEDDEEEKQVFIKPNEENKKIGSSFVRGQKLFSNNATYNIAILNENKGRIALKYFRQLQVSQLLKNLESWQENYSWEVKTKAGNYELKKTPTFNEIINAAYGVDRERYLELDNGSFK

SEQ ID NO: 3668 - protein, 612 aa, Acidovorax oryzae
MILQALATYYSRLQATGESDIAQPGYSQENISYEIVLTPDGSVVAVNDIRNTAGKNPRPKVVAVPASFKRPGIGSKSFFLWDKSSYVLGFGEGKAAQDHAAFRELHLSTMPSLDDPGLIALQSFIKAWQPESLSSHALFAPHAEGLVGANIVFRLDGELRFMHQRPAAEEARERLLGDAGKASASAECLVTGKPSRIATVHPAIKGVHDAQSAGASIVSFNQDAFKSYGKEQGENAPISEQAAFAYTTVLNHLLRRSEHNRQCIQIGDASVVFWAEAEDAEEAQTAEWTFESLLNTPPDDSQEAARVRNVLEHVARGRPLNELDPKLQDGTRMFILGLASNISRISIRFWETGTLGAFAGRLAQHAQDFRLEPVPWKTAPAARRIVLATVPNREGAMPKMDDAFNNLVGEFMRSVLTGRPYPRSLLANTLMRIRTDGNLSGLRAAICKGILARERRLGINVHIHKEEVPVSLDKQSTNPGYRLGRLFAVLESVQRGALGKDINATIRDRYYGAASATPASVFPLLLRNTQNHLSKMRKDDDTSRLAGYFEKQIQEIIDGLTDSFPRNLRIEDQGRFAIGYYHQSRNRPLKGENSTGQENNDSNADTTEGASA

SEQ ID NO: 3669 - protein, 190 aa, Streptococcus mutans
SDQYQQLVTALIDGRSIPNTIVKKLEDNIRQRQKYSKHWYQVQQVSLAVLQKQYGREFTPMLDHQETDRSYLFGRLLAIYELFEAQRYALDGSSQERVTNAERYWNAYTGQPAKMMTHLENKIKPYEEVLKLNKPGIWHKLEKEREEIIQLMTPMYAHKNFTQSLDYKFIFGYYAEKQFYYTKQAKENEE

SEQ ID NO: 3670 - protein, 427 aa, Streptococcus mutans
MDFFTSLLKAYEKAEEIDLVDQQTGDNPVLLPIYHDNKVIKNNDIYIEILLDNEGAFFKARKFEIGENVIFPVTYESSNRTSTKIAPHPIVDSWYYVMYSELRKETHQRYLQNLDNWIIQTENNKVENFLKIIKKFVENPESVELVLNSAFGSDCQIQEEFVDNNGKIQEGSLIFGEKKQKIALKDIKLSFKILEFDGLRDVSVSNFNEMHHDFINYINNNSTEIGIGICNISGKEDRIIKNHRKPKGVFSNGKLISQNNKIAYLGDRFPNENASSDIIKIGYETSEKIHLMIKYLLENNNSHTWLGTSQYLINWFSDDLSNDSQLDIVKPEFDDLFEDDEEEKQVFIKPNEENKKIGSSFVRGQKLFSNNATYNIAILNENKGRIALKYFRQLQVSQLLKNLESWQENYSWEVKTKSGNYKLRTPT

SEQ ID NO: 3671 - protein, 642 aa, Desulfovibrio sp. X2; identical to SEQ ID NO: 3310

SEQ ID NO: 3672 - protein, 638 aa, Desulfohalovibrio alkalitolerans; identical to SEQ ID NO: 3309

SEQ ID NO: 3673 - protein, 590 aa, Phaeospirillum fulvum; identical to SEQ ID NO: 3343

SEQ ID NO: 3674 - protein, 592 aa, Aggregatibacter sp. oral taxon 458; identical to SEQ ID NO: 3350

SEQ ID NO: 3675 - protein, 705 aa, Aggregatibacter sp. oral taxon 458; identical to SEQ ID NO: 3349

SEQ ID NO: 3676 - protein, 624 aa, Atopobium sp. oral taxon 810; identical to SEQ ID NO: 3351

SEQ ID NO: 3677 - protein, 587 aa, Clostridium sp. ATCC BAA-442; identical to SEQ ID NO: 3352

SEQ ID NO: 3678 - protein, 650 aa, Clostridium sp. KLE 1755; identical to SEQ ID NO: 3354

SEQ ID NO: 3679 - protein, 458 aa, Clostridium sp. KLE 1755; identical to SEQ ID NO: 3353

SEQ ID NO: 3680 - protein, 864 aa, Clostridium symbiosum; identical to SEQ ID NO: 3355

SEQ ID NO: 3681 - protein, 657 aa, Clostridium sp. ATCC 29733; identical to SEQ ID NO: 3356

SEQ ID NO: 3682 - protein, 634 aa, Porphyromonas sp. oral taxon 278; identical to SEQ ID NO: 3357

SEQ ID NO: 3683 - protein, 639 aa, Selenomonas sp. oral taxon 892; identical to SEQ ID NO: 3358

SEQ ID NO: 3684 - protein, 593 aa, Treponema lecithinolyticum; identical to SEQ ID NO: 3359

SEQ ID NO: 3685 - protein, 586 aa, Oscillibacter; identical to SEQ ID NO: 3360

SEQ ID NO: 3686 - protein, 610 aa, Oribacterium sp. oral taxon 078; identical to SEQ ID NO: 3363

SEQ ID NO: 3687 - protein, 637 aa, Eubacterium sp. CAG:146; identical to SEQ ID NO: 3123

SEQ ID NO: 3688 - protein, 584 aa, Firmicutes bacterium CAG:646; identical to SEQ ID NO: 3125

SEQ ID NO: 3689 - protein, 577 aa, Clostridium hathewayi CAG:224; identical to SEQ ID NO: 3126

SEQ ID NO: 3690 - protein, 654 aa, Ruminococcus sp. CAG:254; identical to SEQ ID NO: 3127

SEQ ID NO: 3691 - protein, 588 aa, Clostridium sp. CAG:138; identical to SEQ ID NO: 3128

SEQ ID NO: 3692 - protein, 598 aa, Ruminococcus sp. CAG:579; identical to SEQ ID NO: 3129

SEQ ID NO: 3693 - protein, 579 aa, Oscillibacter sp. CAG:241; identical to SEQ ID NO: 3130

SEQ ID NO: 3694 - protein, 591 aa, Enterocloster clostridioformis; identical to SEQ ID NO: 3131

SEQ ID NO: 3695 - protein, 638 aa, Clostridium sp. CAG:352; identical to SEQ ID NO: 3132

SEQ ID NO: 3696 - protein, 650 aa, Clostridium sp. CAG:58; identical to SEQ ID NO: 3133

SEQ ID NO: 3697 - protein, 614 aa, Ruminococcus sp. CAG:379; identical to SEQ ID NO: 3134

SEQ ID NO: 3698 - protein, 611 aa, Eggerthella sp. CAG:298; identical to SEQ ID NO: 3135

SEQ ID NO: 3699 - protein, 601 aa, Anaerotruncus sp. CAG:390; identical to SEQ ID NO: 3136

SEQ ID NO: 3700 - protein, 623 aa, Ruminococcus sp. CAG:330; identical to SEQ ID NO: 3137

SEQ ID NO: 3701 - protein, 604 aa, Ruminococcus sp. CAG:403; identical to SEQ ID NO: 3138

SEQ ID NO: 3702 - protein, 591 aa, Faecalibacterium sp. CAG:74; identical to SEQ ID NO: 3139

SEQ ID NO: 3703 - protein, 591 aa, Enterocloster clostridioformis; identical to SEQ ID NO: 3140

SEQ ID NO: 3704 - protein, 598 aa, Aquaspirillum serpens
MILQALNDYYQRLLTQGVGIALPGYSQEKISYVLVLSSAGELVDVQDVRVQVGKKLQPKLISAPQPEKRTSGVKSNFLWDKTSYVLGVSAKEGGRSAQEHQAFKELHCNLLADNTDPSLQALLKFLQQWTPEQFQPPLFNAEMLDSNLVFRLDGQMQYLHDTPAAQAIWSRLQAGADSKEGMCLVTGQRQPLARLHPAIKGVNGAQSSGASIVSFNLESFSSYGKAQGDNAPVSEQAAFAYTTVLNHLLRRDDSNHQRLQIGDASVVFWAEAANAAQADAAETLFWEMLDPPADDVSETEHLRQALDKVANGRALRELSPELEDDTRIYVLGLSPNASRLSIRFWETDSLGNFARRLAEHFQDLALEPLPWKTEPAMWRLLHATAPSRDGKSKAEDIPPQLAGELTRAILTGSRYPRSLLNTIIMRLRADGDISGTRVALCKAVLARDLRLGVKGINEEIPMSLDKEASNPGYRLGRLFAVLESAQHHALGGKVNATIRDRYYGAASATPATVFPMLLRNTQNHLSKVRKEKPGLAVTLEKEISEIIDGLPPQFPRSLRLEDQGRFAIGYYHQSQARFGHSKDEDADTTESTEQGAAE

SEQ ID NO: 3705 - protein, 577 aa, Desulfovibrio sp. Dsv1
MILSELTAFYQRMLRESDTELPLPGYNRELIGFVLVLTPRGVLRRILLRLDDKGKARPLLVPAPRKQPGSGVSPNLFWDNTGYLLGVDGKGKPERSAKTFAAFRQAHEELARDTGNARLYAVAAFLESWRPEMFADLDVGPLILNKNGVFQIEEDQGFLHEQADIRRIWEAQRRAGGEDPTGICLATGKTAPIARIHPPIRGVSGANPTGAALVSFNCDAFESYGKSQSFNAPVSGEAAEAYTTALNFLLRKDSGHCLRLGSTSLVFWTEQPGPAEKVFASCLFYEDGEALECGADTAEDRELLGRTRAVLRAARDGKKPADADLAALRAAETRFFLLGLKPNQARLGVTVWQISSFGQLLENLGRHYHNLALAPQYANDPPLPPLWMLLRELASQGKTENIPAGLGDALSRAVLSGGRYPKNLLAIVMQSIRADKNISYLRAALLKAFLLRNHPSQGAWTMELDESRKDLPYLLGRLFALLEKTQSDAVGAVGASIKDRYIGAASATPLLVFPQLLRLAQHHIGKADYGKYNEDRIAGVMRDISAFPPHLSLPEQGDFFIGYYHQRIANYQKKEKE

SEQ ID NO: 3706 - protein, 610 aa, Sandarakinorhabdus limnophila
MSVLHALDAYYRRLDERGEVAAPGWSPEKFGWCIVLDPAGQVVDVQDLRDVSGKKPAPKQYRVPASFPRPGTTPRAFFLWDNTKFSLGVTRTEEKNKWQYTNVHWNAFRSLHIDRLFDSNDVGLTSLRRFIEGWRPEYFGRSPFHTDMLDANVMFRLDGDLCFLHERAAAKALIEAEDPQEPLAAVSCLVTGEVGPPARLHPTIKGVEGAQSSGAVLVSFNDPAFRSYGKEQGENAPTTEGAAFRYGAVLNHLLTRDGPNRLKRPVGDATVVFWADASNAAAENAADALFAQWLDSDVSDEDQALKMRQQLEAVAKGKPLGDLHADIVYGTRFHVLGLSPNASRLSVRFWMTDTLDAFAQRLAYHHRDLAIEPLPRGWGAAPSVNRLLVNTTALQREYKNIPPLLAGEMMRAVLTGGRYPFSLFSAALIRLRAGDDPASGWHAAVIRAVLVRLGRRNPELPEQGETPMSLKRDHANAGYQLGRLFAVYELAQRAALGRVNASIRDRYFAAASATPASVFPLVVRGAQNHLAKVRKNRPGWAALIERELEEINGRFDPRPEGTLPRSLRLQDQGEFVVGYYHQRSAKLSSDKGEIISSDDLNETTGNHEAE

SEQ ID NO: 3707 - protein, 588 aa, Youngiibacter fragilis; identical to SEQ ID NO: 3365

SEQ ID NO: 3708 - protein, 590 aa, Shinella sp. DD12
MNILSSLMAAYERLPDAPPFGYSTEKVGVVVGLNEDGTVATVTPWLEGEGRKRKPRPMLVPQAVKRTAGIAPNFLWDKTAYVLGVTAGEGKRTAEEHRAFVERHLADIGDSEDVGLRALKRFLEAWTPDQFAEPLWTDELKDQNVVFALESERRSGTNLHDRPAAKALWNRAAGAAGDAAEICLVTGEPGPVARLHPSIKGVWGAQSSGAALVSFNLDAFTSYGREQGANAPVSEAAAFAYTTMLNRFLERDSGHRLQIGDASTVFWADASGRGAEEAEALFAAYLDDVGDARAEEKISAEHIRGQLARIRAGDHLEDIEPDLADGVDFYVLGLAPNAARLSVRFSYAGSFGDITRNYQKFVSDMRIEPPPRDGYPPLWRYLLETAVLGKRENVSPNLAGDWMRAILSGTPYPLSLMASVLTRIRADGEVNALRVGILKALLIRNFKKEATPVALDPANTNRGYVLGRLFALYEEIQRAALGGRVNATIKDKFYGSASATPRKVFAVLDGGSANHLAKIRKLNIGREVNLQRQLQALMDLMSPSDDPALDPFPVSLTAQEQAYFGLGYHHQRSDFFKKASETASAGETEA

SEQ ID NO: 3709 - protein, 582 aa, Hyphomicrobium nitrativorans; identical to SEQ ID NO: 3090

SEQ ID NO: 3710 - protein, 579 aa, Rhodobacter capsulatus; identical to SEQ ID NO: 3368

SEQ ID NO: 3711 - protein, 580 aa, Dickeya dianthicola
MILHALCQYYQRRQKEPDSALPAFGFEQKAIPFVIVIAGDGHFLQFEDTRYLDEAQGKKPQARLFTVAKSIKKTSGVAANLLWDPADYVLGIDKKGNPARTKQQKACFIHRIQVLAAFAPQDSGLQAVLAFYQRYDSLPQPELEQDPLWAEINDGNPLLTFRLVTDADCLVFQRPAVLAAYQHVLADSDEPTGRCLVSGASLPVATLHPSIKGVWGAQSSGASLVSFNLDAFRSFGKEQGANAPISEQAAFEYTTALNALLQTHSPNRLQLGETSVVCWASQAHPLESWLPTLFGNSDDPDNGVRTVTALFDSVHNGAYCADDGEARFYLLGLSPNAARVAIRFFQEGTVAQFAERLREWFGDIDIIKPKAVTYPFPPLKALLRACALLNKEENLSPLLAGTTVRAILSGQPLPAALMSALLPRIKAERGDVSYYRASLMKACLNRAFRRQSIKEVSVSLDPEEQRVGYRLGRLFATLEQIQHAASPTINATLCDRYYSSASSTPVAVFHTLMRLHTHHLKKLKIPLQIRYQKCIGEIIDDITDFPAHLNQEQQGLFAIGYYHQRQHFFSQSTSSQGDEQ

SEQ ID NO: 3712 - protein, 580 aa, Dickeya dianthicola
MILHALCQYYQRRQTEPDSALPAFGFEQKAIPFVIVIASDGRFLQFEDTRYLDEAQGKKPQARLFTVAKSIKKTSGVAANLLWDPADYVLGIDKKGNPTRTEQQKTCFIDRIRALATFAPQDSGLQAVLAFYQRYPGLPQPELEQDPLWVEINDANPLLTFRLVTDADCLVFQRPAVLAAYQHVLADSDEPTGRCLVSGASLPVATLHPSIKGVWGAQSSGASLVSFNLDAFRSFGKEQGANAPISEQAAFEYTTALNALLQTHSPNRLQLGETSVVCWASQAHPLENWLPTLFGNSDDPDNGVRTIAALFNSVHNGAYCADDGDARFYLLGLSPNAARVAIRFFQEGTVAQFAERLREWFGDIDIIKPKMVTYPFPPLKALLRACALLNKEENLSPLLAGTTVRAILSGQPLPVALMSALLQRIKAERGDVSYYRASLMKACLNRAFRRQSIKEVSVSLDPEEQRIGYRLGRLFAMLEQIQHAANPTINATLCDRYYSSASSTPVAVFHTLMRLHTHHLKKLKIPAQIRYQKCIGEIIDGITDFPAHLNQEQQGLFAIGYYHQRQHFFSQSTSSQGDEQ

SEQ ID NO: 3713 - protein, 580 aa, Dickeya dianthicola
MILHALCQYYQRRQTEPDSALPAFGFEQKAIPFVIVIASDGRFLQFEDTRYLDEAQGKKPQARLFTVAKSIKKTSGVAANLLWDPADYVLGIDKKGNPTRTEQQKTCFIDRIRALATFAPQDSGLQAVLAFYQRYPGLPQPELEQDPLWVEINDANPLLTFRLVTDADCLVFQRPAVLAAYQHVLADSDEPTGRCLVSGASLPVATLHPSIKGVWGAQSSGASLVSFNLDAFRSFGKEQGANAPISEQAAFEYTTALNALLQTHSPNRLQLGETSVVCWASQAHPLESWLPTLFGNSDDPDNGVRTVTALFDSVHNGAYCADDGEARFYLLGLSPNAARIAIRFFQEGTVAQFAERLREWFDDITIIKPKAVTYPFPPLKALLRACALLNKEENLSPLLAGTTVRAILSGQPLPAALMSALLQRIKAERGDVSYYRASLMKACLNRAFRRQSIKEVSVSLDPEEQRVGYRLGRLFATLEQIQHAASPTINATLCDRYYSSASSTPVAVFHTLMRLHTHHLKKLKIPLQIRYQKCIGEIIDDITDFPAHLNQEQQGLFAIGYYHQRQHFFSQSTSSQGDEQ

SEQ ID NO: 3714 - protein, 607 aa, Desulfotomaculum reducens MI-1; identical to SEQ ID NO: 2991

SEQ ID NO: 3715 - protein, 571 aa, Chlorobium phaeovibrioides DSM 265; identical to SEQ ID NO: 2992

SEQ ID NO: 3716 - protein, 595 aa, Pseudomonas stutzeri A1501; identical to SEQ ID NO: 3308

SEQ ID NO: 3717 - protein, 646 aa, Roseiflexus sp. RS-1; identical to SEQ ID NO: 2993

SEQ ID NO: 3718 - protein, 651 aa, Alkaliphilus metalliredigens QYMF; identical to SEQ ID NO: 2994

SEQ ID NO: 3719 - protein, 687 aa, Actinobacillus succinogenes 130Z; identical to SEQ ID NO: 2995

SEQ ID NO: 3720 - protein, 600 aa, Methylobacterium sp. 4-46; identical to SEQ ID NO: 2996

SEQ ID NO: 3721 - protein, 595 aa, Leptothrix cholodnii SP-6; identical to SEQ ID NO: 2997

SEQ ID NO: 3722 - protein, 621 aa, Exiguobacterium sibiricum 255-15; identical to SEQ ID NO: 2998

SEQ ID NO: 3723 - protein, 614 aa, Xanthomonas oryzae pv. oryzae PXO99A; identical to SEQ ID NO: 2999

SEQ ID NO: 3724 - protein, 665 aa, Termite group 1 bacterium phylotype Rs-D17; identical to SEQ ID NO: 3100

SEQ ID NO: 3725 - protein, 675 aa, Cellvibrio japonicus Ueda107; identical to SEQ ID NO: 3000

SEQ ID NO: 3726 - protein, 553 aa, Pelodictyon phaeoclathratiforme BU-1; identical to SEQ ID NO: 3001

SEQ ID NO: 3727 - protein, 627 aa, Streptococcus equi subsp. zooepidemicus MGCS10565; identical to SEQ ID NO: 3002

SEQ ID NO: 3728 - protein, 607 aa, Gluconacetobacter diazotrophicus PA1 5; identical to SEQ ID NO: 3003

SEQ ID NO: 3729 - protein, 629 aa, Desulfovibrio vulgaris str. 'Miyazaki F'; identical to SEQ ID NO: 3004

SEQ ID NO: 3730 - protein, 616 aa, Rhodobacter sphaeroides KD131; identical to SEQ ID NO: 3005

SEQ ID NO: 3731 - protein, 633 aa, Geobacter daltonii FRC-32; identical to SEQ ID NO: 3006

SEQ ID NO: 3732 - protein, 618 aa, Acidobacterium capsulatum ATCC 51196; identical to SEQ ID NO: 3007

SEQ ID NO: 3733 - protein, 598 aa, Azotobacter vinelandii DJ; identical to SEQ ID NO: 3008

SEQ ID NO: 3734 - protein, 596 aa, Aggregatibacter aphrophilus NJ8700; identical to SEQ ID NO: 3010

SEQ ID NO: 3735 - protein, 677 aa, Teredinibacter turnerae T7901; identical to SEQ ID NO: 3009

SEQ ID NO: 3736 - protein, 582 aa, Eggerthella lenta DSM 2243; identical to SEQ ID NO: 3011

SEQ ID NO: 3737 - protein, 642 aa, Desulfotomaculum acetoxidans DSM 771; identical to SEQ ID NO: 3012

SEQ ID NO: 3738 - protein, 583 aa, Zymomonas mobilis subsp. mobilis NCIMB 11163; identical to SEQ ID NO: 3013

SEQ ID NO: 3739 - protein, 578 aa, Halothiobacillus neapolitanus c2; identical to SEQ ID NO: 3014

SEQ ID NO: 3740 - protein, 629 aa, Bifidobacterium dentium Bd1; identical to SEQ ID NO: 3015

SEQ ID NO: 3741 - protein, 591 aa, Acidaminococcus fermentans DSM 20731; identical to SEQ ID NO: 3016

SEQ ID NO: 3742 - protein, 618 aa, Meiothermus ruber DSM 1279; identical to SEQ ID NO: 3017

SEQ ID NO: 3743 - protein, 618 aa, Stackebrandtia nassauensis DSM 44728; identical to SEQ ID NO: 3018

SEQ ID NO: 3744 - protein, 582 aa, Nitrosococcus halophilus Nc 4; identical to SEQ ID NO: 3019

SEQ ID NO: 3745 - protein, 579 aa, Rhodobacter capsulatus SB 1003; identical to SEQ ID NO: 3020

SEQ ID NO: 3746 - protein, 602 aa, Thermincola potens JR; identical to SEQ ID NO: 3021

SEQ ID NO: 3747 - protein, 621 aa, Meiothermus silvanus DSM 9946; identical to SEQ ID NO: 3022

SEQ ID NO: 3748 - protein, 607 aa, Syntrophothermus lipocalidus DSM 12680; identical to SEQ ID NO: 3023

SEQ ID NO: 3749 - protein, 620 aa, Truepera radiovictrix DSM 17093; identical to SEQ ID NO: 3024

SEQ ID NO: 3750 - protein, 590 aa, Spirochaeta smaragdinae DSM 11293; identical to SEQ ID NO: 3025

SEQ ID NO: 3751 - protein, 598 aa, Desulfarculus baarsii DSM 2075; identical to SEQ ID NO: 3026

SEQ ID NO: 3752 - protein, 589 aa, Ketogulonicigenium vulgare Y25; identical to SEQ ID NO: 3027

SEQ ID NO: 3753 - protein, 589 aa, Rhodomicrobium vannielii ATCC 17100; identical to SEQ ID NO: 3028

SEQ ID NO: 3754 - protein, 655 aa, Ethanoligenens harbinense YUAN-3; identical to SEQ ID NO: 3031

SEQ ID NO: 3755 - protein, 613 aa, Ruminococcus albus 7 = DSM 20455; identical to SEQ ID NO: 3030

SEQ ID NO: 3756 - protein, 586 aa, Rhodopseudomonas palustris DX-1; identical to SEQ ID NO: 3032

SEQ ID NO: 3757 - protein, 562 aa, Bacteroides helcogenes P 36-108; identical to SEQ ID NO: 3033

SEQ ID NO: 3758 - protein, 580 aa, Desulfobulbus propionicus DSM 2032; identical to SEQ ID NO: 3034

SEQ ID NO: 3759 - protein, 613 aa, Acidovorax avenae subsp. avenae ATCC 19860; identical to SEQ ID NO: 3035

SEQ ID NO: 3760 - protein, 654 aa, Syntrophobotulus glycolicus DSM 8271; identical to SEQ ID NO: 3036

SEQ ID NO: 3761 - protein, 588 aa, Planctomyces brasiliensis DSM 5305; identical to SEQ ID NO: 3037

SEQ ID NO: 3762 - protein, 588 aa, Planctomyces brasiliensis DSM 5305; identical to SEQ ID NO: 3037

SEQ ID NO: 3763 - protein, 608 aa, Nitrosomonas sp. AL212; identical to SEQ ID NO: 3039

SEQ ID NO: 3764 - protein, 603 aa, Marinithermus hydrothermalis DSM 14884; identical to SEQ ID NO: 3040

SEQ ID NO: 3765 - protein, 579 aa, Selenomonas sputigena ATCC 35185; identical to SEQ ID NO: 3041

SEQ ID NO: 3766 - protein, 614 aa, Treponema brennaborense DSM 12168; identical to SEQ ID NO: 3043

SEQ ID NO: 3767 - protein, 615 aa, Porphyromonas asaccharolytica DSM 20707; identical to SEQ ID NO: 3042

SEQ ID NO: 3768 - protein, 592 aa, Desulfotomaculum carboxydivorans CO-1-SRB; identical to SEQ ID NO: 3045

SEQ ID NO: 3769 - protein, 607 aa, Methylomonas methanica MC09; identical to SEQ ID NO: 3046

SEQ ID NO: 3770 - protein, 709 aa, Desulfotomaculum ruminis DSM 2154; identical to SEQ ID NO: 3048

SEQ ID NO: 3771 - protein, 384 aa, Bacillus coagulans 2-6; identical to SEQ ID NO: 3049

SEQ ID NO: 3772 - protein, 579 aa, Myxococcus fulvus HW-1; identical to SEQ ID NO: 3052

SEQ ID NO: 3773 - protein, 583 aa, Zymomonas mobilis subsp. pomaceae ATCC 29192; identical to SEQ ID NO: 3051

SEQ ID NO: 3774 - protein, 626 aa, Treponema caldaria DSM 7334; identical to SEQ ID NO: 3053

SEQ ID NO: 3775 - protein, 611 aa, Candidatus Arthromitus sp. SFB-mouse-Japan; identical to SEQ ID NO: 3102

SEQ ID NO: 3776 - protein, 601 aa, Sphingobium sp. SYK-6; identical to SEQ ID NO: 3103

SEQ ID NO: 3777 - protein, 583 aa, Roseburia hominis A2-183; identical to SEQ ID NO: 3055

SEQ ID NO: 3778 - protein, 612 aa, Candidatus Arthromitus sp. SFB-rat-Yit; identical to SEQ ID NO: 3105

SEQ ID NO: 3779 - protein, 329 aa, Bacillus coagulans 36D1; identical to SEQ ID NO: 3057

SEQ ID NO: 3780 - protein, 676 aa, Methylomicrobium alcaliphilum 20Z; identical to SEQ ID NO: 3115

SEQ ID NO: 3781 - protein, 611 aa, Pseudoxanthomonas spadix BD-a59; identical to SEQ ID NO: 3058

SEQ ID NO: 3782 - protein, 709 aa, Desulfosporosinus orientis DSM 765; identical to SEQ ID NO: 3059

SEQ ID NO: 3783 - protein, 640 aa, Filifactor alocis ATCC 35896; identical to SEQ ID NO: 3185

SEQ ID NO: 3784 - protein, 585 aa, Sphaerochaeta pleomorpha str. Grapes; identical to SEQ ID NO: 3060

SEQ ID NO: 3785 - protein, 645 aa, Clostridium sp. BNL1100; identical to SEQ ID NO: 3061

SEQ ID NO: 3786 - protein, 571 aa, Desulfovibrio desulfuricans ND132; identical to SEQ ID NO: 3198

SEQ ID NO: 3787 - protein, 585 aa, Thermus thermophilus SG0.5JP17-16; identical to SEQ ID NO: 3047

SEQ ID NO: 3788 - protein, 611 aa, Candidatus Arthromitus sp. SFB-mouse-Yit; identical to SEQ ID NO: 3104

SEQ ID NO: 3789 - protein, 612 aa, Desulfovibrio vulgaris RCH1; identical to SEQ ID NO: 3029

SEQ ID NO: 3790 - protein, 589 aa, Ketogulonicigenium vulgare WSH-001; identical to SEQ ID NO: 3027

SEQ ID NO: 3791 - protein, 607 aa, Rhodospirillum rubrum F11; identical to SEQ ID NO: 2979

SEQ ID NO: 3792 - protein, 631 aa, Streptococcus mutans LJ23; identical to SEQ ID NO: 3106

SEQ ID NO: 3793 - protein, 677 aa, Aggregatibacter actinomycetemcomitans D7S-1; identical to SEQ ID NO: 3062

SEQ ID NO: 3794 - protein, 591 aa, Aggregatibacter actinomycetemcomitans D7S-1; identical to SEQ ID NO: 3063

SEQ ID NO: 3795 - protein, 635 aa, Tistrella mobilis KA081020-065; identical to SEQ ID NO: 3064

SEQ ID NO: 3796 - protein, 617 aa, Desulfomonile tiedjei DSM 6799; identical to SEQ ID NO: 3065

SEQ ID NO: 3797 - protein, 699 aa, Desulfosporosinus acidiphilus SJ4; identical to SEQ ID NO: 3066

SEQ ID NO: 3798 - protein, 586 aa, Geobacter metallireducens GS-15; identical to SEQ ID NO: 2977

SEQ ID NO: 3799 - protein, 637 aa, Bacillus thuringiensis MC28; identical to SEQ ID NO: 3067

SEQ ID NO: 3800 - protein, 631 aa, Streptococcus dysgalactiae subsp. equisimilis AC-2713; identical to SEQ ID NO: 3118

SEQ ID NO: 3801 - protein, 584 aa, Chamaesiphon minutus PCC 6605; identical to SEQ ID NO: 3069

SEQ ID NO: 3802 - protein, 570 aa, Pseudanabaena sp. PCC 7367; identical to SEQ ID NO: 3068

SEQ ID NO: 3803 - protein, 597 aa, Thermobacillus composti KWC4; identical to SEQ ID NO: 3071

SEQ ID NO: 3804 - protein, 628 aa, Methanoregula formicica SMSP; identical to SEQ ID NO: 3072

SEQ ID NO: 3805 - protein, 587 aa, Prevotella dentalis DSM 3688; identical to SEQ ID NO: 3073

SEQ ID NO: 3806 - protein, 560 aa, Chamaesiphon minutus PCC 6605; identical to SEQ ID NO: 3070

SEQ ID NO: 3807 - protein, 588 aa, Myxococcus stipitatus DSM 14675; identical to SEQ ID NO: 3074

SEQ ID NO: 3808 - protein, 654 aa, Desulfocapsa sulfexigens DSM 10523; identical to SEQ ID NO: 3075

SEQ ID NO: 3809 - protein, 652 aa, Dehalococcoides mccartyi DCMB5; identical to SEQ ID NO: 3076

SEQ ID NO: 3810 - protein, 660 aa, Bibersteinia trehalosi USDA-ARS-USMARC-192; identical to SEQ ID NO: 3077

SEQ ID NO: 3811 - protein, 648 aa, Bifidobacterium thermophilum RBL67; identical to SEQ ID NO: 3078

SEQ ID NO: 3812 - protein, 569 aa, Mannheimia haemolytica USDA-ARS-USMARC-183; identical to SEQ ID NO: 3079

SEQ ID NO: 3813 - protein, 594 aa, Mannheimia haemolytica USDA-ARS-USMARC-185; identical to SEQ ID NO: 3080

SEQ ID NO: 3814 - protein, 578 aa, Eubacterium rectale DSM 17629; identical to SEQ ID NO: 3110

SEQ ID NO: 3815 - protein, 613 aa, Ruminococcus champanellensis 18P13 = JCM 17042; identical to SEQ ID NO: 3113

SEQ ID NO: 3816 - protein, 587 aa, Faecalibacterium prausnitzii L2-6; identical to SEQ ID NO: 3112

SEQ ID NO: 3817 - protein, 595 aa, Eubacterium siraeum V10Sc8a; identical to SEQ ID NO: 3114

SEQ ID NO: 3818 - protein, 578 aa, Eubacterium rectale M104/1; identical to SEQ ID NO: 3111

SEQ ID NO: 3819 - protein, 524 aa, Clostridium cf. saccharolyticum K10; identical to SEQ ID NO: 3109

SEQ ID NO: 3820 - protein, 618 aa, Meiothermus ruber DSM 1279; identical to SEQ ID NO: 3017

SEQ ID NO: 3821 - protein, 598 aa, Azotobacter vinelandii CA; identical to SEQ ID NO: 3008

SEQ ID NO: 3822 - protein, 598 aa, Azotobacter vinelandii CA6; identical to SEQ ID NO: 3008

SEQ ID NO: 3823 - protein, 602 aa, Desulfotomaculum gibsoniae DSM 7213; identical to SEQ ID NO: 3084

SEQ ID NO: 3824 - protein, 632 aa, Streptococcus agalactiae ILRI005; identical to SEQ ID NO: 3122

SEQ ID NO: 3825 - protein, 631 aa, Streptococcus pyogenes M1 476; identical to SEQ ID NO: 3108

SEQ ID NO: 3826 - protein, 594 aa, Mannheimia haemolytica D171; identical to SEQ ID NO: 3086

SEQ ID NO: 3827 - protein, 569 aa, Mannheimia haemolytica D174; identical to SEQ ID NO: 3079

SEQ ID NO: 3828 - protein, 569 aa, Mannheimia haemolytica D153; identical to SEQ ID NO: 3079

SEQ ID NO: 3829 - protein, 569 aa, Mannheimia haemolytica USMARC_2286; identical to SEQ ID NO: 3079

SEQ ID NO: 3830 - protein, 582 aa, Hyphomicrobium nitrativorans NL23; identical to SEQ ID NO: 3090

SEQ ID NO: 3831 - protein, 612 aa, Desulfovibrio vulgaris str. Hildenborough; identical to SEQ ID NO: 3029

SEQ ID NO: 3832 - protein, 567 aa, Methylococcus capsulatus str. Bath; identical to SEQ ID NO: 3533

SEQ ID NO: 3833 - protein, 593 aa, Nitrobacter winogradskyi Nb-255; identical to SEQ ID NO: 2974

SEQ ID NO: 3834 - protein, 581 aa, Chlorobium luteolum DSM 273; identical to SEQ ID NO: 2975

SEQ ID NO: 3835 - protein, 642 aa, Chlorobium chlorochromatii CaD3; identical to SEQ ID NO: 2976

SEQ ID NO: 3836 - protein, 607 aa, Rhodospirillum rubrum ATCC 11170; identical to SEQ ID NO: 2979

SEQ ID NO: 3837 - protein, 560 aa, Moorella thermoacetica ATCC 39073; identical to SEQ ID NO: 2978

SEQ ID NO: 3838 - protein, 636 aa, Rhodoferax ferrireducens T118; identical to SEQ ID NO: 2981

SEQ ID NO: 3839 - protein, 604 aa, Methylobacillus flagellatus KT; identical to SEQ ID NO: 2982

SEQ ID NO: 3840 - protein, 661 aa, Deinococcus geothermalis DSM 11300; identical to SEQ ID NO: 2983

SEQ ID NO: 3841 - protein, 582 aa, Myxococcus xanthus DK 1622; identical to SEQ ID NO: 2984

SEQ ID NO: 3842 - protein, 566 aa, Nitrosomonas eutropha C91; identical to SEQ ID NO: 2985

SEQ ID NO: 3843 - protein, 647 aa, Magnetococcus marinus MC-1; identical to SEQ ID NO: 2987

SEQ ID NO: 3844 - protein, 288 aa, Bifidobacterium adolescentis ATCC 15703; identical to SEQ ID NO: 3555

SEQ ID NO: 3845 - protein, 343 aa, Bifidobacterium adolescentis ATCC 15703; identical to SEQ ID NO: 3556

SEQ ID NO: 3846 - protein, 574 aa, Chlorobium phaeobacteroides DSM 266; identical to SEQ ID NO: 2988

SEQ ID NO: 3847 - protein, 599 aa, Desulfovibrio vulgaris DP4; identical to SEQ ID NO: 2989

SEQ ID NO: 3848 - protein, 316 aa, Nitrobacter winogradskyi Nb-255
MTMLTNRYDFVLLFDVTKGNPNGDPDAGNLPRLDPETNHGLVSDVSLKRKVRNYVDLVRSGTDGHHIYVEEAAILNDKHRQAYKALRPDDPKVDKEAKLNPRDDVEAKKLREFMCKNFFDVRTFGAVMSTGINAGQVRGPVQMTFANSVEPIVPQEISITRMAATNEAEKKQRAEGGEEGNDRVDNRTMGRKYIVPYGLYRAHGFVSAKLAERTGFSEADLELTFEALTSMFEHDRSAARGEMTTRKLVVFKHGNALGSAPAHALFERVRIGRNIDGQFRRIDRSDNYPPARAFSDYAVEIDRDNPPDGVEIIERI

SEQ ID NO: 3849 - protein, 299 aa, Pelodictyon luteolum DSM 273
MSDLTKRYDFALLFDVQDGNPNGDPDAGNLPRIDAETGMGLVTDVCLKRKVRNYVQLSGKDIFIKEKAVLNTLISNAYEEQKIDLTKDPVDLKDGKKRNKDGTAQGGEVEKGRSYMCSRYYDIRTFGAVMSTGANAGQVRGPIQITFARSVEPVVALEHSITRMAVTTEADAEKQSGDNRTMGRKYTVPYGLYCSHGFVSAHLANQTGFSAEDLKLFWEALQNMFEHDRSAARGMMSTRGLYVFEHSTALGNAPAHKLFERIKVERKPESEGPARSFEDYTVTIDESGLDGVTLHKMLC

SEQ ID NO: 3850 - protein, 280 aa, Chlorobium chlorochromatii CaD3
MSTLNQKIDFAIIMRVTNANPNGDPLNGNRPRTDLDGHGEMTDVCLKRKIRNRIMELKDKEQKYQFDIFVQPDDSKRDSHTSLKARFESEIGKNVKDKDDAAKKACKKWFDVRAFGQLFAFDGEESSGLSIPVRGPVSIHSAFSVEPVNVSSIQITKSVSGNEGKNGKRSSDTMGMKHRVDYGIYVTYGSMNPQLAERTGFSDEDAKVIMEILPKLFENDASSARPDGSMEVVSVIWWKHGSKAGKHSSAKVHKSLHVNEDGTYRLDDLEGLTPECINGF

SEQ ID NO: 3851 - protein, 284 aa, Geobacter metallireducens GS-15
MTIQNRYDFVLFFDVKDGNPNGDPDAGNLPRIDPETGHGLVTDVCLKRKVRNYVQLDKELSQGYDIFVKEKAILNNLIDEAHEQENVKAKEKGEKTEAARQFMCGKYFDVRTFGAVMSTGKNAGQVRGPVQLTFARSVDQIVPLEHSITRMAVATPAEAEKQDGDNRTMGRKFTVPYALYRCHGFISAPLAAQTGFSEEDLELFWQSLVNMFEHDRSAARGQMSARKLIVFKHDSKMGNAPAHHLFDLVSAEASETPVRSFDQYDICVPTQENMPTGVTVVEKL

SEQ ID NO: 3852 - protein, 297 aa, Moorella thermoacetica ATCC 39073
MTVYTNPEVRHDFVLLFDVRDGNPNGDPDAGNLPRLDPETMQGLVTDVCLKRKIRDWVDMTRGSEANMKIYVQHHGILNAQHQRAYDAIGEKSTGSKQNREIVDKARQWMCQNFYDIRMFGAVMTTGVNCGQVRGPMQLTFARSIDPIVPLDISITRVAITRVEDAATSEQGEGGKVTEMGRKTLVPYGLYLGYGFFNPHFAADTGVSAADLEIFWEALQRMWDVDRSASRGMMACRGLYIFSHASALGNAPADNLFKLITVKRRDGVKAARSFADYQVTINEEDLPPGVTLTRLVG

SEQ ID NO: 3853 - protein, 317 aa, Rhodospirillum rubrum ATCC 11170
MSALTQRHDFVVLFDVTNGNPNGDPDAGNTPRLDPETNHGLVSDVCLKRKIRNYVELAKGEDSGFHIYVQEGAILNDQHRKAYVALRPDKEKAAKEAKLNPQNDDEAKALRAFMCANFFDVRTFGAVMSTGINCGQVRGPVQFSFARSIEPIVPLEISITRMAATNEKEKTAQREGQEGDERTENRTMGRKHIIPYGLYRAHGFISAKLAERTGFDEGDLDLLLEAVEQMFEHDRSAARGEMAVRKLIVFRHANALGNAPAHSLFDRVTVGRVIDGEVRAVDDPAIDNRPPARSFGDYRVTIGREGLPEGVEIIERL

SEQ ID NO: 3854 - protein, 295 aa, Frankia casuarinae
MAFNLDPEKKHDMVLLFDVTDGNPNGDPDNGNRPRTDDETGHGLVTDVAIKRKVRDTIGLAAEAEGLDLTRYQIFVEAGHALNTRLEESYLVKGLELGKKIDDAKAAKAREWLANRYVDIRLFGAVLSTGKTQSLGQIRGPIQVGMARSLDPVLPVDHAITRVTQTTQADIDKGERTEMGGKWTVPYGLYRAEIHYSAPRGRQTGVSAADLDLFLCTLVNMFDHDRSATRGEMATRGLYVFSHHNAFGVAPAHTLSARITARKISAGEPRSFGDYKIDVDDADLPDDVALTRVLG

SEQ ID NO: 3855 - protein, 294 aa, Rhodoferax ferrireducens T118
MTTLQNKIDFAVILRVKNANPNGDPLNGNRPRTDYSNFGEMTDVSIKRKIRDRLLERWVAAGKADDGNMIFVQSDDRKADEYKSLRARAEAVLGKALGSDQTALLACSKWLDVRAFGQLFALKSNKKAGKKNDDGSDDEGDTGVSIGIRGPVTVQSAFSVEPIDITSTQITKSVSGEGDGTKRSSDTMGTKHRVDQGIYRFFGSMNPQLAEKTGFSDADAQALKAVLPKLFENDESSARPAGSMEVVKVIWWQHNCKSGQYSSAKVHRSLTVNPDGSYSIDSLDGLVPECLDGF

SEQ ID NO: 3856 - protein, 325 aa, Deinococcus geothermalis DSM 11300
MTQTSSPLRNRYEFLLLFDVENGNPNGDPDSGNAPRVDPEDGHGLVSDVALKRRVRNYVQAAGEQIFIQHGTNLNRPIFQAKQASGGGSKGKQDVDAARRWMCEHFYDVRTFGAVMSTGANAGQVRGPVQLTFARSLDPVFAIEASITRGAVAEDIKNAKTLDDFLNWEAQQDEDKLRTMGRKSLIPYGLFATKGFVSAHLAQGTGFSEADLKLLLEALLNMYEHDRSASKGLMSSRRLFVFRHVGTDSDPQQRARQAVLGCAPAHKLLDLGQVIEVRRKDEHKPARALSDYEVTVHLDRLPAGVELLDLDSWDEARYHDGWQSR

SEQ ID NO: 3857 - protein, 304 aa, Nitrosomonas eutropha C91
MTLKNRYDFVLLFDVKDGNPNGDPDAGNLPRVDAETGLGLMTDVALKRKVRNFVSMTRDQSEVTESLNGDKKRFEIYVKEKAILNNQNKRAYVGIGKPELLEGEDKKRKGGNAVEEARQWMCKNFYDVRTFGAVMSTGINCGQVRGPVQLTFARSINPIVALEHSITRMAVATEVEAEKQSGDNRTMGRKFTVPYGLYVAHGFISAHLANQTDFGEDDLELLWQALESMFEHDRSAARGEMATRGLYVFKHNSELGNAPAHSLFARIQPKLKNENSIVRDFSDYTVMVDEADLPQGVTLQRIVG

SEQ ID NO: 3858 - protein, 288 aa, Syntrophomonas wolfei subsp. wolfei str. Goettingen G311
MATTIKNRYEFVLFFDVENGNPNGDPDADNMPRIDPETSFGLVSDVCIKRKIRNYVALLKENEDDYQIYVQEKAVLNNQHKKAYEHFKIKPESKKLPKDTAQAEAITQFMCKNFYDIRTFGAVMTTEVNCGQVRGPVQLGFSRSLDPIVPQEITITRMAVTNERDLEKERTMGRKHIVNYALYRAEGFISAPLADKTGFSEEDLELLWDALINMFDHDRSAARGKMSSRKLYVFKHDSKLGNAPASILFDAITVKKINGNKPVRNFSDYEISVTGNEIPQGVEVLELL

SEQ ID NO: 3859 - protein, 272 aa, Magnetococcus marinus MC-1
MSLSHKIDFAVIFAVKNANPNGDPLNGNRPRLTFDNLGEVSDVALKRKLRDRLLEGGHAIFVQSNDRNNDGATSLKDRSDKTLGSKLTSEELAQKACAQWLDVRAFGQLFAWKGTKGAGDGVSVAIRGPVTFQSAFSIAPVDISSIQITKSVNTEGDSEKKGSDTMGMKHRVDHGIYLFYGSMNPQLAQRTHFSDEDAQLIKQTLPRLFENDESTARPAGSMEVRKVLWWQHNCAAGQYSSAKVHRSLSVQHDGSYTLTNLPGLTPEELDGY

SEQ ID NO: 3860 - protein, 290 aa, Desulfovibrio vulgaris DP4
MTAIANRYEFVLLFDVENGNPNGDPDAGNMPRIDPETGHGLVTDVCLKRKIRNHVALTKEGAERFNIYIQEKAILNETHERAYTACKLKPEPKKLPKKVEDAKSVTDWMCTNFYDIRTFGAVMTTEVNCGQVRGPVQMAFARSVEPVVPQEVSITRMAVTTKAEAEKQQGDNRTMGRKHIVPYGLYVAHGFISAPLAEKTGFSDEDLTLFWDALVNMFEHDRSAARGLMSSRKLIVFKHQNKLGNAPAHKLFDLVKVSRAEGSSGPARSFADYAVTVGQAPEGVEVKEML

SEQ ID NO: 3861 - protein, 307 aa, Methanocorpusculum labreanum Z
MTALNNKIDFAVVISAKNANPNGDPLNGNCPRTNFAGIGEMSDVCIKRKLRNRLQDMGQPVFVQSLDRRTDSFLSLKDRADGCEAFKTALADNKKDDAEKIACKEWIDVRSFGQVFAYKGKKQNKKNKNEQKNDSESEDGEEGCVSIGIRGPVSVHPAFSVDAVEITSQQIVKSVNGETDKKNPYKRGSDTMGLKHRVDFGLYVFYGSINCQLAEKTGFSDEDAESIKEALMTLFENDASSARPEGSMEVVQVAWWKHNSKSGQYSSAKVHRTLHVEKRKETPMSVDDYAIKIDDLEGLKPEIFEGR

SEQ ID NO: 3862 - protein, 288 aa, Desulfotomaculum reducens MI-1
MFEPIKNRYEFVLFFDVENGNPNGDPDAGNMPRIDAETGLGLVTDVCLKRKIRNYVDIVKNGIEGFDIYVREGSILNNQHMKAYSALDIKPESKKLPKNEEDARRVKAFMCKHFYDIRTFGAVMTTEVNCGQVRGPVQINFARSIDPIVQQEVTITRMAVTSVKDAEKKDREMGRKHIVPYALYRAEGYVSAHLAEKSGFTKEDLELLWQSLTNMFDHDRSAARGKMATRKLIIFEHETALGNASAHSLFDMVEVSRKDLIRPPRAYSDYKVTVNMAALPAGIKLMEK

SEQ ID NO: 3863 - protein, 282 aa, Chlorobium phaeovibrioides DSM 265
MDAIKKRYDFVLLFDVQDGNPNGDPDAGNLPRIDAETGMGLVSDVCLKRKVRNYVQLAGQEIFIKEKGVLNTLIAESHEQPEVKSKTKGDKTEAARSWMCSKYYDIRTFGAVMSTGENAGQVRGPVQITFARSVEPVVALEHSITRMAVATEAEAEKQDGGNRTMGRKYTIPYGLYLAHGFVSANLANQTGFSEKDLQLFWDALLNMFEHDRSAARGMMSTRGLYIFEHNSALGNAPAHSLFERISVSRKNPASGPARSFAEYSIDINQANLEPVSLIKKLG

SEQ ID NO: 3864 - protein, 324 aa, Roseiflexus sp. RS-1
MTTTLSKKIDFAVILCVRNANPNGDPLNGNRPRTTYEGLGEISDVAIKRKIRNRVMELAKEIERIKEEERTEAQKQAYERLKGVEHPIFVQSDDNRNDEYTSLRERAEAYLKDFMNDRSAYQKKACETWFDVRAFGQVFPFKGKGKGKKGDKSNEGEESDGVSIGIRGPVSIHPAFSVVPVLDRVSSIQITKSVSNEPGEKRGSDTMGMKHRVDHGVYVFYGSINPQLASKTGFSDDDAAVIKEALRTLFRNDASSARPEGSIEVYRVYWWKHNSPNGQYSSAKVHRSLRVRVRDGIEDPKSIDDYVIELQDLDGLKPEVIEGE

SEQ ID NO: 3865 - protein, 286 aa, Alkaliphilus metalliredigens QYMF
MSNFENKIDFAVVISVKNANPNGDPLNGNRPRENYDGFGEISDVCIKRKIRNRFQDMDQAIFVQSDERRTDGFRSLKDRADGCEELKKSSKDKEQYAKIACEKWIDVRSFGQVFAFKKGGDDNSVSIGIRGPVSIHSAVSISPIEISSMQITKSVNGETGKDPDKKSPDTMGMKHRVEFGAYVIYGSINTQLATKTGFNQEDSELVKKALITLFENDCSSARPDGSMEVCKLYWWKHNSKIGQYSSAKVHRTLRIAPTIEMPKDINDYNITHETLDGLAPEIYDGI

SEQ ID NO: 3866 - protein, 279 aa, Actinobacillus succinogenes 130Z
MSLTKKIDFALILKVTNANPNGDPLNGNRPRTDFAGIGEMTDVCLKRKIRDRLQSNGESIFVQSDEKKTDGMTSLANRAKDKDVGLGAEAFGKKANKDETAKAACAKWLDVRSFGQVFAFGKSDDGAGVSIAVRGPVTIQSAFSVEPVNITSTQITKSVSGEGDGTKRGSDTMGMKHRVDSGIYVAFGAMSPQLAERTGFSDEDADKIKAVLTKLFEGDASSARPEGSMQVLKLIWWEHNCKSGQYSSAKVHGSLKVNTDGSYQLDNLDGLKPEEIDGF

SEQ ID NO: 3867 - protein, 302 aa, Leptothrix cholodnii SP-6
MSLNHRYDFVLLFDVKDGNPNGDPDAGNLPRLDAETGHGLMTDVALKRKVRNYVGLVHGEQPPHEIYIKEKAILNKTHERAYVAVGAGDSLKGEDKKRKGGGDVVDKAREWMCANFFDVRTFGAVMSTGVNCGQVRGPVQMTFARSIEPIVALEHSITRMAVATEAEAEKQGGDNRTMGRKHTVPYGLYRSHGFISSFLARQTGFSDGDLELVMTALKDMFEHDRSAARGQMATRGLYVFKHDSELGNASAHSLFDRLTVTPNAPGTPARDFGAYRVLFDGQPIAEGASMQAAPGVTLMRRC

SEQ ID NO: 3868 - protein, 285 aa, Exiguobacterium sibiricum 255-15
MTTLDRKIDFTVILSVTKANPNGDPLNGNRPRQNYDGYGEISDVAIKRKIRNRLQDMGESIFVQSNDRNLDGYASLRDRAEANDTIKKLMKTKNASDQVAAEACATWMDVRAFGQVFAFKGDKAGGVSVGVRGPVSIHTATSVAPIDVTSMQITKSVNSESGKERGSDTMGMKHRVDHGVYVFNGSINTQLAEKTNFTQEDAEKFKLALVSLFENDASSARPEGSMEVHKVYWWEHDSKLGRFSSAKVHRAVSVQALTDEPKSFLDYEIKVDALEGFTPEILDGL

SEQ ID NO: 3869 - protein, 288 aa, Xanthomonas oryzae pv. oryzae PXO99A
MSAIANRYEFVYLFDVINGNPNGDPDAGNLPRLDPETNRGLVTDVALKRKIRNYVALEQEAQAGYAIYMQEKSVLNNQHKQAYAALGIEHEAKKLPKDEAKARELTSWMCKNFFDVRTFGAVMTTEVNSGQVRGPVQLAFASSVEPVLPLEVSITRVAVTNEKDLEKERTMGRKHILPYGLYRAHGFISAKLAERTGFSEDDLQLLWRALTNLFEHDRSAARGEMSARKLIVFKHEHQMGNAPAHVLFDKVTVERVAEVDAGPARSFADYRVTIDRALPAGVSVEELF

SEQ ID NO: 3870 - protein, 277 aa, Cellvibrio japonicus Ueda107
MSSLSKKIDFAIIFSVKNANPNGDPLNGNRPRTDYDGFGEVTDVCLKRKTRDRLQDAGEAIFVQSDEKKTDEYPSLRARAEGVLGKDVLNAKKTKPEAAAKKACETWFDVRAFGQLFAFKSEEKDGVSIPIRGPVSIHSAFSIEPISITSTQITKSVSGDGDGSKKSSDTMGMKHRVDSAIYVAYGAMSPQLAEKTGFNDADAETIKAILPKLFEGDASSARPEGSMAVEKVIWWKHDSKSGQHSSAKVHRSLTVNPDGSFFLADLDGLKPEIIDGF

SEQ ID NO: 3871 - protein, 282 aa, Streptococcus equi subsp. zooepidemicus MGCS10565
MLEHKIDFMVTVEVKEANANGDPLSGNMPRTNAKGYGLMSDVSIKRKIRNRLQDMGQSIFVQANERIEDEFRSLENRFSAQFDKNDKDDDIERRANELWLDVRSFGQVFTYLKKSIGVRGPVSISMAKSLEPVVISSLQITRSTNGMEPKGDSSRSSDTMGTKHFVDYGIYVIKGSINAHFAEKTGFSEEDADIIKQALVSLFENDASSARPEGSMRVREVFWFTHSNKLGNVSSARVFDLLVFDMETPDKDSYEAYGIHLDEENLAAYQAKGLTVEVLEGL

SEQ ID NO: 3872 - protein, 312 aa, Gluconacetobacter diazotrophicus PA1 5
MTEATAMQNRHEFVLFFDVTNGNPNGDPDAGNMPRLDPETNQGLVSDVALKRKVRNYVSLARPDMPGFEIYMSEGMALNRQHRKAWNAIMPEVTKDESFKTLPKDEDKARALTRWMCTNFWDIRTFGAVMTTSVNSGQVRGPVQFSFARSVEPVLPLEIAITRMAATTEADAESKGGRTMGRKHIVPYGLYRMHGYISAPLASHPVKGTGFSESDLELLLEALTGMFDHDRSAARGEMATRKLIVFRHESALGNARAQDLFDRVTVQRAYQGSAHPIGSAAIDNWPPARAWGDYQVLIDRDAVPAGIEIIER

SEQ ID NO: 3873 - protein, 317 aa, Desulfovibrio vulgaris str. 'Miyazaki F'
MSQPISKRYEFVLFFDVENGNPNGDPDAGNLPRLDPETSHGLVTDVCLKRKVRNYISIAKGNTEPHLIFIKEKSILNSTIRRPYEEDPATKACLQEWLAYKKNKKTPKPKEHYEDLAQKWLCQKHYDIRAFGAVMSTGEEEKNEDISSKIRMRAGQVRGPVQMAFARSVEPVVPLDISITRMAVATEREAEAQEGDNRTMGRKSIIPYGLYRAEGFVSAHLAAQTGFTDDDLELFWQALESMFEHDHSAARGKMASRALIVFEHEGALGNAPAHKLFELVASPRAEGSTGPARAFEDYAITVNDAGAPAGVRVIRRL

SEQ ID NO: 3874 - protein, 294 aa, Desulfitobacterium hafniense DCB-2
MNSEIKRATGLMVIEVVNSNANGDPDRESDPRQRPNGIGEISPVSFKRKLRDLVGDHDSVFYQNLPEVYVKNSDHYCILESRGRDRKSIQSEMSKDIKNFEQKSFLESTFVKKYWDARIFGNTFLEEGANKGFIKTGVVQFGVGTSISPVNIIRHTNTNKAGVQEGKNAGMAPLAFRIVEHGVYCMPFFVNPNYAAKTGCTQEDIDLLKLLIPKAYDLNRSAIRPDVRIRHAWYIEHLNALGSCPDYLLLEALTPKRIGDVTIASKSWADYEDKTDLPEELKAKVSSATDLMLV

SEQ ID NO: 3875 - protein, 288 aa, Geobacter daltonii FRC-32
MSLSNKIDFAVVFKVTNANPNGDPLNGNRPRTIYEGNGEVSDVCIKRKIRNRLMEAGQRIFVQSDDSKNDKHPSLKSRADEVLDGIKAADEKAKKACETWFDVRAFGQLFAFKAAGGKKGKAKEGEEPGDDKGVSIGIRGPVSVQSAFSISPVSLTSTQITKSVSGEGDGTKRGSDTMGMKHRVDRGIYTFYGSMNPQLAVKTGFSDADAAAIKAVLPRLFENDASSARPEGSMEVLKVVWWQHNCASGQCSSAKVHRSLNVMDTDDLNLLISFNELNGPVPEIIDGV

SEQ ID NO: 3876 - protein, 302 aa, Azotobacter vinelandii DJ
MSAIANRYEFVYLFEVTNGNPNGDPDAGNLPRLDPETNQGLVTDVCLKRKIRNYVALEKSDAEGKPEQSYVIYMQEKAVLNQQHEQAWKACEIPPDAKNGYKKLPADTAKAKSLTDWMCSNFFDVRAFGAVMTTGVNCGQVRGPIQLAFATSIDPIIPLEVSITRMAVTTEKEAEEQSGDNRTMGRKHIIPYGLYRAHGFISAKLAERTGFSEDDLALLWRALENMFEHDRSAARGEMAARKLIVFKHEHPMGNAPAHKLFDLVKVARTEGEADTPARSFADYQISIDRDGLPAGVSVQEYL

SEQ ID NO: 3877 - protein, 280 aa, Teredinibacter turnerae T7901
MSSLTKKIDFAIVVRVKNANPNGDPLNGNRPRIDYDGFGEISDVCLKRKIRDRLLDAGQTVFVQSDQKNVDGMKSLRERAESEEFGLGKAVLDSKKTPVDKAAQLACEKWFDVRAFGQLFAFKSAGKDGVSIPVRGPVTVQSGYSLAPIGITSIQITKSVSGEGDGSKKSSDTMGMKHRVDNAVYVAYGAMSPQLAERTGFTDADAAILKELLPKLFEGDASSARPEGSMAVEQVVWWEHSSKQGQYSSAKVHGSFSPNSDGELSITPLPGLEPEILQGF

SEQ ID NO: 3878 - protein, 288 aa, Aggregatibacter aphrophilus NJ8700
MSAIQNRYEFVYFFDVTNGNPNGDPDAGNMPRLDPESSKGLVTDVCLKRKIRNFVEISSENEAGYEIYVKEKSVLNLQNKRAYEALGIESEAKKLPKDEAKARDITAWMCKNFFDIRTFGAVMTTEVNSGQVRGPVQLAFAQSIDPIVPLEVSITRMAVTNEKDLEKERTMGRKYIVPYALYRVHGFISANLAAKTGFSDDDLAKLWQALMLMFEHDRSAARGEMAARKLIVFKHDSELGSQPAHKLFDAVKVERVNGESGTPASGFGDYKISVVSDGLNGVSVEELL

SEQ ID NO: 3879 - protein, 299 aa, Eggerthella lenta DSM 2243
MSDTIKNRYDFVVYFDVENGNPNGDPDAGNMPRIDPETSLGIVTDVCLKRKIRNYVETVKEGERGFEIYIKDGVPLNASDRRALDEFGVGTDDKAIKKLKKDDPALDEKIRDFMCETFYDVRTFGAVMTTFVKGALNCGQVRGPVQLTFARSVDPIIPQEVTITRVAITTEADAEKKGTEMGRKYVVPYALYRGEGYVSANLARKSTGFSEDDLALLWDAIVNMFEHDHSAARGKMAVRALVVFKHDSELGNAPSYKLFDAVSTQKKAGVEAPRSIDDYEEITVDEGAVPEGVTVLRMV

SEQ ID NO: 3880 - protein, 286 aa, Desulfofarcimen acetoxidans DSM 771
MSRLINKVDFAVILSVKNANPNGDPLNGNRPRENYEGYGEISDVCIKRKIRNRLQDLGQDIFVQSDERRTDGFRSLKDRADGCAELKKAGKDKERYAAIACEKWIDVRSFGQVFAFKKGDEDSSVSVGIRGPVSIHSAVSVLPIEISSMQITKSVNGETGKDPDKKSPDTMGMKHRVEFGVYVFCGSINTQLAAKTGFSGEDSELIRKALITLFENDCSSARPDGSMEVCKLYWWKHNSQSGQYSSAKVHRSLRVEPKAENPKNIADFEISLEILDDLSPEIYDGI

SEQ ID NO: 3881 - protein, 316 aa, Zymomonas mobilis subsp. mobilis NCIMB 11163
MTVITNRYDFALVFDVVNGNPNGDPDAGNLPRVDPETNRGLVTDVSLKRKIRNYVDLARHAEEGFHIYVEEGAILNNKNREAYTAIRGDDMKSGKGGKLNPENDDEAKKLTDFMCRNFFDVRCFGAVMATGVNCGQVKGPVQMSFARSVEPILPLEITITRMAATNEAEKKKGAEGDDSNSRSDNRTMGRKYIVPYGLYVAHGFISAKFAERTGFSEQDLQLLFDALKNMFEHDRSAARGEMATRKLIVFKHENALGNAPAHILFDRIKIGRNIDNQIHPIDSRLDNLLPARAFSDYIVDIDRENFPAGVEILELI

SEQ ID NO: 3882 - protein, 291 aa, Halothiobacillus neapolitanus c2
MSLTNRYDFVLLFDVKDGNPNGDPDAGNLPRMDAETGHGLMTDVSLKRKVRNFVGIAKGEQPPYEIYVKEKAILNNQHKRAYVGIGREELLAGDDKKRKGGDAVDDARQWMCRNFFDVRTFGAVMSTGINCGQVRGPVQLTFARSIDPIIAQEHSITVCAARKEDKPIEEQIGIQGRKHTVPYGLYMAHGFISSFLAKQTGFSEDDLELLWQALTQMFEHDRSAARGEMTTRGLYVFKHDSELGNAPAHALFERIQPKLKPGISVPRNFTDYEVWVDEADFPAGVTLLKKF

SEQ ID NO: 3883 - protein, 298 aa, Acidaminococcus fermentans DSM 20731
MEENKAIRNRYDFVVLFDVENGNPNGDPDAGNMPRVDPETGLGLVTDVCLKRKIRNYVEAAKEDQPGYQIYVRETVPLEVNDKKALEYLGVEDVKKIDKKKDPEADRKIRDFMCSNFYDIRTFGAVMTTFVKGALSCGQVRGPVQLGFAHSIDPIMPQEITITRVAITTTKRQEEGRSTEMGRKYIVPYGLYRVEGYVSANLARKSTGFSEEDLQLLWQAIINMFENDHSAARGNMAVRELIVFKHDSELGNAPSYKLFERVKVEKKDPRKAPRSYHDYQVTVDTENLPEGVACQRMV

SEQ ID NO: 3884 - protein, 326 aa, Meiothermus ruber DSM 1279
MSQPIQNRYEFLLFFDVKDGNPNGDPDSGNAPRIDPEDGHGLVSDVALKRRVRNYAQIAGASIFVQHSTNLNRPIFEAHVKSQGGFTGSKTKDKVEAARRWMCEQFFDVRTFGAVMSTGANAGQVRGPVQITFARSLDPIFPAEFSITRGAVAEDVKNAKTLEDYLRWEAEQPEDKLRTMGRKSQVSYGLYMAKGFISAHLAEQTGFSEADLKLLVEALMNMFEHDRSASKGHMATRRLYLFKHVGNGDPNNAEQNRRQARLGCAPAHRLLELGQVVSVERLDEGRPPRSFTDYRITADPAQLPKGVRMLELSEWDEARFDAWMGV

SEQ ID NO: 3885 - protein, 293 aa, Stackebrandtia nassauensis DSM 44728
MSEAHLDPTMRHDAVLLFDVTDGNPNGDPDAANQPRMDDETGQGIVTDVAIKRKIRDTVSLLKGDDPRFGIFVEAGHALNTRIAQALKESADDSDNARQWICDHYFDVRMFGAVLSTGDKIPGSKKRGAGQVYGPTQLTFARSIDAISPVEHTITRVTQTKQADIDAGESTELGAKWTVPYGLYRTHLHYSAPKATKTGVTADDLHTLWKAIQFMFEHNHSAARGEMKLCGLYVFSHSSAVGDAPAHQLFNTIAISPLEADKPPRHHTDYRRQFEKASVPSRITSTVLTDLWP

SEQ ID NO: 3886 - protein, 294 aa, Nitrosococcus halophilus Nc 4
MSNPIQNRYEFVLLFDVQDGNPNGDPDAGNLPRVDPETGNGLVTDVCLKRKVRNYVGIAHGEQPPFEIYVKEKAILNHQHERAYKALDIDLSGDTGKRKGGENVEVARQWMCKNFYDVRTFGAVMSTGINCGQVRGPVQMSFARSVSPVVPLEHSITRMAVATEAEAEKQGGDNRTMGRKFTIPYALYRGHGYISAHLARQTGFSEEDLALLWEALTNMFEHDHSAARRQMSMRGLYIFKHDNALGHAPAHVLFDGITVQPRDGVSVPREFSDYQVTVNDTGLPQGVTLLRQVG

SEQ ID NO: 3887 - protein, 290 aa, Thermincola potens JR
MADVIKNRYEFVLLFDVENGNPNGDPDAGNMPRIDAETGLGLVTDVCLKRKIRNYVDIVKNGVEGYDIYVREGAILNAQHRRAYTAIGIEPNTKDKKLPADVQKAKEITDFMCHHFFDIRAFGAVMTTEVNCGQVRGPVQLNFARSIDPIVQQEVTITRMAVTSEKDAEKKDREMGRKHIIPYALYRVEGYISAHLAEKTGFSMDDLQLLWDALVNMFDHDRSAARGKMASRKLIIFEHESPLGNAPAHKLFDLVKVSRKDLGRPARSYEDYQVDLNSSALPAGVKIIEK

SEQ ID NO: 3888 - protein, 327 aa, Meiothermus silvanus DSM 9946
MSQPIQNRYEFLLFFDVQDGNPNGDPDSGNAPRVDPEDGHGLVSDVALKRRIRNYAQAAGAPIFVQHGTNLNRPIFEAHEKTGGFTGVKTKDKVEAARRWMCAHFYDVRTFGAVMSTGANAGQVRGPVQITFARSLDPIFPAEFSITRGAVAEDVKNAKTLEDYLKWEALQPEDKLRTMGRKSQVSYGLYLAKGFVSAHLAQGTGFSPADLKLLVEALLNMYDHDRSASKGLMATRRLFLFQHVGTDPHNAEQNKRQAMLGCAPAHRLLDLGQVVSVRRLDESKPPRRFADYEVKADPQKLPKGVRMLELNQWDEERFDVWLGGAHA

SEQ ID NO: 3889 - protein, 368 aa, Syntrophothermus lipocalidus DSM 12680
MAQELCFNPDRKHDFVFLFDVVNGNPNGDPDAGNMPRIDPETNHGFVTDVALKRKIRDYAALVHGKAIFVQSKVALNTLYYNSMAEHGYAFPEVEVNDEGLLEWLVNEAADVFDVNEDLKKVRYIREMKNQKDILDTVKEEVGEVPPEIRPKLEQLVKDLVAAGRNLKKLSASDRDAIKEVMTKRYYDMRMFGAVLTAGTNAGQVRGPVQLTFARSISPILPMDVSITRVAITREADKRSKQTEMGRKPIVPYGLYRCHGFYNPKLAERLTSKGNPVTSEDLAVLWEALGNMFEYDRSAARGEMTCRGLYIFSHDDEKGLGKAPAHKLFDLIRIEQKEPSKPPRSFDDYEIVVNQKELPPGIELKAYV

SEQ ID NO: 3890 - protein, 299 aa, Truepera radiovictrix DSM 17093
MTATIQLPTDAANRHDFVLLFDVTNGNPNGDPDAGNLPRVDPETGLGIVTDVALKRKVRNYVDALKGTEERYKIYVQQGAILNNQHARAYSALGKDPKKANQADIGAAKAWMCENFYDIRTFGAVMSTDVNAGQVRGPVQLTFGRSVDPILGLDAAITRVALTKPDPKQAAEDETARSGTMGRKAYIPYGLYVAHGFFVPSFAKATGFDDNDLTLLWQALVNMWDLDRSASRGLTGCRGLYVFSHSSPLGNAPAHKLLERVQVRRKDGVEAPRAFSDYTVTVNQDDLPDEVQLHVLAEG

SEQ ID NO: 3891 - protein, 288 aa, Sediminispirochaeta smaragdinae DSM 11293
MEAIKNRYEFVLLFDVENGNPNGDPDAGNLPRIDAETSKGIVTDVCLKRKIRNYIEIKHGHEAGYHIYVKEKGVLNAQHELAYKALGLKPEPKKLPKDEAKARELTEWMCTNFFDIRTFGAVMTTEINCGQVKGPVQLNLAKSIDPVMPSELSITRMAVTKEADKEKERTIGKKTLIPYGLYRVEGYISAHFAERTGFNETDLNELWDAFKNMFDHDRSASRGKMSPQKLIVFKHDSALGNAPAHKLFDLVDIKRIGNTDQPPRSFQDYEVVMNDNPFNGVTIQTLLD

SEQ ID NO: 3892 - protein, 292 aa, Desulfarculus baarsii DSM 2075
MSQVLENRYEFVYLFDVENGNPNGDPDAGNMPRLDPETNHGLVTDVCLKRKVRNYVQLAKEEAAGFKIYVKEKALLNQLHELAYVNNPDIERPDKKKLPKKQEEAQKITRWMCDNFYDIRTFGAVMSTEINAGQVRGPVQFNFSRSVEPILPMEISITRMAVTNEADLQKERTMGRKHIVPYALYRGEGYVSAPLAQQTGFGPDDLELLWEALCNMFEHDRSAARGKMSARRLYVFKHDSRLGSAPAQKLFDLVRVARKDAEAKAPARSFGDYQVSVDRAGLPQGVTVEEML

SEQ ID NO: 3893 - protein, 291 aa, Spirochaeta thermophila DSM 6192
MAITNRYDFLYIFDVENGNPNGDPDAGNMPRIDPETNLGWVTDVCLKRKVRNYVLIKHKDTPPYKIYVKEKAILNLLHKEALEEVGADLSSDKGRKGSREEVEKARKWMCEHYYDVRTFGAVMSTTYDCGQVRGPVQFSFARSVDPITPVEVSITRMAVTREEDAEKQQGDNRTMGRKHVVPYGLYVARGFVSAPLSQDTGFSDADLELLWEALCNMFEHDRSAARGVMSARKLIVFKHQSELGNAPAQKLFGAVSISRKDETAPPRSFEDYTISLNREVVPKEVEIIEML

SEQ ID NO: 3894 - protein, 316 aa, Ketogulonicigenium vulgare Y25
MTTLSRRHDFVLIFDVTNGNPNGDPDAGNQPRLDPETGHGLVSDVSLKRKIRNYVELAHEGKDGHHIYVQEGAILNEKHRAAYIAKRPGDEKAKTDKKLNPKDDAEAKELRDWMCANFFDVRTFGAVMSTGINCGQVKGPVQMTFATSVERILPAEITITRMAATNEAEKKKAEEGSDGDQRTENRTMGRKHIVPYGLYVAHGFVSAKFAERTGFSEADLDLLLEALKNAFEHDRSAARGEMATRKLIVFKHENALGNAPAHELFDRVRIGRNLAGEFRPIGDSRLDNQPPARKFGDYLIEIDREALPAGVDIIEL

SEQ ID NO: 3895 - protein, 290 aa, Desulfovibrio vulgaris RCH1
MTAIANRYEFVLLFDVENGNPNGDPDAGNMPRIDPETGHGLVTDVCLKRKIRNHVALTKEGAERFNIYIQEKAILNETHERAYTACDLKPEPKKLPKKVEDAKRVTDWMCTNFYDIRTFGAVMTTEVNCGQVRGPVQMAFARSVEPVVPQEVSITRMAVTTKAEAEKQQGDNRTMGRKHIVPYGLYVAHGFISAPLAEKTGFSDEDLTLFWDALVNMFEHDRSAARGLMSSRKLIVFKHQNRLGNAPAHKLFDLVKVSRAEGSSGPARSFADYAVTVGQAPEGVEVKEML

SEQ ID NO: 3896 - protein, 285 aa, Ruminococcus albus 7 = DSM 20455
MAVLQNKIDFSVILTAKNANPNGDPLNGNRPRENYDGFGEISDVCIKRKIRNRLQDMGEKIFVQSDDRCGDGFKSLHDRAKGCETLAALSKAKNTDRDEYAKAACAEWIDVRSFGQVFAFKGDSVSVGVRGPVSIQMAESISPVDIVSMQITKSVNGESGKESKASDTMGSKHRVDFGLYVFHGSINVQLAEKTGFTEEDAEKIHEALETLFENDCSSARPEGSMEVRRVYWYKHECKTPTNSSAKVHRLLKVTLRDGIDRPKCFEDYDITLDKLEGLDPEIFEG

SEQ ID NO: 3897 - protein, 282 aa, Ethanoligenens harbinense YUAN-3
MGTLSNKIDFAVVLSVKNANPNGDPLNGNRPRETYEGLGEISDVCIKRKIRNRLLDMGQPIFVQSDDRRVDGFKSLRERADACTELKKAETAKDKDAFAKAACTAWMDVRSFGQVFAFKGSDVSVGVRGPVSVHPAFSIEPIDAVSIQITKSVNSVTGDKKSSDTMGMKHRVPFGVYTFFGSISCQLAEKTGFTDEDAELIHQALRSLFENDSSAARPDGSMEVYKVIWWKHNCKTGQYSSAKVHRSLNVLPRDGGDPRDVTGYAVTADALDGLQPEIEDGI

SEQ ID NO: 3898 - protein, 317 aa, Rhodopseudomonas palustris DX-1
MSPLANRYDIVFLFDVTRGNPNGDPDAGNLPRIDPETNFGLVTDVSLKRKIRNYTELAKGDQPGYRIYVQEGSILNEKHREPYKAIRGDTDKVAKAEKLNPQNDDEARAITKFMCDNFYDVRSFGAVMSTGINAGQVRGPVQVTFATSIEPILPLEISITRMAATNAKEKAERDKAGGDDERTENRTMGRKHIVPYGLYRAHIFVNAKLAERTGFSQDDLDHLFTSLSVMFEHDRSAARGEMVSRRGIAFKHASALGNAHAQALFDRVEIWRRVGEDLIKPGDSRLDNYKPARQYADYEVTIKRDGLPDGIEVVELF

SEQ ID NO: 3899 - protein, 308 aa, Bacteroides helcogenes P 36-108
MEAIKNRYDFVFLFDVKDGNPNGDPDFDNMPRTDEETNHGLVTDVCIKRKIRNYVQLAEGLQSPYDIFIREGNVLNPLIQKVRDEADKKIEDEKKAVESGRGEMCKNYFDIRTFGAVMSTGDEKVEDENDGDKTKGKSPKKKIKGLGVVRGPVQLTFARSIDPVFAKSHSVTRCCVTKKDAKGNNTIGNKNTVSYGLYRMHGFISATDAAKTGFSEDDKKLLFDAMINAFENDHAAARGEMNPRALFVFKHESHLGNARAGELFDLVQIKNKEVDFPRSFGDYEVTSKEEIEAILKERFPKVTVEELI

SEQ ID NO: 3900 - protein, 286 aa, Desulfobulbus propionicus DSM 2032
MRNPIQNRYDFVLLFDVKDGNPNGDPDAGNLPRIDPETGHGLVTDVCLKRKVRNYVQLEKGGAVAFDIFVKERAILNNLIDEAHEQDIVKSKEKGDKTEAARQFMCGKYYDVRTFGAVMSTGKNAGQVRGPVQFTFARSVDQIVPLEHSITRMAVATEAEAEKQQGDNRTMGRKFTVPYALYCCHGFISAPLAAQTGFSEDDLNLFWQAVINMFEHDRSAARGLMSSRKLFVFKHENKMGNAPAHKLFDLIDIQRAEGSTGPARSFKDYVVKVGAAPDGVTLLEKL

SEQ ID NO: 3901 - protein, 297 aa, Acidovorax avenae subsp. avenae ATCC 19860
MTAIAHRYEFVYLFDITNGNPNGDPDAGNLPRLDPETNRGLVTDVCLKRKIRNFVTLDKEDTPGHAIYMQEKAVLNQQHQKAWEALGIPPDAKEQFKKLPKEEAKAREITAWMCANFFDVRTFGAVMTTGVNAGQVRGPVQMAFATSIDPVVPLEISITRMAVTTEKEAEAQSGDNRTMGRKHIIPYGLYRAHGFVSAKLAERTGFSDADLELFWRALINMFEHDRSAARGEMAARKLIVFEHESAMGNAPAHVLFDAVKVARARPDADAAPRRFADYRVEVDHAAVPQGVTVRELI

SEQ ID NO: 3902 - protein, 288 aa, Syntrophobotulus glycolicus DSM 8271
METLKNKIDFAVIINVKNANPNGDPLNGNRPRVNYDGIGELTDVCIKRKIRNRLMEAGYAIFVQSDDNRIDEYPSLRKRVEGEISKDDWKDEKKFREAVCKKWIDVRAFGQVFAYEGGKKGEGVSIGVRGPVSMHSAFSVAPVLERISSIQITKSVSSEGDGTKRSSDTMGMKHRVDHGVYVFYGSMNPQLASKTGFSDEDAEAIKKVLVNLFENDASSARPEGSMEVYKVYWWKHNCKNGQYSSAKVHGALKVEVKLDVDVPKDIEKDYDITLQPLSELNPEIIPGR

SEQ ID NO: 3903 - protein, 295 aa, Rubinisphaera brasiliensis DSM 5305
MDNRYDFVYLFDVTDGNPNGDPDAGNLPRLDAETGQGLVTDVCIKRKIRNFIGVTREEQPPFEIYIKEKAVLNQQHERAYKALDLEPDSKKRKSKGEARAAEDRNIRQWMCDNFFDIRTFGAVMTTGVNAGQVRGPLQFTFGRSIDPIISSEHSVTRCAVTTEKEAEAQQGDNRTMGRKFTVPYGLYRMHGFINANLAAQTGFNKNGEDLDLLWSALTNMFDLDRAAARGQMAPQALIVFKHDSQLGNAPAHKLFERVKVSRAAENGTPPRSFSDYQVDINDADLPSGISIERKF

SEQ ID NO: 3904 - protein, 295 aa, Rubinisphaera brasiliensis DSM 5305; identical to SEQ ID NO: 3903

SEQ ID NO: 3905 - protein, 291 aa, Nitrosomonas sp. AL212
MTIQNRYEFVYLFDVSNGNPNGDPDAGNMPRLDPESSKGLVTDVCLKRKIRNFIELTDEQTPGYEIYVKEKSILNLQNIKAYDALEIKHESKKLPKDTKKADEITRWMCEHFFDIRTFGAVMTTEVNCGQVRGPVQLAFAKSIDPIIPLEISITRMAVTTEKESEEQAGGNRTMGRKHIVPYGLYRVHGFISAKLAGKTGFSETDLEKLWQALSLMFEHDRSAARGEMAARKLVVFKHNDALGNVPAHVLFDRVKVERIHGDTDTPASSFSDYKISVDKANITDVIIDEKF

SEQ ID NO: 3906 - protein, 286 aa, Bacillus thuringiensis serovar chinensis CT-43
MKTLDHKIDFAVVLSVTKANPNGDPLNGNRPRQNYDGHGEISDVAIKRKIRNRLQDMEESIFVQSNDRKVDQFNSLRERAETNVDLVKALKSKDNPHEQFAAIACKEWIDVRSFGQVFAFKGGAGKGVSVGVRGPVSIHTATSVDPIDITSMQITKSVNSEPGKDKGSDTMGMKHRVDFGVYVFYGSINTQLAEKTGFTNEDAEKIKNALVTLFENDASAARPEGSIEVHKVCWWDHNSKLGQYSSAKVHRLLEVKRNIDEPKTIDDYTVLVHELDDLKVEIINGM

SEQ ID NO: 3907 - protein, 33 aa, Bacillus thuringiensis serovar chinensis CT-43
MSEPGKDKGSDTMGMKHGVDLGAYIFYGSIHMQ

SEQ ID NO: 3908 - protein, 74 aa, Bacillus thuringiensis serovar chinensis CT-43
MFGNDGSAARPEGSIEVHKVCWWKHNSKLGQYSSAKVHRLLDIKRNIDEPKIIDDYNILVKELDILKVAIIDGL

SEQ ID NO: 3909 - protein, 74 aa, Bacillus thuringiensis serovar chinensis CT-43
MFENDASAARPEGSIEVHKVCWWDHNSKLGQYSSAKVHRLLEVKRNIDEPKTIDDYTVLVHELDGLKVEIIDGM

SEQ ID NO: 3910 - protein, 37 aa, Bacillus thuringiensis serovar chinensis CT-43
MQIKKSVNSELGKDKGSDTTGIKHRVDFGVYVFLWKY

SEQ ID NO: 3911 - protein, 72 aa, Bacillus thuringiensis serovar chinensis CT-43
MFFYGSINTQLAEKTGFTNEDAEMMKNALVPLIENDASAARPEGIIEVHRVCWWDHIVQNLVNTPLQKYIVY

SEQ ID NO: 3912 - protein, 294 aa, Selenomonas sputigena ATCC 35185
MAEAIKNRYDFVILFDVENGNPNGDPDAGNMPRVDQETGYGLVTDVCLKRKIRNYVETAQEGKPGYRIYIKENVPLVQSDQEACDHLGIKDIKKVKASDPAIDGKIRDFMCSNFFDIRTFGAVMTTFVQGALNCGQVRGPVQLGFARSIDPILPQEITITRTAITTVKDAQTKKTEIGRKFIVPYALYKVEGYVSANLARKTTGFSEEDLALLWQAILRMFELDRSAARGNMATRELIVFRHESELGNAPSYKLFERIHVKKKATEEPARSYQDYEVTVDEADLPEGVTCTRMS

SEQ ID NO: 3913 - protein, 289 aa, Porphyromonas asaccharolytica DSM 20707
MLQNRYDFILLFDVKDGNPNGDPDSDNLPRVDPETGEGLVTDVCIKRKVRNYIQMATDQGIFVRENSVLNDSINAAVEEATGKDAKTKNATDRDKARALMCQKYYDIRAFGAVLSTGNNAGQVRGPIQLTFARSIDPIFPHEHTITRMAATDTKEQKANEEADDKGGNRTMGRKATVPYGLYKMYGFVTPHFAEDTGFTEDDLQLFWEALKNMFDLDHSAARGLMSLQKLIVFKHDSPLGNAPAHKLFERVTIARREGLTSPARDFSDYTVQIDRDGLQGVQVDDIELV

SEQ ID NO: 3914 - protein, 280 aa, Treponema brennaborense DSM 12168
MAVLENKIDFALVFSVKNANPNGDPLSENMPRTTLEGYSEVSDVCLKRKIRNRLLEAGNPIFVQSDDNRVDEYRSLLNRAKGVLGNAAKSEDELRKKSCETWLDVRSFGQVFAYKGDDKTGISVGIRGPVSIQSAFSVTPVNVTSMQITKSVSGEGDGSKRGSDTMGMKHRVDFGLYVTYGSINPQLAEKTGFSAEDAEQIKNALLHIFDNDASSARPEGSMEVISVYWWKHNCKSGQYSAAKVHRSLRITAKTANPKAADDFDIIVDSLDGLKPEILSF

SEQ ID NO: 3915 - protein, 294 aa, Desulfotomaculum nigrificans CO-1-SRB
MANPIEKRYEFVLFFDVENGNPNGDPDAGNLPRIDPETSLGIVTDVCLKRKVRNYVDIAKRDKEGNTLPGYDIYVRESHALNAQHRKAYSFIGREPEPKKLPKDVAEAEKVIRFMCNNFFDIRTFGAVMTTEVNCGQVRGPVQFNFARSIDPIVQQEITITRMAVTNEKDLEKKDREMGRKYIVPYALYRVEGYISAYLAQKTGFSEDDLNLLWEALINMFEHDHSAARGKMASRKLFVFEHETALGNAPAHKLFELIKVEKVDSSKPARSFHDYVIRFDSSKIPQGVRCEEKL

SEQ ID NO: 3916 - protein, 291 aa, Methylomonas methanica MC09
MTIQNRYEFVYLFDVSNGNPNGDPDAGNMPRLDPESSKGLVTDVCLKRKIRNFIELTDDKTPGYEIYVKEKSILNLQNTKAYDALEIKHESKKLPKDTKKADEITRWMCEHFFDIRAFGAVMTTEVNCGQVRGPVQLAFAKSIDPIIPLEISITRMAVTTEKESEEQAGGNRTMGRKHIVPYGLYRVHGFISAKLAEKTGFSESDLEKLWQALGLMFEHDRSAARGEMAARKLVVFKHNDALGNVPAHVLFDRVKVERINGEKDTPASSFSDYKISIDKTDLQGVAIDEKF

SEQ ID NO: 3917 - protein, 284 aa, Desulfotomaculum ruminis DSM 2154
MSTLQNKIDFAAIVSVTRANINGDPLNGNRPREDYEGHGIFSDVAIKRKLRNRLQDLGECIFVQSDDRSNDGYKSLKDRADGYGEFKTEMSKGKKADRDKCMQIACRKWFDVRAFGQVFAFKGDEVSVGVRGPVSVQQAVSVSPIDIVDMQITKSVNSEAGKSGKSSDTMGMKHYVNFGLYVIRGSINCQLAEKTGFTAGDAQKLKEALCTLFENDASSARPEGSCEVCRVYWWEHADKTPKETSAVIQRALRISSKKDIPQSFDDYEIKLDQTECVPEIINLV

SEQ ID NO: 3918 - protein, 282 aa, Streptococcus parasanguinis ATCC 15912
MLENKIDFMVTIEVREANANGDPLSGNMPRTDAKGHGLISDVAIKRKIRNRMQDFGHPTFVQAGDRIEDEFRSLEKRFSNQFNSKDSDEDIEDQANKLWLDVRSFGQVFTYLKKSIGVRGPVSINMAKSLEPIVISGLQITRSTNGMEAKNESGRSSDTMGMKYFVDYGVYLLKGSINPNFAEKTGFSTEDVEVIKQALVSLFENDASSARPEGSMRVREVFWFTHSNKLGNISSARVFDLFEFDKENQEKNTYEDYGIHLNQEKLAEYENKGLKVDILEGL

SEQ ID NO: 3919 - protein, 316 aa, Zymomonas mobilis subsp. pomaceae ATCC 29192
MTVITNRYDFALVFDVVNGNPNGDPDAGNLPRVDPETNRGLVTDVSLKRKIRNYVDLARHAEEGFHIYVEEGAILNNKNREAYTAIRGDDLKSGKGGKLNPENDGEAKKLTDFMCRNFFDVRCFGAVMATGVNCGQVKGPVQMSFARSVEPILPLEITITRMAATNEAEKKKGSEGDDSNSRSDNRTMGRKHIVPYGLYVAHGFISAKFAERTGFSEQDLQLLFDALKNMFEHDRSAARGEMATRKLIVFKHENALGNAPAHILFDRIKIGRSIDNQIHPIDSRLDNLPPARAFSDYIVDIDRENFPAGVEILELI

SEQ ID NO: 3920 - protein, 289 aa, Treponema caldarium DSM 7334
MAGISNRYEFVLFYDVENGNPNGDPDAGNMPRIDPETGYGIVTDVCLKRKIRNYVEMVKGDAPGYRIYIKEGIPLNQNHAEAYLALQLNPGDKNVKIDDIQRARAWICANFFDVRTFGAVMTTGDNCGQVRGPVQINFSRSIDPIVQQEVTITRQTVTRIEEAEKERTMGRKHIVPYGLYRAEGYISARLANDPSKGTGFSEEDLQLFWDALINMFEHDRSAARGKMATRKLFVFKHDSELGNAPAHVLFDLITANKKNNSIVPRSFNDYQILVDETKVPEGITLIKML

SEQ ID NO: 3921 - protein, 316 aa, Ketogulonicigenium vulgare WSH-001; identical to SEQ ID NO: 3894

SEQ ID NO: 3922 - protein, 295 aa, Roseburia hominis A2-183
MGEAIRNRYDFVVLFDVENGNPNGDPDAGNMPRIDPETGYGLVTDVCLKRKIRNYVETLKEDTTGYKIYIKDNVPLNRSDLGAFQSLGIDEKEIKNLKKTDPMLDVKVRDFMCQNFYDIRTFGAVMTTFVKANLNCGQVRGPVQMGFAKSVDPILPQEITITRVAITTEEDAAKKGTEMGRKYIVPYGLYRVEGYVSANLARKVTGFSEEDLELLWKAILNMFENDHAAARGKMAVRKLIIFKHDSELGNAPSYKLFEAVKVARKPGVDLARAFSDYEVTLPEQLPEGVTCTCME

SEQ ID NO: 3923 - protein, 317 aa, Rhodospirillum rubrum F11; identical to SEQ ID NO: 3853

SEQ ID NO: 3924 - protein, 45 aa, Bacillus coagulans 36D1
MNINSIIDPNKRYDFVLVFDVTDGNPNGDPDAGNLPRQDKLFELD

SEQ ID NO: 3925 - protein, 296 aa, Pseudoxanthomonas spadix BD-a59
MSAIAHRYEFVYLFDVTNGNPNGDPDAGNLPRLDPETNRGLVTDVALKRKIRNYVALEKENEAGYAIYMQEKAILNQQHQKSWEALGIAPDVKDGFKKLPKDEAKARELTAWMCGNFFDVRTFGAVMTTGVNAGQVRGPVQLAFATSVEPVLPLEVSITRVAVTTEKESEAQSGDNRTMGRKHIIPYGLYRAHGFVSAKLAERTGFSEDDLQLLWRALTNLFEHDRSAARGEMAARKLVAFEHEHPMGNAPAHALFDKVKVTRVEGQSETPARGFADYRVHIDRELPVGVTLIEVF

SEQ ID NO: 3926 - protein, 284 aa, Desulfosporosinus orientis DSM 765
MSILQNKIDFAAIVSVTRANINGDPLNGNRPREDYDGHGIFSDVAVKRKLRNRLQDLGECIFVQSDDRSDDGHKSLKDRADGYEEFKAEMGKGKKADRDKCMQIACRKWFDVRAFGQVFAFKGDEVSVGVRGPVSVQQAVSVSPIDIVDMQITKSVNSEAGKSGKSSDTMGMKHYVNFGLYVIRGSINCQLAEKTGFTHEDAEKFKEALRTLFENDASSARPEGSCEVCRVYWWEHREKTPKETSAMIQRALHITPKKDVPQSFDDYEIELEPTECVPEIIDLV

SEQ ID NO: 3927 - protein, 291 aa, Sphaerochaeta pleomorpha str. Grapes
MELQKRYDFILLFDVRDGNPNGDPDAGNLPRIDPETGNGLVTDVCIKRKIRNYVDIVKGNQPPYEIYIKEKAILNNSNKRAFEALGVDLAKDTSKRKGGDKTEEAKLWMCKNFFDIRTFGAVMTTKINCGQVRGPVQFTFARSIDPVIAAEHSITRMAVTTEEEAEKQSGDNRTMGRKYTIPYGLYQIHGFISPHLARQTGFDTDDLELLWDSLLNMFDYDRSAARGFMSTQRLIIFEHSSLLGDKPAQDLFARVSVERKTDQDKPARSFSDYKVTLDGQLLDNKKNIIPV

SEQ ID NO: 3928 - protein, 117 aa, Aggregatibacter actinomycetemcomitans ANH9381
MGRKFTVPYGLYRCHGFISAHFAKQTGFSEEDLALFWKALINMFDHDHSAARGQMNARGLYVFEHSSSLGDAPADSLFKRIRVAKKDGVEVARNFDDYTVSVDETNLGETKLDRKLG

SEQ ID NO: 3929 - protein, 285 aa, Clostridium sp. BNL1100
MSTLKNKIDFAVIISVKNANPNGDPLNGNRPRENYDGYGEISDVCIKRKIRNRLQDTNKEIFVQSDERRTDGFRSLKDRADGCQELKKLIKDKEKYAEYACSKWIDVRSFGQVFAFKAGEDNSVSIGIRGPVSIHSGVSASPIEISSMQITKSVNGETGKDPDKKSADTMGMKHRVDFGVYVIYGSINTQLASKTGFSEEDSELIKEALRTLFENDCSSARPDGSMEVHKLYWWKHNCEIGQYSSAKVHRTLNIKANVDVPKCINDYSIYSNDLEGLELKVYDGI

SEQ ID NO: 3930 - protein, 297 aa, Aggregatibacter actinomycetemcomitans D7S-1
MSLSKKIDFALILKVTNANPNGDPLNGNRPRADFQGFGEMTDVCLKRKIRDRLQDGGESIFVQSDEKKTDGMTSLANRAKDKDVGLGAEAFNAKKANKDETAQKACEKWLDVRSFGQVFAFSGDGSTGISIAVRGPVTVQSAFSIEPINITSTQITKSVSGEGDGTKKSSDTMGMKHRVDHGVYVAFGAMSPQLAERTGFSDDDAEKIKAVLTKLFEGDASSARPEGSIQVLKLIWWEHNCKAGQYSSAKVHGKLKEIIEKRVKDNSINQLLEDVTEDKLTVMENGMSLKPEILDGF

SEQ ID NO: 3931 - protein, 288 aa, Aggregatibacter actinomycetemcomitans D7S-1
MATVQNRYEFVYFFDVTNGNPNGDPDAGNMPRLDPESSKGLVTDVCLKRKIRNFIEISAENQPGYEIYVKEKSVLNLQNKRAYEALGIESEAKKLPKDEVKAREITAWMCKNFFDIRTFGAVMTTEVNSGQVRGPVQLAFAQSIDPIVPLEISITRMAVTNEKDLEKERTMGRKYIVPYALYRVHGFISANLAAKTGFSDDDLAKFWQALQLMFEHDRSAARGEMAARKLIVFKHDNALGSLPAHKLFDAVKVERVNGELGTPAGGFGDYKISVHSDDLKGVSVEEYL

SEQ ID NO: 3932 - protein, 344 aa, Desulfomonile tiedjei DSM 6799
MSNTIGNRYEFMYMFDCENGNPNGDPDAGNSPRIDPEDMRGLVSDVAQKRRIRNYVQIAKQNILPYGIFVQHGTNLNTKIALAHEKSGGMPPFDEKKKKWKTNGEKAAAAGKWLCSNFYDVRTFGAVLSTGPNAGQIRGAVQLSFARSVDPILPLDLSITRMAVTDNEIKGPDVGSKDFEQWEKIQPEDQLRTMGRKNLIPYGLYVAKGFISAHLAEGTGFSEQDLSIFWDALLNMFEHDRSASKGIMSVREPIVVFKHIGTDTNSDQRKQQAKLGCAPAHKLFDLIDVRKRDEVEVPRSFSDYRVLFDKSKLPKGVQVGFVLSGENGKAHIQWDVVPEMVIAH

SEQ ID NO: 3933 - protein, 284 aa, Desulfosporosinus acidiphilus SJ4
MSILQNKIDYTAILSVTRANINGDPLNGNRPRGDYEGYGIFSDVAIKRKLRNRLQDLGECIFVQSDDRSDDGHKSLKDRADGYAEFKAEMSKGKKADKDKCMQIACRKWFDVRAFGQVFAFKGDEVSIGVRGPVSIQQAISVSPIDIVDMQITKSVNSEAGKSGKSSDTMGMKHYVNFGLYVIRGSINCQLAEKTGFTDEDAKKLKEALCTLFENDASSARPDGSCEVCRVYWWEHAEKTPKETSAMIQRALHITPKKDVPDSFGAYDIVLDRTECVPEIINLV

SEQ ID NO: 3934 - protein, 286 aa, Bacillus thuringiensis MC28
MTILNHKIDFAVVLSVTKANPNGDPLNGNRPRQNYDGYGEISDVAIKRKIRNRLQDMEESIFVQSNDRRVDQFNSLKERAENNVDLIKVLKSEENPYEQFAAIACKEWIDVRSFGQVFAFKGGAGKGVSVGVRGPVSIHTATSIDVIDITSMQITKSVNSEPGKDKSSDTMGMKHRVDFGVYVFYGSINTQLAEKTGFTNEDAEKIKSALVTLFENDASAARPEGSIEIQRVCWWEHNSKLGQYSSAKVHRLLDINRNIDEPKTIDDYTILVHELDGLKVEIIDGL

SEQ ID NO: 3935 - protein, 282 aa, Streptococcus pyogenes A20
MLEHKIDFMVTLEVKEANANGDPLNGNMPRTDAKGYGVMSDVSIKRKIRNRLQDMGKSIFVQANERIEDDFRSLEKRFSQHFTAKTPDKEIEEKANALWFDVRAFGQVFTYLKKSIGVRGPVSISMAKSLEPIVISSLQITRSTNGMEAKNNSGRSSDTMGTKHFVDYGVYVLKGSINAYFAEKTGFSQEDAEAIKEVLVSLFENDASSARPEGSMRVCEVFWFTHSSKLGNVSSARVFDLLEYHQSIEEKSTYDAYQIHLNQEKLAKYEAKGLTLEILEGL

SEQ ID NO: 3936 - protein, 282 aa, Streptococcus agalactiae
MLEHKIDFIVTFEVKEANANGDPLNGNMPRTDAKGYGVMSDVSIKRKIRNRLQDMGKPIFVQANERIEDDFRSLEKRFSQHFTAKTPDKEIEEKANALWFDVRAFGQVFTYLKKSIGVRGPISISMAKSLEPIVISSLQITRSTNGMEAKNNSGRSSDTMGTKHFVDYGIYVLKGSINAYFAEKTGFSQEDAEAIKEVLVSLFENDASSARPEGSMRVREVFWFTHSSKLGNVSSARIFDLLEYNQSIEEKSTYDAYQIHLNQEKLAKYEAKGLTVKILEGL

SEQ ID NO: 3937 - protein, 389 aa, Pseudanabaena sp. PCC 7367
MTKHFDPNRRHDFVLLFDVTDGNPNGDPDGGNMPRTDPETLQGLVTDVSLKRKIRNYVATYAAHEAPDDQKARLKIFVEHHGVLNEQIRLAYTEQDIPTGKPADDNIDDAEILAGLRAIAADLPEAFTFVDRDDDASDDETEPANLAYSGELSDTEKKEALEQLEEVISELAIESAIAKKTITFIKNLTKKAGKPDKSRANAEKAQVWMCNNFFDVRMFGAVMSTGLNAGQVRGPVQITFARSIDPVLPQDLAITRMAVTTEADREKLQTMGRKTLIPYGLYLAYGFYSPYLAQNTGVNKFDLQLFWQALVNMWDFDRSASRGLMAPRGLYVFTHESKLGNAPAHKLFERITVRLKNPNSTPRSFKDYELIVNTDNLPDAITLTDLLAE

SEQ ID NO: 3938 - protein, 379 aa, Chamaesiphon minutus PCC 6605
MTVHLDCQRRHDFVLLFDVTDGNPNGDPDGGNMPRTDAETSHGLVTDVCLKRKIRNYVSTYAEYEATEEQAKHLNIFVEHHGVLNNQIRRAYTEQGIPTGKPASEVIKENNVLETLREYKHLLPAAFTFTDSEGDTEEDVIATLAYSGELTDAELKEELEKTEEIYQNKAVKKFIDALVKKAGKPDKSRANAEKARKWMCENFYDVRMFGAVMSTGLNAGQVRGPVQLTFARSFDPVLPQDLAVTRVAVTDVKDAEKLQTIGRKTLIPYGLYMMRGFYSPSLAAQTGVNDRDLELFWESLVKMWDFDRSASRGLMAPRGLYVFSHESKLGNAPAHKLFDRITAQLDNPSEPPRKFGDYQVSIDDAELPSGVTLTRLTEG

SEQ ID NO: 3939 - protein, 292 aa, Thermobacillus composti KWC4
MNEKTLNNRYEFVLLFDVENGNPNGDPDAGNMPRIDAETGLGLVTDVCLKRKIRNYVELVKAGEPGYDIYVREGVVLNQLNKEAYDHHPEIELKESKEDRIEAKKKDDQLTLARWMCKKYFDIRTFGAVMTTGVNCGQVRGPVQLTFSKSIDPINPTEVSITRMAVTNEKDIEKERTMGRKAFVPYGLYRLEGYISAPLAQQTGFSEEDLELLWTALINMFEHDRSAARGKMASQKLFVFKHDTALGNAPANKLFQLVQVQRKDGVTVPRSFNDYEVTVGTAPQGVAIIEML

SEQ ID NO: 3940 - protein, 283 aa, Methanoregula formicica SMSP
MSEVIKSRYEFVLLFDVENGNPNGDPDMGNMPRVDPQTGYGIVTDVCLKRKIRDYVDMVKTGNEGYDIYVKDGVVLNEQHTKAYAALKRKPDSKKPKDDELAKFMCKNFFDIRAFGAVMALEVNCGQVRGPVQLTFARSQDPIFQQEVTITRQAVANVKDADKGQTMGKKQIVPYGLYRAEGYVSAHLAKKTTGFSEDDLALLWESLVNMFEHDHSASRGKLSARKLIVFKHDSELGCCQSHVLFDKVKIERLGKDLPPRSFKDYKVTIDKDVPKGVTIIEKL

SEQ ID NO: 3941 - protein, 281 aa, Prevotella dentalis DSM 3688
MEELKNRYDFIYLFDVVDGNPNGDPDAGNMPRIDAETGNGLVSDVCLKRKVRNYVQTTKGFEAPYDIFIKEGSVLNDTINNTAKDTKTKEEARKSMCNRFYDVRAFGAVMTTGKKNAGQVRGPIQLTFSRSVSPIITAEHTITRMAVTDAKDTDANEMGTRQTMGRKYTIPYALYQAQGFISANLARQTGFSCEDLQLFWEALKNMFDMDHSAARGQMCPRKLIVFKHSSELGNAPSYQLFDLVKVRQKDESKPARTFSDYEVSIDRANIPNGIELLDEMI

SEQ ID NO: 3942 - protein, 288 aa, Desulfocapsa sulfexigens DSM 10523
MSEIIKNRYDFVLFFDVQDGNPNGDPDAGNLPRMDAETGFGLVTDVCLKRKIRNYVQLVKEAKRPFDIFIKEKAVLNNLIDEPYETDEVKKQEKSAEKVESARQWMCTNYYDIRTFGAVMSTGKNAGQVRGPVQLTFSRSVDPIIATEHSITRMAVTTEAEAEAQHGDNRTMGRKYTVPYGLYRAHGFISPHLASQTGFSEEDLELLWQALRDMFDHDHSAARGLMGTRKLIVFKHDSALGNASAQQLFEMVANPRLKDPANPARAFSDYTNIEVTGDLPSGVTVLEV

SEQ ID NO: 3943 - protein, 280 aa, Bibersteinia trehalosi USDA-ARS-USMARC-192
MSLTKKIDFALIISVKNANPNGDPLNGNRPRTDFHGFGEITDVCLKRKIRDRLQDAGESIFVQSDEKKTDSMTSLANRAKDKDVGLGSDAFNAKKSSRDETAKKACKKWLDVRSFGQVFAFGKSDDGAGVSIAVRGPVTIHSAFSVAPVSVTSTQITKSVSGEGDGSKKSSDTMGMKHRVDGGVYVAYGAMSPQLAERTGFSDSDAEKIKSVLTKLFEGDASSARPEGSMQVVKLIWWEHNCKSGQYSSAKVHSSLKVNADGSYELNALDSLIPQEIDGF

SEQ ID NO: 3944 - protein, 326 aa, Meiothermus ruber DSM 1279; identical to SEQ ID NO: 3884

SEQ ID NO: 3945 - protein, 302 aa, Azotobacter vinelandii CA; identical to SEQ ID NO: 3876

SEQ ID NO: 3946 - protein, 302 aa, Azotobacter vinelandii CA6; identical to SEQ ID NO: 3876

SEQ ID NO: 3947 - protein, 283 aa, Streptococcus cristatus AS 1.3089
MLEHKIDFMVTVEVREANANGDPLSGNMPRTNAANQGLISDVAIKRKIRNRIQDFGHTIFVQANDRIEDGLNSLEKRFKTQFTGKESDEEINEKANQLWMDVRSFGQVFTYLKDRSFAIRGPVSVSMAKSLDPIIISSLQITRSTNGVEPKKAGGRSSDTMGTKHFVDYGVYVIKGSINPNFAEKTGFSNEDAEVIKEVLVSLFENDASSARPEGSMRVREVFWFTHSNKLGNVSSARVFDLFEFDKEKQDKDSYEDYAIHLNQEKLAEYEAKGLTVDILEGL

SEQ ID NO: 3948 - protein, 288 aa, Desulfallas gibsoniae DSM 7213
MAEAIKNRYEFVLLFDVENGNPNGDPDAGNMPRIDAETGLGLVTDVCLKRKIRNYVDIARGGNEGYDIYVREGAVLNVQHKKAYEHYELKPESKKLPKNEADAKKVTDFMCHHFYDIRSFGAVMTTEVNCGQVRGPVQINFARSMDPIIQQEITITRMAVTSEKDAEKKDREMGRKHIVPYGLYRAEGFVSANLAQKTGFTTDDLELLWEALINMFDHDRSAARGKMAARKLVIFEHETALGNAPAHKLFELVTVAKKDLTRPARAYSDYEVTVNAAAVPAGVKLTEK

SEQ ID NO: 3949 - protein, 282 aa, Streptococcus equi subsp. zooepidemicus
MLEHKIDFMVTVEVKEANANGDPLSGNMPRTNAKGYGLMSDVSIKRKIRNRLQDMGQSIFVQANERIEDEFRSLENRFSAQFDKNDKDDDIERRANELWLDVRSFGQVFTYLKKSIGVRGPVSISMAKSLEPVVISSLQITRSTNGMEPKGDSSRSSDTMGTKHFVDYGIYVIKGSINAQFAEKTGFSEEDADIIKQALVSLFENDASSARPEGSMRVREVFWFTHSSKLGNVSSARVFDLLVFDMETPDKDRYEAYGIHLDEEKLAAYQAKGLTVEVLEGL

SEQ ID NO: 3950 - protein, 315 aa, Hyphomicrobium nitrativorans NL23
MTALANRYDIVFLFDVKNGNPNGDPDAGNLPRIDPETSHGLVSDVSLKRKIRNYTELARGAEAGYRIYVQEGSILNERHREAYKAERPGDDTVEKAPKLNPRNDDEAKALTRFMCENFFDVRTFGAVMSTGINAGQVRGPVQVAFASSVEKILPLEISITRMAATNEKEKAAREKDAGDDRTENRTMGRKHIVPYGLYRAHIFVNAKLAERTGFSDADLKHLFASLKAMFEHDRSAARGEMATRRVVAFKHASALGNAPAHQLFERVKVQRKVGDDLYDVDSAKLDNYPPARAYSDYQVSVDLNGLPDGVEVVEL

SEQ ID NO: 3951 - protein, 280 aa, Mannheimia varigena USDA-ARS-USMARC-1388
MSLTKKIDFALIIQVKNANPNGDPLNGNRPRTDFEGFGEITDVCLKRKIRDRLQDDGESIFVQSDEKKTDGMTSLANRAKDKDVGLGNDAFNAKKSNRDETAKKACEKWLDVRSFGQVFAFGKSDDGAGVSIAVRGPVTIQSAFSVEPVLITSTQITKSVSGEGDGSKKSSDTMGMKHRVDGGIYVAYGAMSPQLAERTGFSDSDADKIKSVLTKLFEGDASSARPEGSMQVLKLIWWEHNCKSGQYSSAKVHGSLNVNADGSYTLSQLEGLKPQEIDGF

SEQ ID NO: 3952 - protein, 280 aa, Bibersteinia trehalosi USDA-ARS-USMARC-188
MSLSKKIDFALIISVKNANPNGDPLNGNRPRTDFYGFGEITDVCLKRKIRDRLQDAGESIFVQSDEKKIDGMTSLANRAKDKDVGLGSDAFNAKKSSRDETAKKACGKWLDVRSFGQVFAFGKSNDGAGVSIAVRGPVTIHSAFSVAPVNITSTQITKSVSGEGDGSKKSSDTMGMKHRVDGGVYVAYGAMSPQLAERTGFSDSDAKKIKSVLTKLFEGDASSARPEGSMQVVKLIWWEHNCKSGQYSSAKVHSSLKVNADGSYELSVLDGLTPQEIDGF

SEQ ID NO: 3953 - protein, 280 aa, Bibersteinia trehalosi USDA-ARS-USMARC-189; identical to SEQ ID NO: 3943

SEQ ID NO: 3954 - protein, 280 aa, Bibersteinia trehalosi USDA-ARS-USMARC-190
MSLSKKIDFALIISVKNANPNGDPLNGNRPRTDFHGFGEITDVCLKRKIRDRLQDAGESIFVQSDEKKTDSMTSLANRAKDKDVGLGSDAFNAKKSSRDETAKKACEKWLDVRSFGQVFAFGKSDDGAGVSIAVRGPVTIHSAFSVAPVNITSTQITKSVSGEGDGSKKSSDTMGMKHRVDGGVYVAYGAMSPQLAERTGFSDSDAKKIKSVLTKLFEGDASSARPEGSMQVVKLIWWEHNCKSGQYSSAKVHSSLKVNADGSYELNALDSLIPQEIDGF

SEQ ID NO: 3955 - protein, 283 aa, Candidatus Endomicrobium trichonymphae
MTLLSKKIDFVVIFKVKSANPNGDPLNENMPRTLADGIGEVTDVCIKRKIRNRLLDMNKDIFVQSDDYKKDKYSSLQERANEEIGKISETSDFSTKACEKWMDVRAFGQVFAYEKGSSIGIRGPVTIRTAFSKEPIIVISDQITKSVNSKSNKKGNDSDDEGMASDRMGMKHWIREAIYVFYGAMNPQLAEKTAFTDEDAKDIKDVLPKLFEKDASSARPEGSMEILKVIWFEHNSPAGQYSSAKVHSSIKIDNSGNIENEKDLENGTVESIKGLKAEIIQGW

SEQ ID NO: 3956 - protein, 302 aa, Streptomyces rochei
MTAPHVDPARKHDFVFLIEATDSNPNGDPDNGGLPRTDPVTGQGLITDVAIKRKIRNTVALINEIEKKPGYEIYVEAGVALNAQHERAYAGGDKGGNATNQATAQHWMCQNFFDVRMFGAVMSTGKADRKAGRVQGPVQIGFARSVDPVTPFDIGITRVTPTRQEDVDAWNNPQEGKSKGKETEMGSKHIVPYGLYKGAGHFSAPLAARTKVTSDDLTTFWRAFTNMFEHDRAAARAGLALRGLYVFTHADAFGSVPSHELIDRITVKPLGEATARSFADYGSVDVRDADLPDGVTITKLVG

SEQ ID NO: 3957 - protein, 287 aa, Candidatus Arthromitus sp. SFB-mouse-Japan
MLLSKRYEFVILFDVENGNPNGDPDSGNMPRIDPETGHGIVTDVCIKRKIRNYIEVVEGERQGFDIYVKNGAVLNEQHRKAYEAFELKPENKKLPKDEKLAKELTGYMCKNFYDIRSFGAVMSNEVNCGQVRGPIQLNFGRSIDPIFSQDLTITRCAVTNMKDLEKGQTMGRKQIVPYALYRMEGYVSAHLAQKVTGFNEEDLNILWQSIINMFEYDRSASHGKMATRKLYVFEHETALGNAPSHKLFDLIEVERKDKSKPSRHFNDYEISIDRDSLPKGVDLIEKL

SEQ ID NO: 3958 - protein, 310 aa, Sphingobium sp. SYK-6
MSTPVIQRHEFVLYFDVTNGNPNGDPDAGNMPRLDPETNQGLVSDVALKRKVRNFVALVKEDQPGFEIYMTEGATLNNQHKKAWAALLPEVTKDDEFKRLPKDQQKAQELTRWMCANFWDIRTFGAVMTTGVNAGQVRGPVQFGFAKSVERILPLEISITRMAATTEKDAEEKGGRTMGRKHIVPYGLYRVHGFVSAPLASHPTKGTGFSESDLELLWQALGQMFDHDRSAARGEMASRKLIVFRHQSALGNAQAQSLFDRVKTWRVHEGSVQEIGSTATDNWPPARKWEDYKVTIDREGLPAGVEILEL

SEQ ID NO: 3959 - protein, 283 aa, Streptococcus mutans LJ23
MLEHKIDFMVTVEVREANANGDPLSGNMPRTNAANQGLISDVAIKRKIRNRMQDLGHTIFVQANDRIEDGLNSLEKRFKTQFTGKESDEEINEKANQLWMDVRSFGQVFTYLKDRSFAIRGPVSVSMAKSLDPIIISSLQITRSTNGVEPKKAGGRSSDTMGTKHFIDYGVYVIKGAINPNFAEKTGFSKEDAEVIKEVLVSLFENDASSARPEGSMRVREVFWFTHSNKLGNVSSARVFDLLEFDKEKQDKDSYEDYAIHLNQEKLAEYEAKGLQVEIIEGL

SEQ ID NO: 3960 - protein, 299 aa, Taylorella equigenitalis
MENYMSLNMKIDFALIIKVKNANPNGDPLNGNRPRINFEGYGEISDVCLKRKIRNRILALKGNEEGFKIFVQSDDNNVDGITTLEKRAEDEEHGLGKRGFNDRNTAYENACKKWYDVRAFGQVFAMKGKTNKSKKKNEDKSEENKSSSVSIGIRGPVTIQPAFSVDPVNITSTQITKSVSGSGDGKKKSSDTMGMKHRIDDAVYVSFGSISPQLAEKTGFSNDDADILKNAMLSMFEGDASSARPEGSMEILKLIWWKHDSKLGKHSSAKVHQSLEVNSDGSFNIKDLSELIPDILNGR

SEQ ID NO: 3961 - protein, 288 aa, Xanthomonas albilineans GPE PC73
MSAIAHRYEFVYLFDVTNGNPNGDPDAGNLPRLDPETNRGLVTDVALKRKIRNYVALEKEGQSGYAIYMQEKSVLNNQHKQAYAALGIEPETKKLPKDEAKARELTAWMCANFFDVRSFGAVMTTEVNSGQVRGPVQLAFASSVEPVLPLEVSITRVAVTHEKDLEKERTMGRKHILPYGLYRAHGFISAKLAERTGFSEEDLQLLWRALTNLFEHDRSAARGEMAARKLIVFKHEHPMGNAPAHMLFDKVKVERDEGSDNGPARSFADYRVVIDRDLPAGITLTELF

SEQ ID NO: 3962 - protein, 299 aa, Clostridium cf. saccharolyticum K10
MSEAIKNRYEFVVLFDVENGNPNGDPDAGNMPRIDPESNFGLVTDVCLKRKIRNYVETVKEGEEGYGIYIREDVPLNTSDKKALSYIGVEDLSDKGLKELKKNDPEADRKIRDFMCRNFFDIRTFGAVMTTFVKASLNCGQVRGPVQIGFARSIDPIVSQELTITRVAITTEEDSLNKKTEMGRKNIVPYGLYRAEGFISANLARKVTGFSEEDLELLWEAIINMFEHDHSAARGKMAVRRLIVFKHSRELGDCPSYKLFDAVEVKRKEGVEFARQYSDYEIAIHREQIPESVEVMDKI

SEQ ID NO: 3963 - protein, 303 aa, Eubacterium rectale DSM 17629
MGEVIKNRYEFVVLFDVENGNPNGDPDAGNMPRIDPESGLGIVTDVCLKRKIRNYIETVKEDEDGYKIYIKENVPLNRSDREACKSLGINDDEDKKVTEALKKLKKSDKDADIKLRDYMCRNFYDIRAFGAVMTTFVKASLNCGQVRGPVQLGFARSIDPVISQEVTITRVAITTEKDAENKSNEMGRKSIVPYGLYRVEGYISANLARKVTGFSEEDLELLWNAIINMFENDHSAARGKMAVRELIVFKHSKELGDCPAYKLFDAVKVQKNDDIQYPRKYQDYTVTINDDEIPDTVEVKRMI

SEQ ID NO: 3964 - protein, 303 aa, Eubacterium rectale M104/1
MGEVIKNRYEFVVLFDVENGNPNGDPDAGNMPRIDPESGLGIVTDVCLKRKIRNYIETVKEDEDGYKIYIKENVPLNRSDREACKSLGINDDEDKKVTEALKKLKKSDKDADIKLRDYMCRNFYDIRAFGAVMTTFVKASLNCGQVRGPVQLGFARSIDPVISQEVTITRVAITTEKDAENKSNEMGRKSIVPYGLYRVEGYISANLARKVTGFSEEDLELLWDAVINMFENDHSAARGKMAVRELIVFKHSKELGDCPAYKLFDAVKVQKNDDIQYPRKYQDYTVTINDDEIPDTVEVKRMI

SEQ ID NO: 3965 - protein, 294 aa, Faecalibacterium prausnitzii L2-6
MSEPIKNRYDFVILFDVENGNPNGDPDAGNMPRIDPETGYGLVTDVCLKRKIRNYVETLKEDEKGYRIYIKDGVPLNRSDAEAIKTLGIDPDLKAAKKADPDIDAKLRDYMCENYFDIRTFGAVMTTFVKGALNCGQVRGPVQLSFARSVDPIVPQEVTITRVAITTEADAEKKGTEMGRKHIVPYALYRAEGYVSANLARKTTGFSEDDLKLLWTAILNMFENDHSAARGKMAVRELIVFKHDSELGNAPAYKLFDSVTVQRKPDVDAARSYRDYTVTVADTLPEGVTCERLS

SEQ ID NO: 3966 - protein, 290 aa, Ruminococcus champanellensis 18P13 = JCM 17042
MENKAIENRYEFVMLFDVESGNPNGDPDAGNMPRTDPETSLGIVTDVCLKRKIRNFVELYKEGEPGYNILIKADKALNTKFTAAYDALGLEKGQKGKKPEDVKKAQKYICDNYFDVRTFGAVMSTGDDPCGIVRGPVQLNFARSLDPVSVQDITITRQAVTTQKDFTERKQSEMGKKSLIPYGLYRAEGYVSAMLAQRVTGFSEEDLELLWTAIINMFEGDRSAARGKMSMRKLFVFKHASALGNAPAQTLFDKIQVQKKEGVNPPRAYTDYTVTVDRNMPDGVELIEKL

SEQ ID NO: 3967 - protein, 185 aa, Ruminococcus sp. SR1/5
MCENYYDIRTFGAVMTTFVKASLNCGQVRGPVQLGFARSIDPVISQEVTITRVAITTEKDAENKSTEMGRKSIVPYALYRAEGFISANLARKTTGFTEEDLELLWDAIINMFENDHSAARGKMSVRELIVFKHSKELGDCPAYKLFDAVEVTRKENVEYPRRYQDYTVEIHNDKIPESVEVKRMI

SEQ ID NO: 3968 - protein, 289 aa, Eubacterium siraeum V10Sc8a
MSTLANKVDFEVIISATDANPNGDPLSGNRPRINSKGLGEISDVCIKRKIRNRLQDMGERIFVQSDDKCDDGCDSLRARADSCDELKKASSGKNTNKDEYARIACEQWIDVRSFGQVFAFKGDAVSVGVRGPVSISIAKSVSPIEIISMQITKSVNGESGKNGKASDTMGTKNRVGFGLYVFKGSINCQLAEKTGFSDEDAEKIKKALVTLFENDCSSARPEGSMQVCRVYWWKHDGKTPKVSSAKIHNAVQIKEKAELNGKEPNSVEDYDIVLNNPEGAVQPEIIDNI

SEQ ID NO: 3969 - protein, 315 aa, Methylomicrobium alcaliphilum 20Z
MNIENRYEFLFLFDCENGNPNGDPDAGNAPRIDPEDMYGLVSDVALKRRVRNYVQIARHNMRPHAIFIEHATNLNRPIAESHLEANGEIPEKGKASKDKVRLAKEWMCKNFYDVRTFGAVMSTGANAGQVRGPVQFSFARSLDKVLPLDISVTRMAVAEDVKGAKDIASYKAWEDAQPEDQLRTMGRKSLIPYGLYAAKGFISANLAQETGFSEADLELLWEALLNMYDHDRSASKGMMSCRGLYIFKHTGTDSDLEQRKKQAMLGCAPAHKLLDLGGIIDIKKREGIETPRKFADYEVTVNKDRLPDGIELIAK

SEQ ID NO: 3970 - protein, 287 aa, Methylomicrobium alcaliphilum 20Z
MSELDRNTLSHKIDFAVIFSVDHANPNGDPLNGNRPRTDYDGYGEMTDVCLKRKIRDRLQSESFSIFVQSDEKKTDGMTSLKNRAEAEPPIGLGKDAFNPKKQSKDQTAQMACAKWFDVRAFGQVFAFGKDGDAAGVSIPIRGPVTIQSAFSVEPVSITSTQITKSVNSEGDGSKKGADTMGMKHRVDHAVYVAYGAITPQLAEKTGFSDDDAEAIKKVLPRLFEGDASSARPEGSMAVKKVIWWQHNSRSGQYSSAKVHGSLTVNADGSYELETLPGLQPEEKEGF

SEQ ID NO: 3971 - protein, 323 aa, Phaeospirillum molischianum DSM 120
MSALSHRHEFVVLFDVANGNPNGDPDAGNLPRLDPETNHGLVSDVCLKRKIRNYVELAKGDESGFHIYVQDGSILNDKHREAYVALRPGDEKVAKEAKLNPKDEAEAKKLRAFMCDNFFDIRTFGAVMGTGINCGQVRGPVQFAFASSVEPIVPLEISITRMAATNEKEKEKNDKEKAQQDNGDGNDRTDNRTMGRKHIVPYGLYRAHGFVSAKLAERTGFSEADLDLLLEAVENMFEHDRSAARGEMAVRKLIVFRHDCALGKAPAHSLFERVKVGRNIDGEFRAVNDPAIDNRTSARSFADYLVTIDRDNLPEGVEIVERL

SEQ ID NO: 3972 - protein, 290 aa, Saccharothrix espanaensis DSM 44229
MTEPHLDPTRRHDAVLLFDVLDGNPNGDPDAGNQPRVDVETGQGLVTDVSLKRKIRDQIPLLRPDEARYKIFVEADTALNTNILRGFTATDTPVTKKTTPDQRRTVQDWLCNEFFDIRMFGGVVSTGTGNAGRIRGPLQLTFARSIDRVLVQGHGITRITQTTEKDITEGGESTEMGTKWTVHYGLYRVHLHYSAPRGIDTHVTPEDLDVLWKTLTNLFEHDRASGRGEMDVKGLHVFTHDDAYGKARASQLFSDITVSSLTTTPRNIGDYKIKLADTEHSGVTRTSIVE

SEQ ID NO: 3973 - protein, 287 aa, Streptococcus agalactiae
MRSKKMLEHKIDFIVTFEVKEANANGDPLNGNMPRTDAKGYGVMSDVSIKRKIRNRLQDMGKPIFVQANERIEDDFRSLEKRFSQHFTAKTPDKEIEEKANALWFDVRAFGQVFTYLKKSIGVRGPISISMAKSLEPIVISSLQITRSTNGMEAKNNSGRSSDTMGTKHFVDYGIYVLKGSINAYFAEKTGFSQEDAEAIKEVLVSLFENDASSARPEGSMRVREVFWFTHSSKLGNVSSARIFDLLEYNQSIEEKSTYDAYQIHLNQEKLAKYEAKGLTVKILEGL

SEQ ID NO: 3974 - protein, 282 aa, Streptococcus dysgalactiae subsp. equisimilis AC-2713
MLEHKIDFMVTLEVKEANANGDPLNGNMPRTDAKGYGVMSDVSIKRKIRNRLQDMGKSIFVQANERIEDDFRSLERRFSQHFTAKTPDKEIEEKANALWFDVRAFGQVFTYLKKSIGVRGPVSISMAKSLEPIVISSLQITRSTNGMEAKNNSGRSSDTMGTKHFVDYGVYVLKGSINAYFAEKTGFSQEDAEAIKEVLVSLFENDASSARPEGSMRVCEVFWFTHSSKLGNVSSARVFDLLEYHQSIEEKSTYDAYQIHLNQEKLAKYEAKGLTVEILEGL

SEQ ID NO: 3975 - protein, 285 aa, Magnetospira sp. QH-2
MTAIANRYDFVLLFDVKDGNPNGDPDAGNMPRIDPETGHGLVTDVALKRKVRNYVGLKHDNAAPNEIYVREGSVLQEQRGVPYEGKKPDSTDKGDHDVARAFMCQNFYDVRTFGAVMSTKKFNAGQVRGPVQITFARSENRILPMDHTITRVARETEARAAEGGTTEMGGKNTVAYGLYQAHGFVSPHLAEGDRGTGFSEADLTLLWEALERMFEVDRSAARGMMATQKLIVFKHDSKLGNARAQDLFGRVSVRQKADTPRDISDFDISVSQTSLPSGVEVMILV

SEQ ID NO: 3976 - protein, 282 aa, Streptococcus agalactiae SS1219; identical to SEQ ID NO: 3936

SEQ ID NO: 3977 - protein, 282 aa, Streptococcus agalactiae LADL-90-503; identical to SEQ ID NO: 3936

SEQ ID NO: 3978 - protein, 372 aa, Clostridium ultunense Esp
MTNHYLDPKKRHEFVLFYDVKDGNPNGDPDAGNLPRVDPETMHGIVTDVAIKRKIRDYVANVLNRKIFIQSQSALNSLIFRAYQEIGVELAEISLSEEEQENTSLIEWLSGLEEAGITLEEDKLIYAAEDVKEKDIRNKLLEGLEEAGFKPELESTLKNIAKRLAQAAKNMKIDEETRQNAQNALCKKYFDIRMFGAVMSTGLNAGQVRGPVQLTFSRSIDPVFPWDLTVTRIAITKESDRRRKKTEMGRKPLIPYGLYRTHGFFNPFLAEKTGVTSEDLEDLWDALTNLFDFDRSAARGEMNVRGLFIFTHENGKGAAPAHQLFELVKAERRMDVQVPRSFEDYVIQGPVFKREIDVPLEGFPGITVTRLV

SEQ ID NO: 3979 - protein, 286 aa, Thalassolituus oleivorans MIL-1
MSLQNRYDFLYLFDVKDGNPNGDPDAGNLPRIDAETGMGLVTDVCLKRKVRNFVQLTQQEKTGYKIFVKEKAILNNLIDESHEQEAVASKEKGDKTEAAKQWMCDNYFDVRTFGAVMSTGKNAGQVRGPIQLTFSRSIDPIVASEHSITRMAVTTEKESESQKGDNRTMGRKFTVPYGLYLCKGFISANLANQTGFGEEDLTLFWQSLEQMFDHDRSASRGEMSPRGLYIFKHSNELGNASAASLFDRVKVTKKPEVDVARSFDAYQVDVIENGLPEGIELIRKLG

SEQ ID NO: 3980 - protein, 294 aa, Halanaerobium saccharolyticum subsp. saccharolyticum DSM 6643
MIYNNPEKRHDFILIFDVKDGNPNGDPDAGNLPRVDPETMHGLVSDVSLKRKVRNWVALTQDENIYVENEGVLYNQQEMAYQDLELDEKANDRDSIDDARDWMCKNFYDVRTFGAVMSTSKFNCGQVQGPFQLTFARSVDPIVPMDLSITRVAVTKPEDARKQSSDDEGASSNKITEMGRKTMIPYGLYVAHGFYNPYFADNTGVKESDLEIFWESLVKMWDLDRSASRGMMACRGLYVFTHEDKTGNAPANKLFDLIDVSKKDNVETPRKFSDYQVFIENDLPDKITLSKILD

SEQ ID NO: 3981 - protein, 282 aa, Streptococcus agalactiae ILRI005
MLEHKIDFIVTFEVKEANANGDPLNGNMPRTDAKGYGVMSDVSIKRKIRNRLQDMGKPIFVQANERIEDDFRSLEKRFSQHFTAKTPDKEIEEKANALWFDVRAFGQVFTYLKKSIGVRGPISNSMAKSLEPIVISSLQITRSTNGMEAKNNSGRSSDTMGTKHFVDYGIYVLKGSINAYFAEKTGFSQEDAEAIKEVLVSLFENDASSARPEGSMRVREVFWFTHSSKLGNVSSARVFDLLEYNQSIEEKSTYDAYQIHLNQEKLAKYEAKGLTVKILEGL

SEQ ID NO: 3982 - protein, 222 aa, Streptococcus agalactiae ILRI112
MQANERIEDDFRSLEKRFSQHFTAKTPDKEIEEKANALWFDVRAFGQVFTYLKKSIGVRGPISISMAKSLEPIVISSLQITRSTNGMEAKNNSGRSSDTMGTKHFVDYGIYVLKGSINAYFAEKTGFSQEDAEAIKEVLVSLFENDASSARPEGSMRVREVFWFTHSSELGNVSSARVFDLLEYNQSIEEKSTYDAYQIHLNQEKLAKYEAKGLTVKILEGL

SEQ ID NO: 3983 - protein, 294 aa, Clostridium sp. CAG:226
MEAIKNRYDFVILFDVENGNPNGDPDSGNMPRIDPETGYGLVTDVCLKRKIRNYVETIKEGESGYRIYIKDNVPLNRSDREAYDYLGIEPAKVADAKKKKENLDLEIRDFMCKNFYDIRTFGAVMTTFVKDKLNCGQVRGPVQLSFAKSVDPIMPQEVTITRVAITTEADAEKKGTEMGRKYIVPYALYRAEGYVSANLARKTTGFSEEDLELLWQAIMNMFEVDHAAARGKMATRELIVFKHDSELGNAPAYKLFDLVKAERREGVDTPRAYSDYNVSVDEAVLPSGVECIRI

SEQ ID NO: 3984 - protein, 286 aa, Eubacterium sp. CAG:146
MGVLQNKIDFEGIIVVENANCNGDPLNGNMPRVTYEGYGEMSDVCIKRKIRNRLLDAGENIFVQSDDKCIDKCKSLKARADANEAFGAELKKGKKADAQRGYEIACKEWMDVRSFGQVFAFKGSELSLGIRGPVSVQPAFSVDPIDITSMQITKSVNSEDKEGKSSDTMGMKHRVDFGVYILKGSINVQLSEKTGFTEEDAEKIKEAIRTLFVNDSSSARPDGSMVMHKLYWWKHNCKIGQYSSHKVHNSIEIKKKEGVRNPRKIEDYEIICHELPGLAVEEYEGL

SEQ ID NO: 3985 - protein, 332 aa, Firmicutes bacterium CAG:124
MAIQNRYEFMYYVACTNCNPNGDPDMGNMPRLDPQTMQGFITDAATKRRIRNYVELAHQGEPGMNIIIQQATNINRHIAEAKRAAGVEDCAKAKEAVYAGRKKACELFYDVRTFGAVMSTGPNAGQVRGPVQITYGKSLDAVLPLDISITRMAVADKVKDGATVEDYAAWEQEQPEDKLRTMGRKQIIPFGLYEVRGFVSANLAEETGFDDEDLNILFEAILNMYEHDHSASKGEMAVVSPLIIFRHVGTDTDAAQRIRQAKLGCAPAHKLFDLVKVTKKASVSYPRSYRDYDALVSLDRVPKGVQIGFKPSAFEPVVWDALPADEDWFCHG

SEQ ID NO: 3986 - protein, 285 aa, Clostridium hathewayi CAG:224
MGELKGKIDFVLLISATNANPNGDPLNGNQPRISIDGFGEISDVCIKRKIRNRFQDMGQRVFVQSDDRSDDSYKSLKDRADGCAELKAEMGNKKNTDKQKCSEIACREWIDVRSFGQVFAFKGEDVSLGIRGPVSIHQAVSVSPVDTISMQITKSVNSEAGKESKASDTMGMKYRVGFGLYVVKGSINVQLAEKTGFSQEDAECLKEALRTLFENDASSARPEGSMEVCRLYWWQHNEKTPAVSTARIHRSVKIIPRVDRPRCFEDYDVNIEELPCVEPEVYGIV

SEQ ID NO: 3987 - protein, 282 aa, Firmicutes bacterium CAG:212
MSELKGKIDFTLFISANNANPNGDPLNGNRPRINMDGLGEISDVCIKRKIRNRFQDLGQKIFVQSDDRTDDTYTSLKDRADSCAELKAEMGNKKNANRDACAAIACKEWLDVRAFGQVFAFKGIPVSFGVRGPVSIHQAVSLSPIDIISMQITKSVNSESGKESKASDTMGTKHRVGFAVYKVMGSVNVQLAEKTGFSQEDAEVLKEALKTLFENDASSARPEGSMEVCKMYWWQHDEKTPAVSSGKIQRGFKIDPQKEHPRKFEDYKISWNVEGCKQPEEF

SEQ ID NO: 3988 - protein, 297 aa, Clostridium sp. CAG:138
MEPIKNRYDFVVLYDVENGNPNGDPDAGNMPRVDPETGYGIVTDVCLKRKIRNYVETAKEGEPGYRIYIKEGVPLNASDREACEKYNVSTDEKKLKEAKKNDPELDIKIRDYMCGNFFDIRTFGAVMTTFVKGALNCGQVRGPVQLGFSRSIDPIISQEITITRVAITTEADAEKKGTEMGRKYIVPYGLYRCEGYVSANLARKTTGFSEADLELLWKAIINMFENDHSAARGKMAVRELVVFKHESELGNAPAHKLFERVTAARKADCAVARCYDDYDIVVDTDNLPEGVSCIRMV

SEQ ID NO: 3989 - protein, 289 aa, Ruminococcus sp. CAG:579
MENAIKNRYEFVMIFDVENGNPNGDPDAGNMPRVDPESNLGYVTDVCLKRKIRNFVELVKEGEPGYNILIKADKALNTKFTEAYNALDLPTGNGKTTPAETQKQARDYICKNYYDVRTFGAVMSTGDDPCGIVRGPVQINFARSLDPVFPQEISITRQAKTTAERKEVGDTEMGRKSFIPYALYRAEGYVSAMLADKITGFSEDDLELLWSAVINMFEHDRSAARGKMCMRKLIVFKHESPLGNAPAQTLFDKISIKLKEDTAVPRAFSDYEISIDRDMPAGVEMIEKL

SEQ ID NO: 3990 - protein, 296 aa, Oscillibacter sp. CAG:241
MSEPIKNRYEFVVFFDVENGNPNGDPDAGNMPRIDPETGYGLVTDVCLKRKIRNYVEMAKEGETGYRIYIKDGVPLNTSDKEACAFVGVDADKLKDAKKKDEHLDEKLRDFMCRNFYDIRTFGAVMTTFVKGALNCGQVRGPVQLGFARSVDPIMPQEVTITRVAITTEADAEKKGTEMGRKYIVPYGLYRVEGYISANLARKTTGFSEDDLNLLWTAILNMFENDHSAARGKMAVRELIVFRHDSELGCAPAHKLFDLVKAAHKDNVTAPRSYEDYTVTVDEAALPAGVTCTRLG

SEQ ID NO: 3991 - protein, 330 aa, Firmicutes bacterium CAG:137
MAIDNRYEFLFYIQCRNGNPNGDPDMGNAPRMDPQDLHGYVTDVAIKRRIRNYVQAAYAGKPGMEMLIRSASNINTGIARAKELAQVELSAKGRNEVYAGRKAACQLFYDVRTFGAVMSTGPNAGQVRGPVQLTFARSLDPIQPQDISITRMAKAEEVKNAKTAADYEQWENGQSEDSLRTMGRKQFIPYGLYEARGFVSANLAMETGFDEEDLRVLFEAILNMYEHDRSSSKGEMAVVSPLILFRHTGTDSDLEQRKRQARLGCAPSYQLFDLVRVEKRPEVEYPRSYRDYTGSIRLDARPAGVDVGFLCSPYGEISWNQVPEDAELFR

SEQ ID NO: 3992 - protein, 283 aa, Firmicutes bacterium CAG:41
MEPIKNRYEFTVIFDVENGNPNGDPDAGNMPRIDPETSAGLVTDVCLKRKIRNFVEIFKEDEPYYNILVKPDKALNTKFTEAYEAIGEKTGQKGKNPEAVRAARDYICQNYFDVRTFGAVMSTGNDPCGIVRGPVQISFAKSVDPIFTQDITITRQARTNESDSATMGRKSIVPYGLYRADGYVSAMLAQKITKFSEEDLELLWKAIINMFEHDRSAARGKMCVRKLYVFKHDSLLGNAPANVLFDKIVIGKKDGVEVPRSFNDYEITVDKNMPEGVELQEKA

SEQ ID NO: 3993 - protein, 282 aa, Clostridium sp. CAG:352
MSVFNNKVDFVAFISVNHANPNGDPINGNRPRDTMEGFGEISDVCIKRKIRNRLQDIGECVFVQSDERSDDGCKSLKERADSYEELKKLSKGKETGKDAFAKLACEKWIDVRTFGQVFAFKGDAVSVGVRGPVTIQPAFSLEPIEIEDIQITKSVNSESKSGKASDTMGMKHRVRFGIYVLKGSINCQLAEKTGFTEEDAEKIKNAVATLFENDCSSARPEGTMNIEKLFWFKHNCKSGQYSSAKVHNSVIAKALCEEPTSAKDYEFIYDGNLEGLTPEVIE

SEQ ID NO: 3994 - protein, 281 aa, Clostridium sp. CAG:58
METLQNKIDFALVIAVNHANPNGDPLNGNRPRETYEGYGEISDVCLKRKIRNRMMDFGASVFVQSDDRCNDGFRSLKDRADACPELSDAQKKKDREAYAKAACAKWMDVRSFGQVFAFKDGKEGVSVGVRGPVSIHPAFSIEPINIESLQITKSVNSITTDKKSSDTMGTKHRVDFAVYTTFGSINCQLAEKTGFTMEDAELIKEALHTLFENDASSARPDGSMEVLRLYWWKHDCKNGQYSSAKVHRLLHVKPKNELPKNIQDYEITCGELPGLSVEVYD

SEQ ID NO: 3995 - protein, 167 aa, Ruminococcus sp. CAG:57
MSTGDDPCGIVRGPVQLNFARSIDPVFAQDITITRQARTTEDRQQSGETEMGKKSIIPYALYRGEGYVSAMLAQKITGFSEDDLELLWTSIINMFEHDRSAARGKLCMRKLIVFKHDSALGNAPAHILFDKVSVKLKDGVTTPRHYSDYDISIDKDMPEGVTLIEKL

SEQ ID NO: 3996 - protein, 290 aa, Ruminococcus sp. CAG:379
MENKAIENRYEFVMLFDVENGNPNGDPDAGNMPRTDPETSLGIVTDVCLKRKIRNFVELYKEGEPGYNILIKADKALNTKFTAAYDALGLEKGQKGKNTEDVEKAKKYICDNYFDVRTFGAVMNTGVDRCGIVRGPVQLNFARSLDPVAVQDITITRQAVTDETDFKERKQSEMGKKSLIPYGLYRAEGYVSAMLAQRVTGFSEEDLELLWTAIINMFEGDRSAARGKMSMRKLFVFKHASALGNAPAQTLFDKIQVQKKEGVNPPRAYTDYTVTVDRNMPDGVELIEKL

SEQ ID NO: 3997 - protein, 305 aa, Eggerthella sp. CAG:298
MNNPIKNRYDFIVYFDVENGNPNGDPDAGNLPRVDPEQGYGIVTDVCLKRKIRNYVELVKEDEPGFDIYIKEGVPLNSSDMRALESVGIDTSKSDTAIKDAVKKMKKDDPQLDYLIRNFMCSNYFDIRTFGAVMTTFVKNNLNCGQVRGPVQLTFARSVDPIIPQEVTITRVAITTEADAEKKGTEMGRKHIVPYGLYRCEGFVSAALAEKTTGFSEEDLELLWESIINMFEHDHSAARGKMAVRQLIVFKHENKLGNAPAHQLFDAVSIEKKSGVDSPRSFDDYEDIAINAEAIPEGVTLEFKI

SEQ ID NO: 3998 - protein, 282 aa, Roseburia sp. CAG:471
MSELKGKIDFTLFISAWNANPNGDPLNGNRPRINLDGYGEISDVCIKRKIRNRLQDLGQKIFVQSDDRSDDGYTSLKDRADGCKELKEQMDNKKKADRETCAAIACKEWMDVRAFGQVFAFKGIPVSFGVRGPVSIHQAVSLSPIEIISMQITKSVNSEPGKDSKASDTMGMKHRVGFAVYKVMGSVNVQLAEKTGFTQEDAEVLKEALKTLFENDASSARPEGSMEVCKMYWWQHDEKTPATSSGKIQRGFDIKEKVEHPTKFSDYEITWKVEGCKEPEVI

SEQ ID NO: 3999 - protein, 293 aa, Anaerotruncus sp. CAG:390
MSEIIKNRYEFTILFDVENGNPNGDPDAANMPRIDPETGLGLVTDVCLKRKIRNYVEDTMEDAPGYGIYIKDGVPLNTSDKRAYTAVLGEGKKLEKKDPEIDLKLRDFMCANFYDVRTFGAVMTTFVKDKLNCGQVRGPVQIGFARSVDPIVRQEVTITRVAITTEADYEKKDTEMGRKHIVPYALYRADGFISANLARRVTHFTEDDLELLWNAIVNMFENDHSAARGKMAVRKLIIFKHDSELGNAPSHRTLDLVSVKRRDGIETARSYNDYEVTVNEAACPEGVHISCRE

SEQ ID NO: 4000 - protein, 285 aa, Ruminococcus sp. CAG:330
MCLEHKIDFAVLVTVTNANPNGDPLNGNRPRENYDGYGEISDVCIKRKIRNRLQDMGEKIFVQSDDRKQDEYKSLRDRADHHEVLKPLNKGKKTDRKAYSEAACKEWIDVRSFGQTFAFSGGMSIGIRGPVTVQQAFSVSPVDIVSMKIVKSVNGDGTELSKSPDTMGTKHMVEFGLYVIKGSINCQLAEKTGFTEEDAEKIKEALRTLFENDCSSARPDGSMEVCQLYWWKHDCKMPKYSSAKVHRSLHVELKEGVEKPVSFADYKVTLDSLDGLEPKIIDNMA

SEQ ID NO: 4001 - protein, 290 aa, Ruminococcus sp. CAG:403
MKEQAIQNRYEFIMLFDVENGNPNGDPDAGNMPRTDPETSLGLVTDVCLKRKIRNYVELAKEGEAGYNILIKADKALNTKFTDAYSACGLKTKQKGKNSDDVKKAQEYICENYYDVRTFGAVMSTGEDPCGIVRGPVQINFARSIDPIFPQDITITRQSKTTEDRQEKGATEMGKKNIVPYGLYRAEGYVSAMLAQKVTGFSEADLELLWTAIINMFEHDRSAARGKLCMRKLIVFQHASALGNAPAHVLFDKVTVKRKDSVCVARAYSDYEVCIDRNMPDGVKLIEKLS

SEQ ID NO: 4002 - protein, 288 aa, Ruminococcus sp. CAG:353
MEAIKNRYEFVMYFDVENGNPNGDPDAGNTPRIDPETNLGIVTDVCIKRKIRNFVELTMNGKEGYNILIKGDRSLNSKFTEAYEKLGMPTGKNADKPADAEKRAQEYICKNYYDVRTFGAVMSTGDDLCGIVRGPVQINFARSIDPVLIQDIAITRQAKTTEERQNMSGNSEIGRKSIIPYALYRAEGYVSAMLAQNVTQFSEEDLELLWTAIINMFENDRSSARGKMCLRKLYVFKHESALGNAPAAVLFDKITAESKCDGAPRKFSDYEISVDRTMPAGVELIEKI

SEQ ID NO: 4003 - protein, 292 aa, Bacteroides sp. CAG:98
MSEIRNRIDFVYIFDVQDGNPNGDPDAGNLPRVDAETGMGLVTDVCLKRKVRNYVQIAKSGQLGNDILVKSKEISGEEVFINGEIRKTYEDLSIKLEKGKAPADKVPAGRTAMCKRFFDVRTFGAVLSTGPNAGQVKGAVQMTFARSKDMIVSEEHALTVCAARDEEKPYELQVGIQGRKATVPYGLYICHGFISANLARQTGFSEEDLALFFEALKNMFDVDRSAARGLMSAQKLIVFKHDSILGNAPANKLFDLVKVEKICDGAPRSFSDYSVIIDKENVPSNVTVEELI

SEQ ID NO: 4004 - protein, 282 aa, Dialister sp. CAG:588
MLENKVDFIMTIEVNNANPNGDPLAGNNPRIDSKGYGEISDVCIKRKIRNRMQDEGYEIFVKSRERQDDGFNSLAVRYKNFFKGEKDDLVVEKGFNEKWIDVRAFGQVITYENKSIGIRGPVSISIGKSLSPIDITTMQIVRSTNGMEAKSQSGRSSDTMGTKHYVEYGVYVIYGSVNCFFAEKTGFDKDDLEALKESLRTLFINDSSSARPEGSMEVKEIFWFEHSSKLGNASSAKIRELVTWDKTDSEKDKYEDYNVHINEDAFSKLENEGLNLEIIQGI

SEQ ID NO: 4005 - protein, 280 aa, Verrucomicrobiae bacterium DG1235
MKNRYDFVVLFDAQDANPNGDPDAGNLPRVDAETGQGLVTDVCLKRKIRNFVQTTRPDQRIYFRENIVLNDQNEEAYKALDLGDPKKSKQAERDKARAWMCENFYDVRAFGAVMSTEINCGQVRGATQLSFARSIDPIVTSEHAITRTSVTNQKDIEKGRTIGRKFTIPYGLYRAHGFVNPFLADQTGFSDEDLELLFTALENAFQFDQSAARPAGSMAMRGLLVFKHDSQLGNAPSHKLFDLVSVKKKDEVEVARSFSDYEVSIDEAAIPEGVTLIKRI

SEQ ID NO: 4006 - protein, 166 aa, Neisseria flavescens NRL30031/H210
MTTEVNSGQVRGPVQLAFAQSIDPIVPLEVSITRMAVTNEKDLEKERTMGRKYIVPYALYRVHGFISANLAAKTGFSDDDLAKLWQALTLMFEHDRSAARGEMAARKLIVFKHDSALGSQPAHKLFDAVKVERINGESGTPASGFGDYKISVVSDGLNGVSVEELL

SEQ ID NO: 4007 - protein, 286 aa, Bacillus cereus F65185
MKTLDHKIDFAVVLSVTKANPNGDPLNGNRPRQNYDGHGEISDVAIKRKIRNRLQDMEESIFVQSNDRKVDQFNSLRERAETNADLVKALKSKDNPHEQFAAIACKEWIDVRSFGQVFAFKGGAGKGVSVGVRGPVSIHTATSVDPIDITSMQITKSVNSEPGKDKGSDTMGMKHRVDFGVYVFYGSINTQLAEKTGFTNEDAEKIKNALVTLFENDASAARPEGSIEVHKVCWWDHNSKLGQYSSAKVHRLLEVKRNIDEPKTIDDYTVLVHELDDLKVEVINGM

SEQ ID NO: 4008 - protein, 40 aa, Bacillus cereus F65185
MQITICINSESDKDKGSDTMGMKHRFDLGAHIFYGSIHMQ

SEQ ID NO: 4009 - protein, 78 aa, Bacillus cereus F65185
MTGYMFGNDASAARPEGSIEVHKVCWWDHKSKIGQYSSAKVHRLLEVKRNIDEPKTIDDYTVLVHELDGLKVEIINGM

SEQ ID NO: 4010 - protein, 112 aa, Bacillus cereus F65185
MQITKIVNSELGKDKGSDTMGMKHRVDFGVYVFYGSINTQLAEKTGFTNEDAEKIKNTLVTLFENDVSAARPEGSIEVHKACWWKHNSKLGQYHSAKVHRLLDIKRNIDEPK

SEQ ID NO: 4011 - protein, 286 aa, Bacillus pseudomycoides DSM 12442
MTTLNHKIDFAVVLSVTKANPNGDPLNGNRPRQNYDGHGEISDVAIKRKIRNRLQDMEESIFVQSNDRKVDQFNSLRERAETNVDLVKALKSKENPHEQFASVACKEWIDVRSFGQVFAFKGGSGKGVSVGVRGPVSIHTATSVDPIDITSMQITKSVNSEPGNDKGSDTMGMKHRVDFGVYVFYGSINTQLAEKTGFTNEDALKIKNALVTLFENDASAARPEGSIEVHKVCWWEHNSKLGQYSSAKVHRLLDIKRNIDEPKTIDDYTILVHELDGLKVAIIDGL

SEQ ID NO: 4012 - protein, 286 aa, Bacillus thuringiensis serovar monterrey BGSC 4AJ1
MTILNHKIDFAVVLSVTKANPNGDPLNGNRPRQNYDGYGEISDVAIKRKIRNRLQDMEESIFVQSNDRRVDQFNSLKERAENNVDLIKVLKSEENPYEQFAAIACKEWIDVRSFGQVFAFKGGAGKGVSVGVRGPVSIHTATSIDVIDITSMQITKSVNSEPGKDKSSDTMGMKHRVDFGVYVFYGSINTQLAEKTGFTNEDAEKIKSALVTLFENDASAARPEGSIEIQRVCWWEHNSKLGQYSSAKVHRLLDINRNIDEPKTIDDYTILVHELDGLKVDIIDGL

SEQ ID NO: 4013 - protein, 288 aa, Actinobacillus minor 202
MTIEKRYDFVFLFDVQDGNPNGDPDAGNLPRIDPETGMGLVTDVCLKRKVRNFVQLIKDSEEDRKRNDIFVREKAILNDLIADAHQQEGVKDKLKGKEKTESARQYMCNRYYDIRTFGAVLTTGENAGQVRGPVQLTFSRSIDPIITLEHSITRMAVTNEKDASETGDNRTMGRKFTVPYGLYRCHGFVSAHFAKQTSFSDEDLELFWQALINMFDHDHSAARGQMNARGLYVFEHSNGLGDAPADTLFKRIQIRKKEGVDAARSFDDYIVSVNEQELSATKLHRKLG

SEQ ID NO: 4014 - protein, 105 aa, Cardiobacterium hominis ATCC 15826
MHGFISANLAAKTGFSDDDLAKLWQALTLMFEHDRSAARGEMAARKLIVFKHDSALGSQPAHKLFDAVKVERVNGESGTPASGFGDYNISVVSDGLNGVSVEELL

SEQ ID NO: 4015 - protein, 288 aa, Pyramidobacter piscolens W5455
MSVLQNKIDFAVILSVNNANPNGDPLNGNRPRENYDGYGEISDVCLKRKIRNRWQDLEQKIFVQAAERADDGYNSLKERAEKELSEDDRKDRERYAREACKKWLDVRSFGQVFAFDNKNDDEEKGKGVSVGVRGPVTVQSAMTVLPVNIDSMQITKSVNGKPTKDGSKSPDTMGMKHRVAHSVYVFYGSINCQLAEKTGFSEEDAELLHKALITLFENDASSARPDGSMEVKRVYWWKHNCKTGQYSSAQVHRSLSVTAPEDATSWREYKVEVTPLDGLNPEEYSAVE

SEQ ID NO: 4016 - protein, 279 aa, Dethiosulfovibrio peptidovorans DSM 11002
MSLSKKIDFALVFSVDRANPNGDPLNGNRPRIDYEGYGEVSDVCLKRKIRDRLVEDGYSIFVQSDQKKIDGMPSLRKRAESADFGLGKEAFDSKKTKAEDFVKKACGKWLDVRTFGQLFAFGNDNKGGVSIPIRGPMTIQSAFSVEPVSVASIQITKSVSGDGDGSKRGSDTMGMKHRVDHGIYVTYGAISPQLAERTGFSDEDAEVIKRVLPKIFEGDASSARPEGSMSVIKVLWWEHSSKMGSFSSAKVHGTLTVNPDGSYEVDSLEGISLEEIDGF

SEQ ID NO: 4017 - protein, 291 aa, Desulfonatronospira thiodismutans ASO3-1
MTAIQNRYEFVYLFDVENGNPNGDPDAGNMPRIDPETGYGLVTDVCLKRKVRNFVDIVKNNEPGFKIYIAEKAVLNQTNEMAYKALDLKPEKKKLPKKWEDARKVTRWMCDNFYDVRTFGAVMTTEVNCGQVRGPVQLTFARSIEEIVPAEVSITRMAVTNERDLEKERTMGRKHIIPYALYRAEGFISAHLADGDKGTGFSEADLNLLWQAMENMFDHDHSAARGKMNARRLIIFKHDSKLGNAPAHKLFDLVKVERATDPEKPPRSFSDYTIAIDQANIPQGVTLEQRL

SEQ ID NO: 4018 - protein, 297 aa, Eggerthella sp. 1_3_56FAA
MSNPIKNRYDFVVYFDVENGNPNGDPDAGNMPRIDPETGYGIVTDVCLKRKVRNYVETVKEDDPGFDIYVKDGSILNVNDARAFEALGIDAKDIKKLKKDDPELDEKIRDFMCATFYDVRTFGAVMTTFVKNSLNCGQVRGPVQLTFARSVDPIIPQEITITRVAKTTEERAEASNTEMGRKYVVPYALYRGEGYVSANLARKSTGFSEDDLALLWDAIVNMFEHDHSAARGKMAVRALVVFKHDSELGNAPSYKLFDAVSTQKKAGVEAPRSIDDYEEITVDEGAVPEGVTVLRMV

SEQ ID NO: 4019 - protein, 293 aa, Clostridium symbiosum WAL-14163
MDTSAVLKNRIDFCGIIVAERCNPNGDPINGNVPRQDFNGNGIITDVCLKRKLRDRLSENGYDIFIVKQEELLDEQKSLHSKVKAEPDMVQAAKSKDRTAYRKIACEKWIDVRAFGQVFAFKSSKASKESEEELGISECVRGPVSIQDAVSLDYVTVIQKNLTKSVNSNDPNSRSDKSSDTMGTRYQINYGAYVFRGSIYPQLAKITGFTYGDALAIKNSIINMFMNDASAARPAGSMTLDRLYWWEHNCPNGQYSPAKVFRTLQFSPMDAPPYYKAELLNLPGLEPEVIEGW

SEQ ID NO: 4020 - protein, 294 aa, Clostridium symbiosum WAL-14163
MAALKEKIDFALVFTAKNANPNGDPLDGNRPRTTYNGLGEVSDVCLKRKLRNRLLDEGQNIFVQSDERRREGDTFRSLKDRADNEPALAACVKEMKAGKKTREDYARQACETWYDVRAFGQVFAFKKGKKEEEESDAVSIGIRGPVSIQPAFSKGPVNITSSQITKSVNLETGKDPDKKGPDTMGMKHRVDFGVYVTYGAVNVQLADKTGFSEEDGEALKEALRTLFRNDETSARPAGSMEVVKLIWWKHNCASGQYSSAKVHRTLRVSCDAEGNVSVNTEDLEGLVPEVLDGE

SEQ ID NO: 4021 - protein, 291 aa, Desulfovibrio desulfuricans ND132
MTVINNRYEFVYLFDVENGNPNGDPDAGNTPRIDPETGFGLVTDVCLKRKIRNYVDVVKQGAEGYNIYVAEKGVLSQTREPAYKTEEVQKLKKKDEQIAAARNWMCANFFDVRTFGAVMSTKENNCGQVRGPVQLTFAKSIEPIVPAEVSITRMAVETSKEAEAQEGDNRTMGRKHIVPYGLYRAEGFVSANLAQGDKGTGFSDADLELLWQALGGMFDHDHSAARGKMSPRGLIVFKHQDALGNAPAHKLFEAVTVTRREGDGPARSFTDYAVAVDKGAIPDTVAVDVKF

SEQ ID NO: 4022 - protein, 296 aa, Clostridium sp. D5
MSEVIKNRYEFVVLFDVENGNPNGDPDAGNMPRIDPESGYGLVTDVCLKRKIRNYVEIVKEDAEGHRIYIKEDVPLNRSDNEAYTHLGVNDKTIKELKKKDPEADVKIRDFMCEKFYDIRTFGAVMTTFVKAALNCGQVRGPVQLGFARSIDPIISQEVTITRVAITTEKDAENKSTEMGRKNIVPYALYRVEGYISANLARKVTGFSEEDLELLWEAIINMFEHDHSAARGKMAVRELIVFKHSKELGDCPAYKLFDAVEVNKKADVQYPRKYKDYTVEIHKELIPDSIEVTRKI

SEQ ID NO: 4023 - protein, 286 aa, Lachnospiraceae bacterium 6_1_37FAA
MSSLSNKIDFALLVTVTNANPNGDPLNGNRPRDNYDGYGEISDVCIKRKLRNRLQDMGEKIFVQSDDRCDDNCDSLKSRADSCGMLKKIASGKKTNRDEYAKAACAEWIDVRSFGQVFAFKGDTVSVGVRGPVSIHQAVSLSPVDIVSMQITKSVNSESKEGKSSDTMGMKHRIEFALYEIKGSINCQLAEKTGFSDEDAEKIKHALCTLFENDSSSARPEGSMEVCRLYWWRHNCKTPSVSTAKVHRSLKISEKNLGEKPRSFDDYLITVEELPGGVVPEIIDLM

SEQ ID NO: 4024 - protein, 288 aa, Lactobacillus delbrueckii subsp. lactis DSM 20072
MVNEMANVLNHRIDFKVVFSVAGANPNGDPLNGNRPRQTSDGYGEVSDVAIKRKLRNRLQEMGEKIFVQSQDRADDGLKSLKARADSVKELKGQKDESKYQEVACQTWFDVRAFGQVFAFDKGSSVGVRGPVSIQTARSITPIMINDMQITKSVNSKDAAGRSSDTMGMKYSIDYAVYQFNGSINVQLAEKTGFTEEDANAIHEALKTLFYNDESSARPAGSMEVLRVYWWEHKNKLGDESPAKIFRTVEIKPNEGVDVVKSTEDIDWGSADSAAKTIQCDKLDIFED

SEQ ID NO: 4025 - protein, 285 aa, Ruminiclostridium papyrosolvens DSM 2782
MSILKNKIDFAVIISVKNANPNGDPLNGNRPRENYDGYGEISDVCIKRKIRNRLQDMNKEIFVQSDERRTDGFRSLKDRADGCQELKKLIKDKEKYAEYACSKWIDVRSFGQVFAFKAGEDNSVSIGIRGPVSVHSGVSASPIEISSMQITKSVNGETGKDPDKKSADTMGMKHRVDFGVYVIYGSINTQLASKTGFSEEDSELIKEALKTLFENDCSSARPDGSMEVYKLYWWKHNCEIGQYSSAKIHRSLKIKAKVDVPKCINDYSIYTDDLDGLEPKVYEGI

SEQ ID NO: 4026 - protein, 315 aa, Acetobacter pomorum DM001
MNKPVENRYEFVLYFDVTNGNPNGDPDAGNLPRLDPETNKGLVSDVALKRKVRNYISAVKEGDPGFEIYVSEGATLNVQNKKSWAAVMPDVTKDEEMKKLPKETEKALALTKWMCANFWDIRTFGAVMTTAVNAGQVRGPVQFAFARSVEPIVPLEISITRMAATTEADAEKKGGRTMGRKHIVPYGAYRVHGFVSAPLASHPVKGTGFSEEDLELLWSALLNMFELDHSAARGEMSARKLIVFKHASKLGNARAQDLFDRVKTFRTYQGSSYQVDHGSAQNPKMDNWPPARFWNDYAVVIDRENLPDGVEIIER

SEQ ID NO: 4027 - protein, 303 aa, Rubrivivax benzoatilyticus JA2 = ATCC BAA-35
MTALNRRYDFVLLFDVKDGNPNGDPDAGNLPRLDAETGHGLMTDVALKRKVRNYVGLVHGEQPPYEIYVKERAILNKTHERAYLATGGEEALKGDDKKRKGAGDQVDKARDWMCANFYDVRAFGAVMSTGVNCGQVRGPVQMTFARSIEPIVALEHSITRMAVATEAEAEKQGGDNRTMGRKHTVPYGLYRSHGFVSSFLARQTGFSAEDLELHFKALEQMFEHDRSAARGQMSTRGLYVFEHESELGNAPAHALFDRLVVSAVAPGTPARDFGAYAVTFDGSPLAVGERVQAAPGVTLQRRC

SEQ ID NO: 4028 - protein, 282 aa, Streptococcus sanguinis SK355
MLEHKIDFMVTIEVREANANGDPLSGNMPRTDAKGHGLISDVAIKRKIRNRMQDFGCPTFVQAGDRIEDEFRSLEKRFSNQFTSKDSDAEIEEKANQLWLDVRSFGQVFTYLKKSIGVRGPVSLNMAKSLEPIVISSLQITRSTNGMEAKNESGRSSDTMGTKHFVDYGIYLIKGSINPNFAEKTGFSDEDAEVIKKALISLFENDASSARPEGSMRVREVFWFTHSNKLGNVSSARVFDLFEFDKEKQDKDSYEDYAIHLNQEKLAEYETKGLKVDILEGL

SEQ ID NO: 4029 - protein, 296 aa, Centipeda periodontii DSM 2778
MMSALTKKIDFIGFITVERSNPNGDPLNGNQPRTDYGGYGEISDVCLKRKLRNRLQDAGEKILVQSNERADDGCDSIRSRVEANPAMEKPLKMKDKEEGRTRIFAEEACKAWMDVRAFGQVFALKEAKKQGVDSVSVGVRGPVTIHTAVSLDPVTITGVQITKSVNNEPGDKKGSDTMGMKYRVDFGVYKFQGSINVQLAEKTGFSEEDAQKVKEALRTIFENDASSARPEGSMEMSCFYWIEHSNKTGAASSGKVHRSVKAQKRDGVEVPSRFEDYVIDDSALYAIDGIHIEKYV

SEQ ID NO: 4030 - protein, 285 aa, Lachnospiraceae bacterium 5_1_57FAA
MTTLKGKIDFALLVSATDANPNGDPLNGNRPRENYEGYGEISDVCIKRKIRNRFQDMGQKIFVQSDDRSDDGYTSLKERAEGCEELNNEIKKKKKADRERFAQIACQEWLDVRTFGQVFAFKGEEVSVGIRGPVSIHQAVSLSPVDVVSMQITKSVNSEAGKDSKASDTMGTKHRVGFGLYLVKGSVNVQLAEKTGFSQEDAELLKEALRTLFENDASSARPEGSMEVCRLYWWQHEEKTPSVSTAQIHRSIKIEALEDRPKSFKDYSIKLEELNCVKPEVYEFV

SEQ ID NO: 4031 - protein, 258 aa, Haemophilus haemolyticus M21127
MTDVCLKRKIRDRLQDSGESIFVQSDEKKTDGMTSLANRAKDKDVGLGADAFNAKKANKDDTAKKACEKWLDVRSFGQVFAFSGDGTSGISIAVRGPVTIQSAFSIEPINITSTQITKSVSGEGDGTKKSSDTMGMKHRVDNGVYVAFGAMSPQLAERTGFSDDDAEKIKAVLTKLFEGDASSARPEGSMEVVKLIWWEHNCKAGQYSSAKVHGKLRDMIEEKVKTNTIDQLIDAIKKDSLTLKEDGTLLEPEIIDGF

SEQ ID NO: 4032 - protein, 283 aa, Haemophilus haemolyticus M19107
MTIEKRYDFVFLFDVQDGNPNGDPDAGNLPRIDPQTGEGLVTDVCLKRKVRNFIQMTQNGEHHDIFIREKGILNNLIDEAHEQENVKGKEKGEKTEAARQYMCSRYYDIRTFGAVMTTGKNAGQVRGPVQLTFSRSIDPVMTLEHSITRMAVTNEKDASETGDNRTMGRKFTVPYGLYRCHGFISAHFAKQTGFSESDLELFWQALVNMFDHDHSAARGQMNARGLYVFEHSNNLGDAPADSLFKRIQVVKKDGAEVARSFDDYLVRVDDQNLGETKLLRKLG

SEQ ID NO: 4033 - protein, 215 aa, Haemophilus haemolyticus M21639
MLNLQNKRAYEALGIESEAKKLPKDEAKARDITAWMCKNFFDIRTFGAVMTTEVNSGQVRGPVQLAFAQSIDPIVPLEVSITRMAVTNEKDLEKERTMGRKYIVPYALYRVHGFISANLAAKTGFSDDDLAKLFQALTLMFEHDRSAARGEMAARKLIVFKHDSALGSQPAHKLFDAVKVERVNGESGTPASGFGDYKISVVSDGLNGVSVEELL

SEQ ID NO: 4034 - protein, 372 aa, Thiorhodococcus drewsii AZ1
MQHRYDFIYFFDVRDGNPNGDPDAGNLPRVDPETGHGLVTDVCIKRKIRNFVALSYDYTRPNDIYVREKAVLGQSHVEAFKALGFNLGETVSRPVPDSMQEALEELDLPDGLSLDVNEDGENILTLALDVDKKLVQTWLKEVKPSTEIKKLLSEMLKGSKGRKPTAEETEKGREWMCANFFDIRTFGAVLSLKSAPNCGQVRGPVQLTFARSIDPIVSSEHAITRVAVATEAESAKQHGDNRTMGRKFTVPYGLYRAHGFISAPFAEKTGFTDADLDLLWKALSQLFDQDRSAARGEMSARALLVFKHQDRLGNAPAHQLFDRIEVARRNGDGPARAFSDYEITLDGEPLERRLSLDKPLDLGKGVTLTRMI

SEQ ID NO: 4035 - protein, 287 aa, Neisseria weaveri LMG 5135
MSIQNRYEFVFFFDVTNGNPNGDPDAGNMPRLDPESSKGLVTDVCLKRKIRNFVELANENQAGYEIYVKEKSVLNLQNKRAYEALGIESEAKKLPKDEAKARDITAWMCKNFFDIRTFGAVMTTEVNSGQVRGPVQLAFAQSVDPIVPLEVSITRMAVTNEKDLEKERTMGRKYIVPYALYRVHGFVSANLAAKTGFSDEDLQQLWNALRLMFEHDRSAARGEMAARKLIVFKHDSALGNEPAHKLFEAVKVERIHGESGTPAAAFSDYRISVHSDGLKGVTVEELL

SEQ ID NO: 4036 - protein, 291 aa, Desulfovibrio sp. 6_1_46AFAA
MSALANRYEFVLLFDVENGNPNGDPDAGNLPRIDPETGCGLVTDVCLKRKIRNYVGLAKNGEEGFNIYIQEKAVLNQRHEQAYKACALEPDKNGKRLPKKAEDAARVTAWMCANFYDVRAFGAVMSTEINCGQVRGPVQLAFARSVEPIVPQEVSITRMAVTNEKDLEKERTMGRKAIVPYGLYRAEGYISAPFAEKTGFDENDLELLWEALRTMFEHDHSAARGKMSSRKLFVFKHANRLGNTPAHALFERVTVTRKGSGTVAGPARAFSDYDVQVRRDGLESVEILEKL

SEQ ID NO: 4037 - protein, 135 aa, endosymbiont of Tevnia jerichonana (vent Tica)
MEPVSITSTQITKSVSGEGDGSKKSSDTMGMKHRVDSATYVVYGSMNPQLAERTGFSTEDAEAIKTVLPRLFEGDASSARPEGSMAVEKLIWWQHNCKSGQYSSAKVHRTLQVNSDASYQLTNLEGLVPEEIDGF

SEQ ID NO: 4038 - protein, 287 aa, Candidatus Arthromitus sp. SFB-mouse-NYU
MLLSKRYEFVILFDVENGNPNGDPDSGNMPRIDPETGHGIVTDVCIKRKIRNYIEVVEGERQGFDIYVKNGAVLNEQHRKAYEAFELKPENKKLPKDEKLAKELTGYMCKNFYDIRSFGAVMSNEVNCGQVRGPIQLNFGRSIDPIFSQDLTITRCAVTNMKDLEKGQTMGRKQIVPYALYRMEGYVSAHLAQKVTGFNEEDLNILWQAIINMFEYDRSASHGKMATRKLYVFEHETALGNAPSHKLFDLIEVERKDKSKPSRHFNDYEISIDRDSLPKGVDLIEKL

SEQ ID NO: 4039 - protein, 281 aa, Erysipelotrichaceae bacterium 2_2_44A
MTTFTNKVDFAVIFTVNKANPNGDPLSGNQPRIDFKGFGEVSDVCMKRKIRNRLQDMGENIFVQSDERSNDGFKSLSERASNNKELKAVLKDREAYASAACKQWTDVRAFGQVFAFKANNVSVGVRGPVSIRTAESINPVVTTDMQITKSVNSEPSEKCSSDTMGMKHRVDFGLYVCKGSINHQLAEKTGFSEEDAEKIKEALCSLFMNDASSARPEGSMEVCKVYWWKHNCLAGQYSSAKVHNSLKVEVKNDVDTPNCFEDFTITLSPLEGLEPEIYDGI

SEQ ID NO: 4040 - protein, 288 aa, Aggregatibacter aphrophilus ATCC 33389
MSAIQNRYEFVYFFDVTNGNPNGDPDAGNMPRLDPESSKGLVTDVCLKRKIRNFVEISSENEAGYEIYVKEKSVLNLQNKRAYEALGIESEAKKLPKDEAKARDITAWMCKNFFDIRTFGAVMTTEVNSGQVRGPVQLAFAQSIDPIVPLEVSITRMAVTNEKDLEKERTMGRKYIVPYALYRVHGFISANLAAKTGFSDDDLAKLWQALQLMFEHDRSAARGEMAARKLIVFKHDSALGNQPAHKLFDAVKVERVNGESGTPASGFDDYKISVVSDGLNGVSVEELL

SEQ ID NO: 4041 - protein, 297 aa, Aggregatibacter actinomycetemcomitans serotype d str. I63B; identical to SEQ ID NO: 3930

SEQ ID NO: 4042 - protein, 288 aa, Aggregatibacter actinomycetemcomitans serotype e str. SC1083
MTAIQNRYEFVYFFDVTNGNPNGDPDAGNMPRLDPESSKGLVTDVCLKRKIRNFIEISAENQPGYEIYVKEKSVLNLQNKRAYEALGIESEAKKLPKDEAKAREITAWMCKNFFDIRTFGAVMTTEVNSGQVRGAVQLAFAQSIDPIVPLEISITRMAVTNEKDLEKERTMGRKYIVPYALYRVHGFISANLATKTGFSDDDLAKLWRALQLMFEHDRSAARGEMAARKLIVFKHDNSFGSQPAHKLFDAVKVERVNGESGTPASSFGDYKISVHSDDLKGVSVEEYL

SEQ ID NO: 4043 - protein, 297 aa, Aggregatibacter actinomycetemcomitans serotype a str. H5P1; identical to SEQ ID NO: 3930

SEQ ID NO: 4044 - protein, 258 aa, Aggregatibacter actinomycetemcomitans serotype e str. SCC393
MTDVCLKRKIRDRLQDGGESIFVRSDEKKTDGMTSLANRAKDKDVGLGAEAFNAKKANKDETAQKACEKWLDVRSFGQVFAFSGDGSTGISIAVRGPVTVQSAFSIEPINITSTQITKSVSGEGDGTKKSSDTMGMKHRVDHGVYVAFGAMSPQLAERTGFSDDDAEKIKAVLTKLFEGDASSARPEGSMQVLKLIWWEHNCKAGQYSSAKVHGKLKEIIEKRVKDNSINQLLEDVTEDKLTVMENGMSLKPEILDGF

SEQ ID NO: 4045 - protein, 288 aa, Aggregatibacter actinomycetemcomitans serotype a str. H5P1; identical to SEQ ID NO: 3931

SEQ ID NO: 4046 - protein, 288 aa, Aggregatibacter actinomycetemcomitans serotype f str. D18P1; identical to SEQ ID NO: 3931

SEQ ID NO: 4047 - protein, 297 aa, Aggregatibacter actinomycetemcomitans serotype f str. D18P1
MSLSKKIDFALILKVTNANPNGDPLNGNRPRADFQGFGEMTDVCLKRKIRDRLQDGGESIFVQSDEKKTDGMTSLANRAKDKDVGLGAEAFNAKKANKDETAQKACEKWLDVRSFGQVFAFSGDGSTGISIAVRGPVTVQSAFSIEPINITSTQITKSVSGEGDGTKKSSDTMGMKHRVDHGVYVAFGAMSPQLAERTCFSDDDAEKIKAVLTKLFEGDASSARPEGSMQVLKLIWWEHNCKAGQYSSAKVHGKLKEIIEKRVKDNSINQLLEDVTEDKLTVMENGMSLKPEILGGF

SEQ ID NO: 4048 - protein, 203 aa, Aggregatibacter actinomycetemcomitans serotype e str. SCC393
MGIESEAKKLPKDEVKAREITAWMCKNFFDIRTFGAVMTTEVNSGQVRGPVQLAFAQSIDPIVPLEISITRMAVTNEKDLEKERTMGRKYIVPYALYRVHGFISANLAAKTGFSDDDLAKFWQALQLMFEHDRSAARGEMAARKLIVFKHDNALGSLPAHKLFDAVKVERVNGELGTPAGGFGDYKISVHSDDLKGVSVEEYL

SEQ ID NO: 4049 - protein, 74 aa, Aggregatibacter actinomycetemcomitans serotype e str. SCC393
MATVQNRYEFVYFFDVTNGNPNGDPDAGNMPRLDPESSKGLVTDVCLKRKIRNFIEISAENQPGYEIYVKEKAC

SEQ ID NO: 4050 - protein, 75 aa, Aggregatibacter actinomycetemcomitans serotype b str. SCC1398
MFDHDHSAARGQMNARGLYVFEHSSSLGDAPADSLFKRIRVAKKDGVEVARNFDDYTVSVDETNLGETKLDRKLG

SEQ ID NO: 4051 - protein, 283 aa, Neisseria sp. GT4A_CT1
MTIEKRYDFVFLFDVQDGNPNGDPDAGNLPRIDPQTGEGLVTDVCLKRKVRNFIQMTQNDEHHDIFIREKGILNNLIDEAHEQENVKGKEKGEKTEAARQYMCSRYYDIRTFGAVMTTGKNAGQVRGPVQLTFSRSIDPIMTLEHSITRMAVTNEKDASETGDNRTMGRKFTVPYGLYRCHGFISAHFAKQTGFSENDLELFWQALVNMFDHDHSAARGQMNARGLYVFEHSGSLGDVPADSLFKRIQIAKKDGVEVARSFDDYLVRVDDQNLGETKLLRKLG

SEQ ID NO: 4052 - protein, 297 aa, Aggregatibacter actinomycetemcomitans D17P-3; identical to SEQ ID NO: 3930

SEQ ID NO: 4053 - protein, 288 aa, Aggregatibacter actinomycetemcomitans D17P-3; identical to SEQ ID NO: 3931

SEQ ID NO: 4054 - protein, 293 aa, Thiorhodospira sibirica ATCC 700588
MTAITHRYEFVYLFDVTNGNPNGDPDAGNLPRLDPETNCGLVTDVSLKRKIRNYVTLDKDSAPGFAIYMQEKAVLNNQHKRAYEALEIKPEDKKLPKDEAKARAITAWMCANFFDVRTFGAVMTTGINAGQVRGPVQLAFATSIEPVLPLEIAITRMAVTTEKEAEAQSGDNRTMGRKHILPYGLYRAHGFVSAKLAERTGFSDDDLQLLWNALINMFEHDRSAARGEMAARKLIVFEHESAMGNAPAHVLFDAVKIQRTEGTQDRPARSFADYRVNVDAKAMPKGVSVRELL

SEQ ID NO: 4055 - protein, 288 aa, Paenibacillus lactis 154
MSILDHKIDFAVVLSVHNANPNGDPLNGNRPRQNYDGHGEISDVCIKRKIRNRLQDMGEPILVQSDERRGDAYRSIKERVDANAEVSEFAKGKKQNNDMYAEAACKAWMDVRSFGQVFAFSGTDVSVGIRGPVSIHTAVSVDPIDITSMQITKSVNAVTPKDPNKKSSDTMGMKHRVDFGVYVFYGSINTQLAEKTGFTREDAEKIREALRTLFENDTSSARPDGSMEVHHLYWWEHSSKLGQYSSAKVHRSLKVQRKEGVSDAKSFADYDCIVEPLEGLRVQEYAGI

SEQ ID NO: 4056 - protein, 295 aa, Olsenella sp. oral taxon 809 str. F0356
MEEIKNRYDFVFYFDVENGNPNGDPDAGNMPRIDAETGIGIVSDVCLKRKVRNYVDLTREGTAGYRIYVQNGAVLNDRNKEAYINNDIKQESKKLPKNLEDQVKVTKFMCDNFYDIRTFGAVMTTEVNCGQVRGPVQLCFSRSVEPIMPAEMSITRMAVTNSKDADKGKTMGRKEYVPYGLYRLEGFVSAPLAEKSGFSDDDLNLLWEALMNMFENDRSASRGLMTSRRLIVFRHESRLGNAPAHRLFDLVKAERADANPSRPGRHFSDYMISVDEDNLPTGVTVKSFDYIPPQE

SEQ ID NO: 4057 - protein, 326 aa, Selenomonas infelix ATCC 43532
MMAALTKKIDFVGFITVERSNPNGDPLNGNQPRTDYSGFGEISDVCLKRKMRNRLQDAREKILVQSDERVDDGYDSIRTRVKEHPIVGQLLVRLESDKGKGEDKEQNGSDKRLIRLEFAKEACKAWMDVRTFGQVFAFKKSKKGKSAEDDSESTQTDAVSVGVRGPVTLHTAVSLDPVTITGIQITKSVNNEPGDKKGSDTMGMKYRVDFGVYKFQGSINVQLAEKTGFSEEDAVKVKEALRTIFENDASSARPEGSMELSHFYWVEHSNKTGSAPSAKVHRSISAQKKVDVETPTSLGDYIIDDSALYAIDGIRIEKYVEGSLVD

SEQ ID NO: 4058 - protein, 301 aa, Selenomonas noxia F0398
MAVLTKKIDFIGFITVERSNPNGDPLNGNQPRTDYGSYGEISDVCLKRKLRNRLQDIGEKILVQSNERADDGCDSIRSRVEANPAMDKPLKMKDKEQGRTRIFAEEACKAWIDVRSFGQVFALKEAKKQGVDAVSVGVRGPVTLHTAVSLDPVTITGIQITKSVNNEPGDKKGSDTMGMKYRVDFGVYKFQGSINVQLAEKTGFSEGDAEKIKEALCTIFENDASSARPEGSMEMSRFYWIEHANKTGCAPSAKIHRSVSAQKKDGVERPSHLDDYIIDDSALYAIDGIHIEKYVEGSLVD

SEQ ID NO: 4059 - protein, 288 aa, Aggregatibacter actinomycetemcomitans RhAA1; identical to SEQ ID NO: 4042

SEQ ID NO: 4060 - protein, 293 aa, Aggregatibacter actinomycetemcomitans RhAA1
MTIEKRYDFVFLFDVQDGNPNGDPDAGNLPRVDPQTGEGLVTDVCLKRKVRNFIQMTQNDEHHDIFIREKIILNDLIAEAHKQDEVKDKPKGKERMESARQYMCNRYYDIRTFGAVLTTGENAGQVRGPVQLTFSRSIEPIVTLEHSITRSAPAKEVEILNPDDSEEEKAKKERGRMGRKFTVPYGLYRCHGFISAHFAKQTGFSEEDLALFWKALINMFDHDHSAARGQMNARGLYVFEHSSSLGDAPADSLFKRIRVAKKDGVEVARNFDDYTVSVDETNLGETKLDRKLG

SEQ ID NO: 4061 - protein, 286 aa, Thermanaerovibrio velox DSM 12556
MSCVDRRYDFVYFFDVVDGNPNGDPDAANMPRIDAETGIGLVTDVCIKRKVRNYVYITRNEGPGYGIFVKEKAVLNNFIDEAREQEEVKARKTEGEMVEAARNWMCRKYYDVRAFGAVMSTGKNAGQVRGPIQLTFARSLEPIVALEHSITRMAVATEAEAKEQSGGNRTMGRKYTVPYGLYRAYGFVSAHLAAQTGFSKDDLDLFWEALQVMFEHDRSAARGLMSARALIVFEHETALGNKPAHELFERVTWERTTEGPARSFSDYALFLDGNPITSPLNFVSVK

SEQ ID NO: 4062 - protein, 302 aa, Jonquetella anthropi DSM 22815
MTTLTNRYDFAFYFDVQDGNPNGDPDMDNQPRIDLETGHGLVSDVCLKRKVRNYIMMACRTPEGQPKEGYEVFIKEKAVLNTMIGQAWDDAEKKSSGENKKDGKKDKNPQVEMAAQQLMCARFYDVRAFGAVMSTGSSDSGGKKTAGQVRGPIQLTFARSQLPIVVAEHCITRMAVTNEKNAEKERTMGRKFTVPYALYCAHGFVSPFLAQQTGFSEEDMEIFWDALLNMFEIDRSAARGLMTARRLVIFKHSSALGSAPAADLFEKIAVAVSDGVTPRSFGDYRLTLDGQELTERKKIVLI

SEQ ID NO: 4063 - protein, 279 aa, Eubacterium infirmum F0142
MNKIDFIMTFTVSNANPNGDPLAGNMPRTNASGFGEVSDVCIKRKIRNRFQDNGFDIFVKSKERSDDGCKSLESRYKHFFNDAVSDVELEKAFNEKWIDVRGFGQVITYDKRSIGIRGPISIGIAKSLDPVSIENMQITKSVNGMETKNEKGVSSDTMGMKYFVEFGTYIVQGAINAYFAEKTGFDELDVDAFKEALRTLFVNDSSSARPDGSMEVQDIFWFEHSCPVGNVSSAKIKNLVKWDESDEHKCYEDYNIRIDEEKLKEYEGLGLKLTVIKGL

SEQ ID NO: 4064 - protein, 284 aa, Geobacter metallireducens RCH3; identical to SEQ ID NO: 3851

SEQ ID NO: 4065 - protein, 299 aa, Leptonema illini DSM 21528
MSAISNRYEFVYLFDVKDGNPNGDPDAGNMPRIDSETGHGLVTDVSLKRKVRNYVGITKRYEPPYDIYIKEKAVLIEAHEKAYKELGVDLEKDDKKRKGGDRVPEARSWMCKNFYDVRSFGAVMALKVNAGVVKGPVQLSFARSVDPVLQFEHSITRMAVATKEEAESQGGDNRTMGKKHTVPYGLYRSHGFISAFYAEDTGFTEEDLQLFWNSLTNMFDHDRSAARGEMSARRLIVFKHIGEGESARLGTHPAHKLFDTVTVHRKSDGPPRSYADYEVKIDEAAIEKLKGKIELLDLI

SEQ ID NO: 4066 - protein, 284 aa, Desulfosporosinus youngiae DSM 17734
MSILQNKIDFAAIVSVTRANINGDPLNGNRPREDYDGHGIFSDVAVKRKLRNRLQDLGECIFVQSDDRSDDGYKSLKDRADGYEEFKAEMGKGKKADRDKCMQIACRKWFDVRAFGQVFAFKGDEVSVGVRGPVSVQQAVSVSPIDIVGMQITKSVNSEAGKSGKSSDTMGMKHFVNFGLYVIRGSINCQLAEKTGFTHEDAERFKEALRTLFENDASSARPEGSCEVCRVYWWEHGDKTPKETSAMIQRALHITPKKDVPQSFADYEIELKPTECVPEIIDLV

SEQ ID NO: 4067 - protein, 229 aa, Candidatus Arthromitus sp. SFB-1
MLLSKRYEFVILFDVENGNPNGDPDSGNMPRIDPETGHGIVTDVCIKRKIRNYIEVVEGERQGFDIYVKNGAVLNEQHRKAYEAFELKPENKKLPKDEKLAKELTGYMCKNFYDIRSFGAVMSNEVNCGQVRGPIQLNFGRSIDPIFSQDLTITRCAVTNMKDLEKGQTMGRKQIVPYALYRMEGYVSAHLAQKVTGFNEEDLNILWQAIINMFEYDRSASHGKMATRK

SEQ ID NO: 4068 - protein, 287 aa, Candidatus Arthromitus sp. SFB-4; identical to SEQ ID NO: 4038

SEQ ID NO: 4069 - protein, 287 aa, Candidatus Arthromitus sp. SFB-5; identical to SEQ ID NO: 4038

SEQ ID NO: 4070 - protein, 287 aa, Candidatus Arthromitus sp. SFB-co; identical to SEQ ID NO: 4038

SEQ ID NO: 4071 - protein, 287 aa, Candidatus Arthromitus sp. SFB-mouse-SU; identical to SEQ ID NO: 4038

SEQ ID NO: 4072 - protein, 288 aa, Treponema saccharophilum DSM 2985
MAKLEKRYDFVLYFDVKDGNPNGDPDAGNLPRIDAETGNGIVTDVCLKRKIRNYVQISKGAEAGYDIFVKEKAVLNKEIDDIYKELGINADSKNKAKGADVEKGRAGMCKKFFDIRTFGAVLSTGANAGQVRGPVQLTFARSVEPVVALEHSITRMAVTSEEESEKQGGDNRTMGRKYTIPYGLYKAYGFVSPHFASSTGFSTEDLDVLWDALTQMFELDHSAARGLMTTRRLVIFEHQTALGTKPADELFNRVKCEHTGNVPARDFSDYTISLDGNPLSEIKTVVAL

SEQ ID NO: 4073 - protein, 372 aa, Thiorhodovibrio sp. 970
MSIGHRYDFVLLFDVQDGNPNGDPDAGNLPRLDAETGQGLVTDVSLKRKVRNFVGLTKQQGDGQFAPGYDIYVKEKAVLGHAHVQTFEKLGINLGEKKVVPVPAELEDALTEITLPAGIERITDDEGQSQLEFSAVLDKAEVKDWLKETPDLDKNLVKLINQALKDAKPRRPKPEETERGRVQMCKDFFDIRTFGAVLSLKSAPNCGQVRGPVQLTFARSVDPIVAAEHSITRMAVATEAEAEKQSGDNRTMGRKHTVPYGLYRGHGFVSAFLAKQTGFSDDDLQLFWQALGQMFEHDRSAARGQMATRGLYVFKHDSELGNAPAHKLFDLIRIERNDTQRPARQIGDYRIESPPPGPLADFPGVEFLVLNQ

SEQ ID NO: 4074 - protein, 289 aa, Desulfovibrio sp. U5L
MRQPIANRYEFVFLFDVENGNPNGDPDAGNMPRLDPETSHGLVTDVCLKRKIRNFVELAKGNASPYEIYIREKAVLGTVQGRAYAAVAKEGGKKADAIKEARDWMCANFFDVRTFGAVMSLKENNCGQVRGPVQLNFARSIEPIVPLEVSITRMAVATEKEAESQSGDNRTMGRKHIVPYGLYRAEGFISAHLAAQTGFSEDDLELLWQALMVMFDHDHSAARGKMSARKLVVFKHESMLGNAPAQKLFDLVGVSRATDRSSPARAYADYAVAVDAANLPAGVELIEKL

SEQ ID NO: 4075 - protein, 295 aa, Thiothrix nivea DSM 5205
MSLQHRYDFVLLFDVKDGNPNGDPDAGNLPRVDAETGQGLVTDVSLKRKVRNFIGLLKEEQPPYEIYVKEKAILNKQHERAYQAIPGGTELLAGDDKKRKGGDKVEEARQWMCHNFYDVRTFGAVMSTGVNCGQVRGPVQMTFARSVDPVIASEHSITRMAVATEKEAEKQDGDNRTMGRKFTVPYGLYVAHGFVSAHLADQTGFSDSDLELLWQALSNMFEHDRSAARGEMATRGLYVFKHDSKLGNAPAYSLFERVKAELKDKDSVPRSFSDYTVTVDADNLPNGVELLTLVD

SEQ ID NO: 4076 - protein, 291 aa, Rhodanobacter thiooxydans LCS2
MSLSNRYDFVLLFEVRDGNPNGDPDAGNLPRLDAETGHGLVTDVSLKRKVRNFVGLVKGDAAPYEIYVKEKAVLNKTHERAYEGIGKAELLKGDDKKRKGGEAVSQARAWMCQNFFDVRTFGAVMSTGVNCGQVRGPVQLTFARSADPIIAQEHSITRMAVATEAEAEKQDGDNRTMGRKHTVPYGLYMAHGFVSSFLAKQTGFSRDDLELLWQALVQMFEHDRSAARGEMATRGLYVFKHESELGNAPAHALFERIQVSKNAEIPRSFADYTVAVNDADLPVGVTLTRLV

SEQ ID NO: 4077 - protein, 300 aa, Eubacterium cellulosolvens 6
MSDVIKNRYDFVVFFDVENGNPNGDPDSGNMPRVDAETQLGLVTDVCLKRKVRNYVETVKDDATGYRIYVKSHAVLNKNDEEAYAALGVDNDLKKIATKKKEDPELDLKIRDWMCKNFYDIRTFGAVMTTYTKAKLNCGQVRGPVQFGFAKSVEPIIPQEITLTRVAITTEKDAEKKNNEMGSKYIVPYGLYRCEGFVSANLARKTTGFSEDDLSLLWDAIYNMFENDHSAARGKMAVRKLIIFKHETELGNAPSHKLFELVSVKRKDEESSAPARSFADYEIVINEDQIPSGVELTVRD

SEQ ID NO: 4078 - protein, 284 aa, Opitutaceae bacterium TAV1
MKNRYDFIYIFDVQDGNPNGDPDAGNLPRLDPETGNGLVTDVCLKRKIRNFVALVKNGQPPYDIYIREKAILNDQHEKAYVALGKDVKKTKQEDRDETRAWMCQNFYDIRTFGAVMTTEVNCGQVRGPVQLSFSRSVDPIITSEHAVTRCAVTTKKEAEKQDGDNRTMGRKSTVPYALYLGHGFINPFLAAQTGFSDDDLALLKTAFGQMFELDRSASRGLMSPRRCIAFKHDSQLGNAPAHKLFDAVTVKKKANVDVPRSFADYEVTIDQAAIPQGVTVEEWV

SEQ ID NO: 4079 - protein, 287 aa, Fictibacillus macauensis ZFHKF-1
MTVLDHKIDFAVVFSVTKANPNGDPLNGNRPRQNYDGHGEVSDVAIKRKIRNRLQDMEESVFVQSADRTTDPFNSLRERAEGSDLYAQALKEKNNQAEKLAEVACQEWIDVRSFGQVLAFKGAGKSKGVSVGIRGPVSIHTATSVSPIDITSMQITKSVNSESGSERGSDTMGMKHRVDFGLYVFKGSINTQLAEKTGFTHEDAQKIKSALITLFENDVSSARPDGSMEVQKVCWWTHNSKLGQYSSAKVHRLLEVKAEVDEPKSIEDYTIVVNELEGLQAEVVSGL

SEQ ID NO: 4080 - protein, 301 aa, Pelosinus fermentans B4
MRTLENKIDFAVVINVKNANPNGDPLNGNRPRTNYDGYGEISDVCIKRKIRNRLMEMGKEYSIFVQSDDNRVDGYRSLRERAEGELKDALKNEENFREEACKKWLDVRAFGQVFAYSGGKKGKGKAKSESGEEPGDDKGVSIGIRGPVSIHPAFSVSPISISSIQITKSVSGEGDGSKRASDTMGMKHRVDHGVYVFYGSINPQLASKTGFNDVDAEVIKQALSELFQNDASSARPEGSMEVYQVYWWRHDSKNGQYSSGKVHRSLEIVLKDSVAEAKSIDDYNITIHPLENLVPEIIDGK

SEQ ID NO: 4081 - protein, 301 aa, Pelosinus fermentans A11; identical to SEQ ID NO: 4080

SEQ ID NO: 4082 - protein, 301 aa, Pelosinus fermentans A12; identical to SEQ ID NO: 4080

SEQ ID NO: 4083 - protein, 301 aa, Pelosinus fermentans DSM 17108; identical to SEQ ID NO: 4080

SEQ ID NO: 4084 - protein, 301 aa, Pelosinus fermentans B3; identical to SEQ ID NO: 4080

SEQ ID NO: 4085 - protein, 283 aa, Methanofollis liminatans DSM 4140
MSEIIKNRYEFVLLFDVENGNPNGDPDMGNMPRVDPQTGYGIVTDVCLKRKIRDYVDLVKSGEAGYDIYVKSGVVLNDQNKKAYDYLGIKPDSKKPKDDELTKFMCQNFFDIRAFGAVMTTEVNCGQVRGPVQFCFARSADPIFQQEVTVTRCAVTNERDAEKGQTMGKKQIVPYGLYRAEGYISAHLAKKTTGFNEDDLNLLWDSLINMFEHDHSAARGKMSARKLIVFKHESELGNCQSHILFDKVKVEHLSRDLPPRSFADYNVTIADDIPKGVELIEKL

SEQ ID NO: 4086 - protein, 286 aa, Brevibacillus sp. CF112
MTTLDHKIDFAVVLSVTKANPNGDPLNGNRPRQNYDGHGEISDVALKRKIRNRLQDMGESIFVQSNDRKSDSYGSLRERADANAELEKVLKSKNVSSDEFARIACQEWIDVRSFGQVFAFKAEKGAGVSVGVRGPVSIHTATSLDPIDISSVQITKSVNSEPGASRGSDTMGMKHRVDSGVYVFYGSINTQLAEKTGFTNEDAEKIKRALVTLFENDASSARPEGSMEVHRVYWWEHPSKLGHYSSAKVHRSLLIERLVEEPKKFDDYMFSVQPLDGLKVEILDGI

SEQ ID NO: 4087 - protein, 286 aa, Bacillus alcalophilus ATCC 27647
MSTLDHKIDFAVVFTVTKANPNGDPLNGNRPRQNYEGKGEVSDVALKRKIRNRLMQMEESVFVQSNDNKVDSYGSLKERAEAIPELQKIMKDKNGSSDAFALLACNEWIDVRSFGQVFAFKGSGGKGVSVGVRGPVSIHTATSVDQIDITNMQITKSVNSEPGTAKGSDTMGMKHRVDFGVYVFKGSINTQLAEKTGFSNEDAKKFKEALITLFENDASSARPDGSMEVNKVLWWEHSSKLGQYSSAKVHRTLKIEKNTEEPREFEDYTIQIDELDGLVPEVIDGL

SEQ ID NO: 4088 - protein, 286 aa, Paenibacillus alvei DSM 29
MTVLDHKVDFAVVFSVTKANPNGDPLNGNRPRQNYDGHGEISDVALKRKIRNRLQDNGESIFVQSNDRNTDSFKSLRERAEANEALAKIMKAKDGASEEFAKIACEEWIDVRSFGQVFAFKGGSDKGVSVGVRGPVSIHTATSVEPIDITSMQITKSVNSEPGKDKGSDTMGMKHRVDFGIYVCYGSINTQLAEKTGFTNDDAEKIKQALVTMFENDVSSARPDGSMEVVKVFWWEHRSKLGQYSSAKVHRSLKVSKNKEEPKSLEDYTIAWNELDGLSVEVIDGL

SEQ ID NO: 4089 - protein, 116 aa, bacterium
MGRKHIVPYGLYVAHGFVSAPLAEKTGFSEDDLQVLWEALGNMFEHDRSAARGMMSSRKLFVFKHDNKMGNAPAHQLFDLIKIERSAGSNGPARSFKDYAVTVGAIPTGVTLEEKL

SEQ ID NO: 4090 - protein, 289 aa, Salimicrobium jeotgali
MSNNTLKNKIDFAVVLSVSKANPNGDPLNGNRPRQDFDGLGEISDVAIKRKIRNRLMDMGEKVFVQSNDRKMDEYDSLKARASGKKELEEILKDKADRDEEFASLACEEWIDVRSFGQVFAYKGSNKGSGVSVGVRGPVSIHTATSLDPVDVTSTQITKSVNSESGDKRGSDTMGMKHRVDFGVYVFYGSINPQLAEKTGFTHEDAMKIKEALRTLFENDSSSARPEGSMEVNKLYWWEHDSKLGKHSAAKVHRSLNISRNVDSPHTIKDYEIRVEELTDLQVEEIEGQ

SEQ ID NO: 4091 - protein, 286 aa, Bacillus xiamenensis
MNTLNKKIDFAVVLSVHKANPNGDPLNGNRPRQTHEGYGEISDVAIKRKIRNRLLDMGESIFVQSNDRKIDGFGSLKERAEADPDVGKRLKDKKATMDEIARLACEKWTDVRSFGQVFAFKGTGGGVSVGVRGPVSIHAATSITPIDLTSMQITKSVNSEPGEKKGSDTMGMKHRVEHGVYIFYGSINTQLAEKTGFTEQDAENIKEALRTLFENDASSARPEGSMEVNKVIWWEHQSKMGQYSSAKVHRLLNIKPLHGEPKTFEEDYHFSVSELEGLQYQVLDGK

SEQ ID NO: 4092 - protein, 321 aa, Acidocella sp. MX-AZ02
MSALLTQRHDFVLFFDVTNGNPNGDPDAGNMPRLDPETSRGLVTDVCLKRKIRNWVELSREDRARYRIYVTEGAVLNEKHREAYIAECPDYKDVKTAAKLTPKSDEDALKLRKFMCDNFFDIRAFGAVLSTGINCGQVRGPVQLSFAESVEPVLPLEISITRMAATSEKEKKDLAEGDDEKRGDKRTMGRKHIIPYGLYRVHGYVSAPLASHGTKGTGFTQDDLEVLFEALDQNMFEHDRSAARGEMAKRKLLIFRHESPLGNAPSHELFGRITTLRRFKGQTHAIGDEATDNWPPARSFDDYEIRVDRDNLPAGVELIER

SEQ ID NO: 4093 - protein, 367 aa, Thermaerobacter subterraneus DSM 13965
MMVYTDPARRHEFVLLFDVRDGNPNGDPDAGNMPRIDPETMYGLVTDVALKRKVRDYVSGVLNIPIFIQSRTTLNTLIREAFESVGYVPPGIDLDPEELDDQDLVEWLQEKGDVGFSVDGKRLLYSGESRNRRDIQRELTDGLPEEHQQLRQKLTRIARRLGDVLNKGAGQVSAREKQEDARKELCRKYYDIRIFGAVLSTGLNAGQVRGPVQFTFARTVDPIQPLDLTITRQARTNTVRMGKKGNAEMGRKPVVPYGLYRAHGYFNPYLAKETGVTTQDLETLWDALQNLFEFDRSAARGEMHVRGLIVFTHDNPKGNAPAHKLFDLVTVRRRDGVSVPRGYHDYAVVIHRDDLPPGVTLSVLVEP

SEQ ID NO: 4094 - protein, 289 aa, Providencia burhodogranariea DSM 19968
MSLENKIDFAIIFDVRNANPNGDPLNGNRPRTDYDGYGEITDVCLKRKIRDRLQDDGEAIFIQSDEKKIDGMPSLRERAISDEFGLGKNVFDTKKTSIEDAAKLACEKWLDVRTFGQLFAFKGTGKDGVSIAIRGPVTLQSAFSIEPINITSTQITKSVSGEGDGTKKGSDTMGMKHRVDNATYVTYGAISPQLAEKTGFNDDDADKIKQVLVRLFEGDASSARPEGSMRVTHLVWWPHNSKSGQYSSAKVHQTLRDHIEKNLPLETNALNESLINALNGLTVEIIEGF

SEQ ID NO: 4095 - protein, 286 aa, Brevibacillus agri BAB-2500; identical to SEQ ID NO: 4086

SEQ ID NO: 4096 - protein, 292 aa, Xanthomonas translucens DAR61454
MSAIAHRYEFVYLFDVTNGNPNGDPDAGNLPRLDPETNRGLVTDVALKRKIRNYVALEKENTPGYTIYMQEKSVLNSQHELAWKALNIPPDEKEKYKKLPKDQAKAKELTFWMCTNFFDVRTFGAVMTTEVNTGQVRGPVQLAFASSVEPVLPLEVSITRVAVTNEKDLEKERTMGRKHILPYGLYRAHGFVSAKLAERTGFSEDDLQLLWRALTNLFEHDRSAARGEMAARKLIVFEHEHPMGNAPAHVLFDKVKVERVESADNEPARCFSDYRVLIDRDLPAGVTVTELI

SEQ ID NO: 4097 - protein, 290 aa, Photobacterium marinum
MPLSNKIDFAIIFRVNHANPNGDPLNGNRPRQDYDGYGEVTDVCLKRKMRDRLQEQGYPIFVQSDEKKTDGMPSLRVRAESEEFGVGKDVFNTKKTPITEAAKIVCNKWLDVRAFGQVFAYSKTSGSEGISLPIRGPVTIQSAFSLEPISISSTQITKSVSGEGDGNKKSSDTMGMKHRVDSATYVTFGAMTPQLAEKTGFSNEDAEVIKAVLPRLFEGDASSARPEGSMMVEKVIWWQHDSKSGQYSSAKVHQTVREHLNKGLPLDTSALNDSLLNTLPGLSPEIIDGF

SEQ ID NO: 4098 - protein, 297 aa, Aggregatibacter actinomycetemcomitans serotype a str. A160
MSLSKKIDFALILKVTNANPNGDPLNGNRPRADFQGFGEMTDVCLKRKIRDRLQDGGESIFVRSDEKKTDGMTSLANRAKDKDVGLGAEAFNAKKANKDETAQKACEKWLDVRSFGQVFAFSGDGSTGISIAVRGPVTVQSAFSIEPINITSTQITKSVSGEGDGTKKSSDTMGMKHRVDHGVYVAFGAMSPQLAERTGFSDDDAEKIKAVLTKLFEGDASSARPEGSMQVLKLIWWEHNCKAGQYSSAKVHGKLKEIIEKRVKDNSINQLLEDVTEDKLTVMENGMSLKPEILDGF

SEQ ID NO: 4099 - protein, 288 aa, Aggregatibacter actinomycetemcomitans serotype a str. A160; identical to SEQ ID NO: 3931

SEQ ID NO: 4100 - protein, 313 aa, Rhodopirellula europaea 6C
MSTATAEPTAADLSKDAIANRYEFVLLFDVTNGNPNGDPDAGNAPRVDPETGHGLVSDVCIKRKVRNLITLAKRKEDGSPEDGYDIYVKEKAILNDQHKRGYDALGLDPKAKEGKLKEGESPKEERVRRWMCQNFFDVRMFGAVMSTGVNAGQVRGPIQFAFARSVDRIAALEQSITRMAVTTEKESVKQDGGNRTMGRKEIVPYALYEMHGYISPFLAQQTGFNEDDLELFFNALTQMFDHDRSASRGEMSACQLIVFKHASPLGNAPARKLFGLVDIKLKDGVEVPRSFEDYTVTIDESKKPNGIEIHERL

SEQ ID NO: 4101 - protein, 287 aa, Mannheimia haemolytica serotype 6 str. H23
MSIQNRYEFVFFFDVTNGNPNGDPDAGNMPRLDPETSKGLVTDVCLKRKIRNFIEMSYENEAGYEIYVKEKSVLNLQNKRAYEALGIESEAKKLPKEEAKAREITAWMCKNFFDIRTFGAVMTTEVNSGQVRGPVQLAFAQSIDPIIPLEVSITRMAVTNEKDLEKERTMGRKYIVPYALYRVHGFISAKLAEKTGFSDEDVQKLWQALQLMFEHDRSAARGEMAARKLIVFKHDSELGNQPAHKLFDSVKVERINGEKDTPAKDYDDYCISVQTEGLTGVTVEELL

SEQ ID NO: 4102 - protein, 284 aa, Rhodopirellula europaea SH398
MNHRYDFVFLFDVTDGNPNGDPDAGNLPRVDPETGHGLVTDVCLKRKIRNFVATVKDETPPYEIYVKERAVLNVQHSRAYEALKLDETKAKRAEVDQCRDWMCQNFYDVRTFGAVMSTKVNCGQVRGPVQMAFSRSIDPIVSLEHSITRCAVATEKEAEKQDGDNRTMGRKFTVPYGMYRCHGFINPFFARQTGFGEDDLQLFWKSLQNMFELDRSASRGQMTPQALVVFQHDEALGNAPAHQLQKRVSVVRRDPVTPARSSDDYAIQIDESDLPKGIAILKVF

SEQ ID NO: 4103 - protein, 313 aa, Rhodopirellula sallentina SM41
MSTATAEPTAADLSKDAIANRYEFVLLFDVTNGNPNGDPDAGNAPRVDPETGHGLVSDVCIKRKVRNLITLAKRKEDGSPEDGYDIYVKEKAILNDQHKRGYDALGLDPKKKEGKLKEGESPKEERVRRWMCQNFFDVRMFGAVMSTGVNAGQVRGPIQFAFARSVDRIASLEQSITRMAVTTEKESAKQEGGNRTMGRKEIVPYALYEMHGYISPFLAQQTGFNEDDLELFFNALTQMFDHDRSASRGEMSACRLIVFKHDSPLGNAPARKLFSLVDIKLKDGVEVPRSFEDYTVTIDESKKPGGIEIIERL

SEQ ID NO: 4104 - protein, 294 aa, Ruminiclostridium cellobioparum subsp. termitidis CT1112
MSEIIMNRYEFTILFEVKNGNPNGDPDAGNMPRIDPETGYGIVTDVCLKRKIRNYIETIKEERPGYRIYIKDGSPLERSDREAFAYLGISDEKEAQSKKEDIDVKIKDFMCKNFFDIRTFGAVMTTFVKAKLNCGQVRGPVQIGFARSIDPIVQQEIAITRVVATTEKDAAKKETEMGRKYIIPYALYRVDGYISANLAKKTTGFTEDDLNLFWDAVINMFEHEHSAARGNMSVRELIVFKHDSEFGNCPAYKLFDTVSIARKDESNPPRSFDDYIVTVDEKAIPAGVELIRKI

SEQ ID NO: 4105 - protein, 297 aa, Thauera sp. 63
MTAIAHRYEFVYLFDVTNGNPNGDPDAGNLPRLDPETNCGLVTDVALKRKIRNFVTLDKEGTPGFAIYMQEKAVLNNQHLLGRQAVGLTNESKEELKKLPKDEAKAREITAWMCANFFDVRTFGAVMTTGVNAGQVRGPVQLAFATSVEPVLPLEISITRMAVTTAEEAEKQSGDNRTMGRKHILPYGLYRAHGFVSAKLAERTGFSDNDLQLLWHALINMFEHDRSAARGEMAARKLIVFEHESAMGNAPAHVLFDAVEVKRAEGTEDCPARSFADYRVRVDADAMPKGVSVRELL

SEQ ID NO: 4106 - protein, 266 aa, Exiguobacterium sp. S17
MNVLDHKIDFTVVLSVSKANPNGDPLNGNRPRQNYDGYGEISDVAIKRKIRNRLQDMGETIFVQSNDRRSDSYESLRDRAEGSEELKKLMKGKGMGDQFAQEACATWMDVRSFGQVFAFKGEKSGVSIGVRGPVSIHTATSVAPIDITSMQITKSVNSESGKERGSDTMGMKHRVDHGVYVLNGSINTQLAEKTNFTKEDAEKLKQVLVTLFENDASSARPEGSMEVHKVYWWEHSSKLGQYSSAKSAPFHFGKTDDRRAKRLFGL

SEQ ID NO: 4107 - protein, 305 aa, Desulfovibrio alkalitolerans DSM 16529
MSTPIANRIDFLLLFDVKDGNPNGDPDFDNSPRFDPETFQGLVSDVCLKRKIREWVYAAKSQGGAIESGYDVFVLQGHSLESRQKMPYEHLAGLDGKAKGAKTARSDVEKAREWMCANFFDVRAFGAVMSTTDFNCGQVRGPVQLTFARSFDRVLSTEHGITRVAYTTEKKTSETSAQTEMGRKHTVAYGLYAAYGFITPAFAGGANGTGFSADDLDVLKKALVNMFDLDHSAARGLMRTRHVFAFEHASPLGNAQSGKLFDLVKVKRKEGVDSPRGFEDYVITPLSDIKAACPDGVTPTDWAEG

SEQ ID NO: 4108 - protein, 305 aa, Desulfovibrio sp. X2
MSTPIANRIDFLLLFDVKDGNPNGDPDFDNTPRFDPETFQGLVSDVCLKRKIREWVFAAKSQGGKIEPGYDVFVLQGHSLESRQKMPYEHLSELAGKAKGAKTTRGDVEKAREWMCANFFDVRAFGAVMSTTDFNCGQVRGPVQLTFARSFDRVLSTEHGITRVAYTTEKKASETSAQTEMGRKHTVAYGLYAAHGFISPAFAGGPSGTGFCADDLAVLKKALVNMFDLDHSAARGLMRTRRVFAFEHSSPLGNAQAGRLFDLVKVARKEGVESPRGFDDYAISSFAEIAAACPAGVTVADWAAE

SEQ ID NO: 4109 - protein, 319 aa, Phaeospirillum fulvum MGU-K5
MSALSFRHEFVVLFDVANGNPNGDPDAGNLPRLDPETNHGLVSDVCLKRKIRNYVELAKGDESGFHIYVQDGSILNDKHREAYIALRPGDAKVAKEAKLNPKDDAEATKLRDFMCANFFDIRTFGAVMGTGINCGQVRGPVQFAFATSVEPIVPIEISITRMAATTEKEKKDKAQSDEGDGNERTDNRTMGRKHIVPYGLYRAHGFISAKLAERTGFSEADLDLLLEAVENMFEHDRSAARGEMAVRKLIVFRHDCALGKAPAHSLFDRVKVGRNIDGDFRAVNDPAIDNRTSARSFADYLVTIDRDNLPEGVEIIERL

SEQ ID NO: 4110 - protein, 304 aa, Myxococcus sp. (contaminant ex DSM 436)
MTELKQRHDFVLFFDVLDGNPNGDPDAGNLPRIDAETGHGLVTDVSLKRKVRNFVLLTQEGKPGLDIFVKEKAVLNQRIADAYKGLGIDLSEKPSRAEDGKKRNKPGEAQGSEVEKGRAWMCKTFFDVRTFGAVMSTGPNAGQVRGPMQLTFARSVDPIVSQEHSITRMAVATEAEAEKQGGDNRTMGRKNTVPYGLYRAHGFVSPHLAKQTGFGTADLEMLFQAFTHMFELDRSAARGLMSMRKVVVFKHGSELGNAPAHALFDRVHADRKQRDKPARSFSDYTVSVDKAGLPQGIEVLELVG

SEQ ID NO: 4111 - protein, 316 aa, Rhodobacter capsulatus DE442
MIPLSRRHDFVLIFDVTNGNPNGDPDAGNLPRLDPETNHGLVSDVSLKRKLRNYVELARTGEAGHHIYVQEGAILNEKHRQAYVAIRGDEKSKKDAKLNPKDDTEAKALRDWMCANFFDVRTFGAVMSTGVNCGQVKGPVQMTFARSVEPILPVEISITRMAATNEAEQKKRAEGEDGDTRTDNRTMGRKHIVPYGLYVAHGFISAKFAERTGFSEADLDLLFEALANMFEHDRSAARGEMTTRKLIVFAHENALGNAPAHALFDRIRIGRAVDGEFRNLDDRGLGNLAPARKFSDYRVEIDREGLPAGVEIRELL

SEQ ID NO: 4112 - protein, 316 aa, Rhodobacter capsulatus R121; identical to SEQ ID NO: 4111

SEQ ID NO: 4113 - protein, 316 aa, Rhodobacter capsulatus B6
MIPLSRRHDFVLIFDVTNGNPNGDPDAGNLPRLDPETNHGLVSDVSLKRKLRNYVELARTGEAGHHIYVQEGAILNEKHRQAYVAIRGDEKSKKDAKLNPKDDTEAKALRDWMCANFFDVRTFGAVMSTGVNCGQVKGPVQMTFARSVEPILPVEISITRMAATNEAEQKKRAEGEDGDTRTDNRTMGRKHIVPYGLYVAHGFISAKFAERTGFSEADLDLLFEALANMFEHDRSAARGEMTTRKLIVFAHEKALGNAPAHALFDRIRIGRAVDGEFRNLDDRGLGNLAPARKFSDYRIEIDREGLPAGVEIRELL

SEQ ID NO: 4114 - protein, 316 aa, Rhodobacter capsulatus Y262; identical to SEQ ID NO: 4111

SEQ ID NO: 4115 - protein, 33 aa, Bacillus thuringiensis serovar aizawai str. Leapi01; identical to SEQ ID NO: 3907

SEQ ID NO: 4116 - protein, 74 aa, Bacillus thuringiensis serovar aizawai str. Leapi01; identical to SEQ ID NO: 3908

SEQ ID NO: 4117 - protein, 285 aa, Paenibacillus sp. JCM 10914
MSILDKKIDFAVILSVNNANPNGDPLNGNRPRQNYDGYGEISDVAIKRKIRNRLQDMGESIFVQSNDRKADEFGSLRERADGNSELRQLMKSKSISSEQFASIACQEWIDVRGFGQVFAFKGTGGGVSVGVRGPVSIHTARSVDPIDISSMQITKSVNSEPGKERGSDTMGMKHRVDFGLYVFYGSINTQLAEKTGFTNEDAEKIKESLISLFENDLSSARPEGSMEVHQVYWWKHHSKLGQYSSAKVHRSLQVRPKAEEPKSFDDYAIELYELDGLKAEVLDGR

SEQ ID NO: 4118 - protein, 289 aa, Paenibacillus pini JCM 16418
MSTLDHKIDFAVVLSVRNANPNGDPLNGNRPRQNYDGFGEISDVCIKRKIRNRLQDMGESILVQSDEKRNDAHRSIKDRVDANENVQEHAKGKKANKDLYAEAACQSWIDVRSFGQVFAFSGTDVSVGIRGPVSIHTAVSLDRIDISSMQITKSVNSVTTAKDPDKKGSDTMGMKHRVDFGVYVFYGSINTQLAEKTGFTYEDAEKIRESLRTLFENDTSSARPDGSMEVHQLYWWEHSSKMGQYSSAKVHRSLLIELKPDVAEAKSYDDFDYTVVPLEGLAVQEYEGL

SEQ ID NO: 4119 - protein, 74 aa, Bacillus thuringiensis; identical to SEQ ID NO: 3909

SEQ ID NO: 4120 - protein, 74 aa, Bacillus cereus group; identical to SEQ ID NO: 3908

SEQ ID NO: 4121 - protein, 135 aa, Bacillus cereus
MQITKIINSEHEKDKGSDTIGMKHRVDFGVYVFYGSINTQLAEKTGFTNEDEEKIKNALVTLFENDASAARPEGSIKVHKVCWWDHNSKLGQYSSAKVHRLLEVKRNIDEPKTIDDYTVLVHELDDLKVEIINGM

SEQ ID NO: 4122 - protein, 112 aa, Bacillus cereus; identical to SEQ ID NO: 4010

SEQ ID NO: 4123 - protein, 40 aa, Bacillus cereus; identical to SEQ ID NO: 4008

SEQ ID NO: 4124 - protein, 78 aa, Bacillus cereus; identical to SEQ ID NO: 4009

SEQ ID NO: 4125 - protein, 135 aa, Bacillus cereus
MQITKSINSEPGKDKGSDTMGMKQRVDFGVYVFYGSINTQLAERTGFTNEDAEKIKNALVTLFENDASAARPEGSIEAHKVCWWEHNSKLGQYSSAKVHRLLDIKQKIDQPKTIDDYTVLILELDGLKVEIIDGI

SEQ ID NO: 4126 - protein, 93 aa, Bacillus cereus
MGMKHRVDFGVYVFYGSINTQLAEKTGFTNEDAEKIKNALVTLFENDVSAARPEGSIEVHKACWWKHNSKLGQYHSAKVHRLLDIKRNIDEPK

SEQ ID NO: 4127 - protein, 93 aa, Bacillus cereus
MGMKHRVDFGVYVFYGSINTQLAEKTGFTNEDAEKIKNALVTLFENDVSAVRPEGSIEVHKACWWKHNSKLGQYHTAKVHRLLDIKRNIDEPK

SEQ ID NO: 4128 - protein, 323 aa, Phaeospirillum molischianum; identical to SEQ ID NO: 3971

SEQ ID NO: 4129 - protein, 299 aa, Brevibacillus laterosporus
MTIQKTYQPIEKRYDFVIIFDVTNGNPNGDPDAGNMPRSDGETGHGIVTDVCLKRRIRNYIEMIKPEKTGFHIYVTEGAVHNEQHRQAYYSVRADQSKIKTSEAKLTPKDKEEAKLLAQWMCDNFYDVRTFGAVMSNSVNCGQIRGPVQFTFSQSVEPIFVKEITITRQSVTREGEDKQRTLGKKYIIPYALYRMNGFISAHFAEKSNFTEEDLNLLWEAIVHMFEHDRSASRGEMVVRKLIIFEHDSKLGRAPAHQLFNRIEIKKVLEQDQPARSYQDYRIEIDSTNLPNGVSIIDKY

SEQ ID NO: 4130 - protein, 292 aa, Xanthomonas translucens; identical to SEQ ID NO: 4096

SEQ ID NO: 4131 - protein, 293 aa, Clostridium symbiosum; identical to SEQ ID NO: 4019

SEQ ID NO: 4132 - protein, 297 aa, Thauera sp. 63; identical to SEQ ID NO: 4105

SEQ ID NO: 4133 - protein, 294 aa, Ruminiclostridium cellobioparum; identical to SEQ ID NO: 4104

SEQ ID NO: 4134 - protein, 294 aa, Halanaerobium saccharolyticum; identical to SEQ ID NO: 3980

SEQ ID NO: 4135 - protein, 297 aa, Aggregatibacter actinomycetemcomitans; identical to SEQ ID NO: 3930

SEQ ID NO: 4136 - protein, 258 aa, Aggregatibacter actinomycetemcomitans; identical to SEQ ID NO: 4044

SEQ ID NO: 4137 - protein, 297 aa, Aggregatibacter actinomycetemcomitans; identical to SEQ ID NO: 4047

SEQ ID NO: 4138 - protein, 75 aa, Aggregatibacter actinomycetemcomitans; identical to SEQ ID NO: 4050

SEQ ID NO: 4139 - protein, 372 aa, Clostridium ultunense; identical to SEQ ID NO: 3978

SEQ ID NO: 4140 - protein, 258 aa, Haemophilus haemolyticus; identical to SEQ ID NO: 4031

SEQ ID NO: 4141 - protein, 279 aa, Dethiosulfovibrio peptidovorans; identical to SEQ ID NO: 4016

SEQ ID NO: 4142 - protein, 278 aa, Pasteurella bettyae
MSLTKKIDFALILKVTNANPNGDPLNGNRPRTNFSGVGEITDVCLKRKIRDRLQDSGENIFVQSDDRKIDSMTSLKNRAESSEFGLGKEAFKAKSKDETAQKACAKWLDVRAFGQVFAFGKSDEGSGVSIAIRGPVTIQSAFSIEPINITSTQITKSVSGEGDGTKKSSDTMGMKHRVDNGIYVAYGAITPQLAERTGFSDEDANKIKKVLTKLFEGDASSARPEGSMQVLKLIWWEHNCKSGQHSSAKVHQSLTVNTDGSYSLANLDGLTPEEIEGF

SEQ ID NO: 4143 - protein, 281 aa, Oxalobacter formigenes
MSPLQHKIDFAVILTVDHANPNGDPLNGNRPRVDYDGFGEITDVCLKRKLRDRLQEAGQSIFVQSDEKKQDGMTSLRNRAESAEYGLGKDTFNEKKTPKDLAAKKACEKWFDVRTFGQLFAFGGDSSGVSIPIRGPVTLQSAFSVEPVSVSSTQITKSVSGEGDGSKRGSDTMGMKHRVDKGVYVFYGSMNPQLAERTGFSDEDAEIVKSLLPRLFENDASSARPEGSMAVNKVFWWKHNCKAGQYSSAKVHKSLRVNPDGSYSIDESATEGLVPEVIDGF

SEQ ID NO: 4144 - protein, 280 aa, endosymbiont of Riftia pachyptila
MSSLTKKIDFAVIFTVKNANPNGDPLNGNRPRTDYEGYGEITDVCLKRKIRDRLQSDGQAIFVQSDEKKTDGMPSLKARAESDEHGLGKDSFNVKKTTPDETARRACEKWLDVRTFGQLFAFKSDAKDGVSIPIRGPVSIQSAFSVEPVSITSTQITKSVSGEGDGSKKSSDTMGMKHRVDSATYVVYGSMNPQLAERTGFSTEDAEAIKTVLPRLFEGDASSARPEGSMAVEKLIWWQHNCKSGQYSSAKVHRTLQVNSDASYQLTNLEGLVPEEIDGF

SEQ ID NO: 4145 - protein, 315 aa, Acetobacter; identical to SEQ ID NO: 4026

SEQ ID NO: 4146 - protein, 135 aa, endosymbiont of Tevnia jerichonana; identical to SEQ ID NO: 4037

SEQ ID NO: 4147 - protein, 367 aa, Thermaerobacter subterraneus; identical to SEQ ID NO: 4093

SEQ ID NO: 4148 - protein, 372 aa, Thiorhodococcus drewsii; identical to SEQ ID NO: 4034

SEQ ID NO: 4149 - protein, 287 aa, delta proteobacterium MLMS-1
MSLSNKIDFAVIFRVVNANPNGDPLNGNRPRTIYEGNGEVSDVCIKRKIRNRLMEAGKAIFVQSDDNKIDEHSSLRSRADSVLSGIKGSDEIAKKACATWLDVRAFGQLFAFKAAGGQKTKAKEGEAAAGAGDDKGVSIGIRGPVSVQSAFSITPVSVTSTQITKSVSGEGDGSKRGSDTMGMKHRVDRGVYVFYGSMNPQLAEKTGFSDADAETIKAILPKLFENDASSARPEGSMAVEKVFWWRHDSKAGQYSSAKVHRSLSVNEDGSFTMENLDGLQPEIINGF

SEQ ID NO: 4150 - protein, 317 aa, Oceaniovalibus guishaninsula
MTEQSALDQDAASRVGLANRYDFVLFLDVENGNPNGDPDAGNMPRMDPETNRGLMSDVSIKRKLRNYVAEAHGNAAPHRIYFTERAVLNEAHQEAWEATGVAPQKPNDYSRLPKADAEARKLTDWMCANFWDIRTFGAVMSTGVNAGQVRGPVQLSFARSEEPIMPMEVSITRSSVTNEKDRDKERTMGRKAVVPYGLYRVHGFVNAKLAQRTGFSKADLDLLWTALRDMLDLDRSAARGMMAARRLIAFRHDSDLGNAQAHRLFERVTVSRMVDGEAVPVGDRGLHNRPPARAFSDYRIDVDDADLPQGVTLIEPW

SEQ ID NO: 4151 - protein, 229 aa, Candidatus Arthromitus sp. SFB-1; identical to SEQ ID NO: 4067

SEQ ID NO: 4152 - protein, 290 aa, Photobacterium marinum; identical to SEQ ID NO: 4097

SEQ ID NO: 4153 - protein, 279 aa, Haemophilus sputorum
MSLTKKIDFALILKVTNANPNGDPLNGNRPRADFQGFGEMTDVCLKRKIRDRLQDGGESIFVQSDEKKTDGMTSLANRAKDKDVGLGADAFNAKKANKDDTAKKACEKWLDVRSFGQVFAFSGDGSSGISIAVRGPVTIQSAFSVEPINITSTQITKSVSGEGDGTKKSSDTMGMKHRVDHGVYIAFGAMSPQLAERTGFSDDDAEKIKAVLTKLFEGDASSARPEGSMQVLKLIWWEHNSKSGQYSSAKVHGSLKVNADGSYELEKLDGLTPQEIDGF

SEQ ID NO: 4154 - protein, 301 aa, Pelosinus; identical to SEQ ID NO: 4080

SEQ ID NO: 4155 - protein, 276 aa, Rheinheimera nanhaiensis
MSLQNKIDFAIIFSVKNANPNGDPLNGNRPRTDYDGFGEITDVCLKRKTRDRLQDAGQAIFVQSDEKKTDGYPSLRARAEGVLGKDVLNAKKTKPEDAAKLACETWFDVRAFGQLFAFKSEEKDGVSIPIRGPVSIHSAFSIEPVSITSTQITKSVSGDGDGSKKGSDTMGMKHRVDNAVYVAFGAMSPQLAEKTGFSDADANTLKSILPKLFEGDASSARPEGSMAVEKVIWWQHSSKAGQYSSAKVHRTLNVKADGSYELSQLEGLTPEEIDGF

SEQ ID NO: 4156 - protein, 319 aa, Rhodovulum sp. PH10
MTTPEKTPLVHRHDIVFLFDVTNGNPNGDPDAGNLPRIDPETNVGLVSDVSLKRKVRNYAELARGAEPGYRIYVQEGSILNEKHREAYKALRDDGKSDGAKLNPKNDDEARALTRFMCDNFFDVRTFGAVMSTGINCGQVRGPVQVAFAASVEKILPLEISITRMAATTEKEKADREKSEGDERTDNRTMGRKYIVPYGLYRAHLFVNAKLAERTGFSQADLDLLFEALKNMFEHDRSAARGEMAARKVVVFEHANALGNAPAHALFERVKVRRRFGTDVYDLGDPRLDNAPPARRFADYEVAVARDGLPDGVEIVEVL

SEQ ID NO: 4157 - protein, 321 aa, Acidocella sp. MX-AZ02; identical to SEQ ID NO: 4092

SEQ ID NO: 4158 - protein, 284 aa, Rhodopirellula europaea; identical to SEQ ID NO: 4102

SEQ ID NO: 4159 - protein, 313 aa, Rhodopirellula sallentina; identical to SEQ ID NO: 4103

SEQ ID NO: 4160 - protein, 273 aa, Synergistaceae
MSLSKKIDFAVIFSVRNANPNGDPLNSNRPRISYEGIGEVSDVCLKRKIRDRLLENGLEIFVQSEDRKVDDATSLKARADAVLNKKMTKSETEKAVCEKWFDVRAFGQVFAYKAAKNEDPGVSIGIRGPVTVQLALSTVPISITSTQITKSVNGEDTKDGKKASDTMGMKHRVDSGVYVFFGSMNPQLAEKTGFSNDDATKIKEVLPKLFENDASSARPEGTMKVEKVFWWEHNCKSGQYSSAKVHGSLSVNADGTYALADLEGLAPEIIPGF

SEQ ID NO: 4161 - protein, 289 aa, Providencia burhodogranariea; identical to SEQ ID NO: 4094

SEQ ID NO: 4162 - protein, 372 aa, Thiorhodovibrio sp. 970; identical to SEQ ID NO: 4073

SEQ ID NO: 4163 - protein, 317 aa, Nitrobacter sp. Nb-311A
MTALANRYDFVLLFDVMRGNPNGDPDAGNLPRLDPETNHGLVSDVSLKRKVRNYIEFARNGVAGFNIYVQEGAILNEQHRKAYLAVRPGDDKVAKDTKLNPKSEDEAARLRDFMCRNFFDVRAFGAVMSTGINAGQVRGPVQMTFAQSVEPIVPQEITITRMAATTPAEKTLRAEGQEEGNDRTDNRTMGRKYIVPYGLYRSHGFVSAKLAERTGFSDADLDALREALTSMFEHDRSAARGEMAMRKAIAFKHANPLGNAPAHELFDRVKVGRGVDDEFRKIDRRLDNLPPAREFADYAIEIDRNELPEGVEIEEWA

SEQ ID NO: 4164 - protein, 290 aa, Streptomyces acidiscabies
MTAPHLDPARKTDFVFLIEARDSNPNGDPDAGGMPRTDPVSGQGLITDVAIKRKIRDTVALLNEDEKKPGYDIYVEAGVALNSQHERAYAPDALGEKASQFDAQQWMCRTFFDIRMFGAVMTTGKKDRQAGRVRGPLQLTFSRSVDPITPLEYGITRVTPTKQEDVDSGKATEMGSKHIVPYGLYRGEGHFSAPLATRAHVTTDDLAMFWRAFTLMFDHDRAAARGELNLRGLYVFTHDDKYGATPARQLLDRVTVKGPGDATARAFTDYQVDVDGADLPEGVTLTTLVG

SEQ ID NO: 4165 - protein, 310 aa, Sphingomonas elodea
MSTPVTQRHEFVLYFDVTNGNPNGDPDAGNMPRLDPETNQGLVSDVALKRKVRNFVALVKEDQPGFEIYMTEGATLNNQHKKAWNALLPEVTKDDEFKKLPKDQHKAQELTRWMCTNFWDIRTFGAVMTTGVNAGQVRGPVQFGFAKSVERILPLEISITRMAATTEKDAEEKGGRTMGRKHIVPYGLYRAHGFVSAPLASHPTKGTGFSQSDLELLWQALGQMFDHDRSAARGEMASRKLIVFRHQSALGNAQAQSLFDRVKTWRVHEGSVQEIGSTATDNWPPARKWEDYKVTIDREGLPAGVEILEY

SEQ ID NO: 4166 - protein, 291 aa, Lactobacillus suebicus
MTKLENRIDFTAVIGVKNANPNGDPLADNMPRVNNQGKGIITDVALKRKIRNAMLDQGGSVYVQSDDYSNDDYKDMRSRLLGNKEIASVLSENDATSDEGKPIFYKTACEQFLDVRAFGALFAFSKGKKDGLDGAAIGIRGPVSIQMAESIKPIDVTDMQITKSTSAELKDNGARGSDTMGHKQIVEFGVYKFSGSIRPNLAEKTQFSLEDSELLKQALLHMFDNDASASRPAGSMQLLKVVWSVHDNKLGQYPQWKVEQQVSVEYNDTASDFENVKIKFNALPNLKNEEF

SEQ ID NO: 4167 - protein, 370 aa, Symbiobacterium thermophilum
MSHTDVSKRHEFVLLFDVRDGNPNGDPDAGNLPRIDPETMHGLVTDVALKRKVRDYVSGVLGKPIFIQSKVALNTLILGAFRHVGYEPVVTSLQGEELEDEELMAWLAGKADAGFAVDGERLLYSGESLRQQDIIRALTEGIDEEQRELNRKLRDLGRRLADAAKARKGELTAETQDKARKWLCQTYYDIRMFGAVLSTGLNAGQVRGPVQLTFARSQHPITPLDLSITRQARTTTVRMATGPTEMGRKPIVPYGLYRAHGFFNPFLAEKTGVTDDDLRILWDALQHLFDYDRSAVRGEMNMRGLWVFTHDDAKGCAPTHKLFELIQTDKLRNGVEVPRDFSHYDVQSPPEGPLDALGYPGVTLTCLVKP

SEQ ID NO: 4168 - protein, 280 aa, Aromatoleum aromaticum
MTSLQNKIDFAVVIRVKHANPNGDPLNGNRPRTDYGGLGEITDVCLKRKLRDRLQETGHAIFVQSDDRKIDGEPSLRTRAESEKNGLGKEAFKKGAKREETAKKACEKWFDVRAFGQVFAFGKGDDANGVSIPIRGPLTIQSAFSKEPVSITSTQITKSVSGEGDGSKRGSDTMGMKHRVDSGIYECFGSINPQLAERTGFSDADAETIKTILPKLFENDASSARPDGSMEVLKVVWWKHNCKAGQYSSAKVHRLLKVSPDGTINLSRLDGLEAEEIDGF

SEQ ID NO: 4169 - protein, 316 aa, Nitrobacter winogradskyi; identical to SEQ ID NO: 3848

SEQ ID NO: 4170 - protein, 280 aa, Chlorobium chlorochromatii; identical to SEQ ID NO: 3850

SEQ ID NO: 4171 - protein, 317 aa, Rhodospirillum rubrum; identical to SEQ ID NO: 3853

SEQ ID NO: 4172 - protein, 291 aa, Syntrophus aciditrophicus
MATLSKKIDFAIIMSVKNANPNGDPLNGNRPRTDYEGLGEITDVCLKRKIRDRLVEQYVSLKNEEEKKGQAIFVQSDDRKIDGETSLRNRAESEKNGLGKKAFGANAKKDETAKSACEKWFDVRAFGQVFAFGKGNDADGVSIPVRGPVTIQSAFSRDLVSISSTQITKSVSGEGDGKKRSSDTMGMKHRVDRGIYVTYGTMNPQLAERTGFSDKDAAVIKAILPKIFENDASSARPEGSMEVVKVLWWQHNSKSGDYSSAKVHRSLKVNPDGSYIIEPLNGLVPEEIAGF

SEQ ID NO: 4173 - protein, 294 aa, Rhodoferax ferrireducens; identical to SEQ ID NO: 3855

SEQ ID NO: 4174 - protein, 325 aa, Deinococcus geothermalis; identical to SEQ ID NO: 3856

SEQ ID NO: 4175 - protein, 272 aa, Magnetococcus marinus; identical to SEQ ID NO: 3859

SEQ ID NO: 4176 - protein, 324 aa, Roseiflexus sp. RS-1; identical to SEQ ID NO: 3864

SEQ ID NO: 4177 - protein, 380 aa, Pelotomaculum thermopropionicum
MDKHCDPKKRHDFVYLFEVINGNPNGDPDAGNMPRVDPQTFNGIVTDVCIKRKIRNYVSLVHQVPVYIQSEMALNTLARDVLRKKNVMAVEADVTEYIRDEELLSWMQDNVSDYVEVVSKEENGKTNYTAYFVGDISILTGRNGINNVIADVKEQTEIPDWIQPNLSKILEKLQSATKGQKLTAEVRSKIKTTMASEFYDIRMFGAVLTMGTNAGQVLGPVQITFARSVSPVFPMNLTITRTAITRESDRLRKQTEMGQKPIIPYGLYVAHGFYNPKLAEKLNPGSELLVKEDDLKLLWEALCNMFEYDRSASRGEMACRGLYIFTHEDEKGYGKAPAHKLFELVKITERDPGRPQRSFDDYTVMLEDKMPPGITLTRLP

SEQ ID NO: 4178 - protein, 279 aa, Actinobacillus succinogenes; identical to SEQ ID NO: 3866

SEQ ID NO: 4179 - protein, 306 aa, Gluconacetobacter diazotrophicus
MQNRHEFVLFFDVTNGNPNGDPDAGNMPRLDPETNQGLVSDVALKRKVRNYVSLARPDMPGFEIYMSEGMALNRQHRKAWNAIMPEVTKDESFKTLPKDEDKARALTRWMCTNFWDIRTFGAVMTTSVNSGQVRGPVQFSFARSVEPVLPLEIAITRMAATTEADAESKGGRTMGRKHIVPYGLYRMHGYISAPLASHPVKGTGFSESDLELLLEALTGMFDHDRSAARGEMATRKLIVFRHESALGNARAQDLFDRVTVQRAYQGSAHPIGSAAIDNWPPARAWGDYQVLIDRDAVPAGIEIIER

SEQ ID NO: 4180 - protein, 277 aa, Cellvibrio japonicus; identical to SEQ ID NO: 3870

SEQ ID NO: 4181 - protein, 312 aa, Gluconacetobacter diazotrophicus; identical to SEQ ID NO: 3872

SEQ ID NO: 4182 - protein, 288 aa, Geobacter daltonii; identical to SEQ ID NO: 3875

SEQ ID NO: 4183 - protein, 316 aa, Zymomonas mobilis; identical to SEQ ID NO: 3881

SEQ ID NO: 4184 - protein, 326 aa, Meiothermus ruber; identical to SEQ ID NO: 3884

SEQ ID NO: 4185 - protein, 316 aa, Rhodobacter capsulatus; identical to SEQ ID NO: 4111

SEQ ID NO: 4186 - protein, 337 aa, Zunongwangia profunda
MKPSITNSSDFLFVYEAIQCNPNGDPDQENKPRMDYDTKTNLVTDTRVKRFIRDYLKASNEDEIVFVDMEGDSKVSVDSKLKAVVKRTVENEGELEKAFENDSEALKVYKEIIAKEKDAEGVWKTITDKKFKQKEVNYELLAYLVKEKFLDIRMFGSAFAVGGFTKAYTGPIQLNWGYSFNKVELIDSSSIVTIMNDDSSTFGKDYRVHYSLLGFNGTINAPAAKTTGLATDDVLEFRKAIWESIPASPTRSKLNQYPKLYLEIVYNEGVSNGQFGDLRNFVETQPKEGITDKQVRKFKDLSIDLSALKTLIAQDKSGEHKIKEIILKTSADFDFSL

SEQ ID NO: 4187 - protein, 327 aa, Meiothermus silvanus; identical to SEQ ID NO: 3888

SEQ ID NO: 4188 - protein, 368 aa, Syntrophothermus lipocalidus; identical to SEQ ID NO: 3889

SEQ ID NO: 4189 - protein, 316 aa, Ketogulonicigenium vulgare; identical to SEQ ID NO: 3894

SEQ ID NO: 4190 - protein, 317 aa, Rhodopseudomonas palustris; identical to SEQ ID NO: 3898

SEQ ID NO: 4191 - protein, 288 aa, Syntrophobotulus glycolicus; identical to SEQ ID NO: 3902

SEQ ID NO: 4192 - protein, 280 aa, Treponema brennaborense; identical to SEQ ID NO: 3914

SEQ ID NO: 4193 - protein, 316 aa, Zymomonas mobilis; identical to SEQ ID NO: 3919

SEQ ID NO: 4194 - protein, 249 aa, Sulfobacillus acidophilus
MFVREERTADGKLLGRDSLAKTIWERAGANPNDAVERQKALLAHAFDARVFGTVFSVKSVSFHVTGPVQFGWAHSLHPVATHYVQGTVVMPSKDETAKGDGGENEGKTQGTIWTTWTTPFAMFVMPGIINHTLAAQSGMTESDVDLLLEGLWNGTLFRQARGRGLQSPLLLVHVEYHDPFFRLGYLEETVHTEFTTSPPTNVADIILDVASLQERLNAARAKIARIRVWHNPLLQMTPRLDAEYHVFEE

SEQ ID NO: 4195 - protein, 310 aa, Sphingobium sp. SYK-6; identical to SEQ ID NO: 3958

SEQ ID NO: 4196 - protein, 315 aa, Methylomicrobium alcaliphilum; identical to SEQ ID NO: 3969

SEQ ID NO: 4197 - protein, 287 aa, Methylomicrobium; identical to SEQ ID NO: 3970

SEQ ID NO: 4198 - protein, 117 aa, Aggregatibacter actinomycetemcomitans; identical to SEQ ID NO: 3928

SEQ ID NO: 4199 - protein, 33 aa, Bacillus thuringiensis; identical to SEQ ID NO: 3907

SEQ ID NO: 4200 - protein, 37 aa, Bacillus thuringiensis; identical to SEQ ID NO: 3910

SEQ ID NO: 4201 - protein, 72 aa, Bacillus cereus group; identical to SEQ ID NO: 3911

SEQ ID NO: 4202 - protein, 344 aa, Desulfomonile tiedjei; identical to SEQ ID NO: 3932

SEQ ID NO: 4203 - protein, 282 aa, Taylorella equigenitalis
MTLENKIDFALIIKVKNANPNGDPLNGNRPRVNFDGLGEISDVCLKRKIRNRILALKGNEEGFKIFVQSDDNNVDGITTLEKRAEDEEHGLGKRGFNDRNTAYENACKKWYDVRAFGQVFAIKKKAGESEGVSIGIRGPVTIQPAFSVDPVNITSTQITKSVSGSGDGKKKSSDTMGMKHRIDEAVYVSFGSISPQLAEKTGFSNDDADILKNAMLSMFEGDASSARPEGSMEILKLIWWKHDSKLGKHSSAKVHQSLEVNSDGSFNINDLSELKPEILDGR

SEQ ID NO: 4204 - protein, 290 aa, Saccharothrix espanaensis; identical to SEQ ID NO: 3972

SEQ ID NO: 4205 - protein, 389 aa, Pseudanabaena sp. PCC 7367; identical to SEQ ID NO: 3937

SEQ ID NO: 4206 - protein, 288 aa, Desulfocapsa sulfexigens; identical to SEQ ID NO: 3942

SEQ ID NO: 4207 - protein, 283 aa, Candidatus Endomicrobium trichonymphae; identical to SEQ ID NO: 3955

SEQ ID NO: 4208 - protein, 280 aa, Bibersteinia trehalosi; identical to SEQ ID NO: 3943

SEQ ID NO: 4209 - protein, 286 aa, Thalassolituus oleivorans; identical to SEQ ID NO: 3979

SEQ ID NO: 4210 - protein, 303 aa, Eubacterium rectale; identical to SEQ ID NO: 3963

SEQ ID NO: 4211 - protein, 185 aa, Ruminococcus sp. SR1/5; identical to SEQ ID NO: 3967

SEQ ID NO: 4212 - protein, 290 aa, Ruminococcus champanellensis; identical to SEQ ID NO: 3966

SEQ ID NO: 4213 - protein, 294 aa, Faecalibacterium prausnitzii; identical to SEQ ID NO: 3965

SEQ ID NO: 4214 - protein, 289 aa, Eubacterium siraeum; identical to SEQ ID NO: 3968

SEQ ID NO: 4215 - protein, 299 aa, Clostridium saccharolyticum; identical to SEQ ID NO: 3962

SEQ ID NO: 4216 - protein, 283 aa, Streptococcus cristatus; identical to SEQ ID NO: 3947

SEQ ID NO: 4217 - protein, 280 aa, Teredinibacter turnerae; identical to SEQ ID NO: 3877

SEQ ID NO: 4218 - protein, 282 aa, Streptococcus agalactiae; identical to SEQ ID NO: 3981

SEQ ID NO: 4219 - protein, 222 aa, Streptococcus agalactiae; identical to SEQ ID NO: 3982

SEQ ID NO: 4220 - protein, 294 aa, Clostridium sp. CAG:226; identical to SEQ ID NO: 3983

SEQ ID NO: 4221 - protein, 280 aa, Teredinibacter turnerae
MSSLTKKIDFAIVVRVKNANPNGDPLNGNRPRIDYDGFGEISDVCLKRKMRDRLLDAGQTVFVQSDQKNVDGMKSLRERAESEEFGLGKAVLDSKKTPVDKAAQLACEKWFDVRAFGQLFAYRSVGKDGVSIPVRGPVTVQSAYSLAPIGITSIQITKSVSGEGDGSKKSSDTMGMKHRVDNAVYVAYGAMSPQLAERTGFTDADAAILKELLPKLFEGDASSARPEGSMAVEQVVWWEHSSKQGQYSSAKVHGSFSPNSDGELSITPLPGLEPEILQGF

SEQ ID NO: 4222 - protein, 317 aa, Verrucomicrobium sp. 3C
MTTLANRYDLALIFDVTNGNPNGDPDAGNLPRLDPETSKGLVSDVSLKRKIRNYVELVRAGQEGFHIFVEEGAILNDQQRKAYRALRPDDPEVDKQAKLNPRNDAEAIKLMEFMCRNFYDVRTFGAVMSTGVNCGQVTGPVQVTFVVSVEPIMPMEISITRMAATNESEKKQKLQGNDSNDRIDNRTMGRKHIVPYGLYVAHVFISAKLAERTGFSQEDVDLLFEAMANMFEHDHSAARGEMSTRKLIAFRHENALGKAPAHVLFDLVKIGRNVDGAFRAIDDKRIVNEPPARKFSDYVIEIDRENLPAGVEMIERL

SEQ ID NO: 4223 - protein, 327 aa, Calidithermus timidus
MSQPIQNRYEFLLFFDVQDGNPNGDPDSGNAPRIDPEDGHGLVSDVALKRRIRNYAQATGAPIFVQHGTNLNRPIFEAHERTGGFTGAKTKDKVEAARRWMCQNFFDVRTFGAVMSTGANAGQVRGPVQITFARSLGPIFPAEFSITRGAVAEDVKNAKTLEDYLRWEKEQPEDKLRTMGRKSQVPYGLYLAKGFISAHLAQGTGFSQADLKLLVEALMNMFEHDRSASKGLMSTRRLYLFQHVGTDPNNPEQNKRQAMLGCAPAHRLLDLGQVVSARLLEESRPPRRFADYEVKADPTKLPKGVRMLELDAWDEARFDAWMGGANA

SEQ ID NO: 4224 - protein, 302 aa, Neisseria sicca
MSLTKKIDFALIIEVTNANPNGDPLNGNRPRADFQNYGEMTDVCLKRKIRDRLQDSGESIFVQSDEKKTDGMTSLKSRAESEEYGLGKKAFQVKKGIEGNKQKDQTKNQACQKWFDVRAFGQVFAFGKGDEGGSGVSIAIRGPVTIQSAFSVAPISITSNQIVKSVDSDEKEGKNARMGMKHRIDHGVYVAFGAMSPQLAERTGFSNDDAEKIKAVLTKLFEGDASSARPEGSMQVLKLIWWEHNSKAGQYSSAKVHGKLKEIIEEKIKNKSIDGLIGDITEEKLTVTGNGASLKPEILDGF

SEQ ID NO: 4225 - protein, 317 aa, Chelatococcus
MTALANRYDFVLLFDVSKGNPNGDPDAGNLPRLDPETNHGLVSDVSLKRKIRNYVELACDGAPGCNIYVQEGAILNEQHRKAYVALRPDDEKAKKEGKLNPKNDEEAQRLRDFMCRNFFDVRTFGAVMSTGINCGQVRGPVQMTFAQSVEPIMPQEISITRMAATNEAEKKQRTEGSEEDNGRTDNRTMGRKHIVPYGLYRAHGFISAKLAERTGFGEADLDLLREALVSMFEHDRSAARGEMASRKVIAFKHTSALGNAPAHALFDHVEIGRNIAGEFRKIDRQIDNYPPARAFSDYFVTINRANLPEGVEVIEWL

SEQ ID NO: 4226 - protein, 280 aa, Teredinibacter turnerae
MSSLTKKIDFAIVVRVKNANPNGDPLNGNRPRMDYDGFGEISDVCLKRKLRDRLLDAGQPIFVQSDQKNVDGMKSLRERAESEEFGLGKAVLDSKKTPVDKAAQLACEKWFDVRAFGQLFAFKSASKDGVSIPVRGPVTVQSAYSLAPIGITSIQITKSVSGEGDGSKKSSDTMGMKHRVDNAVYVAYGAMSPQLAERTGFTDADAAILKELLPKLFEGDASSARPEGSMAVEQVVWWEHSSKQGQYSSAKVHGSFSANSDGELSITPLPGLEPEILQGF

SEQ ID NO: 4227 - protein, 305 aa, Desulfovibrio sp. X2; identical to SEQ ID NO: 4108

SEQ ID NO: 4228 - protein, 305 aa, Desulfohalovibrio alkalitolerans; identical to SEQ ID NO: 4107

SEQ ID NO: 4229 - protein, 319 aa, Phaeospirillum fulvum; identical to SEQ ID NO: 4109

SEQ ID NO: 4230 - protein, 286 aa, Eubacterium sp. CAG:146; identical to SEQ ID NO: 3984

SEQ ID NO: 4231 - protein, 332 aa, Firmicutes bacterium CAG:124; identical to SEQ ID NO: 3985

SEQ ID NO: 4232 - protein, 285 aa, Hungatella hathewayi; identical to SEQ ID NO: 3986

SEQ ID NO: 4233 - protein, 282 aa, Firmicutes bacterium CAG:212; identical to SEQ ID NO: 3987

SEQ ID NO: 4234 - protein, 297 aa, Clostridium sp. CAG:138; identical to SEQ ID NO: 3988

SEQ ID NO: 4235 - protein, 289 aa, Ruminococcus sp. CAG:579; identical to SEQ ID NO: 3989

SEQ ID NO: 4236 - protein, 296 aa, Oscillibacter sp. CAG:241; identical to SEQ ID NO: 3990

SEQ ID NO: 4237 - protein, 330 aa, Firmicutes bacterium CAG:137; identical to SEQ ID NO: 3991

SEQ ID NO: 4238 - protein, 283 aa, Firmicutes bacterium CAG:41; identical to SEQ ID NO: 3992

SEQ ID NO: 4239 - protein, 282 aa, Clostridium sp. CAG:352; identical to SEQ ID NO: 3993

SEQ ID NO: 4240 - protein, 281 aa, Clostridium sp. CAG:58; identical to SEQ ID NO: 3994

SEQ ID NO: 4241 - protein, 167 aa, Ruminococcus sp. CAG:57; identical to SEQ ID NO: 3995

SEQ ID NO: 4242 - protein, 290 aa, Ruminococcus sp. CAG:379; identical to SEQ ID NO: 3996

SEQ ID NO: 4243 - protein, 305 aa, Eggerthella sp. CAG:298; identical to SEQ ID NO: 3997

SEQ ID NO: 4244 - protein, 282 aa, Roseburia sp. CAG:471; identical to SEQ ID NO: 3998

SEQ ID NO: 4245 - protein, 293 aa, Anaerotruncus sp. CAG:390; identical to SEQ ID NO: 3999

SEQ ID NO: 4246 - protein, 285 aa, Ruminococcus sp. CAG:330; identical to SEQ ID NO: 4000

SEQ ID NO: 4247 - protein, 290 aa, Ruminococcus sp. CAG:403; identical to SEQ ID NO: 4001

SEQ ID NO: 4248 - protein, 288 aa, Ruminococcaceae bacterium; identical to SEQ ID NO: 4002

SEQ ID NO: 4249 - protein, 292 aa, Bacteroides sp. CAG:98; identical to SEQ ID NO: 4003

SEQ ID NO: 4250 - protein, 282 aa, Dialister sp. CAG:588; identical to SEQ ID NO: 4004

SEQ ID NO: 4251 - protein, 283 aa, Desulfovibrio desulfuricans
MSLQHKIDFAVILTVDHANPNGDPLNGNRPRTDYDGYGEISDVCLKRKIRDRLMEQKGTQVFVQSDDRKLDNMASLKERAESAEHGLGKDAFNPKKCSKEETARKACAKWFDVRAFGQLFAFGKDGDAAGVSIAVRGPVSIHSAFSVEPVSVASIQITKSVSGEGDGSKRGSDTMGMKHRVDKGVYVFYGSMNPQLAERTGFSDEDAAVLKAILPRLFENDASSARPEGSMAVNQVFWWQHNCASGQYSSAKVHKSLTVNPDGSYTLNGEATPGLKIEVLHGF

SEQ ID NO: 4252 - protein, 311 aa, Sandarakinorhabdus limnophila
MSTPVCNRYEFVLYFDVANGNPNGDPDAGNMPRLDPETNLGLVSDVALKRKIRNFVATAKGDLPSFEIYMSEGATLNNQHKKAWGAVLPEVTKDEDFKKLPKDQQKSRELTAWMCGNFWDIRTFGAVMTTGVNAGQVRGPVQLTFARSVEPILPLEISITRMAATTEKDADEKGGRTMGRKHIVPYGLYRAHGFISAPLASHATKGTGFSEDDLELLWQSLEMMFEHDRSAARGEMATRKLIVFRHESALGNAQAQSLFERVKTWRVHEGARQPVGSHATDNWPPARKWADYAVTIDREGLHAGVEIIERC

SEQ ID NO: 4253 - protein, 316 aa, Shinella sp. DD12
MTILANRYDFALIFEVVNGNPNGDPDAGNMPRLDPETNRGLVTDVSLKRKIRNYVDLARHGEDGFHIYVEEGAILNDKHRQAYKALRPDDAKAAKDAKLNPKDDAEAKALTAFMCRNFFDVRTFGAVMSTGVNCGQVKGPVQMSFAHSVEPILPLEISITRMAATNEAEKKQKAEGDDTNERTDNRTMGRKHIVPYGLYVAHGFISAKFAERTGFSEEDLTLLFQALTTMFEHDRSAARGEMATRKLIVFKHENALGNAPAHTLFDRVRIGRNVDGEFRVIDSRLDNLPPARAFSDYVVTIDRDGLPAGVEVMELL

SEQ ID NO: 4254 - protein, 315 aa, Hyphomicrobium nitrativorans; identical to SEQ ID NO: 3950

SEQ ID NO: 4255 - protein, 316 aa, Rhodobacter capsulatus; identical to SEQ ID NO: 4113

SEQ ID NO: 4256 - protein, 285 aa, Paenibacillus sp. JCM 10914; identical to SEQ ID NO: 4117

SEQ ID NO: 4257 - protein, 288 aa, Desulfotomaculum reducens MI-1; identical to SEQ ID NO: 3862

SEQ ID NO: 4258 - protein, 282 aa, Chlorobium phaeovibrioides DSM 265; identical to SEQ ID NO: 3863

SEQ ID NO: 4259 - protein, 324 aa, Roseiflexus sp. RS-1; identical to SEQ ID NO: 3864

SEQ ID NO: 4260 - protein, 286 aa, Alkaliphilus metalliredigens QYMF; identical to SEQ ID NO: 3865

SEQ ID NO: 4261 - protein, 279 aa, Actinobacillus succinogenes 130Z; identical to SEQ ID NO: 3866

SEQ ID NO: 4262 - protein, 302 aa, Leptothrix cholodnii SP-6; identical to SEQ ID NO: 3867

SEQ ID NO: 4263 - protein, 285 aa, Exiguobacterium sibiricum 255-15; identical to SEQ ID NO: 3868

SEQ ID NO: 4264 - protein, 288 aa, Xanthomonas oryzae pv. oryzae PXO99A; identical to SEQ ID NO: 3869

SEQ ID NO: 4265 - protein, 283 aa, Termite group 1 bacterium phylotype Rs-D17; identical to SEQ ID NO: 3955

SEQ ID NO: 4266 - protein, 277 aa, Cellvibrio japonicus Ueda107; identical to SEQ ID NO: 3870

SEQ ID NO: 4267 - protein, 282 aa, Streptococcus equi subsp. zooepidemicus MGCS10565; identical to SEQ ID NO: 3871

SEQ ID NO: 4268 - protein, 312 aa, Gluconacetobacter diazotrophicus PA1 5; identical to SEQ ID NO: 3872

SEQ ID NO: 4269 - protein, 317 aa, Desulfovibrio vulgaris str. 'Miyazaki F'; identical to SEQ ID NO: 3873

SEQ ID NO: 4270 - protein, 294 aa, Desulfitobacterium hafniense DCB-2; identical to SEQ ID NO: 3874

SEQ ID NO: 4271 - protein, 288 aa, Geobacter daltonii FRC-32; identical to SEQ ID NO: 3875

SEQ ID NO: 4272 - protein, 302 aa, Azotobacter vinelandii DJ; identical to SEQ ID NO: 3876

SEQ ID NO: 4273 - protein, 288 aa, Aggregatibacter aphrophilus NJ8700; identical to SEQ ID NO: 3878

SEQ ID NO: 4274 - protein, 280 aa, Teredinibacter turnerae T7901; identical to SEQ ID NO: 3877

SEQ ID NO: 4275 - protein, 299 aa, Eggerthella lenta DSM 2243; identical to SEQ ID NO: 3879

SEQ ID NO: 4276 - protein, 286 aa, Desulfotomaculum acetoxidans DSM 771; identical to SEQ ID NO: 3880

SEQ ID NO: 4277 - protein, 316 aa, Zymomonas mobilis subsp. mobilis NCIMB 11163; identical to SEQ ID NO: 3881

SEQ ID NO: 4278 - protein, 291 aa, Halothiobacillus neapolitanus c2; identical to SEQ ID NO: 3882

SEQ ID NO: 4279 - protein, 288 aa, Xanthomonas albilineans GPE PC73; identical to SEQ ID NO: 3961

SEQ ID NO: 4280 - protein, 298 aa, Acidaminococcus fermentans DSM 20731; identical to SEQ ID NO: 3883

SEQ ID NO: 4281 - protein, 326 aa, Meiothermus ruber DSM 1279; identical to SEQ ID NO: 3884

SEQ ID NO: 4282 - protein, 293 aa, Stackebrandtia nassauensis DSM 44728; identical to SEQ ID NO: 3885

SEQ ID NO: 4283 - protein, 294 aa, Nitrosococcus halophilus Nc 4; identical to SEQ ID NO: 3886

SEQ ID NO: 4284 - protein, 290 aa, Thermincola potens JR; identical to SEQ ID NO: 3887

SEQ ID NO: 4285 - protein, 327 aa, Meiothermus silvanus DSM 9946; identical to SEQ ID NO: 3888

SEQ ID NO: 4286 - protein, 368 aa, Syntrophothermus lipocalidus DSM 12680; identical to SEQ ID NO: 3889

SEQ ID NO: 4287 - protein, 299 aa, Truepera radiovictrix DSM 17093; identical to SEQ ID NO: 3890

SEQ ID NO: 4288 - protein, 288 aa, Spirochaeta smaragdinae DSM 11293; identical to SEQ ID NO: 3891

SEQ ID NO: 4289 - protein, 292 aa, Desulfarculus baarsii DSM 2075; identical to SEQ ID NO: 3892

SEQ ID NO: 4290 - protein, 291 aa, Spirochaeta thermophila DSM 6192; identical to SEQ ID NO: 3893

SEQ ID NO: 4291 - protein, 316 aa, Ketogulonicigenium vulgare Y25; identical to SEQ ID NO: 3894

SEQ ID NO: 4292 - protein, 282 aa, Ethanoligenens harbinense YUAN-3; identical to SEQ ID NO: 3897

SEQ ID NO: 4293 - protein, 285 aa, Ruminococcus albus 7 = DSM 20455; identical to SEQ ID NO: 3896

SEQ ID NO: 4294 - protein, 317 aa, Rhodopseudomonas palustris DX-1; identical to SEQ ID NO: 3898

SEQ ID NO: 4295 - protein, 308 aa, Bacteroides helcogenes P 36-108; identical to SEQ ID NO: 3899

SEQ ID NO: 4296 - protein, 286 aa, Desulfobulbus propionicus DSM 2032; identical to SEQ ID NO: 3900

SEQ ID NO: 4297 - protein, 297 aa, Acidovorax avenae subsp. avenae ATCC 19860; identical to SEQ ID NO: 3901

SEQ ID NO: 4298 - protein, 288 aa, Syntrophobotulus glycolicus DSM 8271; identical to SEQ ID NO: 3902

SEQ ID NO: 4299 - protein, 295 aa, Planctomyces brasiliensis DSM 5305; identical to SEQ ID NO: 3903

SEQ ID NO: 4300 - protein, 295 aa, Planctomyces brasiliensis DSM 5305; identical to SEQ ID NO: 3903

SEQ ID NO: 4301 - protein, 291 aa, Nitrosomonas sp. AL212; identical to SEQ ID NO: 3905

SEQ ID NO: 4302 - protein, 294 aa, Selenomonas sputigena ATCC 35185; identical to SEQ ID NO: 3912

SEQ ID NO: 4303 - protein, 280 aa, Treponema brennaborense DSM 12168; identical to SEQ ID NO: 3914

SEQ ID NO: 4304 - protein, 289 aa, Porphyromonas asaccharolytica DSM 20707; identical to SEQ ID NO: 3913

SEQ ID NO: 4305 - protein, 294 aa, Desulfotomaculum carboxydivorans CO-1-SRB; identical to SEQ ID NO: 3915

SEQ ID NO: 4306 - protein, 291 aa, Methylomonas methanica MC09; identical to SEQ ID NO: 3916

SEQ ID NO: 4307 - protein, 284 aa, Desulfotomaculum ruminis DSM 2154; identical to SEQ ID NO: 3917

SEQ ID NO: 4308 - protein, 282 aa, Streptococcus parasanguinis ATCC 15912; identical to SEQ ID NO: 3918

SEQ ID NO: 4309 - protein, 316 aa, Zymomonas mobilis subsp. pomaceae ATCC 29192; identical to SEQ ID NO: 3919

SEQ ID NO: 4310 - protein, 289 aa, Treponema caldaria DSM 7334; identical to SEQ ID NO: 3920

SEQ ID NO: 4311 - protein, 287 aa, Candidatus Arthromitus sp. SFB-mouse-Japan; identical to SEQ ID NO: 3957

SEQ ID NO: 4312 - protein, 310 aa, Sphingobium sp. SYK-6; identical to SEQ ID NO: 3958

SEQ ID NO: 4313 - protein, 295 aa, Roseburia hominis A2-183; identical to SEQ ID NO: 3922

SEQ ID NO: 4314 - protein, 45 aa, Bacillus coagulans 36D1; identical to SEQ ID NO: 3924

SEQ ID NO: 4315 - protein, 315 aa, Methylomicrobium alcaliphilum 20Z; identical to SEQ ID NO: 3969

SEQ ID NO: 4316 - protein, 287 aa, Methylomicrobium alcaliphilum 20Z; identical to SEQ ID NO: 3970

SEQ ID NO: 4317 - protein, 296 aa, Pseudoxanthomonas spadix BD-a59; identical to SEQ ID NO: 3925

SEQ ID NO: 4318 - protein, 117 aa, Aggregatibacter actinomycetemcomitans ANH9381; identical to SEQ ID NO: 3928

SEQ ID NO: 4319 - protein, 284 aa, Desulfosporosinus orientis DSM 765; identical to SEQ ID NO: 3926

SEQ ID NO: 4320 - protein, 280 aa, Filifactor alocis ATCC 35896
MNKVDFIMTFTVQNANVNGDPLSGNRPRMDSNGLGEVSDVCLKRKIRNRLQDNGNAIFVQSRERTEDGYTSLEKRYAAHFKKTMSDEEVEKGFHEKWIDVRAFGQVITYDKRSIGIRGPISIGIAKSLEPITIEDMQITKSVNGMEQKNPNDRAPDTLGMKHFVEFGTYVVHGAVNSYFAEKTGFNEKDLEEFKAALKTIFVNDASSARPDGSIEVKQIFWFEHSCKVGDVSSAKIKSLLKWDKEDKEHRCYEDYHIHIDENALKEYEKLGLKLTVIEGL

SEQ ID NO: 4321 - protein, 291 aa, Sphaerochaeta pleomorpha str. Grapes; identical to SEQ ID NO: 3927

SEQ ID NO: 4322 - protein, 285 aa, Clostridium sp. BNL1100; identical to SEQ ID NO: 3929

SEQ ID NO: 4323 - protein, 291 aa, Desulfovibrio desulfuricans ND132; identical to SEQ ID NO: 4021

SEQ ID NO: 4324 - protein, 286 aa, Bacillus thuringiensis serovar chinensis CT-43; identical to SEQ ID NO: 3906

SEQ ID NO: 4325 - protein, 33 aa, Bacillus thuringiensis serovar chinensis CT-43; identical to SEQ ID NO: 3907

SEQ ID NO: 4326 - protein, 74 aa, Bacillus thuringiensis serovar chinensis CT-43; identical to SEQ ID NO: 3908

SEQ ID NO: 4327 - protein, 74 aa, Bacillus thuringiensis serovar chinensis CT-43; identical to SEQ ID NO: 3909

SEQ ID NO: 4328 - protein, 37 aa, Bacillus thuringiensis serovar chinensis CT-43; identical to SEQ ID NO: 3910

SEQ ID NO: 4329 - protein, 72 aa, Bacillus thuringiensis serovar chinensis CT-43; identical to SEQ ID NO: 3911

SEQ ID NO: 4330 - protein, 290 aa, Desulfovibrio vulgaris RCH1; identical to SEQ ID NO: 3895

SEQ ID NO: 4331 - protein, 316 aa, Ketogulonicigenium vulgare WSH-001; identical to SEQ ID NO: 3894

SEQ ID NO: 4332 - protein, 317 aa, Rhodospirillum rubrum F11; identical to SEQ ID NO: 3853

SEQ ID NO: 4333 - protein, 283 aa, Streptococcus mutans LJ23; identical to SEQ ID NO: 3959

SEQ ID NO: 4334 - protein, 297 aa, Aggregatibacter actinomycetemcomitans D7S-1; identical to SEQ ID NO: 3930

SEQ ID NO: 4335 - protein, 288 aa, Aggregatibacter actinomycetemcomitans D7S-1; identical to SEQ ID NO: 3931

SEQ ID NO: 4336 - protein, 344 aa, Desulfomonile tiedjei DSM 6799; identical to SEQ ID NO: 3932

SEQ ID NO: 4337 - protein, 284 aa, Desulfosporosinus acidiphilus SJ4; identical to SEQ ID NO: 3933

SEQ ID NO: 4338 - protein, 284 aa, Geobacter metallireducens GS-15; identical to SEQ ID NO: 3851

SEQ ID NO: 4339 - protein, 286 aa, Bacillus thuringiensis MC28; identical to SEQ ID NO: 3934

SEQ ID NO: 4340 - protein, 282 aa, Streptococcus dysgalactiae subsp. equisimilis AC-2713; identical to SEQ ID NO: 3974

SEQ ID NO: 4341 - protein, 282 aa, Streptococcus pyogenes A20; identical to SEQ ID NO: 3935

SEQ ID NO: 4342 - protein, 282 aa, Streptococcus agalactiae SA20-06; identical to SEQ ID NO: 3936

SEQ ID NO: 4343 - protein, 290 aa, Saccharothrix espanaensis DSM 44229; identical to SEQ ID NO: 3972

SEQ ID NO: 4344 - protein, 379 aa, Chamaesiphon minutus PCC 6605; identical to SEQ ID NO: 3938

SEQ ID NO: 4345 - protein, 389 aa, Pseudanabaena sp. PCC 7367; identical to SEQ ID NO: 3937

SEQ ID NO: 4346 - protein, 292 aa, Thermobacillus composti KWC4; identical to SEQ ID NO: 3939

SEQ ID NO: 4347 - protein, 283 aa, Methanoregula formicica SMSP; identical to SEQ ID NO: 3940

SEQ ID NO: 4348 - protein, 281 aa, Prevotella dentalis DSM 3688; identical to SEQ ID NO: 3941

SEQ ID NO: 4349 - protein, 288 aa, Desulfocapsa sulfexigens DSM 10523; identical to SEQ ID NO: 3942

SEQ ID NO: 4350 - protein, 280 aa, Bibersteinia trehalosi USDA-ARS-USMARC-192; identical to SEQ ID NO: 3943

SEQ ID NO: 4351 - protein, 286 aa, Thalassolituus oleivorans MIL-1; identical to SEQ ID NO: 3979

SEQ ID NO: 4352 - protein, 303 aa, Eubacterium rectale DSM 17629; identical to SEQ ID NO: 3963

SEQ ID NO: 4353 - protein, 185 aa, Ruminococcus sp. SR1/5; identical to SEQ ID NO: 3967

SEQ ID NO: 4354 - protein, 290 aa, Ruminococcus champanellensis 18P13 = JCM 17042; identical to SEQ ID NO: 3966

SEQ ID NO: 4355 - protein, 294 aa, Faecalibacterium prausnitzii L2-6; identical to SEQ ID NO: 3965

SEQ ID NO: 4356 - protein, 289 aa, Eubacterium siraeum V10Sc8a; identical to SEQ ID NO: 3968

SEQ ID NO: 4357 - protein, 303 aa, Eubacterium rectale M104/1; identical to SEQ ID NO: 3964

SEQ ID NO: 4358 - protein, 299 aa, Clostridium cf. saccharolyticum K10; identical to SEQ ID NO: 3962

SEQ ID NO: 4359 - protein, 326 aa, Meiothermus ruber DSM 1279; identical to SEQ ID NO: 3884

SEQ ID NO: 4360 - protein, 302 aa, Azotobacter vinelandii CA; identical to SEQ ID NO: 3876

SEQ ID NO: 4361 - protein, 302 aa, Azotobacter vinelandii CA6; identical to SEQ ID NO: 3876

SEQ ID NO: 4362 - protein, 283 aa, Streptococcus oligofermentans AS 1.3089; identical to SEQ ID NO: 3947

SEQ ID NO: 4363 - protein, 288 aa, Desulfotomaculum gibsoniae DSM 7213; identical to SEQ ID NO: 3948

SEQ ID NO: 4364 - protein, 282 aa, Streptococcus agalactiae ILRI005; identical to SEQ ID NO: 3981

SEQ ID NO: 4365 - protein, 222 aa, Streptococcus agalactiae ILRI112; identical to SEQ ID NO: 3982

SEQ ID NO: 4366 - protein, 315 aa, Hyphomicrobium nitrativorans NL23; identical to SEQ ID NO: 3950

SEQ ID NO: 4367 - protein, 317 aa, Rhodospirillum rubrum ATCC 11170; identical to SEQ ID NO: 3853

SEQ ID NO: 4368 - protein, 325 aa, Deinococcus geothermalis DSM 11300; identical to SEQ ID NO: 3856

SEQ ID NO: 4369 - protein, 304 aa, Nitrosomonas eutropha C91; identical to SEQ ID NO: 3857

SEQ ID NO: 4370 - protein, 272 aa, Magnetococcus marinus MC-1; identical to SEQ ID NO: 3859

SEQ ID NO: 4371 - protein, 290 aa, Desulfovibrio vulgaris DP4; identical to SEQ ID NO: 3860

SEQ ID NO: 4372 - protein, 310 aa, Picrophilus torridus DSM 9790
MDMQELIDSGLIIDLKDLDIRKSYGNFVKIGLISRTIGFFIDRNNDAREITSDEFENSIRAIVPASKWRGPEKSYATSLMRKFNLIQENYARNMVENKEYLKNPMSFLFGDTSVKDNAAAIAARNYYDWSYSYEELAQITLNLQHNSLDESGAILRDGDSVASNAIYDINYIKPNTKFVRFITLENISPELLYLQIATTLGTTRYGGRTAILGDNIENNIIAIGFSKGERPISSYTVMEEAWQYDKYEPEKLLLERMNDIYGDKLLTGDDLNKIIKDAMDSLGSIDIARKVYGPVNEKIGQQWETLFSKK

SEQ ID NO: 4373 - protein, 351 aa, Sulfolobus acidocaldarius DSM 639
MKGKDLVKDLFGDKAIDFFSNLSKEDPNAVIPRGRVVNVYVTLQAENELLIRHEGGEDISLATLGSEKYPIILYDKIQSAWRRNLLALLRKDYDKHISEIDALRGKSNPWNCMLRPTSAAKREEEKMGGLCRECPNCMTFGFAVAEDAKYNLKSRVEGDLFIATTPEQKSVVVRTFNAVDDATKTTFIETEGTRTGSLFRLSLVKGGTLFVGKVSMKDVTPAEFSVLVLSLATTARIGGNTTDFGKVKIRIPAVILSPYEMSSGLDLFNSAKGLDSVDQVNAKVRERVKNFSKEGLVYTFDDLGDLVVKKLTDNGNIDHEIMLEAWKDAINLRKSIELFVQSKKGTKDESS

SEQ ID NO: 4374 - protein, 338 aa, Trichormus variabilis ATCC 29413
MALLKTVDSQLFQSEIPYKPMGKYAHFLTIRITESYPLFQTDGELNKARVRAGIKDKTTISRLSMFKRKQSTPERLVGRELLRKYELVKPEDCEYNVNFAMDNPDCIIYGFAIGDSGSEKSKVVVDTAFSITAFDESHETFTLNAPFENGTMASKGENGSKPGEVTSRINQQDHIRPQVFFPSIVTLKDPTEASFLYVFNNIIRTRHYGAQTTRTGRVRNELIGVVFADGEITSNLRWTQAIYDQMQTNNSLKSPDPLDEDEVTNAAKNAIETLMSEEFIVHTDFIGDAFEPLLKEVKSLTANEAGIKSILQKADVEAKAYASKHISKKKTAAKAGKE

SEQ ID NO: 4375 - protein, 335 aa, Methanospirillum hungatei JF-1
MADKVIQSFYASIKPYTLEKPERKPKQNYVSILILRELQSAARFTTDGTEANSSIIRIGDEEVTVGKLFGRKQVASDRRIAKALQRDLIAEKMNSFYKKGGWSGCSMEVTKMCQKCPECALFGSAASEGDMSVTSRVMYDEAYTIRGINSVVEEYFQNAPGDDYAKKATSGIREPDFFKEGTLFPCVVTLRDVTCEEVLFFLNITDRNTRYGATGTRFGKTRNHILGVFASNREGPSSLEISRGVALRLAGGDEVRLPDSESLKRVLELDSLPLHDVKKNALEVYQHLLKTHRISGIDLGESEVTALLDAMKDDAVIKEILITQIEKISDFLADQ

SEQ ID NO: 4376 - protein, 329 aa, Methanothrix thermoacetophila PT
MNYEELKDKFGKSMAEGLVDELTNEPSAHYVHILLLRELQSSAIFTTNGQDADIANVGIHAEDGFVEYSPVMMFKRKQTGSDRRKGKELQRNLLGIDDTMSVNEMKQDSPESILYGSAAGEEAISVTSRVMYDTAYSIRDSSVLVEEKFQNAPGDAFAKGATTAIREPDFIMPGTLFPCVVTLRDATFEELVFVLGVTKMNKRYGAATSRIGRVENHILGIYYGIEEGPANLYISQEIARRLAAVDGGITTDRLRKVLYSPTLDVEVIKDLTKKVFDENIKEMDIEHLDNADKLVSAISADIVKEALEIQKEKASKFFSSVNSKGSKGG

SEQ ID NO: 4377 - protein, 374 aa, Thermofilum pendens Hrk 5
MSGEKRDVLAELGLGDLRPYLRSIGDKDRIFPKAHRIEVVFLVRAANYLLLRTEGAGTINMTTLEYSGGAMEVPVIQPQKLMAVTRRQMLQLLREYRDSLDEVSKRWLVQEVIGKAKDLGFKKVSEEWNCTIQPPLAEFGEKATDIGMDGFCPHCTIFGAALTEQHNEKFGGLSIGIKTRVRFDPAFATQRRITPETHNKVTEGHLSMTGQALFSEVHVEPGTVFIGRAELVDLTEPELVATLYSLATLRELGGRSGIYGTVRVEILGVKAGKYASTTAYDLAAENAGKGYEEVKKNLKERLEKLGFTPVDNSKLLAAVDHKDPNGLFKDLWRSSIDFAEKMVKWVEELKGGGQKGSGKKSRSKKAEPEESEEE

SEQ ID NO: 4378 - protein, 330 aa, Herpetosiphon aurantiacus DSM 785
MSILNTYQNYLMDQYNPYPHGRFVSLFIVRHVESEAMFRTEGSGEPLNREFVFAGKQGGDNQLIQRVVISKRKQIAVERRMGRELLREYALLQKTAKGEGICSLNTNNPCERCIDCMVYGYAAGGGGAQRSRVITDDAFSLHSAATIIGTRQFNALFDNSTMRNPETGEPSTSIGTDEYVKPESVFLDIETLKDVTADEFRYIVGNILRSSRYGAISSRIGKTRNNLIGVAWSNCELFSNLEWVQETYELLREDQHEPSFPLHTSAVAKAAQSAMQTLRQRVIGQVNWLNSDELGNLVDELGQLYANPEQLKAMLSRLATSYPMTQKKGK

SEQ ID NO: 4379 - protein, 329 aa, Synechococcus sp. PCC 7002
MLESLKSQFQPAFPRLASGHYVHFLVLRHSQSFPVFQTDGVLNTTRTQAGLLQQTDQLSRLVMFKRKQTTPERLSGRELLRNLGLTSADKSAKNLCEYNGEGSCKKCPDCILYGFAIGDSGSERSKVYSDSAFSLGTYEQSHRSFTFNAPFEGGTMSEAGVMRSAINDSTHILPEVTFPTVESLRDATYEGFVYVLGNLLRTKRYGAQESRTGTMKNHLVGIVFADGEIFSNLHLTQALYDHIGGELNKPISELCEAASTVAQDLLNKEPVRKSKLIFGADLEALVQEVNDIYQNDAELTKLLGSLYQQTQDYATEFGALSGGKKKAKS

SEQ ID NO: 4380 - protein, 342 aa, Nostoc punctiforme PCC 73102
MSISKLSTVLAASYENFPKGRFITLVVLRTTHSETIFRTEGSGEPMCSEFVQAGLEGENQKTIIQRLVMTKRKQVAPERRYGREHLRAHELLYTNIKDGSLCSLNTNAPCEMCVDCFLYGFAAGGGGAQKSRIWTEDAFSILPASDVVGDRTINAIYENGTMRDEKGNASTALNTSEYIKPGVHFLDVVTLKDVTADELRYIIGNILFTSRYGAVSSRVGRMENEILGVFGSITELPSSLELVQATYDVLGKPLEHPLNINQLITASKQVIANWKNKRGVSVQLSEEELANLLTDVETNWSEAERDNFLKRLTQSYEPFRHVATEKKKAKAKGKNTPVEVES

SEQ ID NO: 4381 - protein, 356 aa, Rippkaea orientalis PCC 8801
MSILETLKPQFQSAFPRLASANYVHFIMLRHSQSFPVFQTDGVLNTVRTQAGLMAKDSLSRLVMFKRKQTTPERLTGRELLRSLNITTADKNDKEKGCEYNGEGSCKKCPDCIIYGFAIGDSGSERSKVYSDSTFSLSAYEQSHRTFTFNAPFEGGTMSEQGVMRSAINELDHILPEITFPNIETLRDSTYEGFIYVLGNILRTKRYGAQESRTGTMKNHLVGIAFCDGEIFSNLRFTQALYDGLEGDVNQPIDEICHQASQIVQTLLSDEPVRKIKTIFGEELNHLINEVSGIYQNDTLLTETLNMLYQQTKTYSENHGSLAKSKPPKAEGNKSKGRTKKKGDDEQTSLDLNIAE

SEQ ID NO: 4382 - protein, 338 aa, Gloeothece citriformis PCC 7424
MSILETIKPDFKTAFPRLATGKYVHFIMIRHSQSFPVFQTDGILNTARTQAGLSNTEKISRLVMFKRKQTTPERLAGRELLRSVGLTSADKTADNLCEYNGEGTCKKCPDCIIYGFAIGDSGSERSKVYSDSAFSLSPYEESHRSFTFNAPFEGGTMSEAGEMRSAINELDHILPEVTFPTVETLRDSTYEGFIYVLGNLLRTRRYGAQETRTGTMSNHLIGIVFADGEIFSNLYFTQALYDALKLKGDINAPINDICVEAKNVAETLLNQEPVRKSQVIFEPDLQTLLTEVSSIYQNEEDLTNTLTALYQQTTSYAESFGALAGKKKTSKKKSTKEE

SEQ ID NO: 4383 - protein, 84 aa, Methylorubrum extorquens CM4
MPRYELVTAPLPSEAEQGRRAFGALQPTSPPCRYLGTTACANIYKACTDFIGRFGAKAVRLGRTTPQIFGVHPEHGTSRLDWWG

SEQ ID NO: 4384 - protein, 328 aa, Methanosphaerula palustris E1-9c
MNDDVIERFREAIRNYTLEKPEKKPKGRYVTILILRELLSAARFTTDGVEANSAIIRVGEADKIVGKLFGRKQVASDRRMAKAIQRDLIDEEMKEINRNWDGCSMEVTKMCQQCPECALFGSAASEGGVSITSRVMYDEAYTIRDLNAVVEEFFQNAPGDAYVRKPTPGIREPDFFKEGVLFPCVITLKDVTPEEVLFFLNITDRNARYGATGTRFGKTRNHILGVYAGKREGPSSLEVTRAIIFALAGGLDSASIRTVMTADTLDLEAVKAAAIHGFEERAARYRITFPAAFDEAGTAEILGEIQDDTSFKAILEAQIKNLHGFTTV

SEQ ID NO: 4385 - protein, 334 aa, Cyanothece sp. PCC 7425
MSILETLKPEFHTAFPRLASGKYVHFFMVRHSQSFPVFQTDGVLNTARTQAGLNAGDEKSRQAISRLVMFKRKQVTPERLTGRELLRSLGINGVVEGEANFCEYNGERSCKKCPDCILYGFAIGDSGSERSKVYSDSAFSLSPYEVSHRSFTFNAPFEGGTMSEKGEMRSAINELDHVLPEVAFPCVETLRDPTLEGFIYVMGNLIRTRRYGAQESRTGTMANHIIGVTLCDGEIFSNLHFTQALYDALKGDLSAPISDLCREAAIVAENLLNQEPVRKIQVIFGEQLNELLAEVAGICQDETRLRNTVTALYQQSQAYAETYGAAAKKGKGKS

SEQ ID NO: 4386 - protein, 329 aa, Halorubrum lacusprofundi ATCC 49239
MISDTLTAALEDGTVSMDEMTNTPGTNYTTILVLRELESHAVFTTNGQDADIASLSVVGDDSSIEYSPGLMFMRKQTGSDRRMGKAIQRELLKYDRPDSMEVNDMNPKSVESALYGSAASGDDDVDIGVTSRVMYDTAFTVRDASACIDEKFQNAPGEGYAKGSRSTIREPDFFEPGTLFPCAITLRDATPAEVAFVAAITKRNKRYGAATTRLGRVKNHILGVYTGSEEGPSNRELTANVITSFAADGEQTLSDVVQAPALDVAHACEYVKNAYDAACENEIAQEPVDEETVSELLSLAADDELQAVLETQQPRSEAFIDGAIDTDGN

SEQ ID NO: 4387 - protein, 73 aa, Eubacterium eligens ATCC 27750
MVSKGGVPKGRIIPVYLTDEGDVYPIYLHEMGELEIIQRLVAGILDNKIVVDTNTRINSENDKISIFDLSKKK

SEQ ID NO: 4388 - protein, 131 aa, Methylorubrum extorquens AM1
MTPFSVGERAPETFGAGTCYPLRVPGRCNSSYLRPARLREPTVSMSVGCTDAPSRTGARSEADQGRRAFGALQPTSPPCRYLGTTACANIYKACTDFIRRFGAEAVRLGRTTPQIFGVHPEHGTSRLDWWG

SEQ ID NO: 4389 - protein, 356 aa, Rippkaea orientalis PCC 8802
MSILETLKPQFQSAFPRLASANYVHFIMLRHSQSFPVFQTDGVLNTVRTQAGLMAKDSLSRLVMFKRKQTTPERLTGRELLRSLNITTADKNDKEKGCEYNGEGSCKKCPDCIIYGFAIGDSGSERSKVYSDSTFSLSAYEQSHRTFTFNAPFEGGTMSEQGVMRSAINELDHILPEITFPNIETLRDSTYEGFIYVLGNILRTKRYGAQESRTGTMKNHLVGIAFCDGEIFSNLRFTQALYDGLEGDVNKPIDEICYQASQIVQTLLSDEPVRKIKTIFGEELNHLINEVSGIYQNDALLTETLNMLYQQTKTYSENHGSLAKSKPPKAEGNKSKGRTKKKGDDEQTSLDLNIEE

SEQ ID NO: 4390 - protein, 315 aa, Ammonifex degensii KC4
MGKLESFIEQLSPVGLLIPRVINKKKVAQPIYTRKVVTVVGLKTAKSRFIPVSHEGYGNESYVDKLELLGKTRAEFISRKLKGIERRAHMSLFRELVEKKAQKSWQDYFKEKFDRECIIPESLCIACWNCSLFGGLEAGKGATFSRIRYFDTYSIEDAVDCIAMEGSEEGIGIGNQVYEDVNQTRGAETYHLYEYVKAGTRFPFITIIESPTLLDVAGYLHAVRRADEHGYGKYSANHGKFDTKFLVVATGYPRFSVLDMLKWADEGTLESRFSERQVRFDDLNGSVALFGEEIEALAEKLPEAFDQYFEALERK

SEQ ID NO: 4391 - protein, 348 aa, Methanocaldococcus vulcanius M7
MAKQKKLVETGYKKYVEYDENVVKEFREKLYSIIPKEYFQETYTKRTPNVIKVATIRTTTGYLINRSTEPDEVISTTIGNKDVVVIPSRKLKSREKLTGLVLCRKFKVVHPEIEYNFIDKQEHLANPNSIVFGDSVTQSNDAIGLPSRVIYEWAYSIRDKDEITEELTHNALSEEGTMWDKEEGSQRQSLYGIQYIKPGVYFPQFITFYDITPEGFIHALISHLKTTRYGSQSNVMDANMKNEIIAIALDTFEPPVSSYLISKEFNEEVNFENVKEFVKNKLRENSSKLIENEELKGLLKLIDEYLKDEEKLRQLYLKHLNDCINYLVECKIIKKEDVIKKLLEEMGV

SEQ ID NO: 4392 - protein, 344 aa, Sulfolobus islandicus L.D.8.5
MKAEEYLKNILGNNFEKVRQFFSDLSKPNRLNAIPRGRVINTFLIITAEGELVIRHEGGEDITLASIDGSKYPIILHEKLVSAWRRQMLEILRHDYDRNKGDINNLRGNNNDWDCSLRPTASVKKGEERMGGLCGECPNCMTFGFAVKEGGEFNLKSRVEGDLYISTTPEQMSVVVRTFNAVDDVTHTTLISGEGQTTGALFRLSLVKEGTVFVGKVAIKDVSMAELLLLLFSLAKVSRIGGIKSDFGKIKVRIPALIFAPYEVSSGYDIFKRVKGLANAEEVMSKINEYLKSLNEGILITGGFESEVNAIYKNNVIDHDVIKEAWENGINFRKSIEQYISKKE

SEQ ID NO: 4393 - protein, 332 aa, Nitrosococcus halophilus Nc 4
MEQFATHLGSIEHLMDTTRIDSKNTYIHPSLKNLGAVSVVLLREAVAPVVFRNAEAEITDIEIGQDVYVRAVPNKFKYPERGRGLQVLRALGVGGRLPQNKTVLYKGQKPSEAFDLNALVFGDSCNHDNRVLPVKAAVSYSDGLSLLPKHLCVDETFHNRAAEDGTLFDAESKKNSDNLFSRFFIKPGTLMVQVLSTRGKVLPEIGLRHLMLCVGLAGAYGGQTSLTGTNIRTHVVGIYGGRFEQAISSPYELVKVLASQPEDVLRNPTASSETLHGLLAPAHETVMNGAEAQTWVNDLVASFDTDGPLADEYRAAAPKVAELFDNWFGKGK

SEQ ID NO: 4394 - protein, 315 aa, Acetohalobium arabaticum DSM 5501
MDLLDEYSDFLVDEYQNFPQSNYVNILLVRKTESETIFRTESEGGLSKEFVRITGQEEPTQRVVMTKRKQVAVERRTGRELLRRHDQLFENDGDICAMNRNTPCGECVDCMLYGFAVGSGGAQKARVITNDAYSLLPAKKVTAKRTFNALYDNGTMRDPETGETSTSLGEVEYIKPETHFIDVQTLKDVTAEELIYVLGNILRSTRYGAISSKIGKMENYLVGIYFSDCELTSNLELTQQVNQELEEVEFPLETDKIKGLAKEKMDQSLESIFGQVKVLADEKLDQLLNEIREIYQSDEQIEELLETIVKKYPGN

SEQ ID NO: 4395 - protein, 330 aa, Gloeothece verrucosa PCC 7822
MKLETLKPQFQTAFPRLASGKYVHFILLRHSQSFPIFQTDGILNTARTQAGINTPENISRLVLFKRKQTTPERLIGREILRSFNFTSSEENNSNYCQYNGEKSCKQCPDCIIYGFAIGDSGSERSKVYSDSAFSLGAYEQSHRSFTFNAPSEAGTMSEGGQMRSSINEQDHILPEITFPTVETLRDPTYESFIYVLGNLLRTRRYGAQETRTGTMSNYLLGIIFCDGEIFSNLYFTQALYDALKEKRDTPIADVCIEASNVARQLLDKEPVRQSQVIFDTQLEELLNEVTAIYQDEIQLQATLTTLYQQTQTYSQTFGALSGGKGKSKKK

SEQ ID NO: 4396 - protein, 340 aa, Sulfolobus islandicus HVE10/4
MNGIEAVSKILGNEKISTFFADLSKPNKENAVPRGRVANVFVTILAEGELVIRHEGGEDVTLASIDGEKYPMILHEKLVSSWRREMLEQLRHGYDLHKEEINKIREKSDEWHCSLRPTTATGRKDERMGGLCRECPNCMTFGYAVGEEERYNLKSRIEGDVYLATLPEKKSVVVRTFNAIDEPTHTTFIQAEGARTGALFRLSLIKVGTPFVGKIAMKDLAPAEFALALYSLINTTRVGGIRSDFGKIRIIIAAIALCDHEVSSGYEIFEKTKELDNVSEIVWKINEQVKSYQGECQVFTSEDFSPKISEIVGNNKHDIIKEAWINGLNFKKSIEEFIKK

SEQ ID NO: 4397 - protein, 350 aa, Methanotorris igneus Kol 5
MTMAKQKKLVENGYKKYVEYDENIVNEFREKLYSIIPEEYFQETYTKRTPNVIKVATIRTTTGYLINRSTEPDEVISTTIGNKDVVVIPSRKLKSREKLTGLVLCRKFKVIHPEVEYNFIDKQEHLANPNSLVFGDSVTKTNEAVALPSRVIYEWAYSIRDKDEITEELTHNALSEDGTMWDKNEGSQRQSLYGIQYIKPGVYFPHFLTFYDITPEGFIHALISHLKTTRYGAQSNVMDANMKNEIIAIALDTFEPPVSSYLISKEFEGEVNFENVKEFVKNKLRENSSILIENEKLEELLKLIDEYLKDEEKLKQLYLKHLNDCINYLVECKIIKKEDVIKKLLEEMGV

SEQ ID NO: 4398 - protein, 354 aa, Methanothermococcus okinawensis IH1
MFAYNDLYGDNMAKKKETVEFNIPYNKEIVDEFRNKMYSIIPEEYFQDKFDKRTPNVIKVASIRETTGYFINRSTESDEVISTSIGNKEPVVIPSRKLKSKEKLTGLILCRKYKVVHPELEYNFIKESKQLANPNSIIFGDSVTQSNDSTGLPARAIYEWAYSIRDKDEITEELTHNALSEEGTMWDKDKGSQRQSLYEIQYIKPGTYFPQFLTFYDITPEGLLHVIISHLKTMRYGAQQNVMDANMKNNIIAIALDTFEPAVSSYLISKDYTGEINFENIKNFVINKLKENSSIVIENEKLKEFNSLINEYLNDDEKLRQLYLKMLDDSLNYMTMCKILKEKEVEKLVNELGV

SEQ ID NO: 4399 - protein, 324 aa, Spirochaeta thermophila DSM 6578
MTEQTKLDQFTNQLAAVATLVPRDHKKVGKIAQAIYTRQVVTIVGVKTTTSRFLPVSHEGYSNETYVDKVELWGKTRAEFIARKLKGVERRAHMALFREKVETYLRNNGGGQQGWQTFFEEKFGKACTIPDSLCVACWNCSLFGGMEAGKGATFSRIRYFDTFSVEDAAECIQSDDSPEGMAIGNTVGEDLSVERSEASFHRYEYVKAETRFPFITIIESPTLLDVAGYLAAVKLADQHGYGKYSANHGKFKTEFLAVSTGYPLFSVLDLLTWLENGELTNPKEKLHFETAVNNPVTLFGEEIDEIRSKLDGQFRAYMEALTKQ

SEQ ID NO: 4400 - protein, 327 aa, Caldicellulosiruptor lactoaceticus 6A
MIEKYLDPKVAFVDKIPDERKGYFVQVVILREAQSHLCFTTEGRILNTAILEAGYENPTKITRVVMLKRKQVAPERREGKLIRRRLIQEQNLQVAAEESKNCSLIENLCSKCPDCLLYGFAAQGGDDVARKSRVITDSAFSVQPYEQIVEELTLNAVDEITHTTKSALSSREYVKPGVVFPCVETFADVTKEEFLYLLINILYTTRYGAEASRIGTMKNKIVGIYATAGEVFTNLELTKHFYDKLSSTSFDLNNFMAAYPEIEQKIISSSPIKVYGILSGQKLEVFLNEFCKKLNEDDKYLIGIFNNVEQKVKEYLESKSQKEKKSK

SEQ ID NO: 4401 - protein, 316 aa, halophilic archaeon DL31
MTLQYPTTGLEESFEIYRKRKPSVTLVIKRNVTEPTLFRNSSHDRAETQEFGDKLHAQVNGEKFTSKERLTGLSLLRKLDEEFVDDDFAYNEPTDLEGSLNIGTLTYGLAGTGDQDFAIKSRVIEGYTYTTEEYDLMNKETRNAVYESGTMRDDESGGGDQSEALFDFVKVQPGNDLVHFITLEAATGSMLLYTLHNILNTGKYGARETRTGRNIRNEVLGVVLGDHDTSLSTGEFLLEYHDEGDDLKASIGEYISSVRRTDWEVYGEIDGADPFPEWYERLEAVASREASDADEVLREEFAELMDAASDVFIGDD

SEQ ID NO: 4402 - protein, 313 aa, Thermacetogenium phaeum DSM 12270
MSQIELFVDQMASVSVLVPRVVNKRRVAQPIYTRRVVTIVGVKTVKTRFLPVSHEGYGNESYVDKLELLGKTRAEFISRKLKGIERRAHMSLFRELVEQKTNSSWQDYFTAKFDKECTIPDSLCIACWNCSLFGGLEAGKGATFSRIRYFDTYSVEDAVDCIAMEGSEEGMGIGNQVYEDVNKGRGAETYHLYEYVKAGTRFPFITIIESPTLLDVAGYLHTVRRADEHGYGKYSANHGKFDTEFLVVATGYPRFSVLDMLKWADEGTLDSRFEEGKVQFDDLNGSVSLFGKEIEALAGKLTEAFEEYFAALG

SEQ ID NO: 4403 - protein, 347 aa, Anabaena sp. 90
MALLKTVDAKLFQSEIPYKPMGKYAHFLTVRITESYPLFQTDSELNKARVRAGVKDKNTISRLSMFKRKQSTPERLVGRELLRKYEFMTAEECEYNVSFAMDNPDCIIYGFAIGDSGSEKSKVVVDTAFSITAFDESHETFTLNAPFENGTMASKGESGSKAGEVTSRINQQDHIRPQVFFPSIVTLKDPTEASFLYVFNNILRTRHYGAQTTRTGRVRNELVGVIFADGEITSNLRWTQAIYDQMKANNTLKSPDPLDEDDVITSAKSAIENLMNDEFIVHTDLIGDAFIPLVNEVKNLTNNEAGIKSLLQQANDEAKAYAKKHIKGKSEEAKTAKPKAGKNAKAE

SEQ ID NO: 4404 - protein, 334 aa, Calothrix sp. PCC 7507
MTILTTLKSEFKSAFPRLASGKYIHFIMLRHSQSFPVFQTDGILNTARTQAGLGNTDESKKQISRLVMFKRKQTTPERLAGRELLRGLNLTSADDVNKDKYCEYNGEKSCKKCPDCIIYGFAIGDSGSERSKVYSDSAFSLSAYESSHRSFTFNAPFEGGTMSEAGEMRSSINELDHVIPEVTFPTIETLRDSTYEGFLYVLGNLLRTKRYGAQESRTGTMRNYLAGIAFCDGEIFSNLHLTQALHDALKGDIDAPISDVLQQVETVANNLLNDEPVRKTKLVFGSELDDLVAEVNALYQDEARLLETITSLYGQTKAYAESFGALKKKGKSNS

SEQ ID NO: 4405 - protein, 342 aa, Calothrix sp. PCC 7507
MSISKLSSVLATSYENFPKGRFITLVVLRTTHSETIFRTEGSGEPMCSEFVQAGLEGENQKTIIQRLVMTKRKQVAPERRYGREHLRAHELLYTNPKDGSLCSLNTNAPCEMCVDCFLYGFAAGGGGAQKSRIWTEDAFSILPASDVVGDRTINAIYETGTMRDEKGNASTALNTSEYIKPGVHFLDVVTLKDVTADELRYIIGNILFTSRYGAVSSRVGRMENEILGVFGSITELPSSLELVQATYDVLGKPLEHPLNINQLITASKQVIANWKNKRGVSVQLSEEELASLVTDVETNWSEAERDNFLKRLTQSYESFRQVAPEKKKAKAKGKNTPVEVEI

SEQ ID NO: 4406 - protein, 345 aa, Nostoc sp. PCC 7107
MSISKLSSVLATSYENFPKGRFITLVVLRTTHSETIFRTEGSGEPMCSEFVQAGLEGENQKTIIQRLVMTKRKQVAPERRYGREHLRAHELLYTNIKDGSLCSLNTNAPCEMCVDCFLYGFAAGGGGAQKSRIWTEDAFSILPASDVVGDRTINAIYENGTMRLKKDEDTKASTALNTSEYIKPGVHFLDVVTLKDVTADELRYIIGNILFTSRYGAVSSRVGRMENEILGVFGSITELPSTLELVQATYDVLGKPLEHPLNINQLITASKQVIANWKNKRGVSVQLSEEELANLLTDVETNWSEAERDNFLKRLTQSYESFRQVAPEKKKAKAKGKNTPVEVEI

SEQ ID NO: 4407 - protein, 344 aa, Nostoc sp. PCC 7524
MSFLKTTDSKLFHDVIPYKPMGKYAHFLTIRITESYPLFQTDSELNKARVRAGVKDKTTISRLSMFKRKQSTPERLVGRELLRNYGLMTAEECEYNVAFAMDNPDCIIYGFAIGDSGSEKSKVVVDTAYSITAFDDSHETFTLNAPYENGTMAAKGEKKSDGKLDGEIGTVTARINQQDHIRPQVFFPSIVTLKDPTEASFLYVFNNILRTRHYGAQTTRTGRVRNELIGVVFADGEITSNLRWTQAIYDQMKANNSLNSPDPLDEDEVINAAKNAIATLMSEEFIVHTDFIGDAFEPLLKEVKNLTANETGIKSILQKADAEAKAYASKHISKKKTAAKAGKE

SEQ ID NO: 4408 - protein, 347 aa, Rivularia sp. PCC 7116
MTFLKSIDSKLFHTEIPYKPMGKYVHFLTIRVTESYPLFQTDGELNKSRVRAGKKDKNTISRLSMFKRKQSTPERLVGRELMRNYGLVKDEECEYNVKFAMDNPDCIIYGFAIGDSGSEKSKVVVDTAFSITPFDESHETFTLNAPFENGTMTSKGENGSKPGEVTSRINQQDHIRPQVFFPSIVTLKDPTEASFLYVLNNILRTRHYGAQTTRTGRVRNELIGVIFADGEITSNLRWTQAIYDEMKANNSINSPEPLDEDDVITAAKTAIESQMAEEFIVHQDYLNDEFAALLKEVKAITANEDELKKLLKKADVEAKEYAKVHIKVKSKDKDKNKDKNKETAANS

SEQ ID NO: 4409 - protein, 344 aa, Pleurocapsa sp. PCC 7327
MTIEKLTPFLAPTYENFPKGRTIGLVVLRTTHSETIFRTEGSGEPMCSEFVRAGIEDKNIISRLVMTKRKQVAPERRRGREFLRSHNLLYNSPKGDSICSLNTNAPCEMCIDCFLYGFAAGGEGAQKSRVWTEDAFSVLPSTELVGDRTINAIFENGTMRDENGKASTALNTSEYIKPGVHFLDIVTLKDVTADELRYVLGNILLTTRYGAVSSRVGRMENEILGVFGGIAELPSSLELVQAVHDRLKASGKPVEHPLNTNELISATKQAISTWIDKRGISMQLSEDELNNLIADVDRHLSPNEQENFLKRLDRSYENFRRLPAETETKKDKKKKASTTILGEA

SEQ ID NO: 4410 - protein, 328 aa, Oscillatoria acuminata PCC 6304
MSQLEKIQSSFSKQFPRLAGGRYVQFLMLRHSQSFPVFQTDGVLNTARTQAGIESPEMMSRLVMFKRKQTTPERLTGRELLRSLGITSGEIDAPNYCEYNGEKSCKKCPDCILYGFAIGDSGSERSKVYSDSAFSLTAYEQSHRSFTFNAPFEGGTMSEGGKMRSAINELDHVIPEVTFPTVETLRDSTYEGFLYVLGNLIRTRRYGAQESRTGTVKNHLLGIVISDGEIFSNLHFTQALYDALKGDTTAAIADIKAQATTVIHTLLAEEPVRIYQTITGEPLKTLLDEVLAIYQNEAALTPIISTLATQTQTYSETYGAESNKKKKR

SEQ ID NO: 4411 - protein, 341 aa, Oscillatoria acuminata PCC 6304
MSIETLNQFLAPTYENFPKGRTIGMVVLRKTQSELILRTEGSGEPMCSEFVQAGFQHKNSIQRLVMTKRKQVAPERRFGREQLRGFELLYPSKNGSVCSLNTNAPCEMCIDCFLYGFAAGGGGAQKSRVWTEDAFSLLPTSETVAERTINAIFETGTMRDENGTASNALNTSEYIKPGVHFLDVVTLKDMTADEMRYVLGNILMTPRYGAVSSRIGRMENQILGIFGGITELPSSLELVQSLYDALIEAKTPLEHPFDTDLLVRMTKDAIASWTNRRGISMQLTEEQLTAVIADVDRHWDGERETFLKRLDRSYETFRKPPAKASSSRKGKKNTEPVTPEG

SEQ ID NO: 4412 - protein, 341 aa, Calothrix sp. PCC 6303
MSFLKTVDAKFFHSEIPYKPMGKYVHFLTVRVTESYPLFQTDSELNKARVRAGIVDKTTISRLSMFKRKQSTPERLVGRELLRNYGLMTAEECEYNVKFAMNNPDCIIYGFAIGDSGSEKSKVVVDTAFSIKSFDESHETFTLNAPFENGTMASKGENGSKVGEVTSRINQQDHIKPQVFFPSIVTLKDPTEASFLYVFNNILRTRHYGAQTTRTGRVRNELIGVIFADGEIVSNLRWTQAIYDQMKSNNTLNSPDPLNEDEVFVSAKVSISTLMEDEFIVHEDFLGDKFAALLKEVKAITANEEELKKMLKKADDEAKAYAKVHIKGKDKEKDKDKAAAK

SEQ ID NO: 4413 - protein, 338 aa, Oscillatoria nigro-viridis PCC 7112
MSIAKLQPFLAPSYENFPKGRTIGIVVLRTTQSETIFRTEGTGEPMCNEYVQAGIEDTESIPRLVMTKRKQVAPERRKGREFLRSHNLLYTAPKTDAICALNTNAPCEMCVDCFLYGFAAGGEGAQKSRVWTEDAFSVLHSTELIADRTINAIFETGTMRDEKGNASTALNTSEYIKPGVHFLDIVTLKDVTADELRYTLGNILLTSRYGAVSSRVGRMDNQILGVFGGIAELPSSLELVQGVYDKLKAQNTALEHPLKTASLVDATQEIIGSWTNKRGISMQLSPAECDALIADVDRHWSLPEQETFLKRLDESYAPWRKVKSENKTKGRGKKSEES

SEQ ID NO: 4414 - protein, 332 aa, Crinalium epipsammum PCC 9333
MFDKYQSHFQVSIPKIPGAKYAHFIVLRETDSYAVFKTDGELNVARVRAGLNKTDVITRLVLFKRKQTTPERLTGRELLRRYDIYEQIKTQYERVTTKKEKQIEGCTYNGEPCGGCPDCVIYGYAVGESGSEKSKVFIDSAYAIPPYEDSHGTFTLNAPYEDGTMTSGTSTTNRFSEQDHVLPEIPFPSVVTLRDPSPNTFLYVLNNIYRTKRYGAQTTRTGQLRNHLVGIIFADGEIFSNLRLTQKIYDLLDGKNPPYSVEDMKEKTEQSIEELIKQDGVLYELIKGDSLLSVENEAQSILSDETQFKNWLGSITQETLAYAERAKVLKKK

SEQ ID NO: 4415 - protein, 339 aa, Gloeocapsa sp. PCC 7428
MQFLKTVDAKFFHNEIPAKPMGKYAHFITIRVTESYPLFQTDGELNKARVRAGVNNPEPISRLAMFKRKQSTPERLTGRELLRNYQIGDWEKCDYNVDFSKTTPDCILYGFAIGDSGSEKSKVVVDTAYSITSFDDSHLNFTLNAPFENGTMSRKGEVTSRINSQDHILPQIFFPSIVTLKDPTEASFLYVFNNILRTRHYGAQTTRTGRVRNQLIGIVFADGEIVSNLRWTQKIYDLLQDKGQINPPDPLSEDDVLQAANHAITELMTQECISHSDFIGDNFQRLLIEVKSITGDENRLKELLNKANTESSTYAKQYILKPEKEKKAENKTRASAAKE

SEQ ID NO: 4416 - protein, 333 aa, Stanieria cyanosphaera PCC 7437
MTFLKSIDAKYFHAEIPYKPMGKYAHFLTIRVTESYPLFQTDGELNKARVRAGITNQNPISRLTMFKRKQSTPERLIGRELLRNYGLVKPDECEYNVDFAKNNADCIIYGFAIGDGGSEKSKVVVDSAYSITSFDESHETFTLNAPYEHGTMSKNGEVTSRINQQDHIRPQVFFPSIVTLKDPTEASFLYVFNNILRTRHYGAQTTRTGRIRNELIGVIFADGEIVSNLRWTQAIYDKLGGKINSLDPLNEDEVDRAAKEAIEQLMSQEFIVHQDFIGDNFTPILNDVKTLTGSEENIKAILTKANQEAQNYFDNYITKSKDKDKDKKTAKSK

SEQ ID NO: 4417 - protein, 337 aa, Halothece sp. PCC 7418
MSLLKTINSTKHFHTEIPYKPMGKYVHFLTLRITESYPLFQTDGELNKARVRAGINNPNPISRLSLFKRKQSTPERLVGRELLRQYNLITAEECEYNVNFGMDNPDCIIYGFAIGDSGSEKSKVVVDTAYSITPFDQSHETFTLNAPYENGTMSSKGEPGSKPGEVTSRINQQDHIRPQVFFPSIVTLKDPTEASFLYVFNNILRTRHYGAQTTRTGRVRNELLGVVFADGEIVSNLRWTQAIYDRLPEEVLNSLDPLEEKTICDEATNAIQALMEDEFIVHTDFIGEQFTPLLKEVKALTKTAEGIMSILQQADAEAKTYAEKHIGKKSKSSAKKS

SEQ ID NO: 4418 - protein, 336 aa, Anabaena cylindrica PCC 7122
MALLKTVDAKLFQSEIPYKPMGKYAHFLTIRVTESYPLFQTDSELNKARVRAGVKDKNTISRLSMFKRKQSTPERLVGRELLRKYEYMTAEECEYNVSFAMDNPDCIIYGFAIGDSGSEKSKVVVDTAFSITSFDESHETFTLNAPFENGTMASKGEGGSKAGEVTSRINQQDHIRPQVFFPSIVTLKDPTEANFLYVFNNILRTRHYGAQTTRTGRVRNELIGVVFADGEITSNLRWTQAIYDQMKANNTLKSPDPLDEDDVMAAAKTAIENLMADEFIVHNDFIGDAFVPLISEVKNLTNNEAGIKSILQKADTEAKEYANKHISKKKTAAKTK

SEQ ID NO: 4419 - protein, 351 aa, Sulfolobus acidocaldarius N8; identical to SEQ ID NO: 4373

SEQ ID NO: 4420 - protein, 351 aa, Sulfolobus acidocaldarius Ron12/I; identical to SEQ ID NO: 4373

SEQ ID NO: 4421 - protein, 329 aa, Synechocystis sp. PCC 6803
MLDSLKSQFQPSFPRLASGHYVHFLMLRHSQSFPVFQTDGVLNTTRTQAGLLEKTDQLSRLVMFKRKQTTPERLAGRELLRNLGLTSADKSAKNLCEYNGEGSCKQCPDCILYGFAIGDSGSERSKVYSDSAFSLGAYEQSHRSFTFNAPFEGGTMSEAGVMRSAINELDHILPEVTFPTVESLRDATYEGFIYVLGNLLRTKRYGAQESRTGTMKNHLVGIVFADGEIFSNLHLTQALYDQMGGELNKPISELCETAATVAQDLLNKEPVRKSELIFGAHLDTLLQEVNDIYQNDAELTKLLGSLYQQTQDYATEFGALSGGKKKAKS

SEQ ID NO: 4422 - protein, 340 aa, Sulfolobus islandicus LAL14/1
MNGIEAVSKILGNEKISTFFADLSKPNKENAVPRGRVANVFVTILAEGELVIRHEGGEDVTLANIDGEKYPMILHEKLVSSWRREMLEQLRHVYDLHKEEINKIREKSDEWHCSLRPTTATGRKDERMGGLCRECPNCMTFGYAVGEEERYNLKSRIEGDVYLATLPEKKSVVVRTFNAIDEPTHTTFIQAEGARTGALFRLSLIKVGTPFVGKIAMKDLAPAEFALALYSLINTTRVGGIRSDFGKIRIIIAAIALCDHEVSSGYEIFEKTKELDNVSEIVRKINEQVKSYQGECQVFTSEDFSPTISKIVGNNKHDIIKEAWINGLNFKKSIEEFIKK

SEQ ID NO: 4423 - protein, 335 aa, Gloeobacter kilaueensis JS1
MALLSTLDPKYFHSAIPYKPMGKYVHFLTVRITESYPLFQTDGELNKARVRAGIQDDTPISRLAMFKRKQSTPERLVGRELLRRYEIPGAEKCEYNVEFSMNTPDCILYGFAIGDSGSEKSKVVVDTAYSITAFDGSHERFTLNAPYENGTMASKGEPGTKAGEVTSRINSQDHIKPQVFFPSIVTLKDPTEAGFLYVFNNLLRTRHYGAQTTRTGKLRNELIGVSFSDGEILSNLRWTQAIYDAMKANDTLTDPLNEDEVIQAAARTITELLAKECVVHTDLIAEAFAPVLAEVRQLTGSEAGIRRLLEQADREAKEYNKNHIKQKATKAAKES

SEQ ID NO: 4424 - protein, 686 aa, Escherichia albertii KF1
MFWRDITLSVWRKKTTAFKTKKRLLPLMLAAALCSSPAWAEEHTFTANFKDTDLKSFIETVGANLNKTIIMGPGVQGKVSIRTMTPLNERQYYQLFLNLLEAQGYAVVPMENDVLKVVKSSAAKVEPLPLVSEGNDNYAGDEMVTKVVPVRNVSVRELAPILRQMIDSAGSGNVVNYDPSNVIMLTGRASVVERLTEVIQRVDRAGNRTEEVIPLDNASASEIARVLESLTKNSGENQPATLKSQIVADERTNSVIVSGDPATRDKMRRLIRRLDSEMERSGNSQVFYLKYSKAEDLVDVLKQVSGTLTAAKEEAEGTVGSGREVVSIAASKHSNALIVTAPQDIMQSLQSVIEQLDIRRAQVHVEALIVEVAEGSNINFGVQWASKDAGLMQFANGTQIPIGTLGAAISQAKPQKGSTVISENGATTINPETNGDLSTLAQLLSGFSGTAVGVVKGDWMALVQAVKNDSSSNVLSTPSITTLDNQEAFFMVGQDVPVLTGSTVGSNNSNPFNTVERKKVGIMLKVTPQINEGNAVQMVIEQEVSKVEGQTSLDVVFGERKLKTTVLANDGELIVLGGLMDDQAGESVAKVPLLGDIPLIGNLFKSTADKKEKRNLMVFIRPTILRDGMAADGVSQRKYNYMRAEQIYRDEQGLSLMPHTSQPVLPAQNQALPPEVRAFLNAGRTR

SEQ ID NO: 4425 - protein, 335 aa, Thioalkalivibrio paradoxus ARh 1
MTLDTLKPYLGDLNSMLAITEVDAKKSYAQPALKNLGSAVLVVLREVISPASFRNAEAEITDIEVNGRRHVRAVANKFKFGERARGLQVLRYFGAGGKAAQNKTAFHGKEKPSAKFDLNTLVFGDSANHGSKVLPVKASAQYSDAVSIQDYSEAVDLTFHNRASEDGSLWDAEGKKNSSNLFERHFVKPGMLLLQTIAFNGKVAPVQALEHLLLSLGLAGAYGGATSIYGVNVRNHMVGLFAGHLERDLASPYVAIDRLRSGAQVDASDPAAIQEALSALYRAAWPVEIPGATVADLQRDLIARLEADDAGLRERYTTTAAQVGKYFDAWFEGIG

SEQ ID NO: 4426 - protein, 327 aa, Marichromatium purpuratum 984
MERLNDYLAPLNGLLEKTQGNNSAYLHPKRKNLGSISLVLIREAIAPVVFRNAEQEITDIEFNDETYVRAVPNKFKYPERGRALQILRAMGAGGRYPQNRTVIPKKAKPSESFDLNTLVFGDSANSDNKVLPVRAAVNYSDGLSLRPKYLCVDESFHNRGMEDGTLWDAEDNKNTDNLFSRHFIRPGSLMVQVLSTRGKMLPAIGLKHLLLSVGMAGSYGGQTSVTGINIRTHCVGIYADKFEKAETSPYELIKHFDPAETTDVETAAARLHNLLAPLHQTVIPGQEVQGWVEQLVDDFNQPGGRLEAEYKEAATEIAQLFDGWFGK

SEQ ID NO: 4427 - protein, 344 aa, Nostoc sp. PCC 7120 = FACHB-418
MSISKLSSVLATSYENFPKGRFITLVILRTTHSETIFRTEGSGEPMCSEFVQAGLEGENQKTIIQRLVMTKRKQVAPERRYGREHLRAHELLYTNPKDGSLCSLNTNAPCEMCVDCFLYGFAAGGGGAQKSRIWTEDAFSILPASDVVGDRTINAIYETGTMRDEKGNASTALNTSEYIKPGVHFLDVVTLKDVTADELRYIIGNILFTSRYGAVSSRVGRMENEILGVFGSITELPSSLELVQATYDALGKPLEHPLNINQLITASKQVIANWKNKRGVSVQLSEAELADLLTDVETHWSELERDTFLKRLSQSYEPFRQVSPEKNKGKGKGKGKNTPVEVES

SEQ ID NO: 4428 - protein, 259 aa, Synechocystis sp. PCC 6803
PERLAGRELLRNLGLTSADKSAKNLCEYNGEGSCKQCPDCILYGFAIGDSGSERSKVYSDSAFSLGAYEQSHRSFTFNAPFEGGTMSEAGVMRSAINELDHILPEVTFPTVESLRDATYEGFIYVLGNLLRTKRYGAQESRTGTMKNHLVGIVFADGEIFSNLHLTQALYDQMGGELNKPISELCETAATVAQDLLNKEPVRKSELIFGAHLDTLLQEVNDIYQNDAELTKLLGSLYQQTQDYATEFGALSGGKKKAKS

SEQ ID NO: 4429 - protein, 335 aa, Microcystis aeruginosa NIES-843
MSLLKTLNSKFFHSEIPYKPMGKYVHFLTIRVTESYPLFQTDGELNKARVRAGIDSKKTISRLSMFKRKQSTPERLVGRELLRNYKLITAEECEYNVKFAMNNPDCIIYGFAIGDSGSEKSKVVVDTAFSITPFDESHESFTLNAPYENGTMASKGENDTKVGEVTSRINQQDHIRPQVFFPSIVTLKDPTEASFLYVFNNILRTRHYGAQTTRTGRVRNELIGVIFADGEIVSNLRWTQAIYDRLPDEVLHSIDPLDEDLVMEKATEAIQELMAEEFIVHTDFIGENFQPLLTEVKTLTGTEAGILSILNQADKEAKDYAKKHIAEKKPAAQKP

SEQ ID NO: 4430 - protein, 313 aa, Caldilinea aerophila DSM 14535 = NBRC 104270
MNTIESFIEQTATVDALVPRVVNKRRVAQPILTRRVVTIAGIKTVKTRFLPVSHEGYGNESYVDKLELLGKTRAEFISRKLKGIERRAHMNLFREMVERQSGNGWQQFFTAKFDKPCTIPDALCIACWNCSLFGGLEAGKGATFSRIRYFDTYSIEAAEDCIAMEGSEEGMGIGNQVYEDVNQARGAETYHLYEYVKAGTRFPFITLIESPTLLDVAGYLHAVRRADEHGYGKYSANHGKFDTRFLVVATGYPRFSVLDMLRWADEGTLENRFVNRELRFDDLNGSIALFGDEIETLADKLTEAFDGYFRALV

SEQ ID NO: 4431 - protein, 329 aa, Natronomonas pharaonis DSM 2160
MIPDNITNALADGTVPIDGMTNTPGTNYTTLLVLRELDSHAIFTTNGQDADITSLSVVGDSGSIEYSPGLMFMRKQTGSDRRAGKAIQRELLEYDRSDSMDVNDMNPQSVESALYGSAASGDDDVDIGVTSRVMYDTAFTVRDASACIDEKFQNAPGEGYAKGSTANIREPDFFEPGTLFPCTITLRDATPAEVAFVTAITSRNKRYGAATTRLGRVNNRILGLYTGSEEGPSNRELTAETIVSFASESNRTLGDVVQAPALNADQAAAYVREAYDTACTETVAQTPVDDEVLDELLALTDDDDLRAVLEAQQPHSRSFIDDAIAADES

SEQ ID NO: 4432 - protein, 335 aa, Microcystis aeruginosa PCC 7806
MSLLKTLDSKFFHSEIPYKPMGKYVHFLTIRVTESYPLFQTDGELNKARVRAGIDSKKTISRLSMFKRKQSTPERLVGRELLRKYNIVTAEECEYNVSFGMNNPDCIIYGFAIGDSGSEKSKVVVDTAFSITPFDESHESFTLNAPYENGTMASKGENKTKPGEVTSRINQQDHIRPQVFFPSIVTLKDPTEAGFLYVFNNILRTRHYGAQTTRTGRVRNELIGVIFADGEIVSNLRWTQAIYDRLPDEVLHSIDPLDEDLVMEKATEAIQALMAEEFIVHTDFIGENFQPLLTEVKTLTGTEAGILSILNQADKEAKDYAKKHIAEKKPAAKKP

SEQ ID NO: 4433 - protein, 73 aa, Eubacterium rectale DSM 17629; identical to SEQ ID NO: 4387

SEQ ID NO: 4434 - protein, 319 aa, Kamptonema sp. PCC 6506
MSILTKPEYVKFLQERYQEYPQGKYVNLILIRKTESEAIFRTEGSGEPLCREFVQAGVQKRKTDPIQRVVITKRKQTAVERRTGREDLRKQNLLCLNEDGASHPDSIDAYIYGYAVGQGGAQKSRVITEDAFSVLPVSQVVDIRTSNALFETGTMRDTRDEGAEASTSLFGSEYVRPETHFLDIETLKDVTPDELFYVLGNILRSSRYGAVSSRIGKVKNTLAQVIFSDTEIFSTLELTQRVYDILPRDSQDEELDFPLADDVLLQAAINSSSELVQQVFGQYQIMTDADRNSLIEEVRTIYRDPATFLQRLANSYRRG

SEQ ID NO: 4435 - protein, 329 aa, Haloquadratum walsbyi C23
MIPDNITNALADGTVPVDSMTNTPGTNYTTLLVLRELESHAVFTTNGQDADITSLPIIDGDESIEYSPGLMFMRKQTGSDRRTGKAIQRELLEYERSDSMDVNDMNPQSVESALYGSAASGDDDVDIGVTSRVMYDTAFTVRDASACIDEKFQNAPGEGYAKGSTANIREPDFFEPGTLFPCTITLRDATPAEVAFVTAITSRNKRYGAATTRLGRVNNRVLGLYTGSEEGCSNRELTAETIVSFASEGDRTLGDIVQAPVLNADQAATFVREAYDAACAEEIAQAPVDDKILNEILTLTGDEELQTVLETQQPHSQTFIDDAIAADEN

SEQ ID NO: 4436 - protein, 333 aa, Microcystis aeruginosa PCC 9432
MSLLKTLDSKFFHSEIPYKPMGKYVHFLTIRVTESYPLFQTDGELNKARVRAGIDSKKTISRLSMFKRKQSTPERLVGRELLRKYNIVTAEECEYNVKFAMNNADCIIYGFAIGDSGSEKSKVVVDTAFSITPFDESHESFTLNAPYENGTMASKGENNTKVGEVTSRINQQDHIRPQVFFPSIVTLKDPTEASFLYVFNNILRTRHYGAQTTRTGRVRNELIGVIFADGEIVSNLRWTQAIYDRLPDEVLHSIDPLDEDLVMEKATEAIQALMAEEFIVHTDFIGENFQPLLTEVKTLTGTEAGILSILNQANEDSEKYFKQYIEKKKAEKK

SEQ ID NO: 4437 - protein, 333 aa, Microcystis aeruginosa PCC 9717
MTFLKSVDAKFFHSEIPYKPMGKYVHFLTIRVTESYPLFQTDGELNKARVRAGIDSKKTISRLSMFKRKQSTPERLVGRELLRNYKLITAEECEYNVKFAMNNPDCIIYGFAIGDSGSEKSKVVVDTAFSITPFDESHESFTLNAPYENGTMASKGENDTKVGEVTSRINQQDHIRPQVFFPSIVTLKDPTEASFLYVFNNILRTRHYGAQTTRTGRVRNELIGVIFADGEIVSNLRWTQAIYDRLPDEVLHSIDPLDEDLVMEKATEAIQALMAEEFIVHTDFIGENFQPLLTEVKTLTGTEAGILSILKQANEESEKYFKQYIEKKKAEKK

SEQ ID NO: 4438 - protein, 335 aa, Microcystis aeruginosa PCC 9443
MSLLKTLDSKFFHSEIPYKPMGKYVHFLTIRVTESYPLFQTDGELNKARVRAGIDSKKTISRLSMFKRKQSTPERLVGRELLRNYGLITAEECEYNLAFGMNNPDCIIYGFAIGDSGSEKSKVVVDTAFSITPFDESHESFTFNAPYENGTMASKGENKTKPGEVTSRINQQDHIRPQVFFPSIVTLKDPTEAGFLYVFNNILRTRHYGAQITRTGRVRNELIGVIFADGEIVSNLRWTQAIYDRLPDEVLHSIDPLDEDLVMEKATEAIQALMAEEFIVHTDFIGENFQPLLTEVKTLTGTEAGILSILNQADKEAKDYAKKHIAEKKPAAKKP

SEQ ID NO: 4439 - protein, 333 aa, Microcystis aeruginosa PCC 7941
MTFLKSVDAKLFHSEIPYKPMGKYVHFLTIRVTESYPLFQTDGELNKARVRAGIDSKKTISRLSMFKRKQSTPERLVGRELLRKYNIVTAEECEYNVKFAMNNPDCIIYGFAIGDSGSEKSKVVVDTAFSITPFDESHESFTLNAPYENGTMASKGENDTKVGEVTSRINQQDHIRPQVFFPSIVTLKDPTEASFLYVFNNILRTRHYGAQTTRTGRVRNELIGVIFADGEIVSNLRWTQAIYDRLPDEVLHSIDPLDEDLVMEKATEAIQALMAEEFIVHTDFIGENFQPLLTEVKTLTGTEAGILSILNQANEDSEKYFKQYIEKKKAEKK

SEQ ID NO: 4440 - protein, 335 aa, Microcystis aeruginosa PCC 9806
MSLLKTLDSKFFHSEIPYKPMGKYVHFLTMRVTESYPLFQTDGELNKSRVRAGIDSKTTISRLSMFKRKQSTPERLVGRELLRNYGLITARECEYNVAFGMNNPDCIIYGFAIGDSGSEKSKVVVDTAFSITPFDQSHESFTLNAPYENGTMASKGENKTIPGEITSRINEQDHIRPQVFFPSIVTLKDPTEASFLYVFNNILRTRHYGAQTTRTGRVRNELIGVIFADGEIVSNLRWTQAIYDRLPDQVLQLIDPLEEDLVMEKATEAIQALMAEEFIVYTDFIGEKFQPLLTEVKTLTGTEAGIRAILQQADDEAKDYAQKHIADKKTAAKKP

SEQ ID NO: 4441 - protein, 335 aa, Microcystis aeruginosa PCC 9807
MSLLKTLDSKLFHSEIPYKPMGKYVHFLTIRVTESYPLFQTDGELNKARVRAGIDSKKTISRLSMFKRKQSTPERLVGRELLRKYNIITAEECEYNVSFGMNNPDCIIYGFAIGDSGSEKSKVVVDTAFSITPFDESHESFTFNAPYENGTMASKGENKTKPGEVTSRINQQDHIRPQVFFPSIVTLKDPTEASFLYVFNNILRTRHYGAQTTRTGRVRNELIGVIFADGEIVSNLRWTQAIYDRLPDEVLHSIDPLDEDLVMEKATEAIQALMTEEFIVHTDFIGENFQPLLTEVKTLTATEAGIRSILKQADDEAKDYAKKHIAEKKPAAKKP

SEQ ID NO: 4442 - protein, 333 aa, Microcystis aeruginosa PCC 9808
MTFLTSVDAKFFHSEIPYKPMGKYVHFLTIRVTESYPLFQTDGELNKARVRAGIDSKKTISRLSMFKRKQSTPERLVGRELLRNYGLITAEECEYNVKFAMNNADCIIYGFAIGDSGSEKSKVVVDTAFSITPFDESHESFTLNAPYENGTMASKGENNTKVGEVTSRINQQDHIRPQVFFPSIVTLKDPTEASFLYVFNNILRTRHYGAQTTRTGRVRNELIGVIFADGEIVSNLRWTQAIYDRLPDEVLHSIDPLDEDLVMEKATEAIQALMAEEFIVHTDFIGENFQPLLTEVKTLTGTEAGILSVLDQANKESKKYFEQYIEKKKAEKK

SEQ ID NO: 4443 - protein, 335 aa, Microcystis aeruginosa PCC 9809
MSLLKTLDSKFFHSEIPYKPMGKYVHFLTIRVTESYPLFQTDGELNKARVRAGIDSKKTISRLSMFKRKQSTPERLVGRELLRNYKLITAEECEYNVKFAMNNPDCIIYGFAIGDSGSEKSKVVVDTAFSITPFDESHESFTLNAPYENGTMASKGENNTKVGEVTSRINQQDHIRPQVFFPSIVTLKDPTEASFLYVFNNILRTRHYGAQTTRTGRVRNELIGVIFADGEIVSNLRWTQAIYDRLPDEVLHSIDPLDEDLVMEKATEAIQALMAEEFIVHTDFIGENFQPLLTEVKTLTGTEAGILSILKQADKEAKDYAKKHIAEKKPAAQKP

SEQ ID NO: 4444 - protein, 335 aa, Microcystis aeruginosa PCC 9701
MTFLKSVDAKFFHSDIPYKPMGKYVHFLTIRVTESYPLFQTDGELNKARVRAGIDSKKTISRLSMFKRKQSTPERLVGRELLRNYGLITAEECEYNVKFAMNNPDCIIYGFAIGDSGSEKSKVVVDTAFSITPFDESHESFTLNAPYENGTMASKGENNTKVGEVTSRINQQDHIRPQVFFPSIVTLKDPTEAGFLYVFNNILRTRHYGAQTTRTGRVRNELIGVIFADGEIVSNLRWTQAIYDRLPDEVLQSIDPLDEDLVMEKATEAIQALMAEEFIVHTDFIGENFQPLLTEVKTLTGTEAGIRSILNQADKEAKDYAKKHIAEKKPAAKKP

SEQ ID NO: 4445 - protein, 335 aa, Thermobrachium celere DSM 8682
MSKDFLNVLRENNAFAEMITDVKKNKYIQIVILRELQSYGIFTTEGRILNVAETTAGVKDNSKVTRVLMIKRKQVASERRTGKALRRKLIEKGLTICGREDCSLIQHLCGKCPDCMLYGYAAQGGDNADTNQSRKTRVITDTAFSIRDYGEKTVEEITLNAVDEETHSTGTALSSKEHIKPGVIFPCVETLVDVTEDEFLYVLANILLTTRYGAEANRGGLIKNHIVGIYISNQEVFTNLELTKHLYDELKDKLDDIDLNLVKEAFNRVEDEIIKNAFSSVKKVDNINTFIEEFRNYIKDDTNLMEIYQNIEKQIEEYSIRKVEEKGEKSKSRKK

SEQ ID NO: 4446 - protein, 506 aa, Escherichia coli ISC41
MFWRDMTLSVWRKKTTGLKTKKRLLPLVLAAALCSSPVWAEEATFTANFKDTDLKSFIETVGANLNKTIIMGPGVQGKVSIRTMTPLNERQYYQLFLNLLEAQGYAVVPMENDVLKVVKSSAAKVEPLPLVGEGSDNYAGDEMVTKVVPVRNVSVRELAPILRQMIDSAGSGNVVNYDPSNVIMLTGRASVVERLTEVIQRVDHAGNRTEEVIPLDNASASEIARVLESLTKNSGENQPATLKSQIVADERTNSVIVSGDPATRDKMRRLIRRLDSEMERSGNSQVFYLKYSKAEDLVDVLKQVSGTLTAAKEEAEGTVGSGREVVSIAASKHSNALIVTAPQDIMQSLQSVIEQLDIRRAQVHVEALIVEVAEGSNINFGVQWASKDAGLMQFANGTQIPIGTLGAAISQAKPQKGSTVISENGATTINPDTNGDLSTLAQLLSGFSGTAVGVVKGDWMALVQAVKKRLQLERALHAEYHHAGQPGSLLHGGPGRSGINRLYCWL

SEQ ID NO: 4447 - protein, 342 aa, Lyngbya sp. PCC 8106
MAILKTIDAKHFHTEIPYKPMGKYVHFLTIRVTESYPLFQTDGELNKARVRAGIEDRNPISRLSMFKRKQSTPERLVGRELLRKYEFMTAEDCEYNVKFAMDNPDCIIYGFAIGDSGSEKSKVVVDTAFSITAFDESHESFTLNAPFENGTMASKGENGSTPGEVTSRINQQDHIKPQVFFPSIVTLKDPTEASFLYVFNNILRTRHYGAQTTRTGRLRNELIGVVFADGEIVSNLRWTQAIYDQLKTDNKLGDLDPLDEDDVISAATTTIEKLMEDEFIVHTDFLGEGFTPLLKEVKALTRSEEGIIQILQQADTEAKAYAKKHISSKKSKSKGKATTEAN

SEQ ID NO: 4448 - protein, 338 aa, Coleofasciculus chthonoplastes PCC 7420
MSFLKTIDTNLFHSELPYKPMGKYVHFLTIRITESYPLFQTDGELNKARVRAGIQDKTPISRLSMFKRKQSTPERLVGRELLRNYDLVTADECEYNVSFAMDNPDCIIYGFAIGDSGSEKSKVVVDTAFSITPFDESHETFTLNAPFENGTMTSKGEKGSKPGEVTSRINQQDHIRPQVFFPSIVTLKDPTEASFIYVFNNILRTRHYGAQTTRTGRVRNELLGVIFADGEIISNLRWTQAIYDQMKEKNTLPTLDPLDEEDVIDAATTAIEQLMSQEFIVHTDYIGGEFQPLLNEVKTLVGSEAGIQSVLQQADAEAKEYAQKHISSKKKAKAKSTN

SEQ ID NO: 4449 - protein, 326 aa, Cylindrospermopsis raciborskii CS-505
MSFLDSFLHSIKPEFPTALPRLASGKYVHFVMLRHSQCFPILQPDGVLSTVRTRAGMQTSDMINRLVMLKHQQTTSARLAGRKLLCSLGLASDNPKDKDKFCNGENCCKKCPDCIIYGFAGNESGIELAKVYSDSSFSLGDESNDVITEITFPTVETLCDPTFESFLYVLGNLLHNPPHIGRELTISKMSNHVIGIVFCDGEIFSNLHFTQALYDIFKSDLNTSLVDLIIKATEVSNNLLNQEPVRKTRIITGSQLTDLLTEVSILYQDETKLKTVMTTLCQQTKIYAQIYGDSWSSRGKEIIPSLPFRKRNFISLDSSNYQLVNL

SEQ ID NO: 4450 - protein, 343 aa, Cylindrospermopsis raciborskii CS-505
MKFTSLTKYQRYFHESIPVFRQNKYIQIVVLRETKSHAIFTTEGDTLDTEILQAGYSSKNATQKLDRVVMFKRKQIASERRTGKALLRQFGLVAIGDDNENKKSKQEQKVKSCYLMDGMCGECPDCTLYGFAAVKGESSQKSRVLTDSSFSLRSYSKIQKMVKLNAIQDKTEGGISGSAFAEKDTLIPQIFLPCVETLVDVTPAEFMYVLGNILQTTRYGAESNRQGYIRNHLVAITFGNVEKLSNLDLSQRLYDKLSPEGHINDILDLGNFINNDRQTGNIFDVVNEVLAELPGHSQAMSSEDLKLLVEEFNSIFSDLENCQKFLTGLDAASRQYAKSKGKS

SEQ ID NO: 4451 - protein, 323 aa, Raphidiopsis brookii D9
MSFSDGFLDSIKPEFSTALPRLASGKYVHFVMLRHSQCFPILQPDGVLNTVRTQAGIQTSDVINRLVMPKHQQTTSARLVGRELLFSLGLASDNPKDKDKFCEYNGENCCKQCPNCIIYGFASNEGGLELAKVYSDSAFSLGDAKSNDVIAEITFPTVATLCDPTFESFLYVLGNLLHTSPQIGMSNHVIGIVLCDGEIFSNLHFTQALYDVLKSNLNASLADLITKATEVSNNLLNQEPVTKTRIITGSQLINLLTEVSILYQDRTKLKTVMTTLCQQTKIYAQIYGDSWSSRSKEIIPNLPFRKRNFISLDSSNYQLINIS

SEQ ID NO: 4452 - protein, 336 aa, Ktedonobacter racemifer DSM 44963
MSMTSHMSTLKKYEEHLMDAYNNFPYGRYVSLIVIRKTESETIFRTEGSGEGLSKEIVTAGASKDNAGPLRRVVISKRKQTAVERRVGRELLREHKLLKMVTVNKAEQPCALNTNAPCGECIDCMVYGYAVGGGGAQKSRVMTDDAYSIGPASQVTGRRTFNATFDNGTMRNPLTGAASTSINEDEYVLPETHFLDIETLKDVTAGELQYVIGNILRSSRYGAMSSRLGRVRNTLAAIIFSDTEIFSNLELTQHVYDSLKGSDKELAFPLSDYTIKEALKEATNTLIKRVVGRLPVIVRDAVLEQIIDETISLYRSESDLLALLQEIDQGYTKQSK

SEQ ID NO: 4453 - protein, 338 aa, delta proteobacterium NaphS2
MKRFTPYLGDMDSLVAATQIESKGNKEGQYIHPALKNLGCVSLVVVREAIAPVVFRNAEQEITDIEILEEPYIRAIPNKFKYPEKGRGLQILRAYGVGGRLPQNKTTLRKNQKPSDAYDLNTLVFGDSTTHDNRILPVRAGMNYSDGLSLLPKHFCVDESFHNRAMEDGTLFDAESKKNSDNLFTRYFILPGTLMVQVLSTRGKVLPQEGLDHLLLSMGLAGAYGGQTSTTGVNIHSRLAGIYGSKFERAETSPYELVKALSGNRADLKDPKDVGEKIHNLLMPLHEAAMTPDEARSYQRNLVERFEADDPELKDQYTKAAPKVAELFDSWFGTGKSS

SEQ ID NO: 4454 - protein, 345 aa, Oscillochloris trichoides DG6
MLTTNFFPTSVPQRPMGHYAHIVILRETDSYALFQTDGELNTARVQAGITNTKFITRITMFKRKQTTPERLIGRELLRRYGLISGESAPEPKERKTDDRGVAIDAAGLAICDYNVDFCKQCPDCISYGFAIGDAGSEKSKVYSDTAYSLTPFDISHEAFTLNAPYEDGTMSRKGEVTSRINEQDHIRPQTLFPAVITIRDLTSPLFLYVLNNILRTRRYGAQTTRTGTMTNHLLGIVLSDGEIFSNLHFTQHLYDKVASTADFDPTQPVDVQVALGAAQSLLPDLIAADHVAVRQLLIGAELAQFIDELSLRTRDEKGIAELLYTALRDSMGYHAAYIQKKGRGK

SEQ ID NO: 4455 - protein, 332 aa, Thiorhodospira sibirica ATCC 700588
MHSIHPYLGQLDQLTTESSDGKDTYIHPALKNLGAVSLVLIREAIAPVIFRNAEQEITDIDIDGEAFVRAVPNKFKYPEKSRGLQLLRAYGVGGRMPQNKSVFRPKQPISEVYDLNTLVFGDSSTQDKRVLPVKAAVSYSDGLSLQPKYQCVDESFHNRAMEDGTLFDAADKKNSDNLFSRHFVKPGTLLVQVLSTRGRLLPPEGLDHLLLSVGLAGTYGGQTSVTGTNLSTHFVGFYAGRFERASTSPYQLVRHCRQHGVDLTDHKALTQALHQHLAADHEANIPPEATQDYVAQLIARFEANDEALARQYQTTAKATAGLFDNWFGTGKK

SEQ ID NO: 4456 - protein, 337 aa, Fischerella thermalis
MNFLKTIDAKFFHNEIPAKPMGKYAHFITIRITESYPLFQTDGELNKAKVRAGIQHQEAISRLAMFKRKQSTPERLTGRELLRNYKIGDWEKCDYNVEFSKTTPDCILYGFAIGDAGSEKSKVVVDTAYSITPFEDSHLNFTLNAPFENGTMSRKGEVTSRINSQDHILPQVFFPSIVTLKDPTEAGFLYVFNNIIRTRHYGAQTTRTGRLRNELIGIIFADGEIVSNLRWTQKIYDLLNFDGKINPPDPLNEDDVRKAAIKAINELMTQECVTHTDYIGDKFTPLLDEVKSITSNENKLQELLTQANVESSAYAQKYISKDSDKNKKGKKAGAATE

SEQ ID NO: 4457 - protein, 328 aa, Thiothrix nivea DSM 5205
MNTETLNNYLADINHLTDQSTVDGKKYYVHPKLKNLGCVNLVVIREALAPVVFRNAEQEITDIEVDGDVYVRAVPNKFKYVERGRGLQILRALGVGGKQAQNKTVLYKGQQPSDAFDLNALVFGDSANFDSRVLPVKAAVHYSDALSLQSKHLCVDETFHNRAMEDGTLYDAEKGKNSDNLFTRHFIKPGTLMVQVLSSRGKMLPEIALKHLLLSVGMAGSYGGQTSVTGTNIRTHIVGLYADQFEKAITSPYALLAKISNQGLDVMTTQATLHELLAPEHALSIAGGEVTQWQQALIEAFNQTGSELEKEYQQARPKVAELFDQWFQ

SEQ ID NO: 4458 - protein, 335 aa, Leptolyngbya sp. PCC 7375
MTLLKTIDPKFFHTEIPYKPMGKYAHFLTVRVTESYPLFQTDGELNKARVRAGVEDKNTISRLSMFKRKQSTPERLVGRELLRTYGFVEPEECEYNVAFGMDNPDCIIYGFAIGDSGSEKSKVVVDTAFSITSFDESHETFTLNAPFENGTMASKGEKGSKPGEVTSRINQQDHIRPQVFFPSIVTLKDPTEASFLYVFNNILRTRHYGAQTTRTGRVRNELIGVVFADGEIVSNLRWTQAIFDQMKASGTLKAPDPLDEDDVAQAATTAIQSLMEDEFIVHTDVIGENFQDLLAEVKTLTASEEGIRSILKQADDETKAYAEKHIGKKKAAARS

SEQ ID NO: 4459 - protein, 334 aa, Gloeocapsa sp. PCC 73106
MSFLETLKSQFQASFPRLASANYVHFIMLRHSQSFPVFQTDGVLNTARTQAGLETKENLSRLVMFKRKQTTPERLTGRELLRSLNLTTADKEDKEKSCEYNGEGSCKKCPDCIIYGFAIGDSGSERSKVYSDSAFSLTAYEQSHRSFTFNAPFEGGTMSEAGKMRSAINELDHVLPEITFPTVETLRDSTYEGFLYVLGNLLRTRRYGAQETRTGTLKNYLIGIAFCDGEIFSNLRFTQALYDVLKGDLNAPIDTVIQTASQVARELLNQEPVRQSTIMFGEDLNNLVDEVSAIYQNQDVLTETLTTLYQQTLTYAQTYGALSGSKKSKSKDKN

SEQ ID NO: 4460 - protein, 335 aa, Microcystis aeruginosa DIANCHI905; identical to SEQ ID NO: 4432

SEQ ID NO: 4461 - protein, 139 aa, Tupaia chinensis
MSLRAPVFFMEGSVQYRQHVAIAPLRTVLTVVHVVVEEGLWENGLSYECRTLLFKAIHNLLERCLMDKNFVRIGKWFVRPYEKDEKPVNKSSCCSLMCGKCSECFQEPIFITDGIHVKYNECSREDKHLLIHSAAVIEI

SEQ ID NO: 4462 - protein, 313 aa, Natrialba hulunbeirensis JCM 10989
MTLDYPDKGLVESFGIYRKRKPSVTLVVKRDVTEPTLFRNSNHDRAETQEFGDKLHAQVNGEKFTSKERLTGLDLLRELDDKFVHEEYAYNEPVDLEKSLNVGTMTYGLAGTGDQDFAIKSRVVEGYTYTTEEYDLMNKETRNAVYESGTMRDADGNQSEALFDFVKVQPGNDLVHFITLEAATGPMLLYTLHNILNTGKYGARETRTGRNVRNTVLGIVLGNHDTSLSTGELLMEYHSEGADLKGSIGTYVDSVRRSDWDVYGRFDGADDAPEWFDRLVSVASRKADDADDVLREEFTSLTEEAKGELLGDD

SEQ ID NO: 4463 - protein, 328 aa, Natrialba asiatica DSM 12278
MFDYDTYPELERGTVSRDEMTIAPQNNFTNILVLRELESHAIFTTDGQSADLANVAVGSGDDRETYSPGLMFMRKQTGSDRRFGKSLQRNLLGTECTMQVNGMCQDCVECILYGSAASDDADQQLSITSRVMYDTAYTLRDATATIDEKFQNAPGDDYAKTAEATIREPDFFEPGTLFPSVITLRDATPEEVAFVLGIAAKNKRYGAATSRLGRVKNHVLGVYTGSEEGPANLELTRNVVTRLRDSDETTVDSIQDVITAAAHDPQLVGELLQSAFDDRVDAERGGLDLKRVPDETVDDLLEAATGDSLADVLETQLDASHAFLEQTA

SEQ ID NO: 4464 - protein, 328 aa, Haloferax alexandrinus JCM 10717
MFDHDTYPELERGTVSRDEMTIAPKNNFTNVLVLRELESHAVFTTDGQSADLANVAVGLGDDRETYSPGLMFMRKQTGSDRRFGKSLQRDLLQTECTMQVNGMCQDCVECILYGSAASDDADQQLSITSRVMYDTAYTLRDATVTIDEKFQNAPGDDYAKTAEATIREPDFFEPGTLFPSVITLRDATPEELAFVLGITAKNKRYGAATSRLGRVKNHILGVYTGSEEGPANLGLTRDVVTRLRDSDETSADSIQDVITAAAHDPQLVGDHLQSAFDDRVNTERGGLDLERVPDDTVDDLLETATSDSLADVLETQLDASRAFLEQTD

SEQ ID NO: 4465 - protein, 328 aa, Haloferax sulfurifontis ATCC BAA-897
MFDHDTYPELERGTVSRDEMTIAPKNNFTNVLVLRELESHAVFTTDGQSADLANVAVGLGDDRETYSPGLMFMRKQTGSDRRFGKSLQRDLLQTECTMQVNGMCQDCVECILYGSAASDDADQQLSITSRVMYDTAYTLRDATVTIDEKFQNAPGDDYAKTAEATIREPDFFEPGTLFPSVITLRDATPEELAFVLGITAKNKRYGAATSRLGRVKNHILGVYTGSEEGPANLGLTRDVVTRLRDSDETSADSIQDVITAAAHDPQLVGDHLQSAFDDRVNTERGGLDLERVPDDTVDDLLETATSDSLADVLETQLDASRAFLEQTG

SEQ ID NO: 4466 - protein, 316 aa, Halococcus thailandensis JCM 13552
MTLETPETGLVESFDIYRKRKPSVTLIVHREIVEPTLFRNSNHDRAETQEFGDKLHAQVNGEKFTSKERLTGLDLLRRLDDDLENDLVHEEYAYNEPTDLDESLNVGTLTYGLAGTGEQDFAIKSRVVEGYTYTTEEYDLMNKETRNAVYESGTMRTDENEQSEALFDFVKVQPGNSLVHFITLEAATPEMLLYVLHNVLNTGKYGARETRTGRNVRNNVIGLVLGDHDTSLSTGELLMEYHDSDADLNESIGAYVDDVRRSDWEVYGEIDGGESFPSWFGRLHSVAAREAEDADEVLRDEFRSLTESAQAVFDEG

SEQ ID NO: 4467 - protein, 335 aa, Microcystis aeruginosa SPC777
MTFLKSVDAKLFHSEIPYKPMGKYVHFLTIRVTESYPLFQTDGELNKARVRAGIDSKKTISRLSMFKRKQSTPERLVGRELLRNYKLITAEECEYNVKFAMNNPDCIIYGFAIGDSGSEKSKVVVDTAFSITPFDESHESFTLNAPYENGTMASKGENDTKVGEVTSRINQQDHIRPQVFFPSIVTLKDPTEASFLYVFNNILRTRHYGAQTTRTGRVRNELIGVIFADGEIVSNLRWTQAIYDRLPDEVLQSIDPLDEDLVMEKATEAIQALMAEEFIVHTDFVGENFQPLLTEVKTLTGTEAGILSILKQADKEAKDYAKKHIAEKKPAAKKP

SEQ ID NO: 4468 - protein, 335 aa, Thauera terpenica 58Eu
MPLNTLKPYLGDIDALLSITEEDAKKSYAQPALKNLGSVTFVVLRELISPASFRNAESEITDIESRGRRHVRAVANKFKFGERARGLQVLRFFAAGGVSAQNKTAFYGKEKPSDKFDLNALVFGDSANAGNKVLPVKAAAQYSDAISLQEYGDAVDVTFHNRASEDGTLFNAQKKENSVNLFDRHFVRPGTLLLQTISFNGKVAPLEAVEHLILSMGLAGAYGGQTSIYGVNVRNHVVGCYAGRFERDLASPYVAVDALYQAGVDVADSVAVVDALKNLYSHAYPIEVNGAEIVDVQKSLIARLEAEDDGMRTSYQGNAKKIGMYFDAWFEGIGG

SEQ ID NO: 4469 - protein, 341 aa, Lyngbya aestuarii BL J
MAILKTIDAKHFHTEIPYKPMGKYVHFLTIRVTESYPLFQTDGELNKARIRAGIQDRTPISRLTMFKRKQSTPERLAGRELLRKYEFMTAEDCEYNVKFAMDNPDCIIYGFAIGDSGSEKSKVVVDTAFSITAFDESHESFTLNAPFENGTMASKGENGSTPGEVTSRINQQDHIKPQVFFPSIVTLKDPTEASFLYVLNNILRTRHYGAQTTRTGRLRNELIGVVFADGEIVSNLRWTQAIYDQLKAENKLGSLPLDENDVLEAATSTIQMLMTEEFIVHTDFIGDEFTPLLTEVKALTRNETGIVQILQQADTEAKEYAKKHISSKKTKSKGKATTEAN

SEQ ID NO: 4470 - protein, 196 aa, Cetobacterium somerae ATCC BAA-474
MEIFINGEKINIGIKNTKLLNVLEKLEANVIQNGEVIVELKLDGEMVDGKSLPLNKKVKILELTTRSHREILIESLYLLEPYSDRFFENLSEVEEEMNDIGKIIEMVSFVEWVFGIVLSLKEATAIDLLYSDYNEYVEEFKKYAEEIFEAFKKEDFVGIIELLEGAIVPLLEDLLANSKDYLKEVLKEEGRRKLLN

SEQ ID NO: 4471 - protein, 335 aa, Leptolyngbya sp. Heron Island J
MTLLKTIDPKFFHTEIPYKPMGKYAHFLTVRVTESYPLFQTDGELNKARVRAGVEDKNTISRLSMFKRKQSTPERLVGRELLRTYGFVEPEECEYNVAFAMDNPDCIIYGFAIGDSGSEKSKVVVDTAFSITSFDESHETFTLNAPFENGTMASKGEKGSKPGEVTSRINQQDHIRPQVFFPSIVTLKDPTEASFLYVCNNILRTRHYGAQTTRTGRVRNELIGVVFADGEIVSNLRWTQAIFDQMKASGTLKAPDPLDEDDVAQAATAAIQSLMEDEFIVHTDFIGENFQDLLAEVKTLTASEAGIHSILKQADDETKAYAEKHIGKKKAAARS

SEQ ID NO: 4472 - protein, 328 aa, Halarchaeum acidiphilum MH1-52-1
MFDYDTYPELERGTVSRDEMTIAPENNFTNVLVLRELESHAVFTTDGQSADLANVAVGSGDDRETYSPGLMFMRKQTGSDRRFGKSLQRDLLGTECTMQVNGMCQDCVECILYGSAASDDADQQLSITSRVMYDTAYTLRDATATIDEKFQNAPGDDYAKTAEATIREPDFFEPGTLFPSVITLRDATPEELAFVLGITAKNKRYGAATSRLGRVKNHILGVYTGSEEGPANLGLTRDVVTRLRDSDETTAGSIQDVITAAAHDPQLVGELLQSAFDDRVDAERGGLDLECIPDDTVDDLLEAATGDSLADVLETQLDASRAFLEQTA

SEQ ID NO: 4473 - protein, 151 aa, Nocardia seriolae N-2927
MVNDLQDVVQEIRTSIFDLHGGNASSTRLRQRIEQVIAQHTGDTEMRTSLRISGPLSVVAPVLADHAEAVVREAVSNAMRHSGAQTLTVAIDVADDLTVIVSDDGRGIPDDITPSGLTNLARRAEEVGGEFAILRNADDRGTRLRWSAPLG

SEQ ID NO: 4474 - protein, 344 aa, Nostoc sp. PCC 7120; identical to SEQ ID NO: 4427

SEQ ID NO: 4475 - protein, 329 aa, Synechocystis sp. PCC 6803; identical to SEQ ID NO: 4421

SEQ ID NO: 4476 - protein, 125 aa, Escherichia albertii
MFWRDITLSVWRKKTTAFKTKKRLLPLMLAAALCSSPAWAEEHTFTANFKDTDLKSFIETVGANLNKTIIMGPGVQGKVSIRTMTPLNERQYYQLFLNLLEAQGYAVVPMENDVLKVVKSSAAKV

SEQ ID NO: 4477 - protein, 686 aa, Escherichia albertii
MFWRDITLSVWRKKTTAFKTKKRLLPLMLAAALCSSPAWAEEHTFTANFKDTDLKSFIETVGANLNKTIIMGPGVQGKVSIRTMTPLNERQYYQLFLNLLEAQGYAVVPMENDVLKVVKSSAAKVEPLPLVSEGNDNYAGDEMVTKVVPVRNVSVRELAPMLRQMIDSAGSGNVVNYDPSNVIMLTGRASVVERLTEVIQRVDRAGNRTEEVIPLDNASASEIARVLESLTKNSGENQPATLKSQIVADERTNSVIVSGDPATRDKMRRLIRRLDSEMERSGNSQVFYLKYSKAEDLVDVLKQVSGTLTAAKEEAEGSVGSGREVVSIAASKHSNALIVTAPQDIMQSLQSVIEQLDIRRAQVHVEALIVEVAEGSNINFGVQWASKDAGLMQFANGTQIPIGTLGAAISQAKPQKGSTVISENGATTINPETNGDLSTLAQLLSGFSGTAVGVVKGDWMALVQAVKNDSSSNVLSTPSITTLDNQEAFFMVGQDVPVLTGSTVGSNNNNPFNTVERKKVGIMLKVTPQINEGNAVQMVIEQEVSKVEGQTSLDVVFGERKLKTTVLANDGELIVLGGLMDDQAGESVAKVPLLGDIPLIGNLFKSTADKKEKRNLMVFIRPTILRDGMAADGVSQRKYNYMRAEQIYRDEQGLSLMPHTSQPVLPAQNQALPPEVRAFLNAGRTR

SEQ ID NO: 4478 - protein, 523 aa, Escherichia coli
MFWRDITLSVWRKKTTGLKTKKRLLPLVLAAALCSSPVWAEEATFTANFKDTDLKSFIETVGANLNKTIIMGPGVQGKVSIRTMTPLNERQYYQLFLNLLEAQGYAVVPMENDVLKVVKSSAAKVEPLPLVGEGSDNYAGDEMVTKVVPVRNVSVRELAPILRQMIDSAGSGNVVNYDPSNVIMLTGRASVVERLTEVIQRVDHAGNRTEEVIPLDNASASEIARVLESLTKNSGENQPATLKSQIVADERTNSVIVSGDPATRDKMRRLIRRLDSEMERSGNSQVFYLKYSKAEDLVDVLKQVSGTLTAAKEEAEGTVGSGREIVSIAASKHSNALIVTAPQDIMQSLQSVIEQLDIRRAQVHVEALIVEVAEGSNINFGVQWASKDAGLMQFANGTQIPIGTLGAAISQAKPQKGSTVISENGATTINPDTNGDLSTLAQLLSGFSGTAVGVVKGDWMALVQAVKNDSSSNVLSTPSITTLDNQEAFFMVGQDVPVLTGSTVGSNNSNPFNTVERKKSASC

SEQ ID NO: 4479 - protein, 493 aa, Shigella
MFWRDITLSVWRKKTTGLKTKKRLLPLVLAAALCSSPVWAEEATFTANFKDTDLKSFIETVGANLNKTIIMGPGVQGKVSIRTMTPLNERQYYQLFLNLLEAQGYAVVPMENDVLKVVKSSAAKVEPLPLVGEGSDNYAGDEMVTKVVPVRNVSVRELAPILRQMIDSAGSGNVVNYDPSNVIMLTGRASVVERLTEVIQRVDHAGNRTEEVIPLDNASASEIARVLESLTKNSGENQPATLKSQIVADERTNSVIVSGDPATRDKMRRLIRRLDSEMERSGNSQVFYLKYSKAEDLVDVLKQVSGTLTAAKEEAEGTVGSGREVVSIAASKHSNALIVTAPQDIMQSLQSVIEQLDIRRAQVHVEALIVEVAEGSNINFGVQWASKDAGLMQFANGTQIPIGTLGAAISQAKPQKGSTVISENGATTINPDTNGDLSTLAQLLSGFSGTAVGVVKGDWMALVQAVKNDSSSNVLSTPSITTLDNQEAFFMVG

SEQ ID NO: 4480 - protein, 493 aa, Shigella dysenteriae
MFWRDITLSVWRKKTTGLKTKKRLLPLVLAAALCSSPVWAEEATFTANFKDTDLKSFIETVGANLNKTIIMGPGVQGKVSIRTMTPLNERQYYQLFLNLLEAQGYAVVPMENDVLKVVKSSAAKVEPLPLVGEGSDNYAGDEMVTKVVPVRNVSVRELAPILRQMIDSAGSGNVVNYDPSNVIMLTGRASVVERLTEVIQRVDHAGNRTEEVIPLDNASASEIARVLESLTKNSGENQPATLKSQIVADKRTNSVIVSGDPATRDKMRRLIRRLDSEMERSGNSQVFYLKYSKAEDLVDVLKQVSGTLTAAKEEAEGTVGSGREVVSIAASKHSNALIVTAPQDIMQSLQSVIEQLDIRRAQVHVEALIVEVAEGSNINFGVQWASKDAGLMQFANGTQIPIGTLGAAISQAKPQKGSTVISENGATTINPDTNGDLSTLAQLLSGFSGTAVGVVKGDWMALVQAVKNDSSSNVLSTPSITTLDNQEAFFMVG

SEQ ID NO: 4481 - protein, 615 aa, Escherichia coli
MFWRDITLSVWRKKTTGLKTKKRLLPLVLAAALCSSPVWAEEATFTANFKDTDLKSFIETVGANLNKTIIMGPGVQGKVSIRTMTPLNERQYYQLFLNLLEAQGYAVVPMENDVLKVVKSSAAKVEPLPLVGEGSDNYAGDEMVTKVVPVRNVSVRELAPILRQMIDSAGSGNVVNYDPSNVIMLTGRASVVERLTEVIQRVDHAGNRTEEVIPLDNASASEIARVLESLTKNSGENQPATLKSQIVADERTNSVIVSGDPATRDKMRRLIRRLDSEMERSGNSQVFYLKYSKAEDLVDVLKQVSGTLTAAKEEAEGTVGSGREVVSIAASKHSNALIVTAPQDIMQSLQSVIEQLDIRRAQVHVEALIVEVAEGSNINFGVQWASKDAGLMQFANGTQIPIGTLGAAISQAKPQKGSTVISENGATTINPDTNGDLSTLAQLLSGFSGTAVGVVKGDWMALVQAVKNDSSSNVLSTPSITTLDNQEAFFMVGQDVPVLTGSTVGSNNSNPFNTVERKKVGIMLKVTPQINEGNAVQMVIEQEVSKVEGQTSLDVVFGERKLKTTVLANDGELIVLGGLMDDQAGESVAKVPLLGDIPLIGNLFKSTADKKENVT

SEQ ID NO: 4482 - protein, 613 aa, Escherichia coli
MFWRDITLSIWRKKTTGLKTKKRLLPLVLAAALCSSPVWAEEATFTANFKDTDLKSFIETVGANLNKTIIMGPGVQGKVSIRTMTPLNERQYYQLFLNLLEAQGYAVVPMENDVLKVVKSSAAKVEPLPLVGEGSDNYAGDEMVTKVVPVRNVSVRELAPILRQMIDSAGSGNVVNYDPSNVIMLTGRASVVERLTEVIQRVDHAGNRTEEVIPLDNASASEIARVLESLTKNSGENQPATLKSQIVADERTNSVIVSGDPATRDKMRRLIRRLDSEMERSGNSQVFYLKYSKAEDLVDVLKQVSGTLTAAKEEAEGTVGSGREIVSIAASKHSNALIVTAPQDIMQSLQSVIEQLDIRRAQVHVEALIVEVAEGSNINFGVQWASKDAGLMQFANGTQIPIGTLGAAISQAKPQKGSTVISENGATTINPDTNGDLSTLAQLLSGFSGTAVGVVKGDWMALVQAVKNDSSSNVLSTPSITTLDNQEAFFMVGQDVPVLTGSTVGSNNSNPFNTVERKKVGIMLKVTPQINEGNAVQMVIEQEVSKVEGQTSLDVVFGERKLKTTVLANDGELIVLGGLMDDQAGESVAKVPLLGDIPLIGNLFKSTADKKKT

SEQ ID NO: 4483 - protein, 615 aa, Escherichia coli
MFWRDMTLSIWRKKTTGLKTKKRLLPLMLAAALCSSPVWAEEATFTANFKDTDLKSFIETVGANLNKTIIMGPGVQGKVSIRTMTPLNERQYYQLFLNLLEAQGYAVVPMENDVLKVVKSSAAKVEPLPLVGEGSDNYAGDEMVTKVVPVRNVSVRELAPILRQMIDSAGSGNVVNYDPSNVIMLTGRASVVERLTEVIQRVDHAGNRTEEVIPLDNASASEIARVLESLTKNSGENQPATLKSQIVADERTNSVIVSGDPATRDKMRRLIRRLDSEMERSGNSQVFYLKYSKAEDLVDVLKQVSGTLTAAKEEAEGTVGSGREVVSIAASKHSNALIVTAPQDIMQSLQSVIEQLDIRRAQVHVEALIVEVAEGSNINFGVQWGSKDAGLMQFANGTQIPIGTLGAAISAAKPQKGSTVISENGATTINPDTNGDLSTLAQLLSGFSGTAVGVVKGDWMALVQAVKNDSSSNVLSTPSITTLDNQEAFFMVGQDVPVLTGSTVGSNNSNPFNTVERKKVGIMLKVTPQINEGNAVQMVIEQEVSKVEGQTSLDVVFGERKLKTTVLANDGELIVLGGLMDDQAGESVAKVPLLGDIPVIGNLFKSTADKKENVT

SEQ ID NO: 4484 - protein, 626 aa, Escherichia coli
MFWRDITLSVWRKKTTGLKTKKRLLPLVLAAALCSSPVWAEEATFTANFKDTDLKSFIETVGANLNKTIIMGPGVQGKVSIRTMTPLNERQYYQLFLNLLEAQGYAVVPMENDVLKVVKSSAAKVEPLPLVGEGSDNYAGDEMVTKVVPVRNVSVRELAPILRQMIDSAGSGNVVNYDPSNVIMLTGRASVVERLTEVIQRVDHAGNRTEEVIPLDNASASEIARVLESLTKNSGENQPATLKSQIVADERTNSVIVSGDPATRDKMRRLIRRLDSEMERSGNSQVFYLKYSKAEDLVDVLKQVSGTLTAAKEEAEGTVGSGREIVSIAASKHSNALIVTAPQDIMQSLQSVIEQLDIRRAQVHVEALIVEVAEGSNINFGVQWASKDAGLMQFANGTQIPIGTLGAAISQAKPQKGSTVISENGATTINPDTNGDLSTLAQLLSGFSGTAVGVVKGDWMALVQAVKNDSSSNVLSTPSITTLDNQEAFFMVGQDVPVLTGSTVGSNNSNPFNTVERKKVGIMLKVTPQINEGNAVQMVIEQEVSKVEGQTSLDVVFGERKLKTTVLANDGELIVLGGLMDDQAGESVAKVPLLGDIPLIGNLFKSTADKKEKRNLMVFIRPTHSA

SEQ ID NO: 4485 - protein, 336 aa, Escherichia coli
MFWRDITLSVWRKKTTGLKTKKRLLPLVLAAALCSSPVWAEEATFTANFKDTDLKSFIETVGANLNKTIIMGPGVQGKVSIRTMTPLNERQYYQLFLNLLEAQGYAVVPMENDVLKVVKSSAAKVEPLPLVGEGSDNYAGDEMVTKVVPVRNVSVRELAPILRQMIDSAGSGNVVNYDPSNVIMLTGRASVVERLTEVIQRVDHAGNRTEEVIPLDNASASEIARVLESLTKNSGENQPATLKSQIVADERTNSVIISGDPATRDKMRRLIRRLDSEMERSGNSQVFYLKYSKAEDLVDVLKQVSGTLTAAKEEAEGTVGSGREVVSIAASKHVMP

SEQ ID NO: 4486 - protein, 615 aa, Escherichia coli
MFWRDITLSVWRKKTTGLKTKKRLLPLVLAAALCSSPVWAEEATFTANFKDTDLKSFIETVGANLNKTIIMGPGVQGKVSIRTMTPLNERQYYQLFLNLLEAQGYAVVPMENDVLKVVKSSAAKVEPLPLVGEGSDNYAGDEMVTKVVPVRNVSVRELAPILRQMIDSAGSGNVVNYDPSNVIMLTGRASVVERLTEVIQRVDHAGNRTEEVIPLDNASASEIARVLESLTKNSGENQPATLKSQIVADERTNSVIVSGDPATRDKMRRLIRRLDSEMERSGNSQVFYLKYSKAEDLVDVLKQVSGTLTAAKEEAEGTVGSGREIVSIAASKHSNALIVTAPQDIMQSLQSVIEQLDIRRAQVHVEALIVEVAEGSNINFGVQWASKDAGLMQFANGTQIPIGTLGAAISQAKPQKGSTVISENGATTINPDTNGDLSTLAQLLSGFSGTAVGVVKGDWMALVQAVKNDSSSNVLSTPSITTLDNQEAFFMVGQDVPVLTGSTVGSNNSNPFNTVERKKVGIMLKVTPQINEGNAVQMVIEQEVSKVEGQTSLDVVFGERKLKTTVLANDGELIVLGGLMDDQAGESVAKVPLLGDIPLIGNLFKSTADKKENVT

SEQ ID NO: 4487 - protein, 613 aa, Escherichia coli
MFWRDITLSVWRKKTTGLKTKKRLLPLVLAAALCSSPVWAEEATFTANFKDTDLKSFIETVGANLNKTIIMGPGVQGKVSIRTMTPLNERQYYQLFLNLLEAQGYAVVPMENDVLKVVKSSAAKVEPLPLVGEGSDNYAGDEMVTKVVPVRNVSVRELAPILRQMIDSAGSGNVVNYDPSNVIMLTGRASVVERLTEVIQRVDHAGNRTEEVIPLDNASASEIAHVLESLTKNSGENQPATLKSQIVADERTNSVIVSGDPATRDKMRRLIRRLDSEMERSGNSQVFYLKYSKAEDLVDVLKQVSGTLTAAKEEAEGTVGSGREIVSIAASKHSNALIVTAPQDIMQSLQSVIEQLDIRRAQVHVEALIVEVAEGSNINFGVQWASKDAGLMQFANGTQIPIGTLGAAISQAKPQKGSTVISENGATTINPDTNGDLSTLAQLLSGFSGTAVGVVKGDWMALVQAVKNDSSSNVLSTPSITTLDNQEAFFMVGQDVPVLTGSTVGSNNSNPFNTVERKKVGIMLKVTPQINEGNAVQMVIEQEVSKVEGQTSLDVVFGERKLKTTVLANDGELIVLGGLMDDQAGESVAKVPLLGDIPLIGNLFKSTADKKKT

SEQ ID NO: 4488 - protein, 613 aa, Escherichia coli
MFWRDITLSVWRKKTTGLKTKKRLLPLVLAAALCSSPVWAEEATFTANFKDTDLKSFIETVGANLNKTIIMGPGVQGKVSIRTMTPLNERQYYQLFLNLLEAQGYAVVPMENDVLKVVKSSAAKVEPLPLVGEGSDNYAGDEMVTKVVPVRNVSVRELAPILRQMIDSAGSGNVVNYDPSNVIMLTGRASVVERLTEVIQRVDHAGNRTEEVIPLDNASASEIARVLESLTKNSGENQPATLKSQIVADERTNSVIVSGDPATRDKMRRLIRRLDSEMERSGNSQVFYLKYSKAEDLVDVLKQVSGTLTAAKEEAEGTVGSGREIVSIAASKHSNALIVTAPQDIMQSLQSVIEQLDIRRAQVHVEALIVEVAEGSNINFGVQWASKDAGLMQFANGTQIPIGTLGAAISQAKPQKGSTVISENGATTINPDTNGDLSTLAQLLSGFSGTAVGVVKGDWMALVQAVKNDSSSNVLSTPSITTLDNQEAFFMVGQDVPVLTGSTVGSNNSNPFNTVERKKVGIMLKVTPQINEGNAVQMVIEQEVSKVEGQTSLDVVFGERKLKTTVLANDGELIVLGGLMDDQAGESVAKVPLLGDIPLIGNLFKSTADKKKT

SEQ ID NO: 4489 - protein, 615 aa, Escherichia coli
MFWRDMTLSIWRKKTTGLKTKKRLLPLMLAAALCSSPVWAEEATFTANFKDTDLKSFIETVGANLNKTIIMGPGVQGKVSIRTMTPLNERQYYQLFLNLLEAQGYAVVPMENDVLKVVKSSAAKVEPLPLVGEGSDNYAGDEMVTKVVPVRNVSVRELAPILRQMIDSAGSGNVVNYDPSNVIMLTGRASVVERLTEVIQRVDHAGNRTEEVIPLDNASASEIARVLESLTKNSGENQPATLKSQIVADERTNSVIVSGDPATRDKMRRLIRRLDSEMERSGNSQVFYLKYSKAEDLVDVLKQVSGTLTAAKEEAEGTVGSGREVVSIAASKHSNALIVTAPQDIMQSLQSVIEQLDIRRAQVHVEALIVEVAEGSNINFGVQWGSKDAGLMQFANGTQIPIGTLGAAISAAKPQKGSTVISENGATTINPDTNGDLSTLAQLLSGFSGTAVGVVKGDWMALVQAVKNDSSSNVLSTPSITTLDNQEAFFMVGQDVPVLTGSTVGSNNSNPFNTVERKKVGIMLKVTPQINEGNAVQMVIEQEVSKVEGQTSLDVVFGERKLKTTVLANDGELIVLGGLMDDQAGESVAKVPLLGDIPLIGNLFKSTADKKKNVT

SEQ ID NO: 4490 - protein, 613 aa, Escherichia coli
MFWRDMTLSIWRKKTTGLKTKKRLLPLMLAAALCSSPVWAEEATFTANFKDTDLKSFIETVGANLNKTIIMGPGVQGKVSIRTMTPLNERQYYQLFLNLLEAQGYAVVPMENDVLKVVKSSAAKVEPLPLVGEGSDNYAGDEMVTKVVPVRNVSVRELAPILRQMIDSAGSGNVVNYDPSNVIMLTGRASVVERLTEVIQRVDHAGNRTEEVIPLDNASASEIARVLESLTKNSGENQPATLKSQIVADERTNSVIVSGDPATRDKMRRLIRRLDSEMERSGNSQVFYLKYSKAEDLVDVLKQVSGTLTAAKEEAEGTVGSGREVVSIAASKHSNALIVTAPQDIMQSLQSVIEQLDIRRAQVHVEALIVEVAEGSNINFGVQWGSKDAGLMQFANGTQIPIGTLGAAISAAKPQKGSTVISENGATTINPDTNGDLSTLAQLLSGFSGTAVGVVKGDWMALVQAVKNDSSSNVLSTPSITTLDNQEAFFMVGQDVPVLTGSTVGSNNSNPFNTVERKKVGIMLKVTPQINEGNAVQMVIEQEVSKVEGQTSLDVVFGERKLKTTVLANDGELIVLGGLMDDQAGESVAKVPLLGDIPLIGNLFKSTADKKKT

SEQ ID NO: 4491 - protein, 280 aa, Escherichia coli
MFWRDITLSVWRKKTTGLKTKKRLLPLVLAAALCSSPVWAEEATFTANFKDTDLKSFIETVGANLNKTIIMGPGVQGKVSIRTMTPLNERQYYQLFLNLLEAQGYAVVPMENDVLKVVKSSAAKVEPLPLVGEGSDNYAGDEMVTKVVPVRNVSVRELAPILRQMIDSAGSGNVVNYDPSNVIMLTGRASVVERLTEVIQRVDHAGNRTEEVIPLDNASASEIARVLESLTKNSGENQPATLKSQIVADERTNSVIVSGDPVIGTGYGAKTGADAVTTRK

SEQ ID NO: 4492 - protein, 615 aa, Escherichia coli
MFWRDITLSVWRKKTTGLKTKKRLLPLVLAAALCSSPVWAEEATFTANFKDTDLKSFIETVGANLNKTIIMGPGVQGKVSIRTMTPLNERQYYQLFLNLLEAQGYAVVPMENDVLKVVKSSAAKVEPLPLVGEGSDNYAGDEMVTKVVPVRNVSVRELAPILRQMIDSAGSGNVVNYDPSNVIMLTGRASVVERLTEVIQRVDHAGNRTEEVIPLDNASASEIARVLESLTKNSGENQPATLKSQIVADERTNSVIVSGDPATRDKMRRLIRRLDSEMERSGNSQVFYLKYSKAEDLVDVLKQVSGTLTAAKEEAEGTVGSGREVVSIAASKHSNALIVTAPQDIMQSLQSVIEQLDIRRAQVHVEALIVEVAEGSNINFGVQWASKDAGLMQFANGTQIPIGTLGAAISQAKPQKGSTVISENGATTINPDTNGDLSTLAQLLSGFSGTAVGVVKGDWMALVQAVKNDSSSNVLSTPSITTLDNQEAFFMVGQDVPVLTGSTVGSNNSNPFNTVERKKVGIMLKVTPQINEGNAVQMVIEQEVSKVEGQTSLDVVFGERKLKTTVLANDGELIVLGGLMDDQAGESVAKVPLLGDIPLIGNLFKSTADKKKNVT

SEQ ID NO: 4493 - protein, 615 aa, Escherichia coli
MFWRDITLSVWRKKTTGLKTKKRLLPLVLAAALCSSPVWAEEATFTANFKDTDLKSFIETVGANLNKTIIMGPGVQGKVSIRTMTPLNERQYYQLFLNLLEAQGYAVVPMENDVLKVVKSSAAKVEPLPLVGEGSDNYAGDEMVTKVVPVRNVSVRELAPILRQMIDSAGSGNVVNYDPSNVIMLTGRASVVERLTEVIQRVDHAGNRTEEVIPLDNASASEIARVLESLTKNSGENQPATLKSQIVADERTNSVIVSGDPATRDKMRRLIRRLDSEMERSGNSQVFYLKYSKAEDLVDVLKQVSGTLTAAKEEAEGTVGSGREIVSIAASKHSNALIVTAPQDIMQSLQSVIEQLDIRRAQVHVEALIVEVAEGSNINFGVQWASKDAGLMQFANGTQIPIGTLGAAISQAKPQKGSTVISENGATTINPDTNGDLSTLAQLLSGFSGTAVGVVKGDWMALVQAVKNDSSSNVLSTPSITTLDNQEAFFMVGQDVPVLTGSTVGSNNSNPFNTVERKKVGIMLKVTPQINEGNAVQMVIEQEVSKVEGQTSLDVVFGERKLKTTVLANDGELIVLGGLMDDQAGESVAKVPLLGDIPLIGNLFKSTADKKKNVT

SEQ ID NO: 4494 - protein, 686 aa, Escherichia coli
MFWRDITLSVWRKKTTGLKTKKRLLPLVLAAALCSSPVWAEEATFTANFKDTDLKSFIETVGANLNKTIIMGPGVQGKVSIRTMTPLNERQYYQLFLNLLEAQGDAVVPMENDVLKVVKSSAAKVEPLPLVGEGSDNYAGDEMVTKVVPVRNVSVRELAPILRQMIDSAGSGNVVNYDPSNVIMLTGRASVVERLTEVIQRVDHAGNRTEEVIPLVNASASEIARVLESLTKNSGENQPATLKSQIVADERTNSVIVSGDPATRDKMRRLIRRLDSEMERSGNSQVFYLKYSKAEDLVDVLKQVSGTLTAAKEEAEGTVGSGREIVSIAASKHSNALIVTAPQDIMQSLQSVIEQLDIRRAQVHVEALIVEVAEGSNINFGVQWASKDAGLMQFANGTQIPIGTLGAAISQAKPQKGSTGISENGATTINPDTNGDLSTLAQLLSGFSGTAVGVVKGDWMALVQAVKNDSSSNVLSTPSITTLDNQEAFFMVGQDVPVLTGSTVGSNNSNPFNTVERKKVGIMLKVTPQINEGNAVQMVIEQEVSKVEGQTSLDVVFGERKLKTTVLANDGELIVLGGLMDDQAGESVAKVPLLGDIPLIGNLFKSTADKKEKRNLMVFIRPTILRDGMAADGVSQRKYNYMRAEQIYRDEQGLSLMPHTAQPVLPAQNQALPPEVRAFLNAGRTR

SEQ ID NO: 4495 - protein, 175 aa, Escherichia coli
MFWRDITLSVWRKKTTGLKTKKRLLPLVLAAALCSSPVWAEEATFTANFKDTDLKSFIETVGANLNKTIIMGPGVQGKVSIRTMTPLNERQYYQLFLNLLEAQGYAVVPMENDVLKVVKSSAAKVEPLPLVGEGSDNYAGDEMVTKVVPVRNVSVRELAPILRQMIDSAGSGKRC

SEQ ID NO: 4496 - protein, 328 aa, Thiothrix nivea; identical to SEQ ID NO: 4457

SEQ ID NO: 4497 - protein, 335 aa, Microcystis aeruginosa; identical to SEQ ID NO: 4432

SEQ ID NO: 4498 - protein, 333 aa, Microcystis aeruginosa; identical to SEQ ID NO: 4436

SEQ ID NO: 4499 - protein, 333 aa, Microcystis aeruginosa; identical to SEQ ID NO: 4437

SEQ ID NO: 4500 - protein, 335 aa, Microcystis aeruginosa; identical to SEQ ID NO: 4438

SEQ ID NO: 4501 - protein, 333 aa, Microcystis aeruginosa; identical to SEQ ID NO: 4439

SEQ ID NO: 4502 - protein, 335 aa, Microcystis aeruginosa; identical to SEQ ID NO: 4440

SEQ ID NO: 4503 - protein, 335 aa, Microcystis aeruginosa; identical to SEQ ID NO: 4441

SEQ ID NO: 4504 - protein, 333 aa, Microcystis aeruginosa; identical to SEQ ID NO: 4442

SEQ ID NO: 4505 - protein, 335 aa, Microcystis aeruginosa; identical to SEQ ID NO: 4443

SEQ ID NO: 4506 - protein, 335 aa, Microcystis aeruginosa; identical to SEQ ID NO: 4444

SEQ ID NO: 4507 - protein, 548 aa, Photobacterium angustum
MRRILLGITIASLAGCSTNMGHQNPVEVKKALNEAANEASSRPLMELPSAVNADLMPSLDSNINPANSSLEKRFRVNAKNVEANAFFTSLVKGTPFNIVIHPGVTGRITMKLNDVTLDEVLNVVSDIYGYSTTRKGNIIQVFPATLRTEVIPVDYLQLQRKGKSLTSITSGSISDGDNNSSSGDDDNSSSSSSSGGNTTTGGTTIETTSDSDFWTQLEKVVSGMIGSGDGRNVMVSPQAGLISVRAFPNELREVKEFLGMSQRRLKRQVVLEAKIMEVTLNDSYQQGIDWNNLTSSIGGTGIIVNEMKDAANAAASILPGGNAISELLGGQTNIKITDGNFSAVMSFLSTQGDLNVLSSPRVTAANNQKAVIKVGGDEYFVTDVSSSNVSGDNNNVSPDVSLTPFFSGISLDVTPQIDDQGGVLLHVHPAVVDVQNEQKTIEVGTAKPMVLPLAKSTIRESDSIIHARTGDVVVIGGLMKSSINDQVSKVPFLGDIPGIGNLFRHINKVKKKTELVILLKPTVVTDNTWKQEIERSRSLINEWFPEEG

SEQ ID NO: 4508 - protein, 338 aa, Coleofasciculus chthonoplastes; identical to SEQ ID NO: 4448

SEQ ID NO: 4509 - protein, 328 aa, Natrialba asiatica; identical to SEQ ID NO: 4463

SEQ ID NO: 4510 - protein, 343 aa, Cylindrospermopsis raciborskii; identical to SEQ ID NO: 4450

SEQ ID NO: 4511 - protein, 326 aa, Cylindrospermopsis raciborskii; identical to SEQ ID NO: 4449

SEQ ID NO: 4512 - protein, 338 aa, delta proteobacterium NaphS2; identical to SEQ ID NO: 4453

SEQ ID NO: 4513 - protein, 335 aa, Leptolyngbya sp. PCC 7375; identical to SEQ ID NO: 4458

SEQ ID NO: 4514 - protein, 334 aa, Gloeocapsa sp. PCC 73106; identical to SEQ ID NO: 4459

SEQ ID NO: 4515 - protein, 345 aa, Oscillochloris trichoides; identical to SEQ ID NO: 4454

SEQ ID NO: 4516 - protein, 328 aa, Haloferax alexandrinus; identical to SEQ ID NO: 4464

SEQ ID NO: 4517 - protein, 541 aa, Photobacterium sp. SKA34
MRRILLGITIASLAGCSTNMGHQNPVEVKKALNEAANEASSRPLMELPSAVNADLMPSLDSNINPANSSLEKRFRVNAKNVEANAFFTSLVKGTPFNIVIHPGVTGRITMKLNDVTLDEVLNVVSDIYGYSTTRKGNIIQVFPATLRTEVIPVDYLQLQRKGKSLTSITSGSISDGDNNSSSGDDDNSSSSSSSGGNTTTGGTTIETTSDSDFWTQLEKVVSGMIGSGDGRNVMVSPQAGLISVRAFPNELREVKEFLGMSQRRLKRQVVLEAKIMEVTLDDSYQQGINWSYLTKSGNGITTGTASIVEALPGGNAISELLGGQTNITLSDGNFKAVMSFLSTQGDLNVLSSPRVTAANNQKAVIKVGGDEYFVTDVSSSNVSGDNNNVSPDVSLTPFFSGISLDVTPQIDDQGGVLLHVHPAVIDVQNEQKTIEVGTEKPMVLPLAKSTIRESDSIIHARTGDVVVIGGLMKSSINDQVSKVPLLGDIPWVGNLFRHINKVKKKTELVILLKPTVVTDNTWKQEIERSRSLINEWFPEEG

SEQ ID NO: 4518 - protein, 313 aa, Natrialba hulunbeirensis; identical to SEQ ID NO: 4462

SEQ ID NO: 4519 - protein, 332 aa, Thiorhodospira sibirica; identical to SEQ ID NO: 4455

SEQ ID NO: 4520 - protein, 328 aa, Haloferax sulfurifontis; identical to SEQ ID NO: 4465

SEQ ID NO: 4521 - protein, 319 aa, Kamptonema; identical to SEQ ID NO: 4434

SEQ ID NO: 4522 - protein, 316 aa, Halococcus thailandensis; identical to SEQ ID NO: 4466

SEQ ID NO: 4523 - protein, 336 aa, Ktedonobacter racemifer; identical to SEQ ID NO: 4452

SEQ ID NO: 4524 - protein, 323 aa, Aphanizomenonaceae; identical to SEQ ID NO: 4451

SEQ ID NO: 4525 - protein, 337 aa, Fischerella thermalis; identical to SEQ ID NO: 4456

SEQ ID NO: 4526 - protein, 345 aa, Oscillatoriales cyanobacterium JSC-12
MSFLKTVDAKHFHTEIPAKPMGKYAHFITVRVTESYPLFQTDGELNRARVHAGMKKDNPESRKIISRLAMFKRKQSSPERLTGRELLRSYQIGDWDKCDYNVDFSKTTPDCILYGFAIGDAGSEKSKVVVDTAYSITPFDDSHLNFTLNAPFENGTMSRQGEVTSRINSQDHILPQVFFPSIITLKDPTEAGFLYVLNNILRTRHYGAQTTRTGRVRNELVGVIFADGEIVSNLRWTQKIYDLMTEKNQIQAPDPLNEDQVLSAAQEAMVQLMSEECIPHTDLMGDDLEALLAEVKAITSNETQLKKMLTQANAESVAYAQKYIFKPTTDKNKKGSKKTTAAASE

SEQ ID NO: 4527 - protein, 342 aa, Lyngbya sp. PCC 8106; identical to SEQ ID NO: 4447

SEQ ID NO: 4528 - protein, 344 aa, Nostocaceae; identical to SEQ ID NO: 4427

SEQ ID NO: 4529 - protein, 329 aa, Synechocystis; identical to SEQ ID NO: 4421

SEQ ID NO: 4530 - protein, 310 aa, Picrophilus torridus; identical to SEQ ID NO: 4372

SEQ ID NO: 4531 - protein, 351 aa, Sulfolobus acidocaldarius; identical to SEQ ID NO: 4373

SEQ ID NO: 4532 - protein, 338 aa, Nostocaceae; identical to SEQ ID NO: 4374

SEQ ID NO: 4533 - protein, 329 aa, Natronomonas pharaonis; identical to SEQ ID NO: 4431

SEQ ID NO: 4534 - protein, 335 aa, Methanospirillum hungatei; identical to SEQ ID NO: 4375

SEQ ID NO: 4535 - protein, 329 aa, Methanothrix thermoacetophila; identical to SEQ ID NO: 4376

SEQ ID NO: 4536 - protein, 374 aa, Thermofilum pendens; identical to SEQ ID NO: 4377

SEQ ID NO: 4537 - protein, 330 aa, Herpetosiphon aurantiacus; identical to SEQ ID NO: 4378

SEQ ID NO: 4538 - protein, 335 aa, Microcystis aeruginosa; identical to SEQ ID NO: 4429

SEQ ID NO: 4539 - protein, 329 aa, Synechococcus sp. PCC 7002; identical to SEQ ID NO: 4379

SEQ ID NO: 4540 - protein, 342 aa, Nostoc punctiforme; identical to SEQ ID NO: 4380

SEQ ID NO: 4541 - protein, 356 aa, Rippkaea orientalis; identical to SEQ ID NO: 4381

SEQ ID NO: 4542 - protein, 338 aa, Gloeothece citriformis; identical to SEQ ID NO: 4382

SEQ ID NO: 4543 - protein, 328 aa, Methanosphaerula palustris; identical to SEQ ID NO: 4384

SEQ ID NO: 4544 - protein, 334 aa, Cyanothece sp. PCC 7425; identical to SEQ ID NO: 4385

SEQ ID NO: 4545 - protein, 329 aa, Halorubrum lacusprofundi; identical to SEQ ID NO: 4386

SEQ ID NO: 4546 - protein, 73 aa, Lachnospiraceae; identical to SEQ ID NO: 4387

SEQ ID NO: 4547 - protein, 348 aa, Methanocaldococcus vulcanius; identical to SEQ ID NO: 4391

SEQ ID NO: 4548 - protein, 344 aa, Sulfolobus islandicus; identical to SEQ ID NO: 4392

SEQ ID NO: 4549 - protein, 332 aa, Nitrosococcus halophilus; identical to SEQ ID NO: 4393

SEQ ID NO: 4550 - protein, 315 aa, Acetohalobium arabaticum; identical to SEQ ID NO: 4394

SEQ ID NO: 4551 - protein, 330 aa, Gloeothece verrucosa; identical to SEQ ID NO: 4395

SEQ ID NO: 4552 - protein, 350 aa, Methanotorris igneus; identical to SEQ ID NO: 4397

SEQ ID NO: 4553 - protein, 354 aa, Methanothermococcus okinawensis; identical to SEQ ID NO: 4398

SEQ ID NO: 4554 - protein, 327 aa, Caldicellulosiruptor lactoaceticus; identical to SEQ ID NO: 4400

SEQ ID NO: 4555 - protein, 316 aa, halophilic archaeon DL31; identical to SEQ ID NO: 4401

SEQ ID NO: 4556 - protein, 381 aa, Chloracidobacterium thermophilum
MATPAETFRQQFGVGGRCFSAPGRVNLIGEHVDYNAGIVLPMAIGLRLWVWASPRSDRQLHVIAHDLGETDVLDLDAPGRRTGTWRDYLAGTAFHLEAAGFRLTGANLLITSDIPTGAGLSSSAALEVAVGFALLTLAGHTVDRLALARAGQAAEHDFVGTRCGLMDQFVVAHGRAGHAVWLDCRSLAFDFIPLDTNQCAVVVVDSGVKHQLAASEYNTRRQECEAALSVLQRLFPDRTTLRDVTEAELAQAAGMLSDSLLQRARHVVTEIGRVTAFAQALRASDWTQAGALLTASHRSLSEDYAVSCPELDALVAAARQIPGCYGARLTGGGFGGCTVNLVAPEALDAFLREVPRAYAQHTGGTARMWVVQPAAGVGEMD

SEQ ID NO: 4557 - protein, 313 aa, Caldilinea aerophila; identical to SEQ ID NO: 4430

SEQ ID NO: 4558 - protein, 340 aa, Sulfolobus islandicus; identical to SEQ ID NO: 4396

SEQ ID NO: 4559 - protein, 329 aa, Haloquadratum walsbyi; identical to SEQ ID NO: 4435

SEQ ID NO: 4560 - protein, 324 aa, Spirochaeta thermophila; identical to SEQ ID NO: 4399

SEQ ID NO: 4561 - protein, 313 aa, Thermacetogenium phaeum; identical to SEQ ID NO: 4402

SEQ ID NO: 4562 - protein, 347 aa, Nostocales; identical to SEQ ID NO: 4403

SEQ ID NO: 4563 - protein, 345 aa, Nostoc sp. PCC 7107; identical to SEQ ID NO: 4406

SEQ ID NO: 4564 - protein, 347 aa, Rivularia sp. PCC 7116; identical to SEQ ID NO: 4408

SEQ ID NO: 4565 - protein, 334 aa, Calothrix sp. PCC 7507; identical to SEQ ID NO: 4404

SEQ ID NO: 4566 - protein, 342 aa, Calothrix sp. PCC 7507; identical to SEQ ID NO: 4405

SEQ ID NO: 4567 - protein, 344 aa, Nostoc sp. PCC 7524; identical to SEQ ID NO: 4407

SEQ ID NO: 4568 - protein, 344 aa, Pleurocapsa minor; identical to SEQ ID NO: 4409

SEQ ID NO: 4569 - protein, 328 aa, Oscillatoria acuminata; identical to SEQ ID NO: 4410

SEQ ID NO: 4570 - protein, 341 aa, Oscillatoria acuminata; identical to SEQ ID NO: 4411

SEQ ID NO: 4571 - protein, 338 aa, Oscillatoria nigro-viridis; identical to SEQ ID NO: 4413

SEQ ID NO: 4572 - protein, 339 aa, Gloeocapsa sp. PCC 7428; identical to SEQ ID NO: 4415

SEQ ID NO: 4573 - protein, 341 aa, Calothrix parietina; identical to SEQ ID NO: 4412

SEQ ID NO: 4574 - protein, 332 aa, Crinalium epipsammum; identical to SEQ ID NO: 4414

SEQ ID NO: 4575 - protein, 333 aa, Stanieria cyanosphaera; identical to SEQ ID NO: 4416

SEQ ID NO: 4576 - protein, 336 aa, Anabaena cylindrica; identical to SEQ ID NO: 4418

SEQ ID NO: 4577 - protein, 337 aa, Halothece sp. PCC 7418; identical to SEQ ID NO: 4417

SEQ ID NO: 4578 - protein, 340 aa, Sulfolobus islandicus; identical to SEQ ID NO: 4422

SEQ ID NO: 4579 - protein, 315 aa, Ammonifex degensii; identical to SEQ ID NO: 4390

SEQ ID NO: 4580 - protein, 356 aa, Rippkaea orientalis; identical to SEQ ID NO: 4389

SEQ ID NO: 4581 - protein, 131 aa, Methylorubrum extorquens; identical to SEQ ID NO: 4388

SEQ ID NO: 4582 - protein, 84 aa, Methylorubrum extorquens; identical to SEQ ID NO: 4383

SEQ ID NO: 4583 - protein, 335 aa, Microcystis aeruginosa; identical to SEQ ID NO: 4467

SEQ ID NO: 4584 - protein, 337 aa, Fischerella muscicola
MNFLKSVDAKFFHNEIPAKPMGKYAHFITIRITESYPLFQTDGELNKAKVRAGIEHKEPISRLAMFKRKQSTPERLTGRELLRNYKIGDWEKCDYNVDFSKTTPDCILYGFAIGDAGSEKSKVVVDTAYSITPFEDSHLNFTLNAPFENGTMSRNGEVTSRINSQDHILPQTFFPSIVTLKDPTEAGFLYVFNNIIRTRHYGAQTTRTGRVRNELIGVIFADGEIISNLRWTQKIYDLLSYVGKMQPPDPLNEDDVRDAANKAITELMSQEFISHTDYIGDSFLPLLNEVKSITSDENKLKELLTQANTESSAYAQKHIFKSSEKSKKGKKASAAAE

SEQ ID NO: 4585 - protein, 337 aa, Fischerella muscicola
MNFLKTVDAKFFHNEIPAKPMGKYAHFITVRVTESYPLFQTDGELNKAKVRAGIQYPESISRLAMFKRKQSTPERLTGRELLRNYKIGDWEKCDYNVDFSKTTPDCILYGFAIGDAGSEKSKVVVDTAYSITPFEDSHLNFTLNAPFENGTMSRNGEVTSRINSQDHILPQVFFPSIVTLKDPTEAGFLYVFNNILRTRHYGAQTTRTGRVRNELIGIIFADGEITSNLRWTQKIYDLLSYTGKINPPDPLNEDDVRDAAIKAIAELMTQEFISHTDYIGDRFLPLLNEVKAITSDENKLKELLTQANAESSAYAQKHILKSSEKGKKAKKASAAAE

SEQ ID NO: 4586 - protein, 350 aa, Anabaena sp. PCC 7108
MFEQYKKHFQESIPRIPGAKYAHFIVLRETDSYAVFKTDGELNVARVRAGLNDSQAISRLVLFKRKQTTPERLTGRELLRRYEIYDQIKLQHKKDCAYNENPCGVCPDCVIYGYAVGKGGADNSGSEKSKVFIDSAYAVPKYEESHGTFTLNAPYEDGTMTQGTDTTNRFSEQDHVLPEVPFPSVVTLRDPTPNSFLYLLNNLQRTKRYGAQTTRTGQVRNTVVAIIFADGEIFSNLRLTQKIYDIIGDVLPPYETTFLKSATEQAVNELIQKDGVFYELISKESLVSLQDEAQSILGNEDNFKQWMNSLTQDTLNYAKAAGVLKEEKAENSTNSRSRRNKNKTDEGEET

SEQ ID NO: 4587 - protein, 336 aa, Spirulina subsalsa
MALLKTVDAKFFHGEIPYKPMGKYVHFLTVRVTESYPLFQTDSELNKARVCAGINKRQTISRLSMFKRKQSTPERLVGRELLRKYEFMTAEECEYNVSFAMNNPDCIIYGFAIGDSGSEKSKVVVDTAFSITPFDESHETFTLNAPYENGTMASKGENGTKPGEVTSRINQQDHIRPQVFFPSIVTLKDPTEASFLYVFNNIMRTRHYGAQTTRTGRVRNELIGVVFADGEIVSNLRWTQAIYDRLPDEVLESLDPLDETLVIEQATAAIQTLMENEFIVHTDFIGESFQGLLAEVKTLTGTEQGILSILQQADREAKAYAERHIAKKKEKAKAKA

SEQ ID NO: 4588 - protein, 337 aa, Fischerella sp. PCC 9339
MNFLKSVDTKFFHNEIPAKPMGKYAHFITIRITESYPLFQTDGELNKAKVRAGIEHKEPISRLAMFKRKQSTPERLTGRELLRNYKIGDWEKCDYNVDFSKTTPDCILYGFAIGDAGSEKSKVVVDTAYSITPFEDSHLNFTLNAPFENGTMSRNGEVTSRINSQDHILPQTFFPSIVTLKDPTEAGFLYVFNNIIRTRHYGAQTTRTGRVRNELIGVIFADGEIISNLRWTQKIYDLLSYAGKMQPPDPLNEDDVRDAANKAITELMTQEFISHTDYIGDRFLPLLNEVKSITSDEKKLKELLTQANTESSAYAQKHIFKNSEKSKKGKKASAVAE

SEQ ID NO: 4589 - protein, 362 aa, Cyanobacterium PCC 7702
MKTSRDKFQTNFDQNKQLIKGDFTMSLSFLTTVDAKLFLTEIPYKPMGKYAHFLTIRVTESYPLFQTDGELNKARVRAGIKDSTTISRISMFKRKQSTPERLVGRELLRNYGLMTAQECEYNVNFAMNNPDCIIYGFAIGDSGSEKSKVVVDTAFSITAFDESHETFTLNAPYENGTMTSKGENGSKGETSNLINQQDHIKPQVFFPSIITLKDPTEASFLYVFNNILRTRHYGAQTTRTGRIRNELIGVVFADGEITSNLRWTQAIYDYMKSNKTLNPPDPLNEDDVTTAAKSTIQTLMADEFIVHTDFIGDAFIPLLDEVKTLTSSEKKMKAILEKADAEAKKYANKYISKKKTAAKAES

SEQ ID NO: 4590 - protein, 316 aa, Synechococcus sp. PCC 7336
MGKYAHFLTVRITESYPLFQTDGELNKARVRAGVEDKNTISRLSMFKRKQSTPERLVGRELLRTYGFVKPEECEYNVAFGMDNPDCIIYGFAIGDSGSEKSKVVVDTAFSITAFDESHETFTLNAPFESGTMASKGEKGSKPGEVTSRINQQDHIRPQVFFPSIVTLKDPTEASFLYVFNNILRTRHYGAQTTRTGRVRNELIGAVFADGEIVSNLRWTQAIYDRMQADDTLKAPDPLDEDDVAQAAKTAIQSLMAEEFIVHTDFIGEDFQALLAEVKSLTASEEGIQAILKQADDEAKAYATQHIGKKKAASARS

SEQ ID NO: 4591 - protein, 338 aa, Fortiea contorta
MAILKTVESKLFQAEIPYKPMGKYVHFLTIRITESYPLFQTDGELNKARVRAGVKDKTTISRLSMFKRKQSTPERLVGRELLRNYGLMTAEECEYNVNFAMDNPDCIIYGFAIGDSGSEKSKVVVDTAFSITAFDESHETFTLNAPFENGTMASKGENNSKPGEVTSRINQQDHIRPQVFFPSIVTLKDPTEASFLYVFNNILRTRHYGAQTTRTGRVRNELVGVVFADGEITSNLRWTQAIHDQMKANNTLNPPEPLDEHDVITAAKNAIAALMADEFIVHTDFIGDAFISLLNEVKTLTGSEKGIKEILQKADAEAKAYAGKHITKKKTAAKAGKE

SEQ ID NO: 4592 - protein, 334 aa, Geitlerinema sp. PCC 7105
MSVLDSLKSHFTSEFPRLASGQYIHIIALRHSQSFPIFQTDGVLNTARTQAGLETKDPVGRLVMFKRKQTTPERLAGRELLRSMNLTSAEDEKADNYCAYNGEKSCKKCPDCILYGFAIGDSGAERSKVYSDSAFSLTPYETSHHSMTFNAPSEGGTMSEGGQMRHSINEQDHVIPEVTFPAVETLRDTTYEGFLYVLGNFLRTRRYGAQESRTGTMKNHIVSIAFCDGEIFSNLHFTQALYDAMKPDLNAPIDELKARATTVARELLDREPVRQNPVLFGEEVEALLEEVGALYRDETRLTETMGTLYQQTLTYAQKYGAFANPKKKSGKSKS

SEQ ID NO: 4593 - protein, 300 aa, Geitlerinema sp. PCC 7105
MKFLKTLDFKLFHSEIPYKPMGKYAHFLTLRVTESYPLFQTDGELNKARVRAGIENRQTISRLSMFKRKQSTPERLVGRELLRKYELVKPEECEYNVKFGMDNPDCIIYGFAIGDSGSEKSKVVVDTAFSITPFDESHETFTLNAPYESGTMASKGEAGSKPGEVTSRINQQDHIRPQVFFPSIVTLRDPTEASFLYVFNNIMRTRHYGAQTTRTGRVRNELLGVVFADGEIVSNLRWTQAIFDRLPSEVIESIDPLDEDIVLEKATEAIQELMNEEFIVHTDFIGDDGSSQNKVIRKTY

SEQ ID NO: 4594 - protein, 337 aa, Geitlerinema sp. PCC 7105
MSIEKLQSFLAPHYENFPKGRTIGAVVLRTTQSETIFRTEGTGEPMCRESVRAGVQNLESILRLVMTKRKQIAPERRRGREFLRSHELLYPAPKSHSPCSLNTNAPCEMCVDCFLYGFAAGGEGAQKSRVWTEDAFSVLPSSELIGDRTINAVFETGTMRDEEGKASTALNTSEYIKPGVHFLDIVTLKDVTADELRYALGNLLLTTRYGAVSSRVGRMENQILGVFGGITELPSSLELVQGIYDRLVAENVPLEHPFDTTTLIDATQPILNSWTNKRGISVKLSAEELEQLIDDIDRHWSMEERETFLKRLDASYQPYRKIKNASSQKGRKNQSEE

SEQ ID NO: 4595 - protein, 355 aa, Prochlorothrix hollandica
MSFDKLQPFLAPSYENFPKGRTIGTVILRTTQSETIFRTEGSGEPLCSEYVAAGVSDSQIIPRLVMTKRKQIAPERRKGREFLRAFDLLRTDTKTNSLCSLNTNAPCEMCIDCFLYGFAAGGGGAQKSRVWTEDAFSVLSATELVGDRTINAIYENGTMRLKKDESNESKASTALNTSEYIKPGVHFLDVVTFKDVTADELRYGLGNILLTTRYGAVSSRVGRMDNQILGIFGGIAELPSSLELVQGVYDQLVADLQNKPNGPSDRPEHPFSTATLTEATQTVLASWIHKRGITVQLTPDELTALIADLDQHLEPDHQEAFLRRLDQSYESLRHVNPDQGKKKSKNQAKAAEQGA

SEQ ID NO: 4596 - protein, 347 aa, Oscillatoria sp. PCC 10802
MSVLESLKSEFHTAFPRLASGKYVHFIMVRHSQSFPVFQTDGVLNTVPTQAGVRDRKRINRLVMFKRKQTTPERLAGRELLRSLGLTSADKEDKEKGCEYNGEGSCKKCPDCIIYGFAIGDSGSERSKVYSDSAFSISAYDSSHRSFTFNAPFEGGTMSEAGKMRTSINEQDHVLPEVTFPAVETLRDPTCEGFLYVTGNLLRARRYGAQETRTGTMETHILGIVFCDGEIFSNLKFTQAVYDAMEGDMTKPLSEIRVLASQVAESLLSEEPVRKSQAIFGLQLAELLAEVRAIYQDEARLRETIGALYEQTQKYAGDFGANAGGDKKAKGNARGGKKATGNPKSNS

SEQ ID NO: 4597 - protein, 335 aa, Scytonema hofmannii
MNFLKTVDTKHFHTDIPYKPMGKYVHFLTIRVTESYPLFQTDGELNKSRVRAGMDDKTTISRLTMFKRKQSTPERLVGRELLRNYGRMTAEECEYNVKFAMDNPDCIIYGFAIGDSGSEKSKVVVDTAFSITDFAESHETFTLNAPFENGTMASKGENGSKPGEVTSRINQQDHIKPQIFFPSIVTLKDPTEASFLYVFNNILRTRHYGAQTTRTGRVRNELIGIIFADGEIVSNLRWTQAIYDYMKKNVTLASTEPLNEDDVTEAAAHTIASLMQDEFLVHEDFIGETFKSLLNEVKAITTNEESLKKMLKKADDEAKAYAHKHIKGKDKVPAK

SEQ ID NO: 4598 - protein, 350 aa, Scytonema hofmannii
MHADEFLSLVLIYITRSTIVSVLTTLKSEFQSAFPRLASGKYIHFILLRHSQSFPVFQTDGILNTARTQGGLGNTDEGKKQISRLVMFKRKQTTPERLAGRELLRGLSLTSADDTNKDKHCEYNGEKSCKKCPDCIIYGFAIGDSGSERSKVYSDSAFSLSAYEESHRSFTFNAPFEGGTMSEAGEMRSSINELDHVIPEVTFPTVETLRDSTYEGFIYVLGNLLRTKRYGAQESRTGTMRNYIAGIVFGDGEIFSNLHFTQALYDALKGDIDAPISDVLQQVETVANNLLNDEPVRKTKLIFGSQLDDLVGEINALYQDEARLLETMTALYGQTKAYAESFGALKKKGK

SEQ ID NO: 4599 - protein, 344 aa, Euryarchaeote SCGC AAA261-G15
MEYLEKIFEKGLLARSIEEIDLGKNKGIFVKIGIVSETTSFLIIRNNDATETTSEEFFGQERVVIPGSKWRGAERTYALSLLRKYNGLVPQEYERNAIEKKELLIRNPLSALYGDSSIGTGNEATSIASRIYYDWSYSFEPLGLITERFTHNTLSESGTILLDKDKGEPARNALYNTQYIKPGVKFVRFVTLENVSKELLDLAILTIMGTRRYGARTAIVGENIYNNIIAIGFSRGDKPLTSYTLLSDAWSTNNYDPEKQIAQNMEGIYGDYLLSGNDLKSYLSEVIKLKDDKDRLTQYANAIVKKMQIDWKDRFEKKNNKKRKGKGEEENEDTEDQADSDLSN

SEQ ID NO: 4600 - protein, 353 aa, Desulfurispora thermophila
MSKTGYQQLQLYGWVKDFLPAEIPLYPLHRYVHIFILRETKSHAIFTTEGGVLDVERVQAGLNTTGSIDRALMFKRKQIAPERRTGRALLRDAGLLEQQPGKGRGRGAKKAAVACRMMDAMCGRCPDCVLYGFAAVSGTGAQKARVLTDSAFSVRAYQDIQKNIRLNAINDSIAGGIARDGSAFSEKDHLLPQVILPCVETLQDVTPAELLYVLQNILFTTRYGAEANREGFVRNHIVAIATARSEVLSNLELTQLYYDLLSQDGQAGLASGYLEMADFLRHLPAVVKHIQDSAWGGMQLWSGAELATALAELRQIFNSEDAVGAFWQELAGQAAAYADKRGGGNGEAAGEQE

SEQ ID NO: 4601 - protein, 335 aa, filamentous cyanobacterium ESFC-1
MTTLETIKANFATSFPRLASGKYIHFLMLRHSQSFPVFQTDGILNTARTKSGLSAEEKSQEMISRLVMFKRKQTTPERLIGREILRSLNLTSADKEADNYCEYNGENSCKQCPDCIIYGFAIGDSGSERSKVYSDSAFSLSAYEQSHRSFTFNAPFEGGTMSEAGVMRSAINEQDHILPEVTFPTVETLRDPTYEGFLYVLGNLLRTRRYGAQESRTGTMKNHLLGIVLCDGEIFSNLHFTQALYDALNGDLGQPIQDLKATATQVVQNLLEEEPVRKTQAIFGSELDDLLAEVSAIYQDDTQLTNTLSNLYQQTTAYAQEYGALSGGKKGKRKK

SEQ ID NO: 4602 - protein, 334 aa, filamentous cyanobacterium ESFC-1
MALLNSIDSKFFHSEIPYKPMGKYVHFLTVRVTESYPLFQTDGELNKARVRAGINNRQTLSRLTMFKRKQSTPERLAGRELLRKYEFVKPEECEYNVAFGMDNPDCIIYGFAIGDSGSEKSKVVVDTAFSITSFDESHETFTLNAPFESGTMASKGEGTTKPGEVTSRINQQDHIRPQVFFPSIVTLKDPTEASFLYVLNNILRTRHYGAQTTRTGRVRNELLGVVFADGEIVSNLRWTQAIYDRLPEDILQSIDPLDENLVMEIATAAIQDLMQDEFIVHTDFIGESFRPILQDIKALTASEEGIISILNQANEEAKKYAEAHIGKKKKAKAK

SEQ ID NO: 4603 - protein, 333 aa, Neomegalonema perideroedes
MTLDAIKPYLGGLDSLLSTASDDKGKSYAQPALKNLGSAVLVVLREVISPASFRNAEAEITDIDSKGRRHARAVANKFKFGERARGLQVLRYFEAGGASAQNKTAFVGKEKPSARFDLNTLVFGDSANHGSKVLPVKAAAQYSDAVSIQPYGDCVDSTFHNRASEDGSLFDAQSKANSTNIFERHFLRPGTLLLQTIAFNGKTAPPEAVEHLLLSLGLAGAYGGATSIYGVNVRNHPLGIFAGRFERDLSSPYVAIDRLYEQGVDPDDAAAVSRALSEFYRAAWPVEIPGEAILATQKDLIARLEADDPALRGAYKATAGKVGAYFDAWFEGV

SEQ ID NO: 4604 - protein, 335 aa, Thermobrachium celere; identical to SEQ ID NO: 4445

SEQ ID NO: 4605 - protein, 341 aa, Calothrix sp. PCC 7103
MQFLKTVDAKFFHAEIPAKPMGKYAHFITIRITESYPLFQTDGELNKAKVRAGIQHQEPISRLAMFKRKQSTPERLTGRELLRNYQIGEWDKCDYNVEFSKTTPDCILYGFAIGDSGSEKSKVVVDTAYSITPFEDSHLNFTLNAPFENGTMSRNGEVTSRINSQDHILPQTFFPSIVTLKDPTEAGFLYVFNNILRTRHYGAQTTRTGRVRNELIGVIFADGETVSNLRWTQKIYDLLSFDGKINPPDPLNEDDVKDAATKAIAELMTQEFISHTDFIADAFQPLLTEVKSITSDETKLKEMLTLANTESSAYAEKYVSKKSADKDKKDKKPKKASAATE

SEQ ID NO: 4606 - protein, 327 aa, Pleurocapsa sp. PCC 7319
MTFLKSLDAKYFHTEIPYKPMGKYAHFLTTRVTESYPLFQTDGELNKARVRAGITHQKPISRLTMFKRKQSTPERLIGRELLRNYELVKPDECEYNVDFAKNNADCIIYGFAIGDGGSEKSKVVVDSAYSITSFDESHETFTLNAPYEHGTMSKNGEVTSRINQQDHIRPQVFFPSIVTLKDPTEASFLYVFNNIVRTRHYGAQTTRTGRVRNELIGVIFADGEIVSNLRWTQAIYDKLGDKLDSLDPLNENEVNQAAKETIEQLMSEESIVHKDFIGDSFTPILNEVKTLTSKEEKIKEILIQANQEAQNYFSKYIEKPKKPTKSK

SEQ ID NO: 4607 - protein, 341 aa, Sulfolobales archaeon Acd1
MNGMEAVSKILGKENLSQFFADLSKPNKENAVPRGRVANVFLVILAEGELVIRHEGGEDVTLATLDGEKYPMILHEKLVSAWRREMLEQLRHDYDTHKEDLNKVRGKNDEWHCSLRPTAAAGKKEERIGGLCRECPNCMVFGYAVGEEEKYNLKSRIEGDVYLSTLPEQRSVVVRTFNAVDEPTHTTFIQSEGARTGALFRLSLIRVGTPFVGKVAMKDLSPAEFALALYSLIHTTRIGGIKSDFGKVRVIIPAIALCDHEVSSGYEMFQKVKGIDNVGEIVRKINEHVKAYEKECMVLTSNDFSPIITEVVGKNKHDIVKEAWSNGLNFKRCIEEFIKSK

SEQ ID NO: 4608 - protein, 328 aa, Halarchaeum acidiphilum; identical to SEQ ID NO: 4472

SEQ ID NO: 4609 - protein, 327 aa, Lamprocystis purpurea
MERLNDYLPQLSALMEQSQGKDAAYMHPKRKNLGSVSLVLLREAIAPVVFRNAEQEITDIEFNNETYVRAVPNKFKYPERGRALQILRAMQAGGRYPQNRTAIPKGSRPSESFDLNTLVFGDSANRDNKVLPVRAAVNYSDGLSLKPKYFCVEESFHNRGMEDGTLWDAEAKKNTDNLFSRHFVRPGTLLVQVLSTRGKLLPLIGLKHLLLSVGLAGSYGGQTSVTGINLRTHFVGLYADWFERAETSPYELIKHIPADANQDITAASAALHDLLEPLHRTAIPGSDVQTWVTGLIADFNQLGGPLEAEYRAAATAVGQLFDGWFGQ

SEQ ID NO: 4610 - protein, 327 aa, Thiofilum flexile
MQVLTPYLASIDQLTSSSPIDDKKTYIHPKLKNLGCISLVLIREAIAPVIFRNAEQEITDIEWLDDLYVRAVPNKFKYTERSRGLQILRALGVGGKQAQNKTVLYKGQKPADAFDLNTLVFGDSANFDNRVLPVRAAISYSDALSIKPKEQCVDSTFHNRAMEDGTLFDAETKKNSDNLFTRHFIKPGTLMVQVLSTRGQVLPEIGLKHLLLSMGLAGSYGGQTSVTGINIRTHMVGIYADPFEQAITSPYELLKVLQPQANGDLISIKATLHEALQAQHTVSIQGSEAEQWQHELIKAFEKNGSPLEQDYKQAQPKIATLFNEWFS

SEQ ID NO: 4611 - protein, 335 aa, Thauera terpenica; identical to SEQ ID NO: 4468

SEQ ID NO: 4612 - protein, 295 aa, Escherichia coli
MFWRDMTLSVWRKKTTGLKTKKRLLPLVLAAALCSSPVWAEEATFTANFKDTDLKSFIETVGANLNKTIIMGPGVQGKVSIRTMTPLNERQYYQLFLNLLEAQGYAVVPMENDVLKVVKSSAAKVEPLPLVGEGSDNYAGDEMVTKVVPVRNVSVRELAPILRQMIDSAGSGNVVNYDPSNVIMLTGRASVVERLTEVIQRVDHAGNRTEEVIPLDNASASEIARVLESLTKNSGENQPATLKSQIVADERTNSVIVSGDPATRDKMRRLIRRLDSEMERSGNSQVFGDAANLLI

SEQ ID NO: 4613 - protein, 686 aa, Escherichia coli
MFWRDMTLSVWRKKTTGLKTIKRLLPLVLAAALCSSPVWAEEATFTASFKDTDLKSFIETVGANLNKTIIMGPGVQGKVSIRTMTPLNERQYYQLFLNLLEAQGYAVVPMENDVLKVVKSSAAKVEPLPLVGEGSDNYAGDEMVTKVVPVRNVSVRELAPILRQMIDSAGSGNVVNYDPSNVIMLTGRASVVERLTEVIQRVDHAGNRTEEVIPLDNASASEIARVLESLTKNSGENQPATLKSQIVADERTNSVIVSGDPATRDKMRRLIRRLDSEMERSGNSQVFYLKYSKAEDLVDVLKQVSGTLTAAKEEAEGTVGSGREVVSIAASKHSNALIVTAPQDIMQSLQSVIEQLDIRRAQVHVEALIVEVAEGSNINFGVQWASKDAGLMQFANGTQIPIGTLGAAISQAKPQKGSTVISENGATTINPDTNGDLSTLAQLLSGFSGTAVGVVKGDWMALVQAVKNDSSSNVLSTPSITTLDNQEAFFMVGQDVPVLTGSTVGSNNSNPFNTVERKKVGIMLKVTPQINEGNAVQMVIEQEVSKVEGQTSLDVVFGERKLKTTVLANDGELIVLGGLMDDQAGESVAKVPLLGDIPLIGNLFKSTADKKEKRNLMVFIRPTILRDGMAADGVSQRKYNYMRAEQIYRDEQGLSLMPHTAQPVLPAQNQALPPEVRAFLNAGRTR

SEQ ID NO: 4614 - protein, 327 aa, Laceyella sediminis
MKGSNVTWKDCVVKKLLDQHLLEEIPKSPQRVYVSMVILREFHSTAVLTTEGQHLDVEMVRAGRTKNQLLSRVVLQKRKQVAPERRTGRAFNRQMGWGETCDYMKKMCGECPDCLLYGFAATSGDGAQRSRVLTDSGFSIRQYEAIQRSITLNAIQDTTQGGIAGSAFAEREHIRPQVFFPTIETAIDVTSSELVYILRNILSTTRYGAESNRQGYVKNHIIGLLFTNTEIMSNLELTQRVFDYLIQEKGEKIHEGPLEQEEVRQAMLHALNEVVADSYLPIQLYVGEELESVFSGLRQLWKSEEGNREWLKNLAEDHQAYLKKRSK

SEQ ID NO: 4615 - protein, 196 aa, Cetobacterium; identical to SEQ ID NO: 4470

SEQ ID NO: 4616 - protein, 341 aa, Lyngbya aestuarii; identical to SEQ ID NO: 4469

SEQ ID NO: 4617 - protein, 335 aa, Leptolyngbya sp. Heron Island J; identical to SEQ ID NO: 4471

SEQ ID NO: 4618 - protein, 335 aa, Gloeobacter kilaueensis; identical to SEQ ID NO: 4423

SEQ ID NO: 4619 - protein, 290 aa, Escherichia coli
MTLSVWRKKTTGLKTKKRLLPLVLAAALCSSPVWAEEATFTANFKDTDLKSFIETVGANLNKTIIMGPGVQGKVSIRTMTPLNERQYYQLFLNLLEAQGYAVVPMENDVLKVVKSSAAKVEPLPLVGEGSDNYAGDEMVTKVVPVRNVSVRELAPILRQMIDSAGSGNVVNYDPSNVIMLTGRASVVERLTEVIQRVDHAGNRTEEVIPLDNASASEIARVLESLTKNSGENQPATLKSQIVADERTNSVIVSGDPATRDKMRRLIRRLDSEMERSGNSQVFGDAANLLI

SEQ ID NO: 4620 - protein, 615 aa, Shigella flexneri
MFWRDITLSVWRKKTTGLKTKKRLLPLVLAAALCSSPVWAEEATFTANFKDTDLKSFIETVGANLNKTIIMGPGVQGKVSIRTMTPLNERQYYQLFLNLLEAQGYAVVPMENDVLKVVKSSAAKVEPLPLVGEGSDNYAGDEMVTKVVPVRNVSVRELAPILRQMIDSAGSGNVVNYDPSNVIMLTGRASVVERLTEVIQRVDHAGNRTEEVIPLDNASASEIARVLESLTKNSGENQPATLKSQIVADERTNSVIVSGDPATRDKMRRLIRRLDSEMERSGNSQVFYLKYIKAEDLVDVLKQVSGTLTAAKEEAEGTVGSGREVVSIAASKHSNALIVTAPQDIMQSLQSVIEQLDIRRAQVHVEALIVEVAEGSNINFGVQWASKDAGLMQFANGTQIPIGTLGAAISQAKPQKSSTVISENGATTINPDTNGDLSTLAQLLSGFSGTAVGVVKGDWMALVQAVKNDSSSNVLSTPSITTLDNQEAFFMVGQDVPVLTGSTVGSNNSNPFNTVERKKVGIMLKVTPQINEGNAVQMVIEQEVSKVEGQTSLDVVFGERKLKTTVLANDGELIVLGGLMDDQAGESVAKVPLLGDIPLIGNLFKSTADKKKNVT

SEQ ID NO: 4621 - protein, 330 aa, Herpetosiphon aurantiacus DSM 785; identical to SEQ ID NO: 4378

SEQ ID NO: 4622 - protein, 335 aa, Microcystis aeruginosa NIES-843; identical to SEQ ID NO: 4429

SEQ ID NO: 4623 - protein, 329 aa, Synechococcus sp. PCC 7002; identical to SEQ ID NO: 4379

SEQ ID NO: 4624 - protein, 342 aa, Nostoc punctiforme PCC 73102; identical to SEQ ID NO: 4380

SEQ ID NO: 4625 - protein, 356 aa, Cyanothece sp. PCC 8801; identical to SEQ ID NO: 4381

SEQ ID NO: 4626 - protein, 338 aa, Cyanothece sp. PCC 7424; identical to SEQ ID NO: 4382

SEQ ID NO: 4627 - protein, 84 aa, Methylobacterium extorquens CM4; identical to SEQ ID NO: 4383

SEQ ID NO: 4628 - protein, 328 aa, Methanosphaerula palustris E1-9c; identical to SEQ ID NO: 4384

SEQ ID NO: 4629 - protein, 334 aa, Cyanothece sp. PCC 7425; identical to SEQ ID NO: 4385

SEQ ID NO: 4630 - protein, 329 aa, Halorubrum lacusprofundi ATCC 49239; identical to SEQ ID NO: 4386

SEQ ID NO: 4631 - protein, 73 aa, Eubacterium eligens ATCC 27750; identical to SEQ ID NO: 4387

SEQ ID NO: 4632 - protein, 131 aa, Methylobacterium extorquens AM1; identical to SEQ ID NO: 4388

SEQ ID NO: 4633 - protein, 356 aa, Cyanothece sp. PCC 8802; identical to SEQ ID NO: 4389

SEQ ID NO: 4634 - protein, 315 aa, Ammonifex degensii KC4; identical to SEQ ID NO: 4390

SEQ ID NO: 4635 - protein, 348 aa, Methanocaldococcus vulcanius M7; identical to SEQ ID NO: 4391

SEQ ID NO: 4636 - protein, 344 aa, Sulfolobus islandicus L.D.8.5; identical to SEQ ID NO: 4392

SEQ ID NO: 4637 - protein, 332 aa, Nitrosococcus halophilus Nc 4; identical to SEQ ID NO: 4393

SEQ ID NO: 4638 - protein, 315 aa, Acetohalobium arabaticum DSM 5501; identical to SEQ ID NO: 4394

SEQ ID NO: 4639 - protein, 330 aa, Cyanothece sp. PCC 7822; identical to SEQ ID NO: 4395

SEQ ID NO: 4640 - protein, 350 aa, Methanotorris igneus Kol 5; identical to SEQ ID NO: 4397

SEQ ID NO: 4641 - protein, 354 aa, Methanothermococcus okinawensis IH1; identical to SEQ ID NO: 4398

SEQ ID NO: 4642 - protein, 327 aa, Caldicellulosiruptor lactoaceticus 6A; identical to SEQ ID NO: 4400

SEQ ID NO: 4643 - protein, 316 aa, halophilic archaeon DL31; identical to SEQ ID NO: 4401

SEQ ID NO: 4644 - protein, 381 aa, Candidatus Chloracidobacterium thermophilum B; identical to SEQ ID NO: 4556

SEQ ID NO: 4645 - protein, 313 aa, Caldilinea aerophila DSM 14535 = NBRC 104270; identical to SEQ ID NO: 4430

SEQ ID NO: 4646 - protein, 340 aa, Sulfolobus islandicus HVE10/4; identical to SEQ ID NO: 4396

SEQ ID NO: 4647 - protein, 329 aa, Haloquadratum walsbyi C23; identical to SEQ ID NO: 4435

SEQ ID NO: 4648 - protein, 324 aa, Spirochaeta thermophila DSM 6578; identical to SEQ ID NO: 4399

SEQ ID NO: 4649 - protein, 313 aa, Thermacetogenium phaeum DSM 12270; identical to SEQ ID NO: 4402

SEQ ID NO: 4650 - protein, 347 aa, Anabaena sp. 90; identical to SEQ ID NO: 4403

SEQ ID NO: 4651 - protein, 345 aa, Nostoc sp. PCC 7107; identical to SEQ ID NO: 4406

SEQ ID NO: 4652 - protein, 347 aa, Rivularia sp. PCC 7116; identical to SEQ ID NO: 4408

SEQ ID NO: 4653 - protein, 334 aa, Calothrix sp. PCC 7507; identical to SEQ ID NO: 4404

SEQ ID NO: 4654 - protein, 342 aa, Calothrix sp. PCC 7507; identical to SEQ ID NO: 4405

SEQ ID NO: 4655 - protein, 344 aa, Nostoc sp. PCC 7524; identical to SEQ ID NO: 4407

SEQ ID NO: 4656 - protein, 344 aa, Pleurocapsa sp. PCC 7327; identical to SEQ ID NO: 4409

SEQ ID NO: 4657 - protein, 328 aa, Oscillatoria acuminata PCC 6304; identical to SEQ ID NO: 4410

SEQ ID NO: 4658 - protein, 341 aa, Oscillatoria acuminata PCC 6304; identical to SEQ ID NO: 4411

SEQ ID NO: 4659 - protein, 338 aa, Oscillatoria nigro-viridis PCC 7112; identical to SEQ ID NO: 4413

SEQ ID NO: 4660 - protein, 339 aa, Gloeocapsa sp. PCC 7428; identical to SEQ ID NO: 4415

SEQ ID NO: 4661 - protein, 341 aa, Calothrix sp. PCC 6303; identical to SEQ ID NO: 4412

SEQ ID NO: 4662 - protein, 332 aa, Crinalium epipsammum PCC 9333; identical to SEQ ID NO: 4414

SEQ ID NO: 4663 - protein, 333 aa, Stanieria cyanosphaera PCC 7437; identical to SEQ ID NO: 4416

SEQ ID NO: 4664 - protein, 336 aa, Anabaena cylindrica PCC 7122; identical to SEQ ID NO: 4418

SEQ ID NO: 4665 - protein, 337 aa, Halothece sp. PCC 7418; identical to SEQ ID NO: 4417

SEQ ID NO: 4666 - protein, 351 aa, Sulfolobus acidocaldarius N8; identical to SEQ ID NO: 4373

SEQ ID NO: 4667 - protein, 351 aa, Sulfolobus acidocaldarius Ron12/I; identical to SEQ ID NO: 4373

SEQ ID NO: 4668 - protein, 329 aa, Synechocystis sp. PCC 6803; identical to SEQ ID NO: 4421

SEQ ID NO: 4669 - protein, 73 aa, Eubacterium rectale DSM 17629; identical to SEQ ID NO: 4387

SEQ ID NO: 4670 - protein, 340 aa, Sulfolobus islandicus LAL14/1; identical to SEQ ID NO: 4422

SEQ ID NO: 4671 - protein, 335 aa, Gloeobacter kilaueensis JS1; identical to SEQ ID NO: 4423

SEQ ID NO: 4672 - protein, 310 aa, Picrophilus torridus DSM 9790; identical to SEQ ID NO: 4372

SEQ ID NO: 4673 - protein, 351 aa, Sulfolobus acidocaldarius DSM 639; identical to SEQ ID NO: 4373

SEQ ID NO: 4674 - protein, 338 aa, Anabaena variabilis ATCC 29413; identical to SEQ ID NO: 4374

SEQ ID NO: 4675 - protein, 329 aa, Natronomonas pharaonis DSM 2160; identical to SEQ ID NO: 4431

SEQ ID NO: 4676 - protein, 335 aa, Methanospirillum hungatei JF-1; identical to SEQ ID NO: 4375

SEQ ID NO: 4677 - protein, 329 aa, Methanothrix thermoacetophila PT; identical to SEQ ID NO: 4376

SEQ ID NO: 4678 - protein, 374 aa, Thermofilum pendens Hrk 5; identical to SEQ ID NO: 4377

SEQ ID NO: 4679 - protein, 310 aa, Picrophilus torridus DSM 9790; identical to SEQ ID NO: 4372

SEQ ID NO: 4680 - protein, 351 aa, Sulfolobus acidocaldarius DSM 639; identical to SEQ ID NO: 4373

SEQ ID NO: 4681 - protein, 338 aa, Trichormus variabilis ATCC 29413; identical to SEQ ID NO: 4374

SEQ ID NO: 4682 - protein, 335 aa, Methanospirillum hungatei JF-1; identical to SEQ ID NO: 4375

SEQ ID NO: 4683 - protein, 329 aa, Methanothrix thermoacetophila PT; identical to SEQ ID NO: 4376

SEQ ID NO: 4684 - protein, 374 aa, Thermofilum pendens Hrk 5; identical to SEQ ID NO: 4377

SEQ ID NO: 4685 - protein, 330 aa, Herpetosiphon aurantiacus DSM 785; identical to SEQ ID NO: 4378

SEQ ID NO: 4686 - protein, 329 aa, Synechococcus sp. PCC 7002; identical to SEQ ID NO: 4379

SEQ ID NO: 4687 - protein, 342 aa, Nostoc punctiforme PCC 73102; identical to SEQ ID NO: 4380

SEQ ID NO: 4688 - protein, 356 aa, Rippkaea orientalis PCC 8801; identical to SEQ ID NO: 4381

SEQ ID NO: 4689 - protein, 338 aa, Gloeothece citriformis PCC 7424; identical to SEQ ID NO: 4382

SEQ ID NO: 4690 - protein, 84 aa, Methylorubrum extorquens CM4; identical to SEQ ID NO: 4383

SEQ ID NO: 4691 - protein, 328 aa, Methanosphaerula palustris E1-9c; identical to SEQ ID NO: 4384

SEQ ID NO: 4692 - protein, 334 aa, Cyanothece sp. PCC 7425; identical to SEQ ID NO: 4385

SEQ ID NO: 4693 - protein, 329 aa, Halorubrum lacusprofundi ATCC 49239; identical to SEQ ID NO: 4386

SEQ ID NO: 4694 - protein, 73 aa, Eubacterium eligens ATCC 27750; identical to SEQ ID NO: 4387

SEQ ID NO: 4695 - protein, 131 aa, Methylorubrum extorquens AM1; identical to SEQ ID NO: 4388

SEQ ID NO: 4696 - protein, 356 aa, Rippkaea orientalis PCC 8802; identical to SEQ ID NO: 4389

SEQ ID NO: 4697 - protein, 315 aa, Ammonifex degensii KC4; identical to SEQ ID NO: 4390

SEQ ID NO: 4698 - protein, 348 aa, Methanocaldococcus vulcanius M7; identical to SEQ ID NO: 4391

SEQ ID NO: 4699 - protein, 344 aa, Sulfolobus islandicus L.D.8.5; identical to SEQ ID NO: 4392

SEQ ID NO: 4700 - protein, 332 aa, Nitrosococcus halophilus Nc 4; identical to SEQ ID NO: 4393

SEQ ID NO: 4701 - protein, 315 aa, Acetohalobium arabaticum DSM 5501; identical to SEQ ID NO: 4394

SEQ ID NO: 4702 - protein, 330 aa, Gloeothece verrucosa PCC 7822; identical to SEQ ID NO: 4395

SEQ ID NO: 4703 - protein, 340 aa, Sulfolobus islandicus HVE10/4; identical to SEQ ID NO: 4396

SEQ ID NO: 4704 - protein, 350 aa, Methanotorris igneus Kol 5; identical to SEQ ID NO: 4397

SEQ ID NO: 4705 - protein, 354 aa, Methanothermococcus okinawensis IH1; identical to SEQ ID NO: 4398

SEQ ID NO: 4706 - protein, 324 aa, Spirochaeta thermophila DSM 6578; identical to SEQ ID NO: 4399

SEQ ID NO: 4707 - protein, 327 aa, Caldicellulosiruptor lactoaceticus 6A; identical to SEQ ID NO: 4400

SEQ ID NO: 4708 - protein, 316 aa, halophilic archaeon DL31; identical to SEQ ID NO: 4401

SEQ ID NO: 4709 - protein, 313 aa, Thermacetogenium phaeum DSM 12270; identical to SEQ ID NO: 4402

SEQ ID NO: 4710 - protein, 347 aa, Anabaena sp. 90; identical to SEQ ID NO: 4403

SEQ ID NO: 4711 - protein, 334 aa, Calothrix sp. PCC 7507; identical to SEQ ID NO: 4404

SEQ ID NO: 4712 - protein, 342 aa, Calothrix sp. PCC 7507; identical to SEQ ID NO: 4405

SEQ ID NO: 4713 - protein, 345 aa, Nostoc sp. PCC 7107; identical to SEQ ID NO: 4406

SEQ ID NO: 4714 - protein, 344 aa, Nostoc sp. PCC 7524; identical to SEQ ID NO: 4407

SEQ ID NO: 4715 - protein, 347 aa, Rivularia sp. PCC 7116; identical to SEQ ID NO: 4408

SEQ ID NO: 4716 - protein, 344 aa, Pleurocapsa sp. PCC 7327; identical to SEQ ID NO: 4409

SEQ ID NO: 4717 - protein, 328 aa, Oscillatoria acuminata PCC 6304; identical to SEQ ID NO: 4410

SEQ ID NO: 4718 - protein, 341 aa, Oscillatoria acuminata PCC 6304; identical to SEQ ID NO: 4411

SEQ ID NO: 4719 - protein, 341 aa, Calothrix sp. PCC 6303; identical to SEQ ID NO: 4412

SEQ ID NO: 4720 - protein, 338 aa, Oscillatoria nigro-viridis PCC 7112; identical to SEQ ID NO: 4413

SEQ ID NO: 4721 - protein, 332 aa, Crinalium epipsammum PCC 9333; identical to SEQ ID NO: 4414

SEQ ID NO: 4722 - protein, 339 aa, Gloeocapsa sp. PCC 7428; identical to SEQ ID NO: 4415

SEQ ID NO: 4723 - protein, 333 aa, Stanieria cyanosphaera PCC 7437; identical to SEQ ID NO: 4416

SEQ ID NO: 4724 - protein, 337 aa, Halothece sp. PCC 7418; identical to SEQ ID NO: 4417

SEQ ID NO: 4725 - protein, 336 aa, Anabaena cylindrica PCC 7122; identical to SEQ ID NO: 4418

SEQ ID NO: 4726 - protein, 351 aa, Sulfolobus acidocaldarius N8; identical to SEQ ID NO: 4373

SEQ ID NO: 4727 - protein, 351 aa, Sulfolobus acidocaldarius Ron12/I; identical to SEQ ID NO: 4373

SEQ ID NO: 4728 - protein, 329 aa, Synechocystis sp. PCC 6803; identical to SEQ ID NO: 4421

SEQ ID NO: 4729 - protein, 340 aa, Sulfolobus islandicus LAL14/1; identical to SEQ ID NO: 4422

SEQ ID NO: 4730 - protein, 335 aa, Gloeobacter kilaueensis JS1; identical to SEQ ID NO: 4423

SEQ ID NO: 4731 - protein, 686 aa, Escherichia albertii KF1; identical to SEQ ID NO: 4424

SEQ ID NO: 4732 - protein, 335 aa, Thioalkalivibrio paradoxus ARh 1; identical to SEQ ID NO: 4425

SEQ ID NO: 4733 - protein, 327 aa, Marichromatium purpuratum 984; identical to SEQ ID NO: 4426

SEQ ID NO: 4734 - protein, 344 aa, Nostoc sp. PCC 7120 = FACHB-418; identical to SEQ ID NO: 4427

SEQ ID NO: 4735 - protein, 329 aa, Synechocystis sp. PCC 6803; identical to SEQ ID NO: 4421

SEQ ID NO: 4736 - protein, 335 aa, Microcystis aeruginosa NIES-843; identical to SEQ ID NO: 4429

SEQ ID NO: 4737 - protein, 313 aa, Caldilinea aerophila DSM 14535 = NBRC 104270; identical to SEQ ID NO: 4430

SEQ ID NO: 4738 - protein, 329 aa, Natronomonas pharaonis DSM 2160; identical to SEQ ID NO: 4431

SEQ ID NO: 4739 - protein, 335 aa, Microcystis aeruginosa PCC 7806; identical to SEQ ID NO: 4432

SEQ ID NO: 4740 - protein, 73 aa, Eubacterium rectale DSM 17629; identical to SEQ ID NO: 4387

SEQ ID NO: 4741 - protein, 319 aa, Kamptonema sp. PCC 6506; identical to SEQ ID NO: 4434

SEQ ID NO: 4742 - protein, 329 aa, Haloquadratum walsbyi C23; identical to SEQ ID NO: 4435

SEQ ID NO: 4743 - protein, 333 aa, Microcystis aeruginosa PCC 9432; identical to SEQ ID NO: 4436

SEQ ID NO: 4744 - protein, 333 aa, Microcystis aeruginosa PCC 9717; identical to SEQ ID NO: 4437

SEQ ID NO: 4745 - protein, 335 aa, Microcystis aeruginosa PCC 9443; identical to SEQ ID NO: 4438

SEQ ID NO: 4746 - protein, 333 aa, Microcystis aeruginosa PCC 7941; identical to SEQ ID NO: 4439

SEQ ID NO: 4747 - protein, 335 aa, Microcystis aeruginosa PCC 9806; identical to SEQ ID NO: 4440

SEQ ID NO: 4748 - protein, 335 aa, Microcystis aeruginosa PCC 9807; identical to SEQ ID NO: 4441

SEQ ID NO: 4749 - protein, 333 aa, Microcystis aeruginosa PCC 9808; identical to SEQ ID NO: 4442

SEQ ID NO: 4750 - protein, 335 aa, Microcystis aeruginosa PCC 9809; identical to SEQ ID NO: 4443

SEQ ID NO: 4751 - protein, 335 aa, Microcystis aeruginosa PCC 9701; identical to SEQ ID NO: 4444

SEQ ID NO: 4752 - protein, 335 aa, Thermobrachium celere DSM 8682; identical to SEQ ID NO: 4445

SEQ ID NO: 4753 - protein, 506 aa, Escherichia coli ISC41; identical to SEQ ID NO: 4446

SEQ ID NO: 4754 - protein, 342 aa, Lyngbya sp. PCC 8106; identical to SEQ ID NO: 4447

SEQ ID NO: 4755 - protein, 338 aa, Coleofasciculus chthonoplastes PCC 7420; identical to SEQ ID NO: 4448

SEQ ID NO: 4756 - protein, 326 aa, Cylindrospermopsis raciborskii CS-505; identical to SEQ ID NO: 4449

SEQ ID NO: 4757 - protein, 343 aa, Cylindrospermopsis raciborskii CS-505; identical to SEQ ID NO: 4450

SEQ ID NO: 4758 - protein, 323 aa, Raphidiopsis brookii D9; identical to SEQ ID NO: 4451

SEQ ID NO: 4759 - protein, 336 aa, Ktedonobacter racemifer DSM 44963; identical to SEQ ID NO: 4452

SEQ ID NO: 4760 - protein, 338 aa, delta proteobacterium NaphS2; identical to SEQ ID NO: 4453

SEQ ID NO: 4761 - protein, 345 aa, Oscillochloris trichoides DG6; identical to SEQ ID NO: 4454

SEQ ID NO: 4762 - protein, 332 aa, Thiorhodospira sibirica ATCC 700588; identical to SEQ ID NO: 4455

SEQ ID NO: 4763 - protein, 337 aa, Fischerella thermalis; identical to SEQ ID NO: 4456

SEQ ID NO: 4764 - protein, 328 aa, Thiothrix nivea DSM 5205; identical to SEQ ID NO: 4457

SEQ ID NO: 4765 - protein, 335 aa, Leptolyngbya sp. PCC 7375; identical to SEQ ID NO: 4458

SEQ ID NO: 4766 - protein, 334 aa, Gloeocapsa sp. PCC 73106; identical to SEQ ID NO: 4459

SEQ ID NO: 4767 - protein, 335 aa, Microcystis aeruginosa DIANCHI905; identical to SEQ ID NO: 4432

SEQ ID NO: 4768 - protein, 139 aa, Tupaia chinensis; identical to SEQ ID NO: 4461

SEQ ID NO: 4769 - protein, 313 aa, Natrialba hulunbeirensis JCM 10989; identical to SEQ ID NO: 4462

SEQ ID NO: 4770 - protein, 328 aa, Natrialba asiatica DSM 12278; identical to SEQ ID NO: 4463

SEQ ID NO: 4771 - protein, 328 aa, Haloferax alexandrinus JCM 10717; identical to SEQ ID NO: 4464

SEQ ID NO: 4772 - protein, 328 aa, Haloferax sulfurifontis ATCC BAA-897; identical to SEQ ID NO: 4465

SEQ ID NO: 4773 - protein, 316 aa, Halococcus thailandensis JCM 13552; identical to SEQ ID NO: 4466

SEQ ID NO: 4774 - protein, 335 aa, Microcystis aeruginosa SPC777; identical to SEQ ID NO: 4467

SEQ ID NO: 4775 - protein, 335 aa, Thauera terpenica 58Eu; identical to SEQ ID NO: 4468

SEQ ID NO: 4776 - protein, 341 aa, Lyngbya aestuarii BL J; identical to SEQ ID NO: 4469

SEQ ID NO: 4777 - protein, 196 aa, Cetobacterium somerae ATCC BAA-474; identical to SEQ ID NO: 4470

SEQ ID NO: 4778 - protein, 335 aa, Leptolyngbya sp. Heron Island J; identical to SEQ ID NO: 4471

SEQ ID NO: 4779 - protein, 328 aa, Halarchaeum acidiphilum MH1-52-1; identical to SEQ ID NO: 4472

SEQ ID NO: 4780 - protein, 151 aa, Nocardia seriolae N-2927; identical to SEQ ID NO: 4473

SEQ ID NO: 4781 - protein, 344 aa, Nostoc sp. PCC 7120; identical to SEQ ID NO: 4427

SEQ ID NO: 4782 - protein, 329 aa, Synechocystis sp. PCC 6803; identical to SEQ ID NO: 4421

SEQ ID NO: 4783 - protein, 125 aa, Escherichia albertii; identical to SEQ ID NO: 4476

SEQ ID NO: 4784 - protein, 686 aa, Escherichia albertii; identical to SEQ ID NO: 4477

SEQ ID NO: 4785 - protein, 523 aa, Escherichia coli; identical to SEQ ID NO: 4478

SEQ ID NO: 4786 - protein, 493 aa, Shigella; identical to SEQ ID NO: 4479

SEQ ID NO: 4787 - protein, 493 aa, Shigella dysenteriae; identical to SEQ ID NO: 4480

SEQ ID NO: 4788 - protein, 615 aa, Escherichia coli; identical to SEQ ID NO: 4481

SEQ ID NO: 4789 - protein, 613 aa, Escherichia coli; identical to SEQ ID NO: 4482

SEQ ID NO: 4790 - protein, 615 aa, Escherichia coli; identical to SEQ ID NO: 4483

SEQ ID NO: 4791 - protein, 626 aa, Escherichia coli; identical to SEQ ID NO: 4484

SEQ ID NO: 4792 - protein, 336 aa, Escherichia coli; identical to SEQ ID NO: 4485

SEQ ID NO: 4793 - protein, 615 aa, Escherichia coli; identical to SEQ ID NO: 4486

SEQ ID NO: 4794 - protein, 613 aa, Escherichia coli; identical to SEQ ID NO: 4487

SEQ ID NO: 4795 - protein, 613 aa, Escherichia coli; identical to SEQ ID NO: 4488

SEQ ID NO: 4796 - protein, 615 aa, Escherichia coli; identical to SEQ ID NO: 4489

SEQ ID NO: 4797 - protein, 613 aa, Escherichia coli; identical to SEQ ID NO: 4490

SEQ ID NO: 4798 - protein, 280 aa, Escherichia coli; identical to SEQ ID NO: 4491

SEQ ID NO: 4799 - protein, 615 aa, Escherichia coli; identical to SEQ ID NO: 4492

SEQ ID NO: 4800 - protein, 615 aa, Escherichia coli; identical to SEQ ID NO: 4493

SEQ ID NO: 4801 - protein, 686 aa, Escherichia coli; identical to SEQ ID NO: 4494

SEQ ID NO: 4802 - protein, 175 aa, Escherichia coli; identical to SEQ ID NO: 4495

SEQ ID NO: 4803 - protein, 328 aa, Thiothrix nivea; identical to SEQ ID NO: 4457

SEQ ID NO: 4804 - protein, 335 aa, Microcystis aeruginosa; identical to SEQ ID NO: 4432

SEQ ID NO: 4805 - protein, 333 aa, Microcystis aeruginosa; identical to SEQ ID NO: 4436

SEQ ID NO: 4806 - protein, 333 aa, Microcystis aeruginosa; identical to SEQ ID NO: 4437

SEQ ID NO: 4807 - protein, 335 aa, Microcystis aeruginosa; identical to SEQ ID NO: 4438

SEQ ID NO: 4808 - protein, 333 aa, Microcystis aeruginosa; identical to SEQ ID NO: 4439

SEQ ID NO: 4809 - protein, 335 aa, Microcystis aeruginosa; identical to SEQ ID NO: 4440

SEQ ID NO: 4810 - protein, 335 aa, Microcystis aeruginosa; identical to SEQ ID NO: 4441

SEQ ID NO: 4811 - protein, 333 aa, Microcystis aeruginosa; identical to SEQ ID NO: 4442

SEQ ID NO: 4812 - protein, 335 aa, Microcystis aeruginosa; identical to SEQ ID NO: 4443

SEQ ID NO: 4813 - protein, 335 aa, Microcystis aeruginosa; identical to SEQ ID NO: 4444

SEQ ID NO: 4814 - protein, 548 aa, Photobacterium angustum; identical to SEQ ID NO: 4507

SEQ ID NO: 4815 - protein, 338 aa, Coleofasciculus chthonoplastes; identical to SEQ ID NO: 4448

SEQ ID NO: 4816 - protein, 328 aa, Natrialba asiatica; identical to SEQ ID NO: 4463

SEQ ID NO: 4817 - protein, 343 aa, Cylindrospermopsis raciborskii; identical to SEQ ID NO: 4450

SEQ ID NO: 4818 - protein, 326 aa, Cylindrospermopsis raciborskii; identical to SEQ ID NO: 4449

SEQ ID NO: 4819 - protein, 338 aa, delta proteobacterium NaphS2; identical to SEQ ID NO: 4453

SEQ ID NO: 4820 - protein, 335 aa, Leptolyngbya sp. PCC 7375; identical to SEQ ID NO: 4458

SEQ ID NO: 4821 - protein, 334 aa, Gloeocapsa sp. PCC 73106; identical to SEQ ID NO: 4459

SEQ ID NO: 4822 - protein, 345 aa, Oscillochloris trichoides; identical to SEQ ID NO: 4454

SEQ ID NO: 4823 - protein, 328 aa, Haloferax alexandrinus; identical to SEQ ID NO: 4464

SEQ ID NO: 4824 - protein, 541 aa, Photobacterium sp. SKA34; identical to SEQ ID NO: 4517

SEQ ID NO: 4825 - protein, 313 aa, Natrialba hulunbeirensis; identical to SEQ ID NO: 4462

SEQ ID NO: 4826 - protein, 332 aa, Thiorhodospira sibirica; identical to SEQ ID NO: 4455

SEQ ID NO: 4827 - protein, 328 aa, Haloferax sulfurifontis; identical to SEQ ID NO: 4465

SEQ ID NO: 4828 - protein, 319 aa, Kamptonema; identical to SEQ ID NO: 4434

SEQ ID NO: 4829 - protein, 316 aa, Halococcus thailandensis; identical to SEQ ID NO: 4466

SEQ ID NO: 4830 - protein, 336 aa, Ktedonobacter racemifer; identical to SEQ ID NO: 4452

SEQ ID NO: 4831 - protein, 323 aa, Aphanizomenonaceae; identical to SEQ ID NO: 4451

SEQ ID NO: 4832 - protein, 337 aa, Fischerella thermalis; identical to SEQ ID NO: 4456

SEQ ID NO: 4833 - protein, 345 aa, Oscillatoriales cyanobacterium JSC-12; identical to SEQ ID NO: 4526

SEQ ID NO: 4834 - protein, 342 aa, Lyngbya sp. PCC 8106; identical to SEQ ID NO: 4447

SEQ ID NO: 4835 - protein, 344 aa, Nostocaceae; identical to SEQ ID NO: 4427

SEQ ID NO: 4836 - protein, 329 aa, Synechocystis; identical to SEQ ID NO: 4421

SEQ ID NO: 4837 - protein, 310 aa, Picrophilus torridus; identical to SEQ ID NO: 4372

SEQ ID NO: 4838 - protein, 351 aa, Sulfolobus acidocaldarius; identical to SEQ ID NO: 4373

SEQ ID NO: 4839 - protein, 338 aa, Nostocaceae; identical to SEQ ID NO: 4374

SEQ ID NO: 4840 - protein, 329 aa, Natronomonas pharaonis; identical to SEQ ID NO: 4431

SEQ ID NO: 4841 - protein, 335 aa, Methanospirillum hungatei; identical to SEQ ID NO: 4375

SEQ ID NO: 4842 - protein, 329 aa, Methanothrix thermoacetophila; identical to SEQ ID NO: 4376

SEQ ID NO: 4843 - protein, 374 aa, Thermofilum pendens; identical to SEQ ID NO: 4377

SEQ ID NO: 4844 - protein, 330 aa, Herpetosiphon aurantiacus; identical to SEQ ID NO: 4378

SEQ ID NO: 4845 - protein, 335 aa, Microcystis aeruginosa; identical to SEQ ID NO: 4429

SEQ ID NO: 4846 - protein, 329 aa, Synechococcus sp. PCC 7002; identical to SEQ ID NO: 4379

SEQ ID NO: 4847 - protein, 342 aa, Nostoc punctiforme; identical to SEQ ID NO: 4380

SEQ ID NO: 4848 - protein, 356 aa, Rippkaea orientalis; identical to SEQ ID NO: 4381

SEQ ID NO: 4849 - protein, 338 aa, Gloeothece citriformis; identical to SEQ ID NO: 4382

SEQ ID NO: 4850 - protein, 328 aa, Methanosphaerula palustris; identical to SEQ ID NO: 4384

SEQ ID NO: 4851 - protein, 334 aa, Cyanothece sp. PCC 7425; identical to SEQ ID NO: 4385

SEQ ID NO: 4852 - protein, 329 aa, Halorubrum lacusprofundi; identical to SEQ ID NO: 4386

SEQ ID NO: 4853 - protein, 73 aa, Lachnospiraceae; identical to SEQ ID NO: 4387

SEQ ID NO: 4854 - protein, 348 aa, Methanocaldococcus vulcanius; identical to SEQ ID NO: 4391

SEQ ID NO: 4855 - protein, 344 aa, Sulfolobus islandicus; identical to SEQ ID NO: 4392

SEQ ID NO: 4856 - protein, 332 aa, Nitrosococcus halophilus; identical to SEQ ID NO: 4393

SEQ ID NO: 4857 - protein, 315 aa, Acetohalobium arabaticum; identical to SEQ ID NO: 4394

SEQ ID NO: 4858 - protein, 330 aa, Gloeothece verrucosa; identical to SEQ ID NO: 4395

SEQ ID NO: 4859 - protein, 350 aa, Methanotorris igneus; identical to SEQ ID NO: 4397

SEQ ID NO: 4860 - protein, 354 aa, Methanothermococcus okinawensis; identical to SEQ ID NO: 4398

SEQ ID NO: 4861 - protein, 327 aa, Caldicellulosiruptor lactoaceticus; identical to SEQ ID NO: 4400

SEQ ID NO: 4862 - protein, 316 aa, halophilic archaeon DL31; identical to SEQ ID NO: 4401

SEQ ID NO: 4863 - protein, 381 aa, Chloracidobacterium thermophilum; identical to SEQ ID NO: 4556

SEQ ID NO: 4864 - protein, 313 aa, Caldilinea aerophila; identical to SEQ ID NO: 4430

SEQ ID NO: 4865 - protein, 340 aa, Sulfolobus islandicus; identical to SEQ ID NO: 4396

SEQ ID NO: 4866 - protein, 329 aa, Haloquadratum walsbyi; identical to SEQ ID NO: 4435

SEQ ID NO: 4867 - protein, 324 aa, Spirochaeta thermophila; identical to SEQ ID NO: 4399

SEQ ID NO: 4868 - protein, 313 aa, Thermacetogenium phaeum; identical to SEQ ID NO: 4402

SEQ ID NO: 4869 - protein, 347 aa, Nostocales; identical to SEQ ID NO: 4403

SEQ ID NO: 4870 - protein, 345 aa, Nostoc sp. PCC 7107; identical to SEQ ID NO: 4406

SEQ ID NO: 4871 - protein, 347 aa, Rivularia sp. PCC 7116; identical to SEQ ID NO: 4408

SEQ ID NO: 4872 - protein, 334 aa, Calothrix sp. PCC 7507; identical to SEQ ID NO: 4404

SEQ ID NO: 4873 - protein, 342 aa, Calothrix sp. PCC 7507; identical to SEQ ID NO: 4405

SEQ ID NO: 4874 - protein, 344 aa, Nostoc sp. PCC 7524; identical to SEQ ID NO: 4407

SEQ ID NO: 4875 - protein, 344 aa, Pleurocapsa minor; identical to SEQ ID NO: 4409

SEQ ID NO: 4876 - protein, 328 aa, Oscillatoria acuminata; identical to SEQ ID NO: 4410

SEQ ID NO: 4877 - protein, 341 aa, Oscillatoria acuminata; identical to SEQ ID NO: 4411

SEQ ID NO: 4878 - protein, 338 aa, Oscillatoria nigro-viridis; identical to SEQ ID NO: 4413

SEQ ID NO: 4879 - protein, 339 aa, Gloeocapsa sp. PCC 7428; identical to SEQ ID NO: 4415

SEQ ID NO: 4880 - protein, 341 aa, Calothrix parietina; identical to SEQ ID NO: 4412

SEQ ID NO: 4881 - protein, 332 aa, Crinalium epipsammum; identical to SEQ ID NO: 4414

SEQ ID NO: 4882 - protein, 333 aa, Stanieria cyanosphaera; identical to SEQ ID NO: 4416

SEQ ID NO: 4883 - protein, 336 aa, Anabaena cylindrica; identical to SEQ ID NO: 4418

SEQ ID NO: 4884 - protein, 337 aa, Halothece sp. PCC 7418; identical to SEQ ID NO: 4417

SEQ ID NO: 4885 - protein, 340 aa, Sulfolobus islandicus; identical to SEQ ID NO: 4422

SEQ ID NO: 4886 - protein, 315 aa, Ammonifex degensii; identical to SEQ ID NO: 4390

SEQ ID NO: 4887 - protein, 356 aa, Rippkaea orientalis; identical to SEQ ID NO: 4389

SEQ ID NO: 4888 - protein, 131 aa, Methylorubrum extorquens; identical to SEQ ID NO: 4388

SEQ ID NO: 4889 - protein, 84 aa, Methylorubrum extorquens; identical to SEQ ID NO: 4383

SEQ ID NO: 4890 - protein, 335 aa, Microcystis aeruginosa; identical to SEQ ID NO: 4467

SEQ ID NO: 4891 - protein, 337 aa, Fischerella muscicola; identical to SEQ ID NO: 4584

SEQ ID NO: 4892 - protein, 337 aa, Fischerella muscicola; identical to SEQ ID NO: 4585

SEQ ID NO: 4893 - protein, 350 aa, Anabaena sp. PCC 7108; identical to SEQ ID NO: 4586

SEQ ID NO: 4894 - protein, 336 aa, Spirulina subsalsa; identical to SEQ ID NO: 4587

SEQ ID NO: 4895 - protein, 337 aa, Fischerella sp. PCC 9339; identical to SEQ ID NO: 4588

SEQ ID NO: 4896 - protein, 362 aa, cyanobacterium PCC 7702; identical to SEQ ID NO: 4589

SEQ ID NO: 4897 - protein, 316 aa, Synechococcus sp. PCC 7336; identical to SEQ ID NO: 4590

SEQ ID NO: 4898 - protein, 338 aa, Fortiea contorta; identical to SEQ ID NO: 4591

SEQ ID NO: 4899 - protein, 334 aa, Geitlerinema sp. PCC 7105; identical to SEQ ID NO: 4592

SEQ ID NO: 4900 - protein, 300 aa, Geitlerinema sp. PCC 7105; identical to SEQ ID NO: 4593

SEQ ID NO: 4901 - protein, 337 aa, Geitlerinema sp. PCC 7105; identical to SEQ ID NO: 4594

SEQ ID NO: 4902 - protein, 355 aa, Prochlorothrix hollandica; identical to SEQ ID NO: 4595

SEQ ID NO: 4903 - protein, 347 aa, Oscillatoria sp. PCC 10802; identical to SEQ ID NO: 4596

SEQ ID NO: 4904 - protein, 335 aa, Scytonema hofmannii; identical to SEQ ID NO: 4597

SEQ ID NO: 4905 - protein, 350 aa, Scytonema hofmannii; identical to SEQ ID NO: 4598

SEQ ID NO: 4906 - protein, 344 aa, euryarchaeote SCGC AAA261-G15; identical to SEQ ID NO: 4599

SEQ ID NO: 4907 - protein, 353 aa, Desulfurispora thermophila; identical to SEQ ID NO: 4600

SEQ ID NO: 4908 - protein, 335 aa, filamentous cyanobacterium ESFC-1; identical to SEQ ID NO: 4601

SEQ ID NO: 4909 - protein, 334 aa, filamentous cyanobacterium ESFC-1; identical to SEQ ID NO: 4602

SEQ ID NO: 4910 - protein, 333 aa, Neomegalonema perideroedes; identical to SEQ ID NO: 4603

SEQ ID NO: 4911 - protein, 335 aa, Thermobrachium celere; identical to SEQ ID NO: 4445

SEQ ID NO: 4912 - protein, 341 aa, Calothrix sp. PCC 7103; identical to SEQ ID NO: 4605

SEQ ID NO: 4913 - protein, 327 aa, Pleurocapsa sp. PCC 7319; identical to SEQ ID NO: 4606

SEQ ID NO: 4914 - protein, 341 aa, Sulfolobales archaeon Acd1; identical to SEQ ID NO: 4607

SEQ ID NO: 4915 - protein, 328 aa, Halarchaeum acidiphilum; identical to SEQ ID NO: 4472

SEQ ID NO: 4916 - protein, 327 aa, Lamprocystis purpurea; identical to SEQ ID NO: 4609

SEQ ID NO: 4917 - protein, 327 aa, Thiofilum flexile; identical to SEQ ID NO: 4610

SEQ ID NO: 4918 - protein, 335 aa, Thauera terpenica; identical to SEQ ID NO: 4468

SEQ ID NO: 4919 - protein, 295 aa, Escherichia coli; identical to SEQ ID NO: 4612

SEQ ID NO: 4920 - protein, 686 aa, Escherichia coli; identical to SEQ ID NO: 4613

SEQ ID NO: 4921 - protein, 327 aa, Laceyella sediminis; identical to SEQ ID NO: 4614

SEQ ID NO: 4922 - protein, 196 aa, Cetobacterium; identical to SEQ ID NO: 4470

SEQ ID NO: 4923 - protein, 341 aa, Lyngbya aestuarii; identical to SEQ ID NO: 4469

SEQ ID NO: 4924 - protein, 335 aa, Leptolyngbya sp. Heron Island J; identical to SEQ ID NO: 4471

SEQ ID NO: 4925 - protein, 335 aa, Gloeobacter kilaueensis; identical to SEQ ID NO: 4423

SEQ ID NO: 4926 - protein, 290 aa, Escherichia coli; identical to SEQ ID NO: 4619

SEQ ID NO: 4927 - protein, 615 aa, Shigella flexneri; identical to SEQ ID NO: 4620

SEQ ID NO: 4928 - protein, 330 aa, Herpetosiphon aurantiacus DSM 785; identical to SEQ ID NO: 4378

SEQ ID NO: 4929 - protein, 335 aa, Microcystis aeruginosa NIES-843; identical to SEQ ID NO: 4429

SEQ ID NO: 4930 - protein, 329 aa, Synechococcus sp. PCC 7002; identical to SEQ ID NO: 4379

SEQ ID NO: 4931 - protein, 342 aa, Nostoc punctiforme PCC 73102; identical to SEQ ID NO: 4380

SEQ ID NO: 4932 - protein, 356 aa, Cyanothece sp. PCC 8801; identical to SEQ ID NO: 4381

SEQ ID NO: 4933 - protein, 338 aa, Cyanothece sp. PCC 7424; identical to SEQ ID NO: 4382

SEQ ID NO: 4934 - protein, 84 aa, Methylobacterium extorquens CM4; identical to SEQ ID NO: 4383

SEQ ID NO: 4935 - protein, 328 aa, Methanosphaerula palustris E1-9c; identical to SEQ ID NO: 4384

SEQ ID NO: 4936 - protein, 334 aa, Cyanothece sp. PCC 7425; identical to SEQ ID NO: 4385

SEQ ID NO: 4937 - protein, 329 aa, Halorubrum lacusprofundi ATCC 49239; identical to SEQ ID NO: 4386

SEQ ID NO: 4938 - protein, 73 aa, Eubacterium eligens ATCC 27750; identical to SEQ ID NO: 4387

SEQ ID NO: 4939 - protein, 131 aa, Methylobacterium extorquens AM1; identical to SEQ ID NO: 4388

SEQ ID NO: 4940 - protein, 356 aa, Cyanothece sp. PCC 8802; identical to SEQ ID NO: 4389

SEQ ID NO: 4941 - protein, 315 aa, Ammonifex degensii KC4; identical to SEQ ID NO: 4390

SEQ ID NO: 4942 - protein, 348 aa, Methanocaldococcus vulcanius M7; identical to SEQ ID NO: 4391

SEQ ID NO: 4943 - protein, 344 aa, Sulfolobus islandicus L.D.8.5; identical to SEQ ID NO: 4392

SEQ ID NO: 4944 - protein, 332 aa, Nitrosococcus halophilus Nc 4; identical to SEQ ID NO: 4393

SEQ ID NO: 4945 - protein, 315 aa, Acetohalobium arabaticum DSM 5501; identical to SEQ ID NO: 4394

SEQ ID NO: 4946 - protein, 330 aa, Cyanothece sp. PCC 7822; identical to SEQ ID NO: 4395

SEQ ID NO: 4947 - protein, 350 aa, Methanotorris igneus Kol 5; identical to SEQ ID NO: 4397

SEQ ID NO: 4948 - protein, 354 aa, Methanothermococcus okinawensis IH1; identical to SEQ ID NO: 4398

SEQ ID NO: 4949 - protein, 327 aa, Caldicellulosiruptor lactoaceticus 6A; identical to SEQ ID NO: 4400

SEQ ID NO: 4950 - protein, 316 aa, halophilic archaeon DL31; identical to SEQ ID NO: 4401

SEQ ID NO: 4951 - protein, 381 aa, Candidatus Chloracidobacterium thermophilum B; identical to SEQ ID NO: 4556

SEQ ID NO: 4952 - protein, 313 aa, Caldilinea aerophila DSM 14535 = NBRC 104270; identical to SEQ ID NO: 4430

SEQ ID NO: 4953 - protein, 340 aa, Sulfolobus islandicus HVE10/4; identical to SEQ ID NO: 4396

SEQ ID NO: 4954 - protein, 329 aa, Haloquadratum walsbyi C23; identical to SEQ ID NO: 4435

SEQ ID NO: 4955 - protein, 324 aa, Spirochaeta thermophila DSM 6578; identical to SEQ ID NO: 4399

SEQ ID NO: 4956 - protein, 313 aa, Thermacetogenium phaeum DSM 12270; identical to SEQ ID NO: 4402

SEQ ID NO: 4957 - protein, 347 aa, Anabaena sp. 90; identical to SEQ ID NO: 4403

SEQ ID NO: 4958 - protein, 345 aa, Nostoc sp. PCC 7107; identical to SEQ ID NO: 4406

SEQ ID NO: 4959 - protein, 347 aa, Rivularia sp. PCC 7116; identical to SEQ ID NO: 4408

SEQ ID NO: 4960 - protein, 334 aa, Calothrix sp. PCC 7507; identical to SEQ ID NO: 4404

SEQ ID NO: 4961 - protein, 342 aa, Calothrix sp. PCC 7507; identical to SEQ ID NO: 4405

SEQ ID NO: 4962 - protein, 344 aa, Nostoc sp. PCC 7524; identical to SEQ ID NO: 4407

SEQ ID NO: 4963 - protein, 344 aa, Pleurocapsa sp. PCC 7327; identical to SEQ ID NO: 4409

SEQ ID NO: 4964 - protein, 328 aa, Oscillatoria acuminata PCC 6304; identical to SEQ ID NO: 4410

SEQ ID NO: 4965 - protein, 341 aa, Oscillatoria acuminata PCC 6304; identical to SEQ ID NO: 4411

SEQ ID NO: 4966 - protein, 338 aa, Oscillatoria nigro-viridis PCC 7112; identical to SEQ ID NO: 4413

SEQ ID NO: 4967 - protein, 339 aa, Gloeocapsa sp. PCC 7428; identical to SEQ ID NO: 4415

SEQ ID NO: 4968 - protein, 341 aa, Calothrix sp. PCC 6303; identical to SEQ ID NO: 4412

SEQ ID NO: 4969 - protein, 332 aa, Crinalium epipsammum PCC 9333; identical to SEQ ID NO: 4414

SEQ ID NO: 4970 - protein, 333 aa, Stanieria cyanosphaera PCC 7437; identical to SEQ ID NO: 4416

SEQ ID NO: 4971 - protein, 336 aa, Anabaena cylindrica PCC 7122; identical to SEQ ID NO: 4418

SEQ ID NO: 4972 - protein, 337 aa, Halothece sp. PCC 7418; identical to SEQ ID NO: 4417

SEQ ID NO: 4973 - protein, 351 aa, Sulfolobus acidocaldarius N8; identical to SEQ ID NO: 4373

SEQ ID NO: 4974 - protein, 351 aa, Sulfolobus acidocaldarius Ron12/I; identical to SEQ ID NO: 4373

SEQ ID NO: 4975 - protein, 329 aa, Synechocystis sp. PCC 6803; identical to SEQ ID NO: 4421

SEQ ID NO: 4976 - protein, 73 aa, Eubacterium rectale DSM 17629; identical to SEQ ID NO: 4387

SEQ ID NO: 4977 - protein, 340 aa, Sulfolobus islandicus LAL14/1; identical to SEQ ID NO: 4422

SEQ ID NO: 4978 - protein, 335 aa, Gloeobacter kilaueensis JS1; identical to SEQ ID NO: 4423

SEQ ID NO: 4979 - protein, 310 aa, Picrophilus torridus DSM 9790; identical to SEQ ID NO: 4372

SEQ ID NO: 4980 - protein, 351 aa, Sulfolobus acidocaldarius DSM 639; identical to SEQ ID NO: 4373

SEQ ID NO: 4981 - protein, 338 aa, Anabaena variabilis ATCC 29413; identical to SEQ ID NO: 4374

SEQ ID NO: 4982 - protein, 329 aa, Natronomonas pharaonis DSM 2160; identical to SEQ ID NO: 4431

SEQ ID NO: 4983 - protein, 335 aa, Methanospirillum hungatei JF-1; identical to SEQ ID NO: 4375

SEQ ID NO: 4984 - protein, 329 aa, Methanothrix thermoacetophila PT; identical to SEQ ID NO: 4376

SEQ ID NO: 4985 - protein, 374 aa, Thermofilum pendens Hrk 5; identical to SEQ ID NO: 4377

SEQ ID NO: 4986 - protein, 219 aa, Picrophilus torridus DSM 9790
MIYWSEITNISPVQYYTVQSSGGMLTGPFIGDLALDYASAYSLGELDYHKLDMKRPNYNEIKNFSILWSVAVPENVIKNNIFSVNYMKMMYRNTMLGIDYNGTNLNPAYRVGSYMYKNFYFVQPIRPGNKFYAAVKTDLGIEKLPAALRVGNGKTGLLKIKYKSVNMEDLNNIYINLFTIKNIFNKDFNVDNLHIYYVLNHYVMAGPVTGGVMHELYKL

SEQ ID NO: 4987 - protein, 255 aa, Sulfolobus acidocaldarius DSM 639
MRVLEAQFTLEGVLIFSTEVRPAVSQGQAKGSYINPLPYIHNYPVMYGLMGKSAEAYFVIPSLHEKTYAGKVGLRYTSISDMISKFKRGQEDSLYAFPLMPKRIKTMSFLMSSESWSYALPVRGRIKNVYPRLTSYTAFAPESVFFTYLIVVGNPPLPKWIRIGKKRWGIMRVDVKEIQDFKVEKVKDEVTNIPVNIKDAEEFGYKIKSSSKLIETPNIEEGVIGWATLDECVQIVTRGSKICLPIPEGVYNSAM

SEQ ID NO: 4988 - protein, 235 aa, Trichormus variabilis ATCC 29413
MVLIYRCQLQLHDSLYYATREIGRLYETEPIIHNYALCYALGLIDSEIYSTTVAEEHSYRYFCPEQVPKYEEHLTPLNQQGIYVTPALAISHSAILNTWKYANNNYHVEMEKTQKNIPSFGRAKEIAPESEFEFFVISQKQLKLPKWIRLGKWMSKAEVTVTELPKPKNTEGVFTCTHPLNPLDVMFTNQVISYDVVNMPPVSLIQNVQMRGQHYYFDDVKNLKIPARMEYRFRG

SEQ ID NO: 4989 - protein, 244 aa, Methanospirillum hungatei JF-1
MNNQSSVRAFEGVLEMMSELFFASLEPGNNYTTRPLILNTALYYALGYCSGRYVNVPVKKGSAKQNPTYVEDTASFYSKLYVSPAKPVKSIRFASEITNARSDEYIQYNTYEKQMNSPTGKYGVRKQILPGGKFVFFVLSFDGNEPDLPVYIRLGKKRSKASVTWSECPVTRKKGSFILNHPVLVDDLTQIPSRDISFKRMQPFDVIERGSFEGEYIQIQRGGKEKKEDVVFPASIRFLQRIRS

SEQ ID NO: 4990 - protein, 253 aa, Methanothrix thermoacetophila PT
MSESFPAVECTIETMDRTLYASREVGDLVDAGDYILNTALYYALGFTSGRYVNKGNRPSYIEDTSRIYSKLYITPARPEPAEEYTRRVWGFSRADVHVGGHSMGSWNARPHRYAVKNWSAQEDPSKGKNIPKFGRERVLDQQNLFTAYILLYEGDVGSLEIPRYIRLGKKRSKARVTTRIVKCEIGEGEFLSNHPFGIYDYEGVPIGDLISVRMRPVPLVIQARYKGRYVRIPDAGRGDVVLPYRLEFLKNRR

SEQ ID NO: 4991 - protein, 226 aa, Thermofilum pendens Hrk 5
MVFFYRAELRLKGFLWYHTLARATESFYTHSVVPVVHNYGLTLALAGYDADPAFGYVSIYGRKGYRSLLELFREHGVYAYPAIAKRAYTQEVIMSAIGESTVQAKGKGRLSYPDFTKNVVLAPGSILETLIVSEGELPSRFAVRIGAKRAGTLWVELTRVPVDIANNRKVTHPFNVNDVVRVDGYTVLLRHEAGDVGIFGVAEEAYVVPVRDSKTKEVVVPALKLE

SEQ ID NO: 4992 - protein, 253 aa, Herpetosiphon aurantiacus DSM 785
MAQIYRCRLVLLEPTFFSTREISNLYQTEAFIGHIALAYALGLAPSRYANDGKTIYYQQDLAALNQAGVYLTPATITSQARFSLGQFNAQAESYWFAMGNNAIITAPEGTWAERNGSSWYINDGVSTPKKVRVENRPQFGRIRALAIGTTAEFYAISQHELSLPSYLRLGKWMSKASLASQAVAISGESDGGVIPFLLAGADLSPDCRLLAFDVLHVPPTPLIRHSHVQGPCYQLDEKILLPKDMAFNLEAFK

SEQ ID NO: 4993 - protein, 251 aa, Synechococcus sp. PCC 7002
MTKIYRCKLTLHDNVFFASREMGILYETEKYFHNWALSYAFFKGTIIPHPYGLVGGNAQKPAYLDRDREQNLLHLNDSGIYVFPAQPVHWSYQINTFKAAQSAYYGRSVQFGGKGATKNYPINYGRAKELAVGSEFLTYVVSQRELDLPVWIRLGKWSSKIRVEVEAITSEKIISESGVYICSHPLNPLDCPETQQILLYNRVVMPPSSLLSQSQLEGNFWKIGRDLCLPQDFSYGAGTIVKESAMESSHA

SEQ ID NO: 4994 - protein, 252 aa, Nostoc punctiforme PCC 73102
MSTIPFQQAKLVELYCLEPVFFASRELSDTYYTEGVIGNYALTYALGRVNSPYRLQGQATGRPTYKEDFQPIAQDFYILPASPVGRVTFRFERFNALSDAYWYAMTNNRVATAREDLPLQRQGKKPSSFRPSNFPQTGRLRMIERRNKFQTLVFGNHQLPTYIRLGKFMSKVQVNVLNEFPVTLLPEGEYQSQHYLNAADLPQQIEALAFDLISIPPAPIIKNLHFRGAAWQIGEMIVPAGLHFCGRESSNE

SEQ ID NO: 4995 - protein, 258 aa, Rippkaea orientalis PCC 8801
MNIYYCQLTLHDNIFFATREMGLLYETEKYLHNWALSYAFFKGTYIPHPYRLQGKSAQKPNYLDSTGEQSLAHLNRLKIYVFPAKPLRWSYQINTFKAAQTTYYGKSQQFGDKGANRNYPINYGRAKELAVGSEYHTFLISSQELNIPHWIRVGKWSAKVEVKPYLIPQKAISQHSGTYLCDHPLNPIDLPFNQELLLYNRIVMPPVSLVSQAQLQGNYSKINKNNWNDCPSDLTDLPQQICLPLGVNYGAGYIASAS

SEQ ID NO: 4996 - protein, 253 aa, Gloeothece citriformis PCC 7424
MKIYLCLLTLHDNVFFATREMGILFETEKYLHNWALSYALFKGIVIPHPYRLQGDLAQKPDYLDESREQNLIHLNQAKIYVFPAKPIIWSYQINTFKAAQVSYYGKSEQFEAPNYPKNYGRAKELAVGSQYHTYLIASDTVTIPQWIRLGKWSAKVHVQAFLIPDTAIKSLSGDYICDHPLNPIDLSPDTQLILYNRIVMPPVSLITQAQLQGNYWQLSGDDWKALKSSIPHLPNQVNLPQGVMYGAKQLITA

SEQ ID NO: 4997 - protein, 249 aa, Methanosphaerula palustris E1-9c
MQTIHAGVKMRNLRGLRVYEGVLELMGELFFATLEPGNRYVTKPLILNTALYYALGYAQGLYVNRTAGRSKRQRPTYREDTAALADRVYVSVARPITPLRLTTENANACGDDYVQPNHPKKQINSPTGKMGTRTQIQPGARFRFFVMSFDGSEPGLPAYIRIGKKRTKALIEWTALSVQQKTGLFMMNHPVLVDDLARMPVGDLRFSRMIPFDVIEQGCFEGPFCSFVCSNGDPIKFPTDLRFLQRGRV

SEQ ID NO: 4998 - protein, 261 aa, Cyanothece sp. PCC 7425
MVIYRCNLTLHDNVFFATREMGILYETEKYLHNWALSFALFEATHIPKPYRLQGAIAQRPGYLEADNEQNLLVLNHAGIYVFPALPLQWSYQVNTFKAAQVPYYGKSKQFGDKGADRNYPINYGRAKELAVGSTYRTYILAPEPIQIPHWIRLGKWAAKIQVDARPIPNCGIRQRSGEYTCDHPLNPIDLSGSTRLLLYNRIVMPPASLVSQSRVSGDYWEISKPSNWTEFPDWSDLKDIPNQVCLPSGVAYGASTAIAAS

SEQ ID NO: 4999 - protein, 248 aa, Halorubrum lacusprofundi ATCC 49239
MQVIEATLTTHGKVGFASREVGRMTDTDSCILNTALHYALDLAGGRYVDVSHQPTYIEDTAEIVNDVYVSPAAPARIERNESIKTEYITTNRNARSDTYATPNYPAADDPTGKSKKNLPTFERERALAPENVFRFYVFPYGRDATEVVSQLPSYIRLGKKRGKGHVRYRIVDGARRSGEFTLGHPLSVYDHETTPTGGVVMKQMQPTPVWFEAEFDTEYYAIEPPFRNQSRVCYPADAKFLATKRNDV

SEQ ID NO: 5000 - protein, 258 aa, Rippkaea orientalis PCC 8802
MNIYYCQLTLHDNIFFATREMGLLYETEKYLHNWALSYAFFKGTYIPHPYRLQGKSAQKPDYLDSTGEQSLAHLNRLKIYVFPAKPLRWSYQINTFKAAQTTYYGKSQQFGDKGANRNYPINYGRAKELAVGSEYHTFLISSQELNIPHWIRVGKWSAKVEVTSYLIPQKAISQHSGIYLCDHPLNPIDLPFDQELLLYNRIVMPPVSLVSQAQLQGNYCKINKNNWNDCPSNLTDLPQQICLPLGVNYGAGYIASAS

SEQ ID NO: 5001 - protein, 210 aa, Methanocaldococcus vulcanius M7
MLRYYKITLLSPLFCYNKTEGGVASTEPFIGDIALDYALNFVLAKKREYTYQIKDKPNYEEIKEFGFVWTIGRPIYYEKTPIFARKTSEISDYMVRRDIIEQMGKGLFKNYFHIQGIKEGSVFEASLLTFEDIKLPKTFTLRIGVGRECLLLFEEKEEKPEEIWLNLYTIKKIFGKDVKLKESQMLRFVLSHYIIGTGFKVEDLEKIFSN

SEQ ID NO: 5002 - protein, 252 aa, Sulfolobus islandicus L.D.8.5
MIFEATFTLEGILIFSSELRPMISAGESMGSYITPSPYIHNYPVMYGMLNKPVEAYFVLSSLHEAEYKGKKGLSYTSISNLLDDFLNGKEKSFYVFPLIPKKLNIMSFLMSSESWTYGLVRLKTKNVFPRLTSYSAFSVGSEFFSYVFTIGNIDLPKWIRIGKKRWGIMKVKYNKIEPKRVEILEQITASIPINLHDAEYFGYRYDLPETVMRTPSIREGAIAWAKLDRCFSISYEGRSICLPLPDHQKWLR

SEQ ID NO: 5003 - protein, 234 aa, Acetohalobium arabaticum DSM 5501
MEQERKVYHVELELLENTFFASREIYNYYETEPLLGHFALAYALGLCQGTYSQPKKPLYQEHFTDLNDKGIYLTPATVIGRPKFIIQNFNTLSDSYWYSFENNAVESDRSKDRTSASNFPQQGRAKMLATGNQFSFYLFSRDELELPRYIRLGKFMSKAKVKQKKVNYELQEVEQKKIRRVLSPLDFGEKVEMHSYDTINIRPTPLIKNSILSGKMLYIKQSDEYLPADMSYGV

SEQ ID NO: 5004 - protein, 259 aa, Gloeothece verrucosa PCC 7822
MKLYHCLLTLHDNVFFASREMGILYETEKYLHNWALSYAFFKVTYIPHPYRLQGEAAQKPNYLNDNNEQNLNHLNRAGVYVFPAKPLYWSYQVNTFKAAQSAYYGRFKKFGEDEAVKNYPFNYGRAKELAVGSQYRTYIMAKNEISEEIPHWIRLGKWSAKIEVSIIPIPESLIQNKSGEYLCDHPLNPLDLSDTTQLQLYNRIVMPPVSLVSQAQLQGNYYSVLGDNWKEFKQNFPSLPEQIYLPKGAFYGARYMANV

SEQ ID NO: 5005 - protein, 261 aa, Sulfolobus islandicus HVE10/4
MTSMKLYKANFYLQGVLIFSSEVRPMISASSAMGSYISPSPHIHNYPIMYGMLGKPAEAYFVFPSLHYLSFTERKGRTTKTNKGLQYTSIKKLLDDFKKGKDSFYVFPLLPVKFTVSSFLLSAESWSYVLPTRSSTKNVFPRITSYSAFMPGSIFTTYVLTQGNVKLPQWIRIGKKRWGIFKVEYEEVKVKKVEKRSNELTTIPINYSDAEYFGFKIKSFSKVLETPNVEEGMIGWAELEECQVINNQICLPINWQSEEKK

SEQ ID NO: 5006 - protein, 210 aa, Methanotorris igneus Kol 5
MLRHYKITLLSPLFCYNKTEGGVASTEPFIGDIALDYALNFALAKKREYTYQIKDKPDYDEIKEFGFIWTIGRPIYYEKTPIFARKTSEISDYMVRRDIIEQMGKGLFKNYFHIQGIKEGSVFEASLLTFEDIKLPKTFTLRIGVGRECLLLFEEKKEKPEEIWLNLYTIKKIFGKDVKLKESQMLRFVLSHYIIGTGFKVEDLEKIFSN

SEQ ID NO: 5007 - protein, 147 aa, Methanothermococcus okinawensis IH1
MLKHYKITLLSPLFSYNRTEGGVASTEPFIGDIALDYALNFNLAMKREYTYQMKDKPNYEEIKEFGFFWTIGRPILVEKTPIYARKTSEISDYMVRKNIIEKMGKGLFKNYFHIQGIKGGSIFEASLWINDKSINLPKKIHTKNRNG

SEQ ID NO: 5008 - protein, 214 aa, Caldicellulosiruptor lactoaceticus 6A
MYIGQIRLELLDFLFFSSLEYGNYYKTSLYLHNYALCYALGLCPQRYFIQIDKTHYKEDLKNLAKQGIYTYPAKWVGDFTEFQFNSMRDDYLLSREQNSPYPIHGFIKTIAPMSFTITYIVAPEKLNLPSRIRLGKWETLTNVEVEWFKAEKVSKKDFLYQGVLNYFDLVHKPTAFNITELSLPNRLIENCFFENTILITADKIELPLCSFENI

SEQ ID NO: 5009 - protein, 234 aa, halophilic archaeon DL31
MIEQTFRATLYAPLFYSSSEGRAIRTQPTLSSTALMHALGYRYFELEKRYAEFGEDATTADYTHLRELPFFVSDMCPIAVEMDERTFRSTDYRSERHFTTNDSDIAKQVSGSKSVPEILEKSGAAYQTIRNYIGITPGSTFEFTVWSETGLPDHPFFRMGIKQTGEFRAEPVELDTLVLNKYLLSEVYDLSDELLTNLVEHSQGFKRGNDPRLQHFVGVEPKFVRDQVLSEVLV

SEQ ID NO: 5010 - protein, 235 aa, Anabaena sp. 90
MVFIYRCQLELHDSLYFATREIGRLYETEAIIHNYALCYALGLVDSQIYSTTVAEEDSYRYFCPEQVPKYEAHLTPLNEQGIYITPARSLRHSSILNTWKYANNNYHVEMEKTQKNIPSFGRAKEIAPESQFEFFLISQKEIKLPKWIRLGKWMSKAEITVEKLPQPKIKTDLFTCTHPLNPLDVMFTNQVISYDVVNMPPVSLIQNVQIQGEYYYFDDIKKVKLPKLMQYRFRS

SEQ ID NO: 5011 - protein, 263 aa, Calothrix sp. PCC 7507
MALYHCTLTLHDNVFFATREMGILYETEKYLHNWGLSFALFTINYIPQPYRLQGELAQKPTYLDISAEQNLLHLNQAGIYVFPAQPISWSYQINTFKAAQVGYYGKSKQFGDKGADKNYPINYGKAKELAVGSQYRTYIIAPETIKLPRWIRLGKWASKIRVEAIKIPDKVMQNKSGDYTCLHPLNPLDLPTSTRILLYNRIVMPPVSLVSQAQLHGEYLVTKKDDWQDFKSTLTTQQSQQLPEEIYLPTGIFYGAGNVVAAA

SEQ ID NO: 5012 - protein, 252 aa, Calothrix sp. PCC 7507
MSTIPFQQAKLVELYCLEPVFFASRELSDTYYTEGVIGNYALTYALGWVNSPYRLQGQATGRPTYKEDLQPIAQDFYILPASPVGRVTFRFERFNALSDSYWYAMTNNRVATAREDLPLQRQGKKPSSFRPSNFPQTGRLRMIERRNKFQTLVFGNYQLPNYIRLGKFMSKVKVNVLNEFPVTLLPESEYQSQHYLNAADLPQQIEALAFDLISIPPAPIIKNLRFRGAAWQVGEMVIPAGLHFCGRESNNE

SEQ ID NO: 5013 - protein, 252 aa, Nostoc sp. PCC 7107
MSTIPFQQAKLVELYCLEPVFFASRELSDTYYTEGVIGNYALTYALGKVNSPYRLQGQATGRPTYKEDFQPIAQDFYILPASPVGRVTFRFERFNALSDSYWYAMTNNRVATAREDLPLQRQGKKPSSFRPSNFPQTGRLRMIERRNKFQTLVFGNNQLPNYIRLGKFMSKVKVNVLNEFPVTLLPEGEYQSQHYLNAADLPQKIEALAFDLISIPPAPIIKNLRFRGAAWQVGEMIVPAGLHFCGRESNNE

SEQ ID NO: 5014 - protein, 235 aa, Nostoc sp. PCC 7524
MVLIYRCQLELHDSLYYATREIGRLYETEPIIHNYALCYALGLVDSEIYYTTVSEEHSYRYFCPEQVPKYEEHLTPLNQQGIYVTPALAISHSAILNTWKYANNNYHVEMEKTQKNIPSFGRAKEIAPESEFEFFVISQKELKLPKWIRLGKWMSKAEVTVEELPKPKNTEGLFTCTHPLNPLDVMFTHQVISYDVVNMPPVSLIQNVQMRGQYYCFDDVKNLKIPARMEYRFKG

SEQ ID NO: 5015 - protein, 243 aa, Rivularia sp. PCC 7116
MTIIYCCQLELHDSVYFATREIGRLYETEPVIHNYALCYALGLVDSEIYATTVSEEHSYRYFCPEQVPKYEEHLTPLNQQGIYVTPAHSIHHTSVLNTWKYANNNYHVEMQKTQKNIPSFGRAKEIAPESQFEFFIISKNDIELKGKLPKWIRLGKWMSKAEVEIQQVAKLESKTGDFTFPYPLNPLDVMFTNQVISYDVVNMPPVSLIQNVTITKGEFFQFENPFTSQKLKLPAKMAYRFKG

SEQ ID NO: 5016 - protein, 261 aa, Pleurocapsa sp. PCC 7327
MQQLELSLNPAKKTSRPTYTKAQLIELWCAEPVFFASRELSDTYYTEGVIGNYALAYGFGWARSPYRLTGAATGRPTYIEDLSPLDCYVLPAWSDKVSFRFERFNALSDAYWYEMTNNHVATSREDLPLKRTGKRPNTYRPSNFPQTGRLRAIERGNSFQTIVFGKRELPEYIRLGKFMSKVRVRILKDLEIVSLPMGKYDSKTYLNSADLPNINLLAFDLVNMPPVSLLKNLRFRGEAWQVGEFIVPANLKFCGGDRNNG

SEQ ID NO: 5017 - protein, 256 aa, Oscillatoria acuminata PCC 6304
MVLYYCRLKLHDNVFFATREMGILYETEKYLHNWALTYAIFSGSYLPHPYHSQPAQQPGYLDPKNEQNLFFLNPEKIYVFPALPLRCFYQVNTFKAAQTTYYGKSKQFGEKGANRNYPINYGRAKELAVGSEYATYLFAPEPLYIPQWIRLGKWMAKVHLTKYPIPKTAMQAKTGEYACPHPLNPLDLPSQQQIMLYNRIVMPPVSLITESQLVGEYWELSGDDWDSFRANLPELPKKVCLPRGIIYGAGVTADVR

SEQ ID NO: 5018 - protein, 262 aa, Oscillatoria acuminata PCC 6304
MSLLTTIENIPANLPLFEQARLVELWCAEPVFFASRELSDAYYTEGVLGNYALAYALGWVRSPYRLSGTATWRPTYLEDLGTLFDCYVLPAWPKQGKVTFRWERFNALSDSYWYAMTNNRVATSREDLPVQREGKKPNSFRPSNFPQSGRLRTIARGNVFQTLVFGDRELPDYIRVGKFMSKVRVEVISKLKQVPLSEGMYQSSAYLNTADLPANLQMLSFDLISIPPAPLVKNLRFQGAAWQFGEIIVPIGIGFCSGGIQS

SEQ ID NO: 5019 - protein, 235 aa, Calothrix sp. PCC 6303
MTIIYRCQIELHDSVYYATREIGRLYETEPIIHNYALCYALGLVDSEKYATTVSEEHSYRYFCPEQVPKYEEHLTPLNKQGIYVTPACSISHTSILNTWKYANNNYHVEMEKTQKNIPSFGRAKEIAPESVFEFLIISQNELKLPKWIRLGKWMSKAEVTVEKLPEPKTKTDLFICTHPLNPLDVMFTNQVISYDVINMPPVSLIQNVQMRGQYYYFENVKDVRLPVNISYRFRN

SEQ ID NO: 5020 - protein, 267 aa, Oscillatoria nigro-viridis PCC 7112
MPQLELFRTSFTSIIAYQTARLVELWCAEPVFFASRELSDTYYTEGAIGNYALAYALGWARSPYRLTGQDTSRPRYIEDLTPLSGNSYILPAWPAGGTLSFRFERFNALSDSYWYAMTNNRVATAREDLPLSRTGKKPSTYRPSNFPQTGRLRVIERGNRFQTLVFGDRELPEYIRVGKFTSKVRVEIVKKLDFVQLPRGDYRCNTYLSAADLPANIELLAFDLISMPPASLLKNLSFRGEALQAGDFILPANLEFCGGNNNGSSEN

SEQ ID NO: 5021 - protein, 221 aa, Crinalium epipsammum PCC 9333
MHIYQLCLTLQDPLYFATRELGRLYATENYLHNYALTYALGLAKSCYHDAEHIPHYQEDLEPLNKRGIYVTPARPVNFAYVTHTYKWADLRYQVKMEQSSVNLPTFGRIRELAPESTFEAYLLASEPVKLPQWIRLGKWMSKVQVKMKELPKHKQSEGIFTVEFPLNPLDTMFTNQLLSYDVVNMPPVSLIRNVQMRGRYYQFDELKGLKIPVSMEYRFQA

SEQ ID NO: 5022 - protein, 263 aa, Microcoleus sp. PCC 7113
MPQLEISPTSSDANLPFQTARLIELWCAEPVFFASRELSDTYYTEGAIGNYALAYALGWARSPYRLTGKDTGRPRYLEDLTPLAEQCYILPAYPVEGGISFRFERFNALSDSYWYAMTNNRVATAREDLPLKRTGKKPNTFRPSNFPQTGRLRVIERGSRFQTLVFGNRELPEYIRIGKFTSKVRIDVVRELTITLLPVADYCCNVYLSAADIPNNLELFTFDLISIPPVSLLKNLRFHGAAWKVGDFTLPANLKFCGGRTDE

SEQ ID NO: 5023 - protein, 235 aa, Cylindrospermum stagnale PCC 7417
MAIIYRCQLELHDSLYFATREIGRLYETEPIIHNYALCYALGLVDSKIYSTTVVEEDAYRYFCSEQVPKYEQHLTPLNEQGIYLTPARAISHSAVLNTWKYANNNYHVEMEKTQKNIPSFGRAKEIAPESKFEFFLIAQKQLKLPKWIRLGKWMSKAELMVEALPKPKIHEGLFTCTHPLNPLDVMFSNQVISYDVVNMPPVSLIQNVQMRGQYYQFDGSKELKIPVRMEYRFGS

SEQ ID NO: 5024 - protein, 234 aa, Gloeocapsa sp. PCC 7428
MALIYRCQLELHDSLYYATREIGRLYETEPVIHNYALCYALGLVDSEVYSTTVAEEHSYRYFCPEQIPKYKEHLTPLNQQGIYVTPARSIEHTAMLNTWKYANNNYHVEMEKTQKNIPSFGRAKEVAPESLFEFFVICQKEIQLPKWIRLGKWMSKAEVKQLDYLEVKTSTTEENFTFPYPLNPLDVMFTHQIINYDVVNMPPVSLIQNIRIQGHCYQYKHLQIPARMQYRFHG

SEQ ID NO: 5025 - protein, 234 aa, Stanieria cyanosphaera PCC 7437
MTTIYRCQLELHDSLYFATREIGRLYETEPILHNYALCYALGLIDSKKYATNVAEEHSYRYFSAEQMPQYKQHLTPLNQQKIYVTPAKSLNHTSVLNTWKYANNNYHVEMEKTQKNIPSFGRAKEIAVESQFEFFIISESPLNFPQWKWIRLGKWMSKAQVIFEQLTSIKAHQGLFTCIHPLNPLDVMFTNQVFSYDVINMPPVSLIQNAQIQGQFYQIDNNLKIPVNMQYRFS

SEQ ID NO: 5026 - protein, 246 aa, Halothece sp. PCC 7418
MTHIYRCQIELQDSLYFATRELGRLYETEPILHNYALTYALGFVDSETYGTTVSKEESYRYFCSEQIPQYEQHLTPLNQQEIYVTPAYPVSHATVLNTWKYADNRYHVEMQKTQKNIPSYGRTKEITPESIFECYIISEQSLQKETTSQKWQWRLPKFIRLGKWMSKAELFLEELSVAKKYSNQTFTYPHPLNPLDVMFTNQVISYDVVNMPPVSLICNVNLRGDYYTFTNDSSLKLPINMAYQFG

SEQ ID NO: 5027 - protein, 235 aa, Anabaena cylindrica PCC 7122
MTIIYCCQLELHDSLYFATREIGRLYETEPIIHNYALCYALGLVDSPFYSTTVAEEDSYRYFCPEQVPKYEQHLTPLNEQGIYITPARSLNHTAILNTWKYANNNYHVEMEKTQKNIPSFGRAKEIAPESKFEFFLIAQKEIKLPKWIRLGKWMSKAEVRVEKLPQPKTKTDVFTCTHPLNPLDVMFTNQVISYDVVNMPPVSLIQNVQMRGEYYYFDDVKNVKLPKQMQYRFRS

SEQ ID NO: 5028 - protein, 1144 aa, Blattabacterium sp. (Blatta orientalis) str. Tarazona
MSKIFREYKKLDLKKISAEIYQYWKKNNISQKSFQSRNISEKKISTYILYEGPPSLNGSPGLHHMVARTIKDIFCRYHTIKGKKVIRKAGWDTHGLPIELNVEKKMGITKNDVGKNISIEEYNKLCKSFVNESMKEWINFTNRIGYWLDMRDPFITYNPKYIESVWWLIKTFYQKKILYKDYTIQPYSPAAGTGLSHHELNMPGTYKEVKQIAPTLKFKAKKETLPKEIRNFLGDIYFLSWTTTPWTLPSNTALAIGSNIDYLLVKIYNPYTFLKENIIFSERLIHKVLSPKKFYPVSNSSEFDHIKIKKNRFPYFIEYKFKGSKLIQSRYEQLLPWFKPHQEEEKAFRVIEGDYVNAIEGTGIVHVSPTFGIEDLKIAREHNIPSLLVLNQEKKLVPLVDMRGRFLKNFPHGFGGKYVKKDFDSKKNKKQVSVDQEIVSFLEKEKKLFQVEMYAHFYPHCWRTEKPILYYPLDSWFINTTQIKNKMILLNKRVNWYPKFIGKKRFESWLENVKNWNLSRSRYWGTPLPIWRTKNGNEEIVIGSIKELFMEIQKSIEHGFMHNIPWKNFTPGDMKDENYEKIDLHKHFLDKVILVSSQGEPMNREPDLIDVWFDSGAMPYAQFHYPFENKDFIDKNFFFPADFIAEGIDQTRGWFFTLHVISSILFNSKAYKNVISTGLVLDEKGHKMSKSKGNAINPFNLIEDYGPDAIRWYIVFNSEPWDNLKFNIKEIHTGINKFFGTLYNIYSFFVLYANIDGFYYKEEDCYSENNTELDFWILSELNTMIKIVDEHYSNYNPTKAARFIFYFVLDKLSNWYVRLCRRRFWKEKYTKSKISAYQILYKCLITVAKLISPITPFFSERLYMDLNSVTKKETFESIHLADFPVYNSNFINKELEERMALVQKITAMVFSVRKKNGIKIRQPLQKLLVLVHDSKIRFGLQKISEILKQEINVKEIEYPDSYKSLELKKRIQPNYRSLGPRFGNRTQKISEIIKRFTQKEIQEIEIKKKYVFFLQGEKVVLFLKDVKITTEIIKNWSILFDNELTIALDLRVTNSLWEEGVIRGLVRDIQKLRKKCNYEVLEKILIYINAIQKIKSLIQKHKDYICQETLAVDLLLEEDIEKKGIMVNFEENSIYILIRKVENI

SEQ ID NO: 5029 - protein, 255 aa, Sulfolobus acidocaldarius N8; identical to SEQ ID NO: 4987

SEQ ID NO: 5030 - protein, 255 aa, Sulfolobus acidocaldarius Ron12/I; identical to SEQ ID NO: 4987

SEQ ID NO: 5031 - protein, 254 aa, Synechocystis sp. PCC 6803
MTKIYRCKLTLHDNVFFASREMGILYETEKYFHNWALSYAFFKGTIIPHPYGLVGQNAQTPAYLDRDREQNLLHLNDSGIYVFPAQPIHWSYQINTFKAAQSAYYGRSVQFGGKGATKNYPINYGRAKELAVGSEFLTYIVSQKELDLPVWIRLGKWSSKIRVEVEAIAPDQIKTASGVYVCNHPLNPLDCPANQQILLYNRVVMPPSSLFSQSQLQGDYWQIDRNTFLPQGFHYGATTAIAQDSPQLSLLDTN

SEQ ID NO: 5032 - protein, 258 aa, Sulfolobus islandicus LAL14/1
MKLYKANFYLQGVLIFSSEVRPMISASSAMGSYISPSPHIHNYPIMYGMLGKPAEAYFVFPSLHYLSFTERKGRTTKTNKGLQYTSIKKLLDDFKKGKDSFYAFPLLPVKFTVSSFLLSAESWSYVLPTRSPTKNVFPRITSYSAFMPGSIFTTYVLTQGNVKLPQWIRIGKKRWGIFKVEYEEVKVKKVEKRSNELSTIPINYSDAEYFGFNIKSFSKVLETPNVEEGMIGWAELEECQVINNQICLPINWQSEEKK

SEQ ID NO: 5033 - protein, 236 aa, Gloeobacter kilaueensis JS1
MVFVHRYCFELHDSLYFATREIGRLYETEPILHNYALCYALGLVDSDRHGTRVPEAQGYRYFSAEQVPHYAVHLEALNRAGIYVTPARTLQHTTVLNTWKYGDNRYRVEMGKTQKNIPSFGRAKEVAPGSTFEFFLIASKPLDLPRWIRLGKWLSKAELTLVNVRPLEPARSETEFVCAAPLNPLDVMFSHSVLSYDTVNMPPVSLIRNVRLRGIALDCDGIKLPGRMQFRFSAPA

SEQ ID NO: 5034 - protein, 252 aa, Nostoc sp. PCC 7120 = FACHB-418
MSTILFQQAKLVELYCLEPVFFASRELSDTYYTEGVIGNYALTYALGRVNSPYRLQGQATGRPTYKEDLQPIAQDFYILPASPVGRVTFRFERFNALSDAYWYAMTNNRVATAREDLPLQRQGKKPSSFRPSNFPQTGRLRMIERRNKFQTLVFGNYQLPNYIRLGKFMSKVKVNVLNEFPVTLLPEGEYQSQHYLNAADLPQQIEALAFDLISIPPAPIIKNLHFRGAAWQVGEMIVPAGLHFCGRESNNE

SEQ ID NO: 5035 - protein, 254 aa, Synechocystis sp. PCC 6803; identical to SEQ ID NO: 5031

SEQ ID NO: 5036 - protein, 224 aa, Microcystis aeruginosa NIES-843
MVHIYSCQLELHDSLYYATREIGRLYESEPVIHNYALCYALGLVNSDSYRYFCSEQIPQYQEHLNPLNEEKIYVTPARAIVHTAVLNTWKYANNNYHVEMEKTQKNIPSFGRAKEIAPESVFECFIISHHPLQLPKWIRLGKWMSKAEVKLTELSLSKQKEDLFIYPYPLNPLDVMFTHQVIGYDVINMPPVSLIRNVRMRGEYYQISDRPDLKIPARLSYRFG

SEQ ID NO: 5037 - protein, 247 aa, Natronomonas pharaonis DSM 2160
MEVLEATLTTHGKVGFASREVGRMADTDPYILNTALHYALGLAGGNYVDVTHQPTYIEDTADIVDEVYVTPATPVAVESESIRTEYLTTNRNARADTYATPNYPAEDDPTGKASQNLPTFERERALAPGNHFRFYVFPYGRTAKSAKETLPSYIRLGKKRGKGRVRYRIVEAERKSGTFSLGHPLSIYDHDAQPLGGVVMRQMQPTPLWFEGKFEADHYAIESPTESADRVYYPAGAKFLATKRGDV

SEQ ID NO: 5038 - protein, 224 aa, Microcystis aeruginosa PCC 7806
MVHIYSCQLELHDNLYYATREIGRLYESEPVIHNYALCYALGLVNSDSYRYFCSEQIPQYQEHLNPLNEEKIYVTPARAIAHTAVLNTWKYANNNYHVEMEKTQKNIPSFGRAKEIAPESVFECFIISHHPLQLPKWIRLGKWMSKAEVKLTELSLSKQKEDLFIYPYPLNPLDVMFTHQVIGYDVINMPPVSLIRNVRMRGEYYQISDRPDLKIPARLSYHFG

SEQ ID NO: 5039 - protein, 263 aa, Kamptonema sp. PCC 6506
MLVYQCELTLLENTFFSSREINDLYLTEPLIGNYALAYALGLAQAPYRNRGEIYYYEHLSRLNQQEIYITPATIPEGHEPKFSFSQFNSVPDGYWYAMGKNCLVQRPDGYDSVYDTKNKVWYIVNRQTGKRTKEKAVNYPQVGFIKMMGIGTVLHFFVITTKELILPRYIRLGKFMSKARVAVTLYENPAIVSRQHQTVKYLLNPLDLPQGMQVTSYDTYNIHPVPLIRNANLTGHFMGLDNNLYLPAGMKFGIEFLQPSAAS

SEQ ID NO: 5040 - protein, 247 aa, Haloquadratum walsbyi C23
MEVLEATLTTHGKVGFASREVGRMADTDPYILNTALHYALNLAGGNYVDVMHQPTYIEDTANIVNEVYVTPAVPVAIKTESIRTEYLTTNRNARTDTYATPNYPAEDDPTGKANQNLPTFERERALAPGNHFRFYIFPYGRTAESVKETLPSYIRLGKKRGKGHVRYRIVNAERNSGQFSLGHPLSIYDHEAKPLGGVMMRQMQPTPLWFEGEFKSEHYAIESPAGSTERVCYPADAKFLATKRDDV

SEQ ID NO: 5041 - protein, 224 aa, Microcystis aeruginosa PCC 9432
MVHIYSCQLELHDSLYYATREIGRLYESEPVIHNYALCYALGLVNSDSYRYFCSEQIPQYQEHLNPLNEEKIYVTPARAIAHTAVLNTWKYANNNYHVEMEKTQKNIPSFGRAKEIAPESVFECFIISHHPLQLPKWIRLGKWMSKAEVKLTELSLSKQKEDLFIYPYPLNPLDVMFTHQVIGYDVINMPPVSLIRNVRMRGEYYQISDRPDLKIPARLSYHFG

SEQ ID NO: 5042 - protein, 224 aa, Microcystis aeruginosa PCC 9717
MVHIYSCQLELHDSLYYATREIGRLYESEPVIHNYALCYALGLVNSDSYRYFCSEQIPQYQEHLNPLNEEKIYVTPARAIVHTAVLNTWKYANNNYHVEMEKTQKNIPSFGRAKEIAPESVFECFIISHHPLQLPKWIRLGKWMSKAEVKLTELSLSKQKEDLFIYPYPLNPLDVMFTHQVIGYDVINMPPVSLIRNVRMRGEYYQISDRPDLKIPVRLSYHFG

SEQ ID NO: 5043 - protein, 224 aa, Microcystis aeruginosa PCC 9443
MVHIYSCQLELHDSLYYATREIGRLYESEPVIHNYALCYALGLVNSDSYRYFCSEQIPQYQEHLNPLNEEQIYVTPARAIAHTAVLNTWKYANNNYHVEMEKTQKNIPSFGRAKEIAPESVFECFIISHHPLQLPKWIRLGKWMSKAEVKLTELSLSKQKEDLFIYPYPLNPLDVMFTHEVIGYDVINMPPVSLIRNVRMRGEYYQISDHPDLKIPARLSYHFG

SEQ ID NO: 5044 - protein, 224 aa, Microcystis aeruginosa PCC 7941; identical to SEQ ID NO: 5041

SEQ ID NO: 5045 - protein, 224 aa, Microcystis aeruginosa PCC 9806
MVHIYSCQLELHDSLYYATREIGRLYETKPVIHNYALCYALGLVNSDSYRYFCCEQIPQYQEHLNPLNEEKIYVTPARAIIHTAVLNTWKYANNNYHVEMEKTKKNIPSFGRAKEITPESVFECFIISGHPLQLPKWIRLGKWMSKAEVKLTELSLSKQKEDLFIYPYPLNPLDVMFTHEVISYDVINMPPVSLIRNVQMCGEYYPISDRPDLKIPARLSYRFG

SEQ ID NO: 5046 - protein, 224 aa, Microcystis aeruginosa PCC 9807
MVHIYSCQLELHDSLYYATREIGRLYESEPVIHNYALCYALGLVNSDSYRYFCSEQIPQYQEHLNPLNEEQIYVTPARAIAHTAVLNTWKYANNNYHVEMEKTQKNIPSFGRAKEIAPESVFECFIISHHPLQLPKWIRLGKWMSKAEVKLTELSLSKQKEDLFIYPYPLNPLDVMFTHQVIGYDVINMPPVSLIRNVRMRGEYYQISDRPDLKIPARLSYHFG

SEQ ID NO: 5047 - protein, 224 aa, Microcystis aeruginosa PCC 9808
MVHIYSCQLELHDSLYYATREIGRLYESEPVIHNYALCYALGLVNSDSYRYFCSEQIPQYQEHLNPLNEEKIYVTPARAIAHTAVLNTWKYANNNYHVEMEKTQKNIPSFGRAKEIAPESIFECFIISHHPLQLPKWIRLGKWMSKAEVKLTELSLSKQKEDLFIYPYPLNPLDVMFTHQVIGYDVINMPPVSLIRNVRMRGEYYQISDRPDLKIPARLSYHFG

SEQ ID NO: 5048 - protein, 224 aa, Microcystis aeruginosa PCC 9809; identical to SEQ ID NO: 5041

SEQ ID NO: 5049 - protein, 224 aa, Microcystis aeruginosa PCC 9701; identical to SEQ ID NO: 5041

SEQ ID NO: 5050 - protein, 234 aa, Thermobrachium celere DSM 8682
MYLAEVKIELQDYLFYASKEISDYYITSKYQHNYSLSYAFGFCPNRYEVYYDKVYYLEDLNNLNKVGIYIYPSKWDGNLVDLRFNSMKDGYALSMEKNTPFPVNGVISAIEPEAVLTTYILSNEKIEIKNIIRLGKWDTACRISYNWQQAKVIKANGMFEGVYNYMDLLQKPQEFDITELSIPNRLIQNAYYEEEIECIKSENGVVLPICKYFGSDVDELYRNYVEGKKNKKRK

SEQ ID NO: 5051 - protein, 238 aa, Lyngbya sp. PCC 8106
MAIIQSYQLELHDSLYFATREIGRLYETEPILHNYALCYALGLIDSETHATTVSEEHSYRYFCAEQVPQYEAHLTSLNQQGIYVTPARAVSHAAVLNTWKYANNNYHVEMEKTQKNIPSFGRTKEIAPESIFEFFVISEKLLQLPKWIRLGKWMSKAEVTVLNTQEVKSSTSEQQFTFPYPLNPLDVMFTHQVISYDVVNMPPVSLIKNVQMRGEYYQLSEPLKLKIPARMKYHFRSN

SEQ ID NO: 5052 - protein, 106 aa, Coleofasciculus chthonoplastes PCC 7420
MTLYHCTLTLHDNLFFATREMGILYETEKYLHNWAISYALFKVDYIPQPYRLHGKAAQKPGYLDANAEQNLLYLNQAGIYVFPAQPLTWAYQVNTLTMGVERSLVD

SEQ ID NO: 5053 - protein, 234 aa, Coleofasciculus chthonoplastes PCC 7420
MAILYRYQIELHDSLYFATREIGRLYETEPVLHNYALSYAFGLVDSERYATTVPPEASYRYFCAEQVPQYQAQLTPLNQRGIYITPARSIEHTSVLNTWKYADNRYHVEMKKTQKNIPSFGRAKEIAPESRFEGFVISQTPLTLPSWIRLGKWASKARVEIIETQESQVSGGTEAFVFPYPLNPLDVMFCHRVISYDVINMPPVSLIKMVTLQGQYYRFNRLKIPALMQYRFSE

SEQ ID NO: 5054 - protein, 222 aa, Cylindrospermopsis raciborskii CS-505
MMIYQCDLRLHDNVFLANREIGSLYETEKYLHNWALSFAFFETDYIPRSYRLLGKVVPELTYLDTNQEQSLFHLNQAGIYVFPALPISWSYQVNSVAQIPCYHEYTNVKELAVGSHFKTYIFAPHEITIPHWIRLGKWSAKIKVETSIISDFKQKSGEYVSKHPLNPIDLSRTTKLLLYNRIFMSPSSLLSQAQLMGDYYQLPDQTCLPKRVGYGASTGILI

SEQ ID NO: 5055 - protein, 254 aa, Cylindrospermopsis raciborskii CS-505
MEVYRYFLQFEDYVFYATTERGKVFETGWFIHNYSISYALNLARSHYREEGQKPSYKRDLTPINEAGIYLTPAQVLDNTRYCINQFNTMDETFTLTRGKSLGYPAWGFVKMFRPISQKTVISKPNQFLANAFGYLICQDSLITSMERLSNVYDAEVSILPIQYLRLGKFMAKVKMTLKKATSVNLVNNSKTVSGMLNWSDLVTKPQLFDLIASALPTRLLENGKYLVSTRLLEVKFADDEVIYLPSDMNYLAAL

SEQ ID NO: 5056 - protein, 221 aa, Raphidiopsis brookii D9
MIYQCDLRLHDNVFLANREIGTLYETEKYLHNWALSFAFFETDYIPRSYRLPGKIVPELTYLDTNQEQSLFHLNQAGIYVFPALPITWSYQINTVAQIPCYHQYSNVKELAVGSHFKTYVFAPHEITIPHWIRLGKWSAKIKVETSIISDFKQKSGEYVSKHPLNPIDLSRTTKLLLYNRIFMSPSSLLSQAQLTGDYYQLPDQTCLPRRVGYGASTGILI

SEQ ID NO: 5057 - protein, 242 aa, Ktedonobacter racemifer DSM 44963
MQIYRAILTLLENTYFASREVGTLYESEPLVGNYALTYGLGLCAAPYDWSGPPRYKQDLGPLNERGLYVTPATFLPGKLRFAFSQFNAQSDSYYFRFDQNAIATTPNKRARAANFPQSGKIRMLGLESQAHFYLFSREGEMPLLPGYIRLGKFNSKARVEWERLNLLSEQPREADEELRFFLNAVDLPASLAGKLRAFSIYNIYPAPLLSQCRLAGPFWQATTAQGERVVLPAGMRYGVDAL

SEQ ID NO: 5058 - protein, 217 aa, Oscillochloris trichoides DG6
MQIYHCRLVLQEPLFHATRELGRLYETGRYIHNYALTYAFGIATSPWFHREQIPHYADDLLPLRDKIYVTPAQPERVAYQLATFKYGEEIIHVEMQQAERNTPSFGRAKEIAPESTFSCYVLSAEPLKLPRWIRLGKWHSKAMVEVAEVALKEAEGDYTAAAPLNPLDLPGGILRAFDIVSMPPASLVANARCSGRYYRLEQGLGLPLDMRYTFPKP

SEQ ID NO: 5059 - protein, 222 aa, Lachnospiraceae bacterium 2_1_46FAA
MRSLLEQPAMHNYMPDIFGKKVLEIGCGCGKNCRYFAENGAVKVLGTHMSGRMLKIAKRKSVGLPIEYRLLAPEKAAGLDEKFDVIYSSLVFHYVEHFDKFIAGLSSLLHKDGILLFSQKHPITTASLDRQPGWNYDERGKEISYTFSNYHQSGRRGSNWFIDDEVIYHRTVGEIVTALGQHGFYVEAADETRPSSTMIKQYPQLEKEMLKPAFLVIRARKI

SEQ ID NO: 5060 - protein, 235 aa, Fischerella thermalis
MSFIYRCHIELHDSMYHATREIGRLYETEPIIHNYALCYALGLVDSEKYATTVSEEDSYRYFCPEQVPKYEQHLTPLNQQGIYVTPAASIHHTSILNTWKYANNNYHVEMEKTQKNIPSFGRAKEIAPESQFEFFVISQKELKLPKWIRLGKWMSKAEVTVEKLPEAKTTNDLFICTHPLNPLDVMFTNQVISYDVVNMPPVSLIQNVQMRGQYYYFEDIKELKIPVRMTYRFRG

SEQ ID NO: 5061 - protein, 235 aa, Oscillatoriales cyanobacterium JSC-12
MTIIYRCTLELHDSLYFATREIGRLYETEPVLHNYALTYALGLVDSSRYATTVAEEDSYSYFCAEQVPKYKQHLTLLNQRGIYVTPARAIHYASILNTWKYANNNYHVEMEKMERNVPGFGRTKEISPESQFEFFVVSETDLALPRWIRIGKWASKAEIITQPLTTRSSKTEEVVIDLPLNPLDVMFTNQVLSYDTINMLPVSLIRNVRMIGEHYTFEELPDLKLPARMQYEFGN

SEQ ID NO: 5062 - protein, 237 aa, Leptolyngbya sp. PCC 7375
MPNIYRCTLELHDSLYYATREIGRLYETEPVLHNYALCYALGLIDSKKYATTVSDENAYRYFCPTQVPMYEEHLTPLNQQGIYVTPARAVQHTAVLHTWKYADNRYHVEMKKTQKNIPSFGRAKEIAPESQFEFFVMSAKSLTFPRWIRLGKWMSKAKVEVKELPKPQQNSAREFTFPYPLNPLDVMFTNQVLSYDTINMPPVSLIRNVRMAGDFYSFEGLKEPLQLPTNMEYRFSS

SEQ ID NO: 5063 - protein, 247 aa, Gloeocapsa sp. PCC 73106
MALYYCQLTLHDNIFFASREMGILYETEKYLHNWALSYAFFKGTYIPHPYRLQGEKAQTPDYLDSEGEQSLAHLNRLGVYVFPAKPVRWSYQINTFKAAQTNYYGKPKQFGDKEANRNYPINYGRAKELAVGSEYYTFLIAPKDIKIPHWIRVGKWLAKVEVKSSVIPEQAISQKTGLYNCDHPLNPVDLPANQHLLLYNRIVMPPVSLVSQSQLEGNYWELSKDILDLPQSISLPIGVSYGASITN

SEQ ID NO: 5064 - protein, 224 aa, Microcystis aeruginosa DIANCHI905; identical to SEQ ID NO: 5038

SEQ ID NO: 5065 - protein, 233 aa, Natrialba hulunbeirensis JCM 10989
MIEQTFEATLYAPLFYSSSEGRAIRTQPMLSSTALMHALGYRYFGMEKRYAEFGTDATSADYSHLKEAPFFVTDMRPIAVQTDERTFRSTDYRSERHFTTNDTDLANQIAGTKSIPSILEDSGAAYQTIRNYVGISPGSTFEFTVWSEEELPRRPFFRMGIKQTGEFRAALAELETLVLNKYLLSEVYDLSDELLAALMEQSQSFERGNDPRLQHFVGADPEFVRDRILPEVL

SEQ ID NO: 5066 - protein, 242 aa, Natrialba asiatica DSM 12278
MTAALEVTLRTQGEIWFASREVGRLADTEPYFLNTALYYALGFASGRYVDRSFEPTYLDDTDAVADELYVTPAAPSDSTGPGLANRITSTYNTSSDDYATINYSAQEDPDAKQNLPTYGRRRVLGHGNELTFYLLGRGLSAGELELRVPGYIRLGKKRGKARVETEPLDVSEGDGEFDLGHPIGAYDTALTPVGNLVTKRMRPTPLIMQASYEGAYVELTSLGSDDDGIQLPADATFLETKR

SEQ ID NO: 5067 - protein, 243 aa, Haloferax alexandrinus JCM 10717
MMAALEVTLRTQGEIWFASREVGRLADTEPYFLNTALYYAFGFASGRYVDRLFEPTYLDDTDGVSEELYVTPATPSDSTGSGLANRITSTYNTSSDDYATINYSAQDDPDAKQNLPTYGRRRVLGHGNELTCYLLGRGLSTSELESRVPGYIRLGKKRGKARVETEPLDVSQDTGEFDLGHPIGAYDTDLTPVGNLVTKRMRPTPLVMQASYDGTYVELGPTNLDGKNGVQLPADATFLKTKR

SEQ ID NO: 5068 - protein, 243 aa, Haloferax sulfurifontis ATCC BAA-897
MMAALEVTLRTQGEIWFASREVGRLADTEPYFLNTALYYAFGFASGRYVDRLFEPTYLDDTDGVSEELYVTPATPSDSTGSGLANRITSTYNTSSDDYATINYSAQDDPDAKQNLPTYGRRRVLGHGNELTCYLLGRGLSTSELESRVPGYIRLGKKRGKARVETEPLDVSQDTGEFDLGHPIGAYDTDLTPVGNLVTKRMRPTPLVMQASYDGAYVELGPTNLDGKNGVQLPADATFLKTKR

SEQ ID NO: 5069 - protein, 233 aa, Halococcus thailandensis JCM 13552
MIERTYEARLYAPLFYSSSEGRSIRTQPTLSATALMHALGYRYFGLEKRYAEFGDNATSADYSHLTDLPFFVTDMRPIAVETDERTFRSTDYRSERHFTTNDPDLAARVNGKKAVPNVLETSGAAWQTIRNYLGIAPGSTFEFTIWSDDPLPARPFFRMGIKQTGEFRASQRSLGTVVLNKFLLSEVYNLPKKMLTELMEQSTSFRRGNDPRLQHFVGVDPEFVRDRVVPEVV

SEQ ID NO: 5070 - protein, 224 aa, Microcystis aeruginosa SPC777
MVHIYSCQLELHDSLYYATREIGRLYESEPVIHNYALCYALGLVNSDSYRYFCSEQIPQYQEHLNPLNEEKIYVTPARAIVHTAVLNTWKYANNNYHVEMEKTQKNIPSFGRAKEIAPESVFECFIISHHPLQLPKWIRLGKWMSKAEVKLTELSLSKQKEDLFIYPYPLNPLDVMFTHQVIGYDVINMPPVSLIRNVRMRGEYYQISDRPDLKIPARLSYHFG

SEQ ID NO: 5071 - protein, 238 aa, Lyngbya aestuarii BL J
MAIIQLCQIELHDSLYFATREIGRLYETEPIIHNYALCYALGLIDSETHATTVSEEHSYRYFCAEQVPQYEAHLTPLNERGIYVTPARSVFHAAVLNTWKYANNNYHVEMEKTQKNIPSFGRTKEISPESIFEFFVISEKPLQFPKWIRLGKWMSKAEVTVLKTQEVKSSTSEHPFIFPYPLNPLDVMFTHQVISYDVVNMPPVSLIKNVQLQGEYYQLTGTTKLKIPANLEYHFRVN

SEQ ID NO: 5072 - protein, 237 aa, Leptolyngbya sp. Heron Island J
MPNIYRCTLELHDSLYYATREIGRLYETEPVLHNYALCYALGLIDSKKYATTVSDEKAYRYFCPTQVPMYEEHLTPLNQQGIYVTPARAVHHTAVLHTWKYADNRYHVEMKKTQKNIPSFGRAKEIAPESQFEFFVISAKSLTFPQWIRLGKWMSKAKVEVKELPKPQQNSTKEFTFPYPLNPLDVMFTNQVLSYDTINMPPVSLIRNVRMAGEFYSFEGLKETLQLPIQMEYRFSS

SEQ ID NO: 5073 - protein, 243 aa, Halarchaeum acidiphilum MH1-52-1
MTAALEVTLRTQGEIWFASREVGRLADTEPYFLNTALYYALGFASGRYVDRSFEPTYLDDTDAIAEELYVTPATPSDSPGAGLANRITSTYNTSTDDYATINYSAQEDPDAKQNLPTYGRRRVLGHGNELTCYLLGRGLSASELESRVPGYIRLGKKRGKARVETEPLGVSQGDGEFDLGHPIGAYDTALTPVGNLVTKRMRPTPLVMQAAYEGAYVELEASDPDDDDVVRLPADATFLETKR

SEQ ID NO: 5074 - protein, 252 aa, Nostoc sp. PCC 7120; identical to SEQ ID NO: 5034

SEQ ID NO: 5075 - protein, 254 aa, Synechocystis sp. PCC 6803; identical to SEQ ID NO: 5031

SEQ ID NO: 5076 - protein, 224 aa, Microcystis aeruginosa; identical to SEQ ID NO: 5038

SEQ ID NO: 5077 - protein, 224 aa, Microcystis aeruginosa; identical to SEQ ID NO: 5041

SEQ ID NO: 5078 - protein, 224 aa, Microcystis aeruginosa; identical to SEQ ID NO: 5042

SEQ ID NO: 5079 - protein, 224 aa, Microcystis aeruginosa; identical to SEQ ID NO: 5043

SEQ ID NO: 5080 - protein, 224 aa, Microcystis aeruginosa; identical to SEQ ID NO: 5045

SEQ ID NO: 5081 - protein, 224 aa, Microcystis aeruginosa; identical to SEQ ID NO: 5046

SEQ ID NO: 5082 - protein, 224 aa, Microcystis aeruginosa; identical to SEQ ID NO: 5047

SEQ ID NO: 5083 - protein, 405 aa, Pseudomonas sp. Lz4W
MFLMVWQQKKIILATAALFGLVALGYAYLSTPEYQVSSVLRPAAINELDALNRSGVYTLPPNEALLKVGSSLESYDNRLGFFRSNQELFTQFKRPGRTLEQSFEDFNRNSLKLIFPDSKKADSQNAAISMELTYPGGVDGVKILNGFVDYAIDAERKQIAADLKVIVNNRLTELKGKLDAARSSYEIDKEARIAALNEADSIKRAQLQDELKALRQQLKVVRTDRMAQLSEAIGIARALNIQKPTTPSALGDSAGTRGSSSMRTEISNQQIPLYFMGTEALEAERTVLQQRKTDDFTEGRVAQIARELQLLQSNREVEALKQRQNEDLFLSGVEPLRAEIVRLGNLSNLDSSNMKLVSIDRKALEPMQPVKPRKALLILLGLLLGGMLGVLIVLVRYFVATRQQG

SEQ ID NO: 5084 - protein, 234 aa, Coleofasciculus chthonoplastes; identical to SEQ ID NO: 5053

SEQ ID NO: 5085 - protein, 106 aa, Coleofasciculus chthonoplastes; identical to SEQ ID NO: 5052

SEQ ID NO: 5086 - protein, 242 aa, Natrialba asiatica; identical to SEQ ID NO: 5066

SEQ ID NO: 5087 - protein, 254 aa, Cylindrospermopsis raciborskii; identical to SEQ ID NO: 5055

SEQ ID NO: 5088 - protein, 222 aa, Cylindrospermopsis raciborskii; identical to SEQ ID NO: 5054

SEQ ID NO: 5089 - protein, 237 aa, Leptolyngbya sp. PCC 7375; identical to SEQ ID NO: 5062

SEQ ID NO: 5090 - protein, 247 aa, Gloeocapsa sp. PCC 73106; identical to SEQ ID NO: 5063

SEQ ID NO: 5091 - protein, 217 aa, Oscillochloris trichoides; identical to SEQ ID NO: 5058

SEQ ID NO: 5092 - protein, 243 aa, Haloferax alexandrinus; identical to SEQ ID NO: 5067

SEQ ID NO: 5093 - protein, 233 aa, Natrialba hulunbeirensis; identical to SEQ ID NO: 5065

SEQ ID NO: 5094 - protein, 243 aa, Haloferax sulfurifontis; identical to SEQ ID NO: 5068

SEQ ID NO: 5095 - protein, 263 aa, Kamptonema; identical to SEQ ID NO: 5039

SEQ ID NO: 5096 - protein, 233 aa, Halococcus thailandensis; identical to SEQ ID NO: 5069

SEQ ID NO: 5097 - protein, 242 aa, Ktedonobacter racemifer; identical to SEQ ID NO: 5057

SEQ ID NO: 5098 - protein, 221 aa, Raphidiopsis brookii; identical to SEQ ID NO: 5056

SEQ ID NO: 5099 - protein, 235 aa, Fischerella thermalis; identical to SEQ ID NO: 5060

SEQ ID NO: 5100 - protein, 235 aa, Oscillatoriales cyanobacterium JSC-12; identical to SEQ ID NO: 5061

SEQ ID NO: 5101 - protein, 222 aa, Lachnospiraceae; identical to SEQ ID NO: 5059

SEQ ID NO: 5102 - protein, 238 aa, Lyngbya sp. PCC 8106; identical to SEQ ID NO: 5051

SEQ ID NO: 5103 - protein, 197 aa, Sphingomonas sp. PAMC 26621
MAVLGVATLVAASFLVPAFGSRHGASPASPVAPISSGDRITYPANGYPALVLPDGKSERVKSLLNSQRPIRFGDYIWNDAGIPDGPVWVRVDLSRQTLSVFRGGNEIGTTVVLFGADGKPTPRGVYPVLAKAETHRSSLYDAEMPFMLRLTGDGVAIHASTVREGSATHGCIGVPLEFARLLYGQMKVGDRVAIIAA

SEQ ID NO: 5104 - protein, 405 aa, Pseudomonas fragi
MFLMVWQQKKIILATAALFGLVALGYAYLSTPEYQVSSVLRPAAINELDALNRSGVYTLPPNEALLKVGSSLESYDNRLGFFRSNQELFTQFKRPGRTLEQSFEDFNRNSLKLIFPDSKKADSQNAAISMELTYPGGVDGVKILNGFVDYAIDAERKQIAADLKVIVNNRLTELKGKLDAARSSYEIDKEAHIAALNEADSIKRAQLQDELKALRQQLKVVRTDRMAQLSEAIGIARALNIQKPTTPSALGDSAGTRGSSSMRTEISNQQIPLYFMGTEALEAERTVLQQRKTDDFTEGRVAQIARELQLLQSNREVEALKQRQNEDLFLSGVEPLRAEIVRLGNLSNLDSSNMKLVSIDRKALEPMQPVKPRKALLILLGLLLGGMLGVLIVLVRYFVATRQQG

SEQ ID NO: 5105 - protein, 252 aa, Nostocaceae; identical to SEQ ID NO: 5034

SEQ ID NO: 5106 - protein, 254 aa, Synechocystis; identical to SEQ ID NO: 5031

SEQ ID NO: 5107 - protein, 219 aa, Picrophilus torridus; identical to SEQ ID NO: 4986

SEQ ID NO: 5108 - protein, 255 aa, Sulfolobus acidocaldarius; identical to SEQ ID NO: 4987

SEQ ID NO: 5109 - protein, 235 aa, Nostocaceae; identical to SEQ ID NO: 4988

SEQ ID NO: 5110 - protein, 247 aa, Natronomonas pharaonis; identical to SEQ ID NO: 5037

SEQ ID NO: 5111 - protein, 244 aa, Methanospirillum hungatei; identical to SEQ ID NO: 4989

SEQ ID NO: 5112 - protein, 253 aa, Methanothrix thermoacetophila; identical to SEQ ID NO: 4990

SEQ ID NO: 5113 - protein, 226 aa, Thermofilum pendens; identical to SEQ ID NO: 4991

SEQ ID NO: 5114 - protein, 253 aa, Herpetosiphon aurantiacus; identical to SEQ ID NO: 4992

SEQ ID NO: 5115 - protein, 224 aa, Microcystis aeruginosa; identical to SEQ ID NO: 5036

SEQ ID NO: 5116 - protein, 251 aa, Synechococcus; identical to SEQ ID NO: 4993

SEQ ID NO: 5117 - protein, 252 aa, Nostoc punctiforme; identical to SEQ ID NO: 4994

SEQ ID NO: 5118 - protein, 258 aa, Rippkaea orientalis; identical to SEQ ID NO: 4995

SEQ ID NO: 5119 - protein, 253 aa, Gloeothece citriformis; identical to SEQ ID NO: 4996

SEQ ID NO: 5120 - protein, 249 aa, Methanosphaerula palustris; identical to SEQ ID NO: 4997

SEQ ID NO: 5121 - protein, 261 aa, Cyanothece sp. PCC 7425; identical to SEQ ID NO: 4998

SEQ ID NO: 5122 - protein, 248 aa, Halorubrum lacusprofundi; identical to SEQ ID NO: 4999

SEQ ID NO: 5123 - protein, 210 aa, Methanocaldococcus vulcanius; identical to SEQ ID NO: 5001

SEQ ID NO: 5124 - protein, 252 aa, Sulfolobus islandicus; identical to SEQ ID NO: 5002

SEQ ID NO: 5125 - protein, 234 aa, Acetohalobium arabaticum; identical to SEQ ID NO: 5003

SEQ ID NO: 5126 - protein, 259 aa, Gloeothece verrucosa; identical to SEQ ID NO: 5004

SEQ ID NO: 5127 - protein, 210 aa, Methanotorris igneus; identical to SEQ ID NO: 5006

SEQ ID NO: 5128 - protein, 147 aa, Methanothermococcus okinawensis; identical to SEQ ID NO: 5007

SEQ ID NO: 5129 - protein, 214 aa, Caldicellulosiruptor lactoaceticus; identical to SEQ ID NO: 5008

SEQ ID NO: 5130 - protein, 234 aa, halophilic archaeon DL31; identical to SEQ ID NO: 5009

SEQ ID NO: 5131 - protein, 261 aa, Sulfolobus islandicus; identical to SEQ ID NO: 5005

SEQ ID NO: 5132 - protein, 247 aa, Haloquadratum walsbyi; identical to SEQ ID NO: 5040

SEQ ID NO: 5133 - protein, 235 aa, Anabaena sp. 90; identical to SEQ ID NO: 5010

SEQ ID NO: 5134 - protein, 252 aa, Nostoc sp. PCC 7107; identical to SEQ ID NO: 5013

SEQ ID NO: 5135 - protein, 243 aa, Rivularia sp. PCC 7116; identical to SEQ ID NO: 5015

SEQ ID NO: 5136 - protein, 263 aa, Calothrix sp. PCC 7507; identical to SEQ ID NO: 5011

SEQ ID NO: 5137 - protein, 252 aa, Calothrix sp. PCC 7507; identical to SEQ ID NO: 5012

SEQ ID NO: 5138 - protein, 235 aa, Nostoc sp. PCC 7524; identical to SEQ ID NO: 5014

SEQ ID NO: 5139 - protein, 261 aa, Pleurocapsa minor; identical to SEQ ID NO: 5016

SEQ ID NO: 5140 - protein, 256 aa, Oscillatoria acuminata; identical to SEQ ID NO: 5017

SEQ ID NO: 5141 - protein, 262 aa, Oscillatoria acuminata; identical to SEQ ID NO: 5018

SEQ ID NO: 5142 - protein, 267 aa, Oscillatoria nigro-viridis; identical to SEQ ID NO: 5020

SEQ ID NO: 5143 - protein, 263 aa, Microcoleus sp. PCC 7113; identical to SEQ ID NO: 5022

SEQ ID NO: 5144 - protein, 234 aa, Gloeocapsa sp. PCC 7428; identical to SEQ ID NO: 5024

SEQ ID NO: 5145 - protein, 235 aa, Calothrix parietina; identical to SEQ ID NO: 5019

SEQ ID NO: 5146 - protein, 221 aa, Crinalium epipsammum; identical to SEQ ID NO: 5021

SEQ ID NO: 5147 - protein, 235 aa, Cylindrospermum stagnale; identical to SEQ ID NO: 5023

SEQ ID NO: 5148 - protein, 234 aa, Stanieria cyanosphaera; identical to SEQ ID NO: 5025

SEQ ID NO: 5149 - protein, 235 aa, Anabaena cylindrica; identical to SEQ ID NO: 5027

SEQ ID NO: 5150 - protein, 246 aa, Halothece sp. PCC 7418; identical to SEQ ID NO: 5026

SEQ ID NO: 5151 - protein, 1144 aa, Blattabacterium sp. (Blatta orientalis); identical to SEQ ID NO: 5028

SEQ ID NO: 5152 - protein, 258 aa, Sulfolobus islandicus; identical to SEQ ID NO: 5032

SEQ ID NO: 5153 - protein, 258 aa, Rippkaea orientalis; identical to SEQ ID NO: 5000

SEQ ID NO: 5154 - protein, 224 aa, Microcystis aeruginosa; identical to SEQ ID NO: 5070

SEQ ID NO: 5155 - protein, 237 aa, Fischerella muscicola
MAIIYRCQIELHDSLYHATREIGRLYETEPVIHNYALCYALGLVDSEKYSTTVPEKDSYRYFCPEQVPKYEEHLTPLNQQGIYITPARSLNHTAILNTWKYANNNYHVEMEKTQKNIPSFGRAKEIAPESQFEFFVISQKDIKDLLPKWIRLGKWMSKAEVTVQQLPKFKVTEGIFTCAHPLNPLDVMFTNQVISYDVVNMPPVSLIQNVQMQGQYYYFEDIKELKIPVHMAYRFKN

SEQ ID NO: 5156 - protein, 234 aa, Fischerella muscicola
MAVIYCCQIELHDSLYHASREIGRLYETEPVIHNYALCYALGLVDSEIYSTTVSEEHSYRYFCPEQVPKYEEHLTPLNKQGIYITPARSLNHTAILNTWKYANNNYHVEMEKTQKNIPSFGRAKEIAPESQFEFFVISQKELKLPKWIRLGKWMSKAEVTVKQLPKPKIAEGVFTCTHPLNPLDVMFTNQVISYDVVNIPPVSLIQNVQMRGQYYYFEDIKEQIPVRMAYRFKN

SEQ ID NO: 5157 - protein, 235 aa, Chlorogloeopsis fritschii
MVLIYRCQLELHDSLYYATREIGRLYETEPIIHNYALCYALGLVDSEKYSTTVPEEHSYRYFCPEQVPKYEEHLTRLNQQAIYVTPARSLNHSAILNTWKYANNNYHVEMEKTQKNIPSFGRAKEIAPESQFEFFVIAQKQLKLPKWIRLGKWMSKAEVTVEQLPSPKIQENVFTCHHPLNPLDVIFTNRVISYDVVNMPPVSLIQNVKMQGKYYQFDSIKDLKIPAQMEYRFRS

SEQ ID NO: 5158 - protein, 228 aa, Anabaena sp. PCC 7108
MQIYRLLLTLQDPLYFATRELGRLYITEQYLHNYALTYALGLAKSSYSDAEHIPHYERDLEPLNHQGIYITPARPYVTPERPLGSAYVTHTYKWANLNYHVKMEQISKNIPTYGRIRELAPESQFEFFLISQKEIKLPKWIRLGKWMSKAEITVEKLLQPKTKTDLFTCTHPLNPLDVMFTNQVISYDVVNMPPVSLIQNVQMQGEYYYFDDIKNVKLPKQMQYRFRS

SEQ ID NO: 5159 - protein, 232 aa, Spirulina subsalsa
MYIYRCLIELHDSLYFATREIGRLYETEPVLHNYALCYALGLVDSDRHHTRVASPEQEYRYFCPTQVPQYEEHLTPLNEQKIYVTPAHSCSHTAVLNTWKYANNNYHVEMEKTQKNIPSFGRAKEIAPESVFECFVISANPLKLPKWIRLGKWSSKAEVNVKELPKPRQKSGIFLYPNALNPLDVMFSHQVVSYDVINMPPVSLIRNVTLQGEYYEIESLKIPATMTYRFSH

SEQ ID NO: 5160 - protein, 237 aa, Fischerella sp. PCC 9339
MAIIYRCQIELHDSLYHATREIGRLYETEPVIHNYALCYALGLVDSEVYSTTVAEEHSYRYFCREQVPKYEEHLTPLNQQGIYITPARSLNHTAILNTWKYANNNYHVEMEKTQKNIPSFGRAKEIAPESQFEFFVISQKDIKDLLPKWIRLGKWMSKAEVTVQQLLKPKITEGIFTCTHPLNPLDVMFTNQVISYDVVNMPPVSLIQNVQMRGQYYYFEDIKELKIPVQMAYRFKN

SEQ ID NO: 5161 - protein, 236 aa, cyanobacterium PCC 7702
MAIIYRCRLELHDSLYYATREIGRLYETEPIIHNYALCYALGLIDSEEYSTNVPEEHSYRYFCPEQVPKYEEHLTPLNQQGIYVTPARSLNHSSILNTWKYANNNYHVEMKKTEKNIPSFGRAKEIAPESQFEFFVISQKQLQLPKWIRLGKWMSKAEVIQKEPPLAHKIKEDVFVCSHPLNPLDVMFTNRIISYDVVNMPPVSLIQNVKMQGKYYQFDSIEDLKIPVQMKYCFRS

SEQ ID NO: 5162 - protein, 237 aa, Synechococcus sp. PCC 7336
MPHIYRCTLELHDNLYYATREIGRLYETEPVLHNYALCYALGLVDSEKYATTVPEESTYRYFCGEQVPMYEAHLTPLNQQGIYVTPARAVRHATVLNTWKYADNRYHVEMQKTQKNIPSFGRAKEIAPESQFEFFVISEQPLSFPRWIRLGKWMSKAKVDVQELSNPKRNASREFTFPYPLNPLDVMFTNPVLSYDTINMPPVSLIRNVRMVGEHFTFEGLDQPLKLPVNMEYRFSN

SEQ ID NO: 5163 - protein, 235 aa, Fortiea contorta
MVFIYRCQLELHDSLYFATREIGRLYETEPVIHNYALCYALGLVDSQIYSTTVAEEHSYRYFCPEQVPKYEEHLTPLNQQVIYVTPARSLNHSTILNTWKYANNNYHMEMEKTQKNIPSFGRAKEIAPESVFEFFVISQKELKLPKWIRLGKWMSKAEVMVEKLSNPKTVEGLFTCTHPLNPLDVMFTNQVISYDVVNMPPVSLIQNVQMRGQYYYFDDVKNLKIPACMEYRFRS

SEQ ID NO: 5164 - protein, 259 aa, Geitlerinema sp. PCC 7105
MLYACTLTLHDNVFFATREMGTLYETEKYLHNWALSYALFSVSHIPQPYRVKGKTAQKPSYLDEEAEQSLHHLNQAGIYVFPARPLSWSYQINTFKAAQSTYYGRSKQFGEKGADRNYPINYGRAKELAVNSRYRTYILTAGEKKISIPQWIRLGKWAAKVRVEAVEIPSSLVRARQGEYLCDRPLNPLDLDPSTQWLLYDRVVMPPVSLFSQAQLSGNYWEVAGNAWENWKRERSLDLENAIRLPRDVRYGASYVATA

SEQ ID NO: 5165 - protein, 237 aa, Geitlerinema sp. PCC 7105
MTYIYRCRLELHDSLYFATREIGRLYETEPILHNYALCYALGFVDSDRYGTRVETDNEYRYFCRHQVPQYEAHLSQLNHRGIYVTPARSIHHTAVLQTWKYADNRYHVEMQKTQKNIPSFGRAKEIAPESEFECFVISETELPFPKWIRLGKWMSKAAVNVEPLPKPTYRENRSVTVPYPLNPLDVMFSHRVMSFDTINMPPVSLIRNVKLQGNVYEVGLEKETIALPANMTYRFSS

SEQ ID NO: 5166 - protein, 260 aa, Geitlerinema sp. PCC 7105
MQSETLTLTDSPPFTTARIVRLWCAEPVFFASRELSDTYYTEGAIGNYALAYALGWARSPYRLTGKDTGRPRYREDLTPLSGKCYVLPAWPVENSPSYRFERFNALSDAYWYAMTNNRVATAREDLPLKRTGKKPNTYRPSNFPQTGRLRVIDRGNRFETLVFGDGELPEYVRVGKFTSKVRVETGEALPIRQLPVDTYRCNTYLNSADLPARLELFTFDLMAIPPVSLLKNLQFRGAAWQIGDFIVPANLNFLGGCDRE

SEQ ID NO: 5167 - protein, 262 aa, Prochlorothrix hollandica
MKQLELIALTPAPAPYTTARLLELWCAEPVFFASRELSDTYYTEATLGNYALSYALGWARSPYRLQGKATGRPTYKEDLAPLRGQAYILPAWPLESGVSFRFERFNALSDSYWYAMTNNRVAIAREDLPLQRTGAKPSSYRPSNFPQTGRLRLIERGSRFQTLVLGDRELPHYIRVGKFMAKVRVEIKDQFPVVPLGVADYHCQGYLNSADLPKGLDLLSFDLLSIPPASLLKNLRFRGEAWQVGPFTLPAHLQFCNGYEPD

SEQ ID NO: 5168 - protein, 241 aa, Oscillatoria sp. PCC 10802
MPVYKCTLTLHDNVFYATREMGVLYETEKYLHNWALSYALFNVQYIPQPYRLQGQAAQTPGYLDAGCEQNLLHLNQAGIYVFPAVPLCWSYQVNTFKAAQVPYYGKSKKFGDKGALRNYPINFGRAKELAVGSQYETYIVAGEGVKIPRWIRLGKWAAKTHVEAARILQVEEKSGEYTCAHPLNPLDLPSSCRLVLYNRIVMPPVSLVSQAQLIGDFWQLPNRICLPRGLYYGAGYVPTVS

SEQ ID NO: 5169 - protein, 239 aa, Scytonema hofmannii
MTFIYCCRLELHDSLYYATREIGRLYETEAVIHNYALCYAMGLVDSEVYSTTVSEEHSYRYFCPEQVPKYEEHLTPLNQQGIYVTPAHSIHHSTTLNTWKYANNNYHVEMEKTQKNIPSFGRAKEIAPESQFEFFVISQKQLELPKWIRLGKWMSKAEVQNQEVTKFELKTGDFSFAYPLNPLDVMFTHQVVSYDVVNMPPVSLIQNISIRQGEYYVFDNPNKSEKLRLPSRMQYRFKG

SEQ ID NO: 5170 - protein, 249 aa, Scytonema hofmannii
MGILYETEKYLHNWALSFALFSIHYIPQPYRLQGEQAQKPTYLDASAEQNLLHLNQAGIYVFPAQPINWSYQINTFKAAQVGYYGKSKQFGDKGAEKNYPINYGRAKELAVGSQYRTYIVAPENIKIPRWIRLGKWAAKIRVEVIKIPENILRSKSGDYTCLHPLNPLDLPSETRILLYNRIVMPPVSLVSQAQLRGEYVFAKKNDDVKKKDWEAFKATLTVGQYQQLPEEIYLPKVTFYGAGNVVATA

SEQ ID NO: 5171 - protein, 215 aa, euryarchaeote SCGC AAA261-G15
MISPINYYHIQGGKIERPSNFIGDIALKYSLLHQLGIGNFFEISSFKPNYKELKNYDFWFTVGVPVWYENGIFSEKPRFMKPMIRNTMQGIDFNGTNSHPSIKTGSIMYKNFYMQEFMKPGNSFYTYFIGDEKMILPEVLRVGTGKVGVLKAEEIHDLSIAAFINLYTVRHILSKEEIYRYLATMNFDYTEHIALPYYIVGPLKEERILMEIYEN

SEQ ID NO: 5172 - protein, 244 aa, Desulfurispora thermophila
MAISIWRARLKLLDYLFFATYERGKLAETGPFIHNYALTYALGLAGGAWYCGEQTPSYLTHFIPLNQAGCYVTPATMLQGEMVVLQYNTINEGYTLGRGRNIGYPNWGFVRAVRPGAMFDFFVLLRQERQMPAYIRLGKFMAKARVTYEPAVRVQPTAGGRWECSGLLNPLDLPVPPVHFAGALQLLPGNLLAGAVFQDEPGYEATFPGAEKIWLPARLAYLAALANGASTPGAGPAAKKRRGG

SEQ ID NO: 5173 - protein, 260 aa, filamentous cyanobacterium ESFC-1
MTLYACHLTLHDNIFFATREMGILYETEKYLHNWAISYAFFKGSYIPHPYGLQGDTAQKPDYLDPSREQNLLHLNEAGLYVFPAKPLSWSYQINTFKAAQTTYYGKSKQFGVKGADRNYPINYGRAKELAVGSHYQTFLMTPDNSEIQFPRWIRLGKWAAKVMVHLQLIPEAAIQKKSGKYVCDHPLNPLDLPLEQDLELYNRIVMPPSSLVSQAQLNGEYWQLRGDEWNALRQQLPNLPKTLCLPVGVSYGAKTLTAVS

SEQ ID NO: 5174 - protein, 235 aa, filamentous cyanobacterium ESFC-1
MTIISRYRLELHDSLYFATRELGRLYETEPIIHNYALCYALGLVDSDRYNTRVENEAEYRYFCATQIPLYEAHLTRLNEAGIYVTPARSITYAATLNTWKYANNNYHVEMQKTQKNIPSFGRTKEIAVESEFEFFLISQQQLNLPRWIRLGKWASKAEISKIEDYSNPQRRSGSFTFSYPLNPLDVMFSYRVMSYDTINMPPVSLIRNVSLSGEYYQLPNKQSLKIPANLSYCFS

SEQ ID NO: 5175 - protein, 234 aa, Thermobrachium celere; identical to SEQ ID NO: 5050

SEQ ID NO: 5176 - protein, 249 aa, Calothrix sp. PCC 7103
MVFIYHCQLELHDSLYFATREIGRLYETEPVIHNYALCYALNFVDSEVYSTTVAEEYGYRYFCSEQVPLYDTHLTPLNQQDIYVTPARVINYTSILNTWKYANNNYHVEMEKTQKNIPSFGRTKEIAAESKFEFFVISKQSLTEKPKKLPKWIRLGKWMSKAELTVEELPSPKTAEGVFTCTHPLNPLDVMFTNQVMSYDVVNMPPVSLIQNVQMRGSYYRFEAQKGEKISNWLKQLNIPVHMEYRFQG

SEQ ID NO: 5177 - protein, 234 aa, Pleurocapsa sp. PCC 7319
MTIIYRCNLELHDSLYFATREIGRLYETEPILHNYALCYALGLIDSQKYATTVAEKDSYRYFCAEQIPKYKQHLIPLNQQKIYVTPARSLIHTSVLNTWKYANNNYHVKMEKTQKNIPSFGRAKEIAAESQFEFFIFSENLLHFPKWKWIRLGKWMSKAQVIFEQLSSIKIQQGLFNCTHPLNSLDVMFTNQVFSYDVINMPPVSLIRNAQIQGQYYQVDNNLKLPVNMQYRFS

SEQ ID NO: 5178 - protein, 230 aa, Sulfolobales archaeon Acd1
MISAGGSMGSYVSPSPHVHNYPVMYGMLGKPAEAYFVFPSLHYLDYPERKGRVKTSKGLQYTSVRKLLEDFKNGRDSFYSFPLFPVKFSVSSFLLSAESWSYVLPVRTPTKNVFPRLTSYSAFMPGSQFFTYVVTQGNVKLPQWIRIGKKRWGIFRVEYEEVKINKVEKRRNEPTSVPINYKDAEFFGFKVNSFSKVLETPNPQEGLIGWAVLDECEVVNDRICLPIKWR

SEQ ID NO: 5179 - protein, 243 aa, Halarchaeum acidiphilum; identical to SEQ ID NO: 5073

SEQ ID NO: 5180 - protein, 243 aa, Laceyella sacchari
MAKKSGRRSSSVPEKTVQVKEKKYAYRIGIELEDYLFFASMEKGKVAETASLLHNYALAYAMGWVDSLYFNEMQSPQYEQQLQPLNEQGVYVYPAVPVHISHRMMQYNTTDEAFLMKRTQSMGYPNWGFIKCIRPGSTFETYILSHDPIPIPSKIRLGKWMSLASITMQEVSLTKKKGNTCPHMVNIQDIACLPVYFSAMYNVLPTRLVQGVEWDEQLDGYQISYGDHRNVWVPESAFWWWDK

SEQ ID NO: 5181 - protein, 238 aa, Lyngbya aestuarii; identical to SEQ ID NO: 5071

SEQ ID NO: 5182 - protein, 237 aa, Leptolyngbya sp. Heron Island J; identical to SEQ ID NO: 5072

SEQ ID NO: 5183 - protein, 236 aa, Gloeobacter kilaueensis; identical to SEQ ID NO: 5033

SEQ ID NO: 5184 - protein, 253 aa, Herpetosiphon aurantiacus DSM 785; identical to SEQ ID NO: 4992

SEQ ID NO: 5185 - protein, 224 aa, Microcystis aeruginosa NIES-843; identical to SEQ ID NO: 5036

SEQ ID NO: 5186 - protein, 251 aa, Synechococcus sp. PCC 7002; identical to SEQ ID NO: 4993

SEQ ID NO: 5187 - protein, 252 aa, Nostoc punctiforme PCC 73102; identical to SEQ ID NO: 4994

SEQ ID NO: 5188 - protein, 258 aa, Cyanothece sp. PCC 8801; identical to SEQ ID NO: 4995

SEQ ID NO: 5189 - protein, 253 aa, Cyanothece sp. PCC 7424; identical to SEQ ID NO: 4996

SEQ ID NO: 5190 - protein, 249 aa, Methanosphaerula palustris E1-9c; identical to SEQ ID NO: 4997

SEQ ID NO: 5191 - protein, 261 aa, Cyanothece sp. PCC 7425; identical to SEQ ID NO: 4998

SEQ ID NO: 5192 - protein, 248 aa, Halorubrum lacusprofundi ATCC 49239; identical to SEQ ID NO: 4999

SEQ ID NO: 5193 - protein, 258 aa, Cyanothece sp. PCC 8802; identical to SEQ ID NO: 5000

SEQ ID NO: 5194 - protein, 210 aa, Methanocaldococcus vulcanius M7; identical to SEQ ID NO: 5001

SEQ ID NO: 5195 - protein, 252 aa, Sulfolobus islandicus L.D.8.5; identical to SEQ ID NO: 5002

SEQ ID NO: 5196 - protein, 234 aa, Acetohalobium arabaticum DSM 5501; identical to SEQ ID NO: 5003

SEQ ID NO: 5197 - protein, 259 aa, Cyanothece sp. PCC 7822; identical to SEQ ID NO: 5004

SEQ ID NO: 5198 - protein, 210 aa, Methanotorris igneus Kol 5; identical to SEQ ID NO: 5006

SEQ ID NO: 5199 - protein, 147 aa, Methanothermococcus okinawensis IH1; identical to SEQ ID NO: 5007

SEQ ID NO: 5200 - protein, 214 aa, Caldicellulosiruptor lactoaceticus 6A; identical to SEQ ID NO: 5008

SEQ ID NO: 5201 - protein, 234 aa, halophilic archaeon DL31; identical to SEQ ID NO: 5009

SEQ ID NO: 5202 - protein, 261 aa, Sulfolobus islandicus HVE10/4; identical to SEQ ID NO: 5005

SEQ ID NO: 5203 - protein, 247 aa, Haloquadratum walsbyi C23; identical to SEQ ID NO: 5040

SEQ ID NO: 5204 - protein, 235 aa, Anabaena sp. 90; identical to SEQ ID NO: 5010

SEQ ID NO: 5205 - protein, 252 aa, Nostoc sp. PCC 7107; identical to SEQ ID NO: 5013

SEQ ID NO: 5206 - protein, 243 aa, Rivularia sp. PCC 7116; identical to SEQ ID NO: 5015

SEQ ID NO: 5207 - protein, 263 aa, Calothrix sp. PCC 7507; identical to SEQ ID NO: 5011

SEQ ID NO: 5208 - protein, 252 aa, Calothrix sp. PCC 7507; identical to SEQ ID NO: 5012

SEQ ID NO: 5209 - protein, 235 aa, Nostoc sp. PCC 7524; identical to SEQ ID NO: 5014

SEQ ID NO: 5210 - protein, 261 aa, Pleurocapsa sp. PCC 7327; identical to SEQ ID NO: 5016

SEQ ID NO: 5211 - protein, 256 aa, Oscillatoria acuminata PCC 6304; identical to SEQ ID NO: 5017

SEQ ID NO: 5212 - protein, 262 aa, Oscillatoria acuminata PCC 6304; identical to SEQ ID NO: 5018

SEQ ID NO: 5213 - protein, 267 aa, Oscillatoria nigro-viridis PCC 7112; identical to SEQ ID NO: 5020

SEQ ID NO: 5214 - protein, 263 aa, Microcoleus sp. PCC 7113; identical to SEQ ID NO: 5022

SEQ ID NO: 5215 - protein, 234 aa, Gloeocapsa sp. PCC 7428; identical to SEQ ID NO: 5024

SEQ ID NO: 5216 - protein, 235 aa, Calothrix sp. PCC 6303; identical to SEQ ID NO: 5019

SEQ ID NO: 5217 - protein, 221 aa, Crinalium epipsammum PCC 9333; identical to SEQ ID NO: 5021

SEQ ID NO: 5218 - protein, 235 aa, Cylindrospermum stagnale PCC 7417; identical to SEQ ID NO: 5023

SEQ ID NO: 5219 - protein, 234 aa, Stanieria cyanosphaera PCC 7437; identical to SEQ ID NO: 5025

SEQ ID NO: 5220 - protein, 235 aa, Anabaena cylindrica PCC 7122; identical to SEQ ID NO: 5027

SEQ ID NO: 5221 - protein, 246 aa, Halothece sp. PCC 7418; identical to SEQ ID NO: 5026

SEQ ID NO: 5222 - protein, 1144 aa, Blattabacterium sp. (Blatta orientalis) str. Tarazona; identical to SEQ ID NO: 5028

SEQ ID NO: 5223 - protein, 255 aa, Sulfolobus acidocaldarius N8; identical to SEQ ID NO: 4987

SEQ ID NO: 5224 - protein, 255 aa, Sulfolobus acidocaldarius Ron12/I; identical to SEQ ID NO: 4987

SEQ ID NO: 5225 - protein, 254 aa, Synechocystis sp. PCC 6803; identical to SEQ ID NO: 5031

SEQ ID NO: 5226 - protein, 258 aa, Sulfolobus islandicus LAL14/1; identical to SEQ ID NO: 5032

SEQ ID NO: 5227 - protein, 236 aa, Gloeobacter kilaueensis JS1; identical to SEQ ID NO: 5033

SEQ ID NO: 5228 - protein, 219 aa, Picrophilus torridus DSM 9790; identical to SEQ ID NO: 4986

SEQ ID NO: 5229 - protein, 255 aa, Sulfolobus acidocaldarius DSM 639; identical to SEQ ID NO: 4987

SEQ ID NO: 5230 - protein, 235 aa, Anabaena variabilis ATCC 29413; identical to SEQ ID NO: 4988

SEQ ID NO: 5231 - protein, 247 aa, Natronomonas pharaonis DSM 2160; identical to SEQ ID NO: 5037

SEQ ID NO: 5232 - protein, 244 aa, Methanospirillum hungatei JF-1; identical to SEQ ID NO: 4989

SEQ ID NO: 5233 - protein, 253 aa, Methanothrix thermoacetophila PT; identical to SEQ ID NO: 4990

SEQ ID NO: 5234 - protein, 226 aa, Thermofilum pendens Hrk 5; identical to SEQ ID NO: 4991

SEQ ID NO: 5235 - protein, 502 aa, Escherichia coli str. K-12 substr. MG1655
MNLLIDNWIPVRPRNGGKVQIINLQSLYCSRDQWRLSLPRDDMELAALALLVCIGQIIAPAKDDVEFRHRIMNPLTEDEFQQLIAPWIDMFYLNHAEHPFMQTKGVKANDVTPMEKLLAGVSGATNCAFVNQPGQGEALCGGCTAIALFNQANQAPGFGGGFKSGLRGGTPVTTFVRGIDLRSTVLLNVLTLPRLQKQFPNESHTENQPTWIKPIKSNESIPASSIGFVRGLFWQPAHIELCDPIGIGKCSCCGQESNLRYTGFLKEKFTFTVNGLWPHPHSPCLVTVKKGEVEEKFLAFTTSAPSWTQISRVVVDKIIQNENGNRVAAVVNQFRNIAPQSPLELIMGGYRNNQASILERRHDVLMFNQGWQQYGNVINEIVTVGLGYKTALRKALYTFAEGFKNKDFKGAGVSVHETAERHFYRQSELLIPDVLANVNFSQADEVIADLRDKLHQLCEMLFNQSVAPYAHHPKLISTLALARATLYKHLRELKPQGGPSNG

SEQ ID NO: 5236 - protein, 506 aa, Geobacter sulfurreducens PCA
MNLLTEAWIPVRPLPAGAACKLTLRQLLCEDGRWELCLPRDDMELAALQLLICMTQVFFPPQSTAALKQRIVAPLSLDEFESGCAPYREWFRLDHPDFPFMQVRNVSAKDPTPMDKLLAGLTGATNSCFVNEPGLGACLCGGCAAIALFNQSSNAPSFGGGFKGSLRGGAPVTTLVQGEHLRQTVWLNVLSEERLTQIIPWHHATRSQQPTWVAPIKAGETIPSQAIGVLRGLFWQPGHLELMPPQGEQACICCGFVEKQVYAGFNKAKFNYTIDGLWPHPHGPRISSVKKGEREEKFVSFTTAAPAWTHLSRFVVQRQTTNSKEEGQEPAAVVRQAQGLLNKLRLAVGGYRNNQASILERRHELIFLNDGWSGHTEVVHALVGQAVGYRDALNKALFVFSTGFKEIKGAGVKVHELAKEQFYRRSEDTVLDTLARIDFEQAALALLAMGDGLHGIVVGLFNESVAPYRNDPELIRTTAVARKTLYKHLNALKPQRDGRRDDGTNA

SEQ ID NO: 5237 - protein, 521 aa, Pelobacter carbinolicus DSM 2380
MNLIEDAWLPVLREQGPDKIAPWQMVEPYNPVLEIIAPRPDFQGALYQFLIGLLQTCFTPEDHDEWLEYWEEMPTVEELKKTFEKVASAFELDKPVDSSFLQDFDLKAGEIKNIAGLLIESPGGKTIKDNLDHFVKGGAIRRVCPSCVATALFTLQINAPSGGVGHRVGLRGGGPLTTLVMPGAKESLWKKLWLNVLDRDWFETTDIELGPGIFPWMGPTRISDKGGKNTTPEDVDSLQVYWGMPRRIRLDFLDAEESRCDLCGENATSFVEKYRTQNYGTNYEGAWVHPLTPYRFDPKKEKPPLSLKGQQGGLGYRHWLGVTMTDQSSGDCSAKVVKAYMEERVHSLTGESLARLWCFGYDMDNMKARCWYDHEMPLLKLDAAQRDNLLHWVKELVDAATDVSGFLRSQLKEAWFKRAKDVKGDMNAVVLEFWQQSENDFYALLKRFSDLPGDQRQVPPEIYAFWAKTIRNLALDLFDSWALESPVEDADMKRIIGARKELAKKLRTSKAMKTLLNKSSL

SEQ ID NO: 5238 - protein, 494 aa, Desulfatibacillum aliphaticivorans
MEKRFNLVDEEWIPVAGRGLVSLRDVFTDPSLEALGGNPLEKIALTKLFLAITQTAHTPADTDEWLAMGAPGMASRAREYLEAHKDCFWLYGDRPFMQMPAVKAADIQNVSAVLPFVATGNTTQVFESQKDRDLSDPEKALVLVFLSCFALGGKKVDAKIVLSPSYSEKSKTAKPGTCLGFQGFLHNFLVGGSLQETIWLNLFTLEEIGRLEQFPEGLGVPPWEKMPEGEDCSLARSFKNSYMGRLLPLCRFALFADENFHYVEGIFHPGYKDGAYDPSMAVDNTKKPRVLWVDPEKRPWRELTSLLSFIQADSPRSFDCPQLRSGILKARNGGPGSFKIWSGGLRVSSNAGEQYVSGADDFVESEIRLSSQWLGETWFASLKGEMDALEGLARSVYGSSLAYFKHQKADGKKQAAQASNLFWQLSERNFQDLVDVCGSEIDGGAHGMRPRFADCARTAFNTFCPRDTARQMEAWAANRPNLSKYLKNGNSNRP

SEQ ID NO: 5239 - protein, 556 aa, Gardnerella vaginalis 409-05
MSRFNLLDEPWISVIVDEKGHNKLVSITDVFKHASEYKALAGDMKTQDFALLRILLAVLHTVFSRYDIQGNSREFDSNEDNEYYFNKETMNIWREVWNSKEFPDAVFKYLEQWHDRFYLFDDKYPFLQVLKQDIDSKKLGGKSPSEISGKNINRLISESNNKVAVFSPKDNVDNNKSSLNEAQLARWIITLQSYAGLADKTFFGTGKYKASKGWLFDLGGIYVEGENLFETLMLNCVLVGEMQSPEKRQKPCWEYSGAENIENSFYETFIDNISQLYTRWSRAIYINPDISIENPISVSIVKLPDINHKDAFIEPMTVWQYNKERENKDKYTPRKHKVEESMWRSFGLLTLQESDDGILKNHKPGIMEWLNKISKDIEGSSISLQAVSMKDDGNATSWVPTDEICDTLHIDEVVVTDNSDNGWVGRINNEVEYTRSAIGFIYRQFLLDICEIRNRNKDDATKYADKCISHVYFLVDQPFRQWLANIKPKDSMNERCAQWRNTLHNILINEAKGMLENATLRDFTGRPVVQSEKESTKNIVTAYSIFTSRLKKLSKK

SEQ ID NO: 5240 - protein, 506 aa, Geobacter sulfurreducens KN400; identical to SEQ ID NO: 5236

SEQ ID NO: 5241 - protein, 556 aa, Gardnerella vaginalis ATCC 14019
MSRFNLLDEPWISVIVDEKGHNKLVSITDVFKHASEYKALAGDMKTQDFALLRVLLAAIHTVFSRYDIQGNSREFDSGEDSEDDFNEETMDIWREVWNSKKFPDAVFKYLEQWHDHFYLFDDKYPFFQVLKQDIDSKKLGGKSPSEISGKNINRLISESNNKIAVFSPKDNVDNNKSSLTEPQLARWIITLQSYAGLADKTMFGTEKYKASKGWLFDLGGIEIIGANLFETLMLNCVLVGDVQSPEKKQKPCWEYSGTENIENSFYETFIDNISQLYTRWSRAIYINPDISVDKPISVSIVKLPDINHKNSFIEPMTVWQYNKEGENKDKYTPRKHRTEEAMWRSFGLLTSQELYDGSVKNHKPGIMEWLNKIKHDITGSSISLQAISMKDDGNATSWVPTDEICDTLYIDEVVVTDNADDGWVYRINNEVEYTRSAIGFIYKQFLLDICEIRNRNKDDATKYSAKYISQAYFLVDQPFREWLANIKPKDSMNERCTQWRNTLHNILIDEAKGMLENATLRDFTGRPSDQSEKESTKNIVTAYNIFTSRLKKLSGK

SEQ ID NO: 5242 - protein, 472 aa, Oceanithermus profundus DSM 14977
MKNTGAFNLITDAWIPILPTSGSPREVGLLEALERAHEFRGLALAHPLEHMAVLRLLLAILYRVLTPGRDLADLQRLYREGRLPADAIGTYLNEHRERFALEGDTPFLQVPDVETTPTAITVLTADLPQGGWPLLTGRPDSDPPPLSPAQAARTLLAHQTFAVGGLLNRNGVTSVLDAPSARFAQFHAVGETLARTLLLNLAGPSEPADLPFWERPQPTAADVEAYRTRVQPLGPATAYTYLSRAVRLIPTPGGRYAQVRYAAGWRYDDLPNDPMLAWTEHRTQGRVPHRLDPEREAAFDLLAALPVGEGARYPSTLRHALALTGELPRYVAVGALLTDPKRPAKVLGHRLEQLRASALPGEATLALLEAAEETAEAARKVVFHVLHEAHPHWSNSQVAARYRTLNPLAPYWNAVFEAYTAGSGDAPDVLATALRRVEEALAVPYANHPRILALLANRLRPLARNPKEVSHA

SEQ ID NO: 5243 - protein, 523 aa, Deinococcus proteolyticus MRP
MPSLQFRAKEVFILVSFSLLRENWVPVLDLEGKTASVSLSDTLLTPQLYRRIDAGHPLHTAALYRLHLALLHRALGPSSAEDAAQWYSAGFPSEKVQAYLECYADRFDLFGPQPFMQVVGLDPASVGENFRSHWTRLSTEDGSPNTTALFNVEARPNGGRMDEITAAEAAVQLLSQQSFTLGGLIKRFTTSARAAPVATAALFLAEGHNLQQMLALNLVPYTASMAARDLPVWEQPPLTVADIQRIYADKEPKPRPAEGFVSRYAWPSRSILLLPEQTEGGLKVRTIGFGAGVPLAGAGEGAGANLDPMVGLLPSRDDKGDPYPYKLRRDRLLWRDLTALLPSPEVKVSEAKDGKGKKKVTAKPGRTAYVLEHAAEVMRLVQAQRQPAAPPVRPVVSQSQAAELDEPLPDAPAAPPVLPVVVFGQLTDQGKAFAIRQETYTLPQRFIENPEHFHDYIKGSLETATMVGNALWSAVKHLAEELLKKDGSRSPDPADIRKLSEQTDYPSKRGTSRARRFQFSGLG

SEQ ID NO: 5244 - protein, 574 aa, Coriobacterium glomerans PW2
MKDDINSDPTFNLVTEPWIPVTYTDEHKADVSLSTVFKDADQIQEISDEFPQFRIVLLRFLIAILLRAYSSQALSKRDALALWSDLWTQRHFDSEYVDEYLEHFKDRFDILSPVTPFYQVADLTYSDEKKEYDWISELVPDIPKPDKYLFAMKERSSSPPCIKLSEAARYLILAQAFDFAGIKSPVEGNTQVKRGHVYAPHGVVQTGFVGAIGGVYVRGRTLYETLLFNMVLYDSRASNSDKESDVDLPPWERSLPSCDIVFREPNGPVDLLTWQSRRIRLIFDGEKNSAIGVVICYGDATVSYDKHPYEWMTAWRSDGGLQKKLGLSHTPWVPLKHDPSKTIWEGLSALLAARNEEGADVRPGVIRWNETLGEADIALPKSGLIVSICAQGIVYNIKKGSSAIIDSIDDHFDLDVSMMRHDAQAAAASIDLVSRTDQAVLSLMRYVRNMESSAGYMRQNSTMENDIRECAYSELNTIFRKRLSGFTPDQDIDSYSNDWKEEVRSVLLDLGKSYASAASSSAFSVHRVKFGKKEELMTSGKAQILFYRGLTKALGSPTFNSGSRIEEDSHVEHL

SEQ ID NO: 5245 - protein, 500 aa, Marinithermus hydrothermalis DSM 14884
MTYSNLKEVNPLEKFNLLEESWIPVLKRGTVTEIGLAEALVQAHSIERIETPSPLEEAALHRLLLSVLHRALGGPRDVDGALDLLESGVFSKEKLEAYLDRYHKRFYLFHQQTPFLQIADLPEDPPPVPWVKLRPDLASGNNPTLFDHTTEASFPTASYGEAARALLVHQTFTTGGLLKRFKVTSAKGGPLAGAAAFLSTGKNLFETLLLNLVPYAPEDDFPVWEASPLRRTDVEGYQTAWPLSGTTRVYTWPARGVRLLDEGSGVRFMAYGPGVKPGEAYFRDPMVAYRQDKKGQMLPLRLSTERSFWRDFGAMLPAAGGAWPATLAHAEALLREQSLYFRDSIRHGLRVLGQVADQAKILDVRREVYPLPPGLLEATALSDLEVGLKRAEALGQGLRSLAWTVARGMLGEKDSKELSNFAASLPLERIFWAHLDGAFPGFMARLGQSGALKGWNESLARAALEAWEATRLFVGTGGRHLKALAEGEKRLGGLLREVRA

SEQ ID NO: 5246 - protein, 511 aa, Salmonella enterica subsp. enterica serovar Typhi
MDLTKEKWLPVIFSNGDKKKISLRDLLDNRIQDLAYPRADFQGAAWQMLIGILQCTVAPEDKEEWADIWHESIEFEQWEKALNTISLALQFGEQKPSFLQSFDPLDSEYGSIAGLLVDAPGGNALKLNKDHFVKRGNVEQICPHCAAIALFAIQTNSPAGGAGYRVGMRGGGPLTTLVVPQEEDKYPLWKKLWLNVLPQEEPPNVTQHPLIFPWLAPTKTSEKAGNVVTPDNAHPLQAYWGMPRRIELDFTHTVAGICDLCGEHHESLLLQMRSKNYGVQYDSWLHPFSPYRQALKDPSAPWLAFKGQPGGLSYKDWLGLMLNREDKFNKMQPAKVVRAAGQRNKMSLWCFAWDMNKAKVRCWYQHRIPLISVSHEEQFLAALNIVLVLASESLSLLRNALKSAKFDCPKEAKMDFSMVDIAFWQETEPAFRTLQEALAVDPLRQDTQTRHAVSQWEAELAHYLFHVFDRDALTNPDCPDDILQRQLTARQDLASSYRKHKARKDVLALVE

SEQ ID NO: 5247 - protein, 502 aa, Sphaerochaeta coccoides DSM 17374
MLNRFNLVREKWIPIAGGSRVSLMDIFTDPSIGHVGGTAVQKLAILKLLLAIAQTANIPCDEHDWEKLQPTGLATACKEYLEMHEECFWLYGTTPFLQFPRLHDLADKTDITSIGATYIPDLQSSNDTILFQSQTSRPQTDAEKAVFLVTLMNYALGGKRTAKKIPPLTKEYAGKGSTSKPGPSIGNYTGYLNSHLLGQSLWETIWVNLFTQEELNTIQNGWGNLEQPPWEKMPQGEDDEIARKYKTSYLATLCALSRFVLFTDEGGIIYAEGIQYPTIKEGWIDPFLSINSEQKTLYADVNKRPWRSLPALLGTAFNASGKEFFPCKQISSHIFRTQQVCPFVGIWSGGLQIRGQAGDFSIKQNDDFIESSVFIKSSCIETTWFAALNKEMMDLDKKSKILFAAVKAYYNEKNTRAHSEVAQYSFWSACEQHFPKLIEACDEDADPEDLHDIQEVFWKIVMDIYTMSCPAETANQIRRWARNEPKKPRPTFYLAKEDSNGK

SEQ ID NO: 5248 - protein, 555 aa, Streptococcus salivarius 57.I
MSRFNLLDEPWISVVYDEKGSTKDVSLQDLFTNAHQYKELAGDTKTQDFAVLRVLLAVLHTVFSRFDVDGNVYEYLTIDERWNQLEPVDEMDIENYVEALYETWEKLWANKIFPNIVNQYLEKWRDRFYLFDEKYPFFQVTKEEIAGDKISKAKASSILGKNINRIISESGNKIALFSPKDGENKNTLTAAELARWLITFQGYSGLSDKVIFGNEKYKSSKGWLFDIGAIYIKGNTLFETLLLNYISPYNERGNVENIQRPCWELESSDIIKSYLDEKDITNIASLYTVWSRGIYIDPDFNLNKPFSFEIVKLPDINHRDNFLEPMTIWKYNVSGENRDSYTPKKHFLNQSLWRSFGLLSIKDTNLQYRKPGVIDWLTYIDDIIGNRLSTIVAISMQDDGNATSWLPTDEVIDSIFINDLVLTDLDEGGWVPRINEVVEETKKIISRTYKTYINDIKEIRNISNGSYTQQMVESLYFKIDQPFRQWLASIQPEDNKDSKIQEWRVLLKKIVKAEAEVILHQGGTRDYLGIQKDGRIKNIATAYNSFDFWLRQQLK

SEQ ID NO: 5249 - protein, 493 aa, Thermus thermophilus JL-18
MRSLAKFNLIDEPWIPVLKGGRVVEVGIGEALLRAHEFTRIETPSPLEEAALHRLLLAVLHRALRGPRRLEDVLDWWREGGFPQDPIRDYLNRFRDRFFLFHPEAPFLQVADLPEENPLPWSKLLPELASGNNPTLFDHTTEENLPKATYAQAARALLVHQAFAPGGLLRRYGVGSAKDAPVARPALFLPTGRNLLETLLLNLVPYNPGEDAPIWEIPPLRFGDLEGGKTAWPLSGRTRVYTWPARGVRFLDEGNGVRFMGYGPGVEPLEAPHRDPMVAQRLDAKGNLLVLRLSEERSFWRDFSAMLPRQGGKVAATLEHAENLQGELEESEEVRVNLRVLGQVSDQAKILDVRREVYPLPSGLLTPRAEENLEKALKMAEVLGQGLGRLALRVAQAVVGKRDHKELADFARSLPLERLYWHVLDGAFPGFFARVEEEASLDLWREALRGAALEAWKATRRFLGTGARHLKALAQGEQEFGRLLGELGEEVRT

SEQ ID NO: 5250 - protein, 517 aa, Thiocystis violascens DSM 198
MNLISECWIPVRRADGSRQRIAPWQLTDAIDDNPILAVASPRPDFDGALTQFLIGLLQTTCTPDLFTWRTWRKTPPTPAELKTRFETVAYAFELEGEKAFMQDFSPTELDKQFAISALLIGSPPEDSETDLFIKQETVKQLCPHCAATALFSLQTDSPEGGRGYRTGLRGGGPLTTLVLGKHLWDTGWLNVLEKSRYVFGASDSDLLSQDRFPWLKPTRTSEAQPPAGVTTPVDVHPDQQFWALPRRIRLLPKETEPTACDLCGRETQMIYRNFTAKNYGVNYSGFQHSLSPHYVKDGALMPAHPQPGGIGYRHWLGLVESDADGVHRPARVVEQFRSLTRMDGDLWAFGYDMKSNKARCWYDARMPILLISKDMEAVFRDLVTRLVNTADKVAGDLRNSLKTALFGETKVRGDLSFVQSAFWAETEAAFYDHLRQLRDLLPTDQQAHPILESWLKTLRAAAFLLFDRHSQTGDFDAVDPGQIARARNGLGKALAGAPLKEKILGLPKPLKPKRQKS

SEQ ID NO: 5251 - protein, 545 aa, Desulfomonile tiedjei DSM 6799
MAYNLLEEKWIPVRTADGSRRKVAPWEITSIDHGGPIVAIDSPRADFNGALMQFLIGLVQTSELIPKREPEWSRGYRSPPTDAALRDAFLVHKDVFFLDGDGPRFLQDLKLENGTPWPISDLLIELSGNGHFTKSKKGNGFCFCCAAIALFCLQTNAPEGGRGHLTGLRGGGPLTTLVLPPEQDLWKTIWLNIIPEEVLISMGAGDDSPDIKDIFPWMAPTRTGEKNTGTATLPGDAHPLQMYWSMPRRIRIDFNELATGACDVCGEESESLVQGYFARPHGVKYEGPWVHPLTPYRFDSNNVPISQKARAGSLNYRSWVGLVIRSTDADEKSKVQSQPARVVEKFTKRSREVAGKRTGAHLWGFGYDMEHMRARCWFEGRMPMHAISDERTAEKYTLNSERMVRAAITIGGFLSLCLRQAWFGERDKVRGDTGFVGEAFWSRSEHLFFLHLDKLIRELETSDRDRSLPTETLKSWHRVLCKLSLELFDVYVTSGPIENSNPARIARARNRLRFWPHGKKVKRDILALPDEPKKSSVSQVEITRS

SEQ ID NO: 5252 - protein, 578 aa, Lactobacillus buchneri subsp. silagei CD034
MADKRFNLTTDPWIKVLDKTTNRERTVSLIELFKNAQDFSQLSGEMRSQDLAILRFLLAILTTVYSRYDANGRGYDWLDVNPDTMQAEMNDDLEDSEINVYLYETWAHLYRSNHFTNIVTKYLKRYADKFDMFGDQPFYQVTETQYNRLVPKKKQISGSEGPGTVAVKQINRLISESGNTPSIFTPKSDEFKNDIQVDELVRWLIMYQNFTGVTDKTKIETADKFSASAGWLYKLNPVFADGETLFQTLMLNLVLRSDEHASVIQQPVWEYDTIDAYVNERKKQVQPTNIAALYTTWSRLLHIDWSERGQPTIFSAELPMFDSDEAFIEPMTTWREDKKTGRYRPAVKTLRSLGTAMWRNFGEYVKVDPSDSGHEAGIVDWLSDLRNQDDSDDQIIRGSLLTLASVGLVSDGNATSQAPVAEVYDDMHINADVLFDPDEDQALHWPHRIEEMIQLTQIIGSDYWHFAADVARIRNLEVRPFANQLSAQFYEGLNKPFKDWLADLTNQDDRDEKSEEWRKFLRKYVLDAAGNVMQTSSSRDIGGFMDVSGIIDKNKGLVNIFTVNNRLKYRVQVHMNQN

SEQ ID NO: 5253 - protein, 492 aa, Thermus oshimai JL-2
MAKFNLLEEPWIPVLRGGRVEEVGLEEALLKAPEIARIETPSPLEEAALHRLLLAVLHRALGGPSRVEEVGAWWQEGHFPLEPIREYLDRYRARFYLFHEEAPFFQVADLPEKDPLPWSKLLPELASGNNPTLFDHTTEENLPQVGYAQAARALLVHQTFTPGGLLRRHGVPSAKGAPLAGAAAFLPTGANLFETLLFNLVPYQKGEDAPLWEVPPLRLEDLEGHKTKWPLSGVTRVYTWPSRGVRLLDEGDGVRLMAYGPGVEPLEAAFRDPMVAYRKDAKGNLLPLRLSAEKAFWRDFRAMLPQAEGVLPSTVNAADELLGYLEGEGIDPLPSRSLRVLGQVSDQAKILDVRREVYPLPPGALSAKAELNLGWALERAEALGQGLRRLALLLAQEVLGSGEPGELSAFAASLPLERLYWHALDGSFPALLERLGKEGDRAWWKEVLRQAALEGWNATRVALGTGARHLKALAKGEALLLSLLAEKEEVKR

SEQ ID NO: 5254 - protein, 546 aa, Mycobacterium sp. JS623
MTTLGDTFNLIDQPWIPVRSIDGRSREVSIGELFTEAPVIRAVGGDIPTQAFAIQRVLLAIVRRAIDWSEDPVRRWGELWRAGEFPRAEVESYLRTVHHRFDLLDTVAPFYQVADLQTAAGVFKPVDLLIADRPTGAKYFTTRAGAGAQRLSLAEAARWVVHCQAFDPSGIKTGDLRDPRTKDGKGYPIGIAWCGQLGGVLLEGSNLFETMMLNTVLRNTNGTATWPSDVPVWERTHPEVGERDDTAPLGPCDVLTWQSRRIKLQHDGKFVNGAIVGNGDRISPHNRQDIEFCTAWRHSEPQSKQFGETRYLPAQFDPDRSLWRGIEGLLADIPSQDGKPAPRLAPGVVNWIDYLVAEKLLDRSVRIRPHALALQYTNAWTPKPNGVVASIDDALQIKVALIGRRSQPRVFANRAVQAANDSATALANLAGNLAEAAGGNAQLRKATARAAAYFALDAPYRQWVADLDEDTDLEEHCAQWQRQVREIIGANGRDLISSAGKSAWKGRMLGQRLLDSSLASKYFWSALRSALPAAFDTEPPQEGEQQ

SEQ ID NO: 5255 - protein, 519 aa, Salmonella enterica subsp. enterica serovar Bareilly str. CFSAN000189
MDNFSLLTTLWLPVRFKDGSTGKLAPVNLADENVVDIAATRADLQGAAWQFLLGLLQCSIAPKRYKNWEDIWFDGLHADALHKALAQLEHAFQFGAETPSFMQDFEELPDNKITIASLLPETPGIQTTELNTDHFIKRGVMECFCPHCAALALFSMQLNAPSGGQGYRTGLRGGGPLTTLIELQEYQGERQTPLWRKLWLNVMPQDAADLPLPVVYDAAVFPWLAATRTSEPPAHTITTDEQVNKLQAYWGMPRRIRLDFATIRQGVCNICGNNSDELLIQMLVKNYGVNYDRWRHPLTPHRLQIKNSKGFEPVITQPGGLLWRDWLGLSQENPTEKNTEYPAQVIKVFNARELRNIKVGLWGFGADFKKMKIRCWYEHHFPLLMTEGLIPDLRKATQTATRLLSLLRSALKEAWFANAKGARGDFSFIDIDFWNLTQGRFLNLIHDLENGHKPDERLNKWQRELWLFTRCYFDDHVFTNPYESSDLERIMKARKKYFTSSAEKQSAKAAKAKKQEAAE

SEQ ID NO: 5256 - protein, 518 aa, Salmonella enterica subsp. enterica serovar Typhimurium var. 5- str. CFSAN001921
MDNFSLLTTPWLPVRFKDGSTGKLAPVDLADENVVDIAATRADLQGAAWQFLLGLLQCSIAPKRYKNWEDIWFDGLHADVLHKALAPLEHAFQFGAETPSFMQDFEPLSGEKVSIASLLPEIPGAQTTKFNKDHFVKRGVTERFCPHCAALALFSLQLNAPAGGKGYRTGLRGGGPLTTLVELQEYQGERQTPLWRKLWLNVMPQDTADLPLPDQCDATVFPWLAATRTSEQANAVTTPEQVNKLQAYWGMPRRIRLDFATLQSGCCDICGAESDELLGFMTVKNYGVNYDGWRHPLTPYRAPVKDQNAFFSVKPQPGGLIWRDWLGLSQNNQTEANYESPAQVVKVFNARSLTDVKAGIWGFGADFDNMKIRCWYEHHFPLLMTEGLIPDLRKAVQTAARLLSLLRSALKEAWFADAKGARGDFSFIDIDFWNLTQGRFLNLIHDLENGHKPDERLNKWQRELWLFTRHYFDDHVFTNPYESSDLERIMTARKKYFTTSAEKQSAKAAKAKKQEAAE

SEQ ID NO: 5257 - protein, 518 aa, Salmonella enterica subsp. enterica serovar Cubana str. CFSAN002050
MDNFSLLTTPWLPVRFKDGSTGKLAPVDLADEKVVDIAATRADLQGAAWQFLLGLLQCSIAPKRYKNWEDIWFDGLHADALHKALAPLEHAFQFGAETPSFMQDFEPLTGEKVSIASLLPEIPGAQTTKFNKDHFIKRGVTERFCPHCAALALFSLQLNAPAGGKGYRTGLRGGGPLTTLVELQEYQGERQTPIWRKLWLNVMPQDTADLPLPDQCDATVFPWLAATRTSEQANAVTTPEQVNKLQAYWGMPRRIRLDFATLQSGCCDICGAESDELLGFMTVKNYGVNYDGWRHPLTPYRAPVKDQNAFFSVKPQPGGLIWRDWLGLSQNNQTEANYESPAQVVKVFNARSLTDVKAGIWGFGADFDNMKIRCWYEHHFPLLMTEGLIPDLRKAVQTAARLLSLLRSALKEAWFANAKDARGDFSFIDIDFWNLTQGRFLNLIHDLENGHKPDERLNKWQRELWLFTRCYFDDHVFTNPYESSDLERIMKARKKYFTSSAEKQSAKAAKAKKQEAAE

SEQ ID NO: 5258 - protein, 518 aa, Salmonella enterica subsp. enterica serovar Heidelberg str. CFSAN002069
MDNFSLLTTPWLPVRFKDGSTGKLAPVDLADENVVDIAATRADLQGAAWQFLLGLLQCSIAPKRYKNWEDIWFDGLHADVLHKALAPLEHAFQFGAESPSFMQDFEPLSGEKVSIASLLPEIPGAQTTKFNKDHFVKRGVTERFCPHCAALALFSLQLNAPAGGKGYRTGLRGGGPLTTLVELQEYQGERQTPLWRKLWLNVMPQDTADLPLPDQCDATVFPWLAATRTSEQANAVTTPEQVNKLQAYWGMPRRIRLDFATLQSGCCDICGAESDELLGFMTVKNYGVNYDGWRHPLTPYRAPVKDQNAFFSVKPQPGGLIWRDWLGLSQNNQTEANYESPAQVVKVFNARSLTDVKAGIWGFGADFDNMKIRCWYEHHFPLLMTEGLIPDLRKAVQTAARLLSLLRSALKEAWFANAKDARGDFSFIDIDFWNLTQGRFLNLIHDLENGHKPDERLNKWQRELWLFTRHYFDDHVFTNPYESSDLERIMTARKKYFTTSAEKQSAKAAKAKKQEAAE

SEQ ID NO: 5259 - protein, 518 aa, Salmonella enterica subsp. enterica serovar 4,[5,12:i:- str. 08-1736; identical to SEQ ID NO: 5256

SEQ ID NO: 5260 - protein, 518 aa, Salmonella enterica subsp. enterica serovar Pullorum str. S06004
MDNFSLLTTPWLPVRFKDGSTGKLAPVDLADENVVDIAATRADLQGAAWQFLLGLLQCSIAPKRYKNWEDIWFDGLHADVLHKALAPLEHAFQFGAESPSFMQDFEPLSGEKVSIASLLPEIPGAQTTKFNKDHFVKRGVTERFCPHCAALALFSLQLNAPAGGKGYRTGLRGGGPLTTLVELQEYQGERQTPIWRKLWLNVMPQDTADLPLPDQCDATVFPWLAATRTSEQANAVTTPEQVNKLQAYWGMPRRIRLDFATLQSGCCDICGAESDELLGFMTVKNYGVNYDGWRHPLTPYRAPVKDQNAFFSVKPQPGGLIWRDWLGLSQNNQTEANYESPAQVVKVFNARSLTDVKAGIRGFGADFDNMKIRCWYEHHFPLLMTEGLIPDLRKAVQTAARLLSLLRSALKEAWFTNAKDARGDFSFIDIDFWNLTQGRFLNLIHDLENGHKPDERLNKWQRELWLFTRCYFDDHVFTNPYESSDLERIMKARKKYFTSSAEKQSAKAAKAKKQEAAE

SEQ ID NO: 5261 - protein, 520 aa, Escherichia coli LY180
MNSFSLLTTPWLPVRFKDGTTGKLAPVDLADENVVDIAAPRADLQGAAWQFLLGLLQTSFAPKNHGRWDDIWQDGLEAEKLREALLSLEHAFQFGADSPSFMQDFEALKGDKVQVASLLPEIPGAQTTKFNKDHFIKRGVTEHVCPHCSALALFSLQLNAPSGGKGYRTGLRGGGPMTTLIELQEYQGNQQTPLWRKLWPNVMPQDEADLPLPKKFDDLVFPWLGPTRTSELAGAVVTHDQVNKLQAYWGMPRRIRIDFNTTTVGNCDICGEQSDALLSLMTTKNYGANYAMWQHPLTPYRIPLKEGGEFYSVKPQPGGLIWRDWLGLIETGKSENNTELPALVVKLFNASSLKQAKVGLWGFGYDFDNMKARCWYEHHFPLLLKKKEGQIPKLRLAAQTASRILSLLRSALKEAWFSDPKGARGDFSFVDIDFWNKTQHRFLRLVRQIEEGQDADELLGKWQKEIWLFARQDFDERVFTNPYEPVDLKRVMTARKKYFTTSAEKQSAKAAREKKQEAAE

SEQ ID NO: 5262 - protein, 518 aa, Salmonella enterica subsp. enterica serovar Thompson str. RM6836; identical to SEQ ID NO: 5256

SEQ ID NO: 5263 - protein, 502 aa, Synthetic Escherichia coli C321.deltaA; identical to SEQ ID NO: 5235

SEQ ID NO: 5264 - protein, 519 aa, Salmonella enterica subsp. enterica serovar Agona str. 24249
MDNFSLLTTPWLPVRFKDGSTGKLAPVDLADENVVDIAATRADLQGAAWQFLLGLLQCSIAPKRYKNWEDIWFDGLHADALHKALAPLEHAFQFGAETPSFMQDFEELPDNKITIASLLPETPGIQTTELNTDHFIKRGVMECFCPHCAALALFSMQLNAPSGGQGYRTGLRGGGPLTTLIELQEYQGERQTPLWRKLWLNVMPQDAADLPLPVVYDAAVFPWLAATRTSEPPAHTITTDEQVNKLQAYWGMPRRIRLDFATIRQGVCNICGNNSDELLIQMLVKNYGVNYDRWRHPLTPHRLQIKNSKGFEPVITQPGGLLWRDWLGLSQENPTEKNTEYPAQVIKVFNARELRNIKVGLWGFGADFKKMKIRCWYEHHFPLLMTEGLIPDLRKATQTATRLLSLLRGALKEAWFANAKDARGDFSFIDIDFWNLTQGRFLNLIHDLENGHKPDERLNKWQRELWLFTRCYFDDHVFTNPYESSDLERIMKARKKYFTSSAEKQSAKAAKAKKQEAAE

SEQ ID NO: 5265 - protein, 518 aa, Salmonella enterica subsp. enterica serovar Heidelberg str. CFSAN002064; identical to SEQ ID NO: 5258

SEQ ID NO: 5266 - protein, 567 aa, Lactobacillus equicursoris DSM 19284 = JCM 14600 = CIP 110162
MDSFNLVTEPWIKVLESKTNSERLVSIEELLKNAKDYRQIAGEMHGQDLAVLRLLEAILTTIYSRVNEDGQAYEWLKLDERMQVVGSNIDEAEFDSEELLNTWEALSSKGGFTDAVFNYLDRNADLFDFFGSHPFYQVTKEQYDAHVVAAKRVDKGKGTVDLMQMNRLISQSGNSVALFAPKSAPQKNKMSIDELVRWVISYQNFTGVTDKTKVVAKEKMSNGRGWLYTLNPIYIKGKNLFETLLLNMILLNDDEDKYTIQKPVWEEDLDSYVKKRLKQIKPDNYAEVYTVWSRLLHIEWKDDVPTVFSAGLPAFNSTNAFDIEPMSTWRKDKDGNWIPATRQLSSLGWAMWRNFGQYVPLEKNEGKQPLIIEWINILKEGGYIQSTARINLHTTGIISNGGATSLMPAAEFDDNLQIEADVLFDENPDLAKKWPARIEEMVELNQTVGRKYYGFLMEIGTIRFGSRGAGDFAGRKSQDFYDNLNEPFTNWLSGLSNQDEREEKVREWKDELQKLSLQTLDQFLEQMTPRDITGVKKSGNDDADKDRDNIFKAASKFKAGVWKVIHK

SEQ ID NO: 5267 - protein, 503 aa, Parasutterella excrementihominis CAG:233
MTQISLISEQWIPVRDRKGVVRKISPLEILDEEIVDIAAERADFQTALWQFLIGLIQTTLAPEDEDAWFDIWEEGLEKADLAKAFSKVGPAFIFGPQSPSFMQDFDQLEGEAVPLAALLPESPGENTIKHNKDFFIKRGEKRFCPHCAAMALFSLQLNAPSGGQGYRTGLRGGGPLTTLIELHSYKGDRNVPLWRKLWANVMPEFESNLPVPKEFDAAVFPWMGKTRTSKAKGSETTPEQVNPLQAYWGMPRRVRIDFEDLEEGRCDFCGEESDQLLSKMKVQNYGINYSGWVHPLTPYRCKLKTPGELNSVKLQPGGLVWKDWLGLNEETTRKDTKEIPALVVETFKHHIGTETKHGLWGFGYDFDNMKVRCWYEHHLPQLLSKEMQSSLQVAQDKAARTLLGLKRAFSKLNRECSYLDVEFWNLTQNLFLGLIRELDEKNSDSESLSAFIKNINRFALNFFDDRTFSSQMNPKDYKECSEARKNLLASLYAKSKSTPKEAK

SEQ ID NO: 5268 - protein, 556 aa, Schaalia odontolytica ATCC 17982
MKNPEYNLLDEPWIPVRLVDGTITDVGLLELLRRTTDIADLACELPTQSIAIQRLILAIMYRVATPRDTRDWVRQWDEGAPTEQMIEYLERWRDRFYLFGGRFPFMQVANLRTAKDAVSGLEKLIADVPNGEQFFTTRHGRALACIPASEAARWLVHAQAYDPSGIRSGAVGDSQVKGGKGYPIGPAWCGHLGLVWLKGKDLDETLVLNLIPATTAELRGVDSSTDWGACSWEDPEPETSVRGDYSLLDPAGTPKELSIPRLLTWHSRRIRLVGDSSGVTGVVLAQGDKLAPQEMRLYEPQSLWRYSTPQSKKFKTDVYMPRKFEAGRALWRNLPGTLPTVTTVQGVDKQPKREFLPSATLSFHYQLDNSSIQTSYPKVMRIQAVGVTYGPQEATFEDIYSDELTLSVAVMRVEREDLSAQIDREVRLTEEVARDVGTLAANLARAAGESGDGAGDGARDRAKELFFSAVDNDFRAWLTQVDGHESARDVGCRWECTLRQHALGIQTELVRSASSSAIVGRDTGRGYMNVGIAENYFRSALNKRLPVQNTNQEGTK

SEQ ID NO: 5269 - protein, 537 aa, Faecalibacterium prausnitzii M21/2
MKEIEFNLLTEPWIRVRLRDNTVREVSLTEALVSAQDYVDLAGEMPTQNAAVLRLLLAVLFTVFSRVDAKGEPRPLMQSDDALERWSALWQLGHFPAAPVRDYLEQWKDRFWLFHPTHPFWQVPQAKIGTEYGAAKLNGEMSESSNKLRLFPLYAGQSKEQLSYPQAARWLLCVNGYDDTSAKPKGKGLPSVGAGWLGKIGFIQAQGDNLYETLMLNLTLLRDGRECWGESKPCWELEAPKSAERTEICCPDNPAQLLTLQSRRLLLHRTGENVDGFCLLGGDFFPRENVFAEQMTIWRTMPIKKNEPVVFVPCRHDPAKQFWREFPAVFCQDSGHRPGVVCWIEKLQEKRLKLLDPRRKVHFRISGVQYGDKDFFVNDSFSDSLTFQAGILDEIGRPWQSRIVREIERCEQTAALIGRFAQELAIAAGDRNENAGGAVRAQFYFAVDRPFRQWLQAIDQEQDDPDEAALRWQTRARSIAEKLGKQMVMEAGNAALKGRRIVVDKDKKTERTILYTAPKAYNHFRTRLWEIYPKTEP

SEQ ID NO: 5270 - protein, 550 aa, Bifidobacterium catenulatum DSM 16992 = JCM 1194 = LMG 11043
MDRNFSLLDDGWIPVSYVDGHPDEVSLRRLFEDAWKIKEIRGDIPQQAIAILRLALGILYRAYYVENPSEEQMRDMWDDIFRIGHFDLDILEDYFDEWGDRFFLFGDRPFFQVSGLEYVGQKPYDPVSEMIADMPKPEKYLFAMRGLGTTDTLSLPESARWLVYLQSFDTAGIKTPVKGNTHINKGKIYPLKGFLGTGWLGGVGGVYAEGANLFETLMLNWVLYDDRYDSEYYRLFGNTNDIPVWEKNEVPSADMDDQNSFAGPVQAMTWQSRRIRLVPNEDCTRVIGVVNCYGDAVTQYNTDGFEKMTAWRRSIPQQKKLGLPVPPHMPVTHDASKALWRGLEPILCVGDDGDFRPGIIRWLEEIRTEVLDSEEHVLNMVTIHAQGMTYGTQSSVFETGIDDKLSLSMVMFRHDYAGIAAVVDVVKSTDKAVTALTMFVRNLRSAAGDHSGKTQEIADQIRESAYADLDLLFRDRLANFDESQDPVTYSNAWLDEVHRLLLTMGRDYLSQSPVPVFEEHESGRFGVMSAALAQLLFRGSLNKELGRISD

SEQ ID NO: 5271 - protein, 516 aa, Desulfovibrio piger ATCC 29098
MNLVDDPWIPCIRRDGMVRPASLRDCFTCDDIVDLAVRPHERVALMRLLLCVSYAAAGIPEDYDGWEDLRERLPLEVPVYLDQWRDAFELFHPQKPFLQVVGLRSASASGDLTPCSKLDFSLATGSNSTLFDHAALMERAFTPEWLALNLLTYQMFSLGGLIGSVCWGEKTTGRSSCDGPCAPGSMLHTFLRRDVLLDSIHVNLLSEEELHDYQQLGEGWQGRPLWERFPHGLDDAPAIRNATETFLGRMVPLTRAVLLSRDGAGMVLGDGLAFPSYTSPQRPFPPEVTATVIAGGKKDVRFLLGAQPDKAIWRQLAALTVKRQGDGIGGCAALIHGHEEQGTDLVVCGLSRDQADVVDVLESVFHVPGAMFQTAGHTLYEGEVARAENIAGGLGDAVERYRRLVDGGWEARLKLAGPKKGGELARLKAQAFRCYWTSVETGVSLLWDMVRTCGSEAFVPVQRAWWAHLEKSARAAYAAACGKDTERQMRAYVTGRRILAGRLRKYLEHDGKKEEA

SEQ ID NO: 5272 - protein, 551 aa, Actinomyces urogenitalis DSM 15434
MTPSFNLLDEPWIRVTWLSGESEEVSLLTLFRDATQIEGIHGEIASQNIAILRLLLAICHRTMDGPEDLEVWREYWSSPGSLGQDASTYLERFRSRFDLRDPEQPFFQVAGIHTASGKSSGLESLIADIPNGHPFFTTRMGEGLSQMTWAEAARWLIHVHAFDPSGIRSGAVGDPQVRNGKGYPIGPGWTGQIGTITLAGDNLEQTLLLNTVVCNCVEGLQEVDLSRDLPPWERPADGPGGSASKQPTGPVSCYTWQTRRVLLHGKEEVTSLFLGNGDKATPQNRQHVEPLTAWRYSEPQSQKAKATVYMPRKLPTDRAMWRGLPTVVPHLSPMVSTKAGGQVSRFLPPAVITFYQRLMYQRVIPPRKLLPIHAVGMEYGAQEAVITELVEDTLHVPSALLGRDNTRLLTLVSDAIEVTEQAAGTLRNLAANLDRAAGGSPDTSSAARQRAGAQFYQAIDERFPRWLADIADADPESVAEQWREVLRSEAHRQAEHLAQNAPSTAFTGRGDGTSRMDVGRALFFFRRKLAEVLPRPGSQIPAAHDDERADQ

SEQ ID NO: 5273 - protein, 581 aa, Corynebacterium accolens ATCC 49725
MTDTETFNLLDEPWILCMDSADNRKALSIRDIFSGQGDAHKIVGDSPTQDYAVIRLLLAIFWRAHAQELAEAAGGRRKRASFDWGEWFAEKREELCETKRDQVVLDYLDAFRDRFDLLSDTVPFMQVADLHSKNMETRPIVHIVPEAADDHFTMRTAKGRQSVSFAEAARWLVHLQAYDYSGIKTGAVGDPRVKGGKGYPIGTGWTGRTGGTLVLGTEGLLETLLLNTPMAAVMTEQGTNPIELDKPVWEREPDTAAQRRGSDDKLGAVPQGAADLATWQARRVRLVAEEGQITRVLVSNGDRIPDAGKNVMGDPMTPYRYSPNQSKAGQDAYYARPYDSTQTMWRALDALVAVEDDPGFDQKKAKAPKRPANLSNLAALDVDGYLNQSAFDIALVSMEYGPQESSVATTFSTTIGLPLVVLREDDLGRQARNAVRTAAQKTYETAVSLGWFEGQLRVAAGDDYEFGVKSKDRFYAQLEPEFIAWMQTISAENADSAQINWQERVRTVAVSHAMELLRGAGMKAIVGREVDTGEDGKGRIVSAGSLFQQLQRRFDKNLPLTGKSTRNQSPSSPMKEGVAHA

SEQ ID NO: 5274 - protein, 553 aa, Corynebacterium glucuronolyticum ATCC 51867
MSSSPPRFSLLDEPWILCESLDGTPVELGLLDVFDGKHPIKRVRGDAPTQDSAIVGLLLPIYWRAHTGDLTVFNGDNLPFSTWFAEHLEQARSGVADEAVLNYLETYRDRFFLVGGPAPFMQTPTLETKNMEFLPLSRLIPEAESEYFSMREEDAAETVPLGEAARWIVTTQAYDYSGIKPGAIGDDRVKGGRGYPIGVGWSGMTGRTLIVGNTFAETLVYNTTADCISSPEDKPCWERPVDTAAVREFPAPKGAADLLTWQTRRIRVRYEGDRATGVIVTNGDKIPDAGANVFGDPLTPYRYSKNKSKKGHTVYYPQCFDTNRTMWRSLVPLVALDSDPQFTEKDRAPKRPRNLDSLSRVFNDLGIEETIPLELISASYGPNDSTPSTTVHAGLNLPSPILQPENVELRDQIVSQATATSTAAVALGSFAGQLLQAAGGDYEFQPAPTDGALAELEHRFNAWLSTVDEDQLDEQITQWQDIVYETIIDKAETLLRGAGPKALVGRLIPPRQEGGKPWQLTAGTAFAQLRRKLLDTLSACTASKQRKEKGNKS

SEQ ID NO: 5275 - protein, 562 aa, Corynebacterium striatum ATCC 6940
MSREDSDVFSLLDEPWIAAVGSHGEPLLVSIRQIFDGTHDIAELRGDSPAQDYAVLRVLLAIFWRAHSVAKPAGKTKFSMAEWFVKARADALEGAADIKVLSYLDGYANRFNLFDSDHPFMQVADLHTEKGSVSPINRIIPEAENEFFTMRAGKPLETLSFGEAARWLVYVHAYDYSGIKSGAVGDSRVKGGRGYPIGTGWTGMTGGTYLIGANLRETLALNTTEACLRTPNDKPVWEREPDTAAERNGGAIHIGGPADLATWQTRRVRLHRENNEVVAVLVSNGDRIPDAGLNAFGDPMTPYRYSKNQSKKDFVAFYPRPYDAGRTMWRSLEPLIAMESDAPYLRSTSSAGKGAQAPKRPEILDQLAYYWRTDVLPPSVAHVGMVTVEYGAQSSSVAASVTARTTLNLPVLENDAVRRAALNAADVTLNAAIALGQFGGNLLVAAGGTYEFQAEPMDSALAQLEPAFNRWVAGWSDSPEPKEYAIEWQKQVRSFMLSRGEAMLHAAGPRAMIGRPLLSSTTEKPQIVTAASYFSLFGRRLDNSLPLLSEESKKKEMVNTND

SEQ ID NO: 5276 - protein, 562 aa, Anaerococcus lactolyticus ATCC 51172
MSEFNLIDEPWISVVTDYKGTTKLVGLREFFQNCHNYLELAGEMPTQNFAVMRFLLAILHTVFSRYDANGKPYEMVTINEKMQQVENVDEEYEEDYEDALMETWESLWKSGKFPEIVTDYLECWHDRFYLFDDNYPFYQVTKEEISESKISKTNPSEILGKNINRLVSESGNKIALFSPKYSSDDNKEILDYDEVVRWLISFQSYASLSDKVRFSNKSYKASKGWLFDLGGVFLSSDNLYKTMVLNLVLVNTSNTDYNTNIQNPVWEYKPSEVVKKYMSDNPINNTAELYTAYSRAIYISDFDSEKPFKMGIVKLPEVLHSNNFLEPMTVWRYNKDGTNKGDFTPRKHQLNKSLRRSFGLITETEDANEGNENTAKRKPGIIDWLNDVNDYIGDEFVKINAISMEDDGNAMSWVPTNEIVDSIYIEANLVNDLEDKGWIFRINKVVDKTKYIVDKIFRSFVNDTKKIRNIESNEYVSRYSESLYYELDKPFRDWLISIDYSDNKDKKIDDWYKELKKISIKQAEKIVADSGPRDYTGIIENDSVRNIATAFNFFMARINKEL

SEQ ID NO: 5277 - protein, 573 aa, Bifidobacterium angulatum DSM 20098 = JCM 7096
MADNIFSLLDEPWVQVVYRDGHPGEISLRQIFSDAPDIKELSGDIPQQKLPLIRLFLAILYRAYRVVGVNEEQMRELWKEIFSSKHFDMDIVSRYLDKWEDRFFLIGERPFFQIPDLEYVGAKPYSPVSEMIADVPKPDKYLFSMRSMEETDSISFAEASRWLVFMQAYDIAGIKTPVKGNTYVKGGKVYSPKGMSTGWLGAIGGLYAEGRNLFETLMLNWVLYDTKYDSERYRLFGNERDVPVWEQNNIPSPDLDNQSTFAGPVQAMTWQSRRLRLVPNEDVTRIVGVVYCYGDVVSPDDTDGFEKMTAWRSIPQQKKGLPTHKPVMHDASKALWRGLEPILCVKDDDDCRPGLIRWLEEIRTEIFDSEDHVLNLVTIHAQGMVYGSQSSVFETGIDDTLSLNTIMFRHDYDGIAAVIDVAKSADNAVQALTQFIRNLQMSAGDKGKSAKVENRIEERIRESAYTELDRLCRDELAAFDKSKDFIKYSNDWKDKIHRRLLEMERDYLDQSSVPVFDEHEFDNKRKSHTSNMMKATRAQLSFQSKLNRELGSLKRESSVHSDKGASDYDVIHI

SEQ ID NO: 5278 - protein, 581 aa, Corynebacterium tuberculostearicum SK141
MTEKPTFNLLDEPWISCIDSADAPVALSIRDIFSGRGDAQKVLGDSPTQDYAVIRVLLAIFWRAHALEIARTHSHNSRRTHFDWGEWFADQRETLIIERRDEVVLDYLDAFADRFDLLSETQPFMQVATLHSKKGDTRPISYIVPEAAEDFFTMRTGDGRQSLSLAEAARWLIHLQAYDYSGIKTGAEGDPRVKGGKGYPIGTGWTGRTGGTLVLGTGGLLETLLLNTSQYVVTTKQDSNPIEGDKPVWEREPDTAAQRPGSDDKLGAFPRGAADLATWQARRVRLVVEDGRATRVVVSNGDRIPDAGKNVLADPMTPYRYSPNQSKKGVTAYYARPYDSTQTMWRGLDSLIALEDDPGFDQKKDKAPLRPENLSNLAALDADGYLAKHVFDVALVSMEYGPQESSVASTFSSTIGLPVVVLRDDEAGRKVRNAVRASAKQTYQAAISMGWFAGQLRVAAGDDYEFGVAAKDRFYAQLEPQFIEWMSTVAVDTTDESQKIWQKRARGVALAHARELLRGAGQKAVIGREIDAGEEGKGRIISAGSLYRQLLRRLDKDLPLTAPPADSRSNDSSLKEGKAHA

SEQ ID NO: 5279 - protein, 564 aa, Corynebacterium jeikeium ATCC 43734
MPAMAYRKYTAELHTKGRTIVTESFSLLDQPWILTTLTDGSAAELSLREIFDGSHSVASIRGDSPLQDVAIYRLLLTVYWCAHRQELLSDPGTELDMAEWIPDRLEAAAENEPDNTVLNYLERYADRFDLLDPKQPFMQVADLHTSKNATTDVRRIVPDFEDDYFTLRAGDGALSLTYAEAARWLIYVQAYDYSGIKSGAVGDPRVKGGRGYPIGTGWTGAITATIILGENLQETLALNTTGGALQAKNDHPVWKREPDTSAQRLDPANKDGIYPKGPAEILTWQSRRIRLFPDGGLITQVLVSNGDRIPNANANVQDDPMTPYRFSKNKSTKTLDVYYPKPLDSQRTMWRSLEPLIALETDPVYDAKNRAPKRPKTIDQLAYLKENEVDLPETLNVSMTSMEYGPNSAVVGISISTQIELPLEILPKSALNQRQAVLNLAAATSQAGTMLGSFAGQLFQAAGGDYEFQPAATDTLLAELEPKFSEWMKSLHGADLEPRLKAWEMTVRNAVLEHADVLLVGAGPKALVGRIIESNDDERFVSAGTVMNWLQRKLREILPRTVPR

SEQ ID NO: 5280 - protein, 518 aa, Klebsiella pneumoniae subsp. rhinoscleromatis ATCC 13884
MNTFSLLTTAWLPVRYRDGTTGKLAPVGLTDEDVVDIAATRVDLQGAAWQFLIGLLQCAVAPKNRNGWEDTWEEGLSAETLVAALAPLEAAFQFGPDTPSFMQDFDSLAGDKVSIASLLPEVPGAQTTKFNKDHFIKRGVTNTFCPHCAALALFSLQLNAPSGGKGYRTGLRGGGPLTTLIELQEYEGERLTPLWRKLWLNVLPQDAADMPLPAAYDESVFPWLAPTRTSEQASAITTPEQVDKLQAYWGMPRRIRLDFAATQPGTCDICASESDGLLSQMAVKNYGINYDGWRHPLTPYRLALKGDGGFFSVKPQPGGLIWRDWLGLSQDNQTESNSEYPAQVVKVFNARGLRNIKAGLWGFGADFDNMKIRCWYEHHFPLLTDESTIPDLRKAAQTAIRLLSLLRSALKEAWFDDPKGARGDFSFIDIDFWNQTQPLFLNLIHELENGQPAQERLDKWQRELWLFVRRCFDDRVFTNPYENNDLARCMTARKKYFATSAEKQSAKAARAKKQEAAQ

SEQ ID NO: 5281 - protein, 584 aa, Lactobacillus antri DSM 16041
MKRKKKMNKSFNLVTEPWIKVVDEDNRERTVSLEQLFTNAVHYRQLAGEMKSQDLALLRFLLAILTTVYSRYTADGEPYEWLKIDGQTMQPVPFEGKTFEDDDEDGLRQTWKDLYHAQHFTEIVTRYLQKYADRFDLLDADHPFYQATRAQYDSLVPKNKVVAKGKGTVAVKQINRTISESNNKPDIFSPNTSPHKNDLSLASLARWLITYQNFTAVTDKTKVVAKEKFPVSPGWLYGLNPVFATGSNLFETLMLNLVLIPQGVNSETESMDQHPAWEVPIEEYIQARLTGIVPGNLAELYTLWSRVIHIEWDNGRPLIFSAGLPKLNNHEAFLEPMTTWKFNKKDNEWQPNLRWLNSLGKAMWRNFGQYISVQQDDTQKDSQREPGIVTWLHMLRSTKMLPADLALHLTTVGLINDGNATSQSPAAEFADEMQINADVLFDPNPLKRLQWPKLIENTVEMTEKVGALVWYFANHIMELRGVKDDGAFANRVSARFYERLNQPFREWLAGLTNNDERDEKVNLWKQTAKQIAVQTADELLNSATPQDIRGRVKNADGDQHNIFTYYRIFRASVNKVLGIKGGKS

SEQ ID NO: 5282 - protein, 540 aa, Jonquetella anthropi E3_33 E1
MTVLHNLLNEQLITVQDPDGRKTQASLPDIFAMLEENQVESFPLLRPHQSAPWTCLLTQLAALALEESGETLPPLDPEKPWTMAGRHEPEKWAQLLRALTPGYTEDEPWCLVVSDVTKPAFLQPPSSTEASAEKCFDKVDLTPDNLDLTITRKAHDLKPGLIAAPRIEEWLFAIVSLQTNAGFLGAENYGIARQNGGHGKRICSSLGSSRTIGGRWGRNVRVILDHIDDLYSELYEAENPLRLLWLLPWDGEKGSSIFVGDLHPLFVEVARRIRCVEKDGGLCVTRGGTKDWRVAAEDFHGALNDPWTPLIDDEGDVKAYGGDMSYRGLQKVLCFSHKPLLLQWHQKYDGSKNQLVLFEGLMKGKGKTEGVAFRALPVSSAVRRLFSSPDLTKENEIASAMLNLVETAENKVLKVALATSAQARRPSFNGAIEWNGPDVDDWIPTVIREMDKEVDDLFFPALWNELERGAGARDDSDKTWTDRLRELVEKYFELGMKTLSLGSEMNLKGIAQGRNRLFGLMKNLLPAAPCLKEGENEHGA

SEQ ID NO: 5283 - protein, 547 aa, Slackia exigua ATCC 700122
MRGISRELSLWDLFTCAGELKCLANDLPTQDIAILRLLLAILQRSLSPSLDEDDDPAEVWAKLWEADTLPVEEIHSYLEKWRHRFDLLDNNEPFMQIAGLVRSNDAIKDEDGEPYLKRVIADVPSRRNRRLFSVRMGEGINRLSYAEAARWLIHVHSFDTGGPKNAAKGDSSDVIKKEGRSYPGGTGWLGRIGCLYFEGSTIKETLILNFVPLYRNEIDSLFPENDLPIWERRQRCVSDGHEPRVLPDGRADLYTWQSRWVNFSHEDGMITNVVLSAGDLLSVEAAELYTVENMTSWKEGTSKSKPSAPKLIPMHFDSDKALWRGLNAIFAQNCSNKNPACHLSGTAVWLRHLSSNNGGRAISKEYLLNVHAVDFKYDDSQSSSYHSMVDDKLEMSSYLLSPEGAPLVNFACGCVEKTKEAVKTLGDLAVNLYLASGGDSASSSGVREAAESRAFFEIDRLFRVWFSALGSQTNAEAARAGWYAQLRDVLMRLAQELIGEAGPAAVRGSQLKNKKDWMTAGKAEARFYATLDCILSCGSKEEKVKEG

SEQ ID NO: 5284 - protein, 566 aa, Bifidobacterium gallicum DSM 20093 = LMG 11596
MKAIQPQFNLVNDPWIPVVYDDATRAVVSLRESFEQASHIVAIVTDNPLQKAVLYRLFEAIWMRAYEMEQIDVAPSECYALWQEFWDLGEFDLEIINAYLNKYEAKFELFDSKTPFYQVPDLEYVGKKAYDGVETMILDVPKGTGLFSLRNPETLEGLDFAEAARQLLTIMAYDTAGIKSPVEGFSAINKGKAFAPQGVPSVGWLGNIGSVWAEGSNLFETIMLNWVISNPLTSELSESTYDRAPWELDTPPEHDLVVRDGFRGMVDALTVQSRRIRLVCNEAGTQVIGLVICYGDIIRPAYTQIAEMHTSWRVSKPKKGEGNAPVVMPRTFEAGKALWRSLGPLLVADSENSARPGVLRWLDRLFDEIPELREKHLLQTIGIIAQGMTYGTQSSVFEASYDDSLELSSEMLRSGGDIIGRVLDVVAATEQSVKDLGTFAFRLEVASGADSDSKNRRTDTRMQIAEEAYAALDGVFRERLAQYRSDDDALAYCKSWKDEIHRLLLRLAQDYLDQSPTQSFSFHEENGRRVDAGQAMLTLKYRLKENLGSLSEHSIPTEGEEDAPTQ

SEQ ID NO: 5285 - protein, 552 aa, Cutibacterium acnes J139
MTSAFNLMDEPWISVRTPDNGVTEVSIREAFHRATEFRGLAGEIPTQEAAVLRLLLAIAIQATARFRSDDEKIDDWGQWWEEGLPLDEIDSYSDRWLNRFNLFDDSAPFMQVTDLHTSNGGYSGLTKIISEVPPNDKFFTTRDGAGTTSLSFAEAARWLVHTHAFDVSGIKSGAVGDPRVKGGRGYPIGTGISGPMGIVIVEGKSLAETILLNLFLQDDPQQDVPVWERPPQTATPDREHPVPTGCADLFTWQSRRVRLIADGDRVVDVLLCNGDKVEWKYLLHNDSTTAWRYSAPQTKAAGETVYMPRSHDSTKAMWRGLEPLLVREPAADDRRRKKAGEPDELWLRPEIFEQLAAFSSDGALPRDHVTRIRTIGMEYGSQSSVVTTTIDDAMPAAMAVIADEQLGRLAVESAQTADSLIFALQNLATDLAAATGSESEGVRPRASEMGYAALDPTYRDWFSRLSSRTDVETATLSWRRRARQVVREIGEQLCRDAGPTALTGRMVPVPNTEREDLMDRARAWQRFVARVRTSAPLPEDPHRDTKTSRKEQ

SEQ ID NO: 5286 - protein, 536 aa, Pyramidobacter piscolens W5455
MENNLLTERWLSVENPQGAMRRFSLPELFSALERNEVAAFPALLPHQAAPFHVWLVQLGCHALETAGQVENLPPPDPKKPWAMLGRHSPDEWRDMIRGVVPDYSRKFPLDEPWCLVTDDLNKPAFMQVPAPDGDFADYRGEAQFPDDLDLLISAKNFDVKSGVMKHPSAEEWIFALISLQTNSGFLGRGNYGVARQNGGWSIRPILTLQSSSSPGARWGRDARVILNCPPDWELYAFCRSEKETRLLWLEPWNGKTSSALRDLHPLFIEICRRVRAVRSGNSVSVKKAASACARVDIEKTGGNLRDPWEPVVFDKQGSHVFGSNLNYANLARILAEAEGMQKPLLLRYHRGIDDPVATQAWCSALRKGQGKTEGYEERLIPVSVAGVSDKFTLWRAAGAMINLVKTAKNTVLGVALARFMQCGKSADGNRAIDWNSSAVKNWIPVVKNKMEDEVETLFFRYLWDTCSRMTDGEITDESWLVPWKTCLRQLVRKYYEIGVSSLPGSVSQSVKARALSELTLDRLLAIYLKTAEEEEG

SEQ ID NO: 5287 - protein, 518 aa, Klebsiella variicola
MNTFSLLTTAWLPVRYRDGTTGKLAPVGLTDEDVVDIAATRADLQGAAWQFLIGLLQCAVAPKNRNGWEDTWEEGLSAETLVAALAPLEAAFQFGPDAPSFMQDFDSLAGDQVSIASLLPEVPGAQTTKFNKDHFIKRGVTNSFCPHCAALALFSLQLNAPAGGKGYRTGLRGGGPLTTLIELQEYEGERLTPLWRKLWLNVLPQDAADMPLPVAYDESVFPWLAPTRTSEQTSAITTPEQVDKLQAYWGMPRRIRLDFAATQQGTCDICASESDGLLSQMAVKNYGINYDGWRHPLTPYRLALKGDGGFFSVKPQPGGLIWRDWLGLSQDNQTESNSEYPAQVVKVFNARGPRNIKAGLWGFGADFDNMKIRCWYEHHFPLLTDESTIPDLRKAAQTAARLLSLLRSALKEAWFDDPKGARGDFSFIDIDFWNQTQPRFLNLIHELENDQPAQERVDKWQRELWLFVRRCFDDRVFTNPYENNDLARCMAARKKYFATSAEKQSAKAARAKKQEAAQ

SEQ ID NO: 5288 - protein, 579 aa, Megasphaera genomosp. type_1 str. 28L
MGRYNLLDEPWIMVMTEDGENKKVSLKAVFQHAHTYRSLAGDMATQDFAVMRVLLAVLHTVFSRVNAAGETYKYLTLDARYVPQNEIEEDDADDYGEELFETWEILWRTGRFPEIVATYLEAWRDRFYLFDETYPFYQVTKESIAPDKINKAPAGIICGKNINRLISESKNKVALFSPKYEGENNKEILNADEIARWLITFQGYTGVMDKTVFRTEKYTTSKGWLFDLGGIYLSGENLFQTLWLNCMLWHTEESYRIERQCPCWEYTGEELVANYLQGKTVKNSAALYTNWSRAIYIPEDTDTHKPFALQAVKLPEIEHKEQFLEPMTLWQFNQSKSNKNCFTPRKHKEHEVLWRSFGLLTLSYRNDTGKGKIEARRKPEIMAWLDRIKSDLGDKDIRFSAVSMKDDGKSFSWVPTDEICDELQLSYEVIADAYWIPRINDAVEETKEVIELIYGDFLSEVKDIRGFVENQKEKQKEKQKEKQIEKEKQKMYFMVDDPFRRWLSQLTVDAGKEAALKEWRETLKGIVETGAKKIWQTAGPRDYIGIDSGKDSKTGSAKGIKNIATAYRDFRIRLYKKLQ

SEQ ID NO: 5289 - protein, 518 aa, Citrobacter youngae ATCC 29220
MNNFSLLTTPWLPVRFNDGSVGKLAPVNLADENVVDIAAVRADLQGAAWQFLLGLLQCSIAPKNSARWEDIWLDGLSAEALQKALAPLEPAFQFGDQTPAFMQDFEPLSGETVSIASLLPEIPGAQTTKFNKDHFVKRGVTERLCPHCAALALFSLQLNAPSGGKGYRTGLRGGGPMTTLIELQEYQGNRQTPLWRKLWLNVMPQDSAGMPVPNQCDESVFPWLAPTRTSEQANAVTTPEQVNRLQAYWGMPRRIRLDFNTTHSGRCDLCEAQSDELLSGMTVKNYGVNYAGWTHPLTPYRLALKGDSERYSVKPQPGGLIWRDWLGLNQEGTSENNTEYPALVVKTTAARSLKDTKVGLWGFGYDFDNMKARCWYEHHFPLLLTDSIVPDLRQAAQTASRNLGLLRSALKEAWFADAKGARGDFSFIDIDFWHLTQGRFLALVHDLESGDSAKERLSQWQTNIWLFTRRYFDDHVFTNPYEGSDLKRIMLARKKYFTKSAEKQSAKAARAKKQEAAE

SEQ ID NO: 5290 - protein, 556 aa, Schaalia odontolytica F0309
MKNPEYNLLDEPWIPVRLVDGTITDVGLLELLRRTTDIADLACELPTQSIAIQRLILAIMYRVATPRDTRDWVRQWDEGAPTEQMIEYLERWRDRFYLFGGRFPFMQVADLRTAKDAVSGLEKLIADVPNGEQFFTTRHGRALACIPASEAARWLVHAQAYDPSGIRSGAVGDSQVKGGKGYPIGPAWCGHLGLVWLKGKDLDETLVLNLIPATTAELRGVDSSTDWGACSWEDPEPETSVRGDYSLLDPAGTPKELSIPRLLTWHSRRIRLVGDSSGVTGVVLAQGDKLAPQEMRLYEPQSLWRYSTPQSKKFKTDVYMPRKFEAGRALWRNLPGTLPTVTTVQGVDKQPKREFLPSATLSFHYQLDNASIQTSYPKVMRIQAVGVTYGPQEATFEDIYSDELTLSVAVMRVEREDLSAQIDREVRLTEEVARDVGTLAANLARAAGESGDGAGDGARYRAKELFFSAVDNDFRAWLTQVDGHESARDVGCRWECILRQHALGIQTELVRSASSSAIVGRDTGRGYMNVGIAENYFRSALNKRLPVQNTNQEGTK

SEQ ID NO: 5291 - protein, 534 aa, Roseomonas cervicalis ATCC 49957
MSLNLVRDPWIPARYRSGLKLIRPAQITEHHATDPILAFDWPRADFRIASHEMLIGLLAVACPPASEEAWADAMETPPTPEELDAAFAPLAHAFDLDGPGPRFLQDLEDLAADHEPIERLLIEAPGDSTVKKNTDLLVHRGLAARLSRATAAITLYTFQNWAPAGGAGNRTGLRGGGPMVTLVLPHDAPTLWQVLWANTPCGEKPAAADLPRIFPWLAPTLTSEGNRTVTPGAEAHPLQCWWGMPRRIRLDFEASPGTCDLTGQPDDITVPGWRQRPRGANYAFWGKEHPLTPQYRVKPGSEILPVHPQPGGIGYRHWLGLVANTRDDLRYPAPTVATWRRDRAEGSAMWAPHTRLLVAGYDMDNMKARGFVEAEMPLPHAPDRNAQEDLAYRLIDSADTVAQALRQAVRGALFSQGATVKLDAELFTTLRERFWAATEPGFYRLLGDQAAGQAVALPVWLALLRDTAIRLFQEAAPLDPLSGATQAQRITQAQRILAFTLRGYGKAGGELFGRLDLPLPEGAGKAKGKRGKAA

SEQ ID NO: 5292 - protein, 502 aa, Escherichia coli MS 196-1; identical to SEQ ID NO: 5235

SEQ ID NO: 5293 - protein, 460 aa, Escherichia coli MS 175-1
MELAALALLVCIGQIIAPAKDDVEFRHRIMNPLTEDEFQQLIAPWIDMFYLNHAEHPFMQTKGVKANDVTPMEKLLAGVSGATNCAFVNQPGQGEALCGGCTAIALFNQANQAPGFGGGFKSGLRGGTPVTTFVRGIDLRSTVLLNVLTLPRLQKQFPNESHTENQPTWIKPIKSNESIPASSIGFVRGLFWQPAHIELCDPIGIGKCSCCGQESNLRYTGFLKEKFTFTVNGLWPHPHSPCLVTVKKGEVEEKFLAFTTSAPSWTQISRVVVDKIIQNENGNRVAAVVNQFRNIAPQSPLELIMGGYRNNQASILERRHDVLMFNQGGQQYGNVINEIVTVGLGYKTALRKALYTFAEGFKNKDFKGAGVSVHETAERHFYRQSELLIPDVLANVNFSQADEVIADLRDKLHQLCEMLFNQSVAPYAHHPKLISTLALARATLYKHLRELKPQGGPSNG

SEQ ID NO: 5294 - protein, 520 aa, Escherichia coli MS 198-1
MNSFSLLTTPWLPVRYKDGTTGKLAPVDLADENVVDIAAPRADLQGAAWQFLLGLLQTSFAPKDHRRWDDIWEDGLESEKLREALLSLEHAFQFGPDSPSFMQDFEALTGDKVQVASLLPEIPGAQTTKFNKDHFIKRGVTEYLCPHCSALALFSLQLNAPSGGKGYRTGLRGGGPMTTLIELQEYQGNQQTPLWRKLWLNVMPQDEADLPLPKKFDDLVFPWLGPTRTSELAGAVVTDDQVNKLQAYWGMPRRIRIDFNTTTVGNCDICGEQNDALLSLMTTKNYGANYAMWQHPLTPYRVPLKEGGEFYSVKPQPGGLIWRDWLGLIETGKSENNTELPALVVKLFNASSLKQAKVGLWGFGYDFDNMKARCWYEHHFPLLLDKKEGQIPKLRLAAQTASRILSLLRSALKEAWFSDPKGARGDFSFVDIDFWNKTQHRFLRLVRHIEEGQDADELLSKWQKEIWLFARQDFDERVFTNPYEPVDLKRVMTARKKYFTTSAEKQNAKAAREKKQEAAE

SEQ ID NO: 5295 - protein, 520 aa, Escherichia coli MS 69-1
MYPTSLITSPWLPVRFKDGTTGKLAPVDLADENVVDIAAPRADLQGAAWQFLLGLLQTSFAPKDQRRWDDIWEDGLEAEKLREALLSLDHAFQFGPDSPSFMQDFEALTGDKVPVASLLPEIPGVQTTKFNKDHFIKRGVTEHLCPQCSALALFSLQLNAPSGGKGYRTGLRGGGPMTTLIELQEYQGNQQTPLWRKLWLNVMPQDEADLPLPKKFDDLIFPWLGPTRTSELAGAVVTHDQVNKLQAYWGMPRRIRIDFNTTTVGNCDICDEQNDALLSLMTTKNYGANYAMWQHPLTPYRVPLKEGGEFYSVKPQPGGLIWRDWLGLIETGKSENNTELPALVVKLFNASSLKQAKVGLWGFGYDFDNMKARCWYEHHFPLLLNKKEGQIPKLRLAAQTASRILSLLRSALKEAWFSDPKGARGDFSFVDIDFWNKTQHRFLRLVRQIEEGQDADELLGKWQKEIWLFARQDFDERVFTNPYEPVDLKRVMTARKKYFTTSAEKQSAKAAREKKQEAAE

SEQ ID NO: 5296 - protein, 520 aa, Escherichia coli MS 84-1
MNSFSLLTTPWLPVRFKDGTTGKLAPVDLADENVVDIAAPRADLQGAAWQFLLGLLQTSFAPKDHRRWDDIWEDGLEVEKLREALLSLEHAFQFGPDSPSFMQDFEALTGDKVQVASLLPEIPGAQTTKFNKDHFIKRGVTEYLCPHCSALALFSLQLNAPSGGKGYRTGLRGGGPMTTLIELQEYQGNQQTPLWRKMWLNVMPQDEADLPLPKKFDDLVFPWLGPTRTSELAGAVVTDDQVNKLQAYWGMPRRIRIDFNTTTVGNCDICGEQNDALLSLMTTKNYGANYAMWQHPLTPYRVPLKEGGEFYSVKPQPGGLIWRDWLGLIETGKSENNTELPALVVKLFNASSLKQAKVGLWGFGYDFDNMKARCWYEHHFPLLLNKKEGQIPKLRLAAQTASRILSLLRSALKEAWFSDPKGARGDFSFVDIDFWNKTQHRFLRFVRQIEEGQDADELLSKWNKEIWLFARQDFDERVFTNPYEPVNLERIMTARKKYFTTSAEKQSAKAAREKKQEAAE

SEQ ID NO: 5297 - protein, 522 aa, Escherichia coli MS 115-1
MRMNSFSLLTTPWLPVRFKDGTTGKLAPVDLADENVVDISAPRADLQGAVWQFLLGLLQTSFAPKDHRRWDDIWEDGLEAEKLREALQSLEHAFQFGPDSPSFMQDFEALTGDKVPVASLLPEIPGAQTTKFNKDHFIKRGVTEYLCPHCSALALFSLQLNAPSGGKGYRTGLRGGGPMTTLIELQEYQGNQQTPLWRKLWINVMPQDEADLPLPKKFDDLVFPWLGPTRTSELAGAVVTDEQVNKLQAYWGMPRRIRIDFNTTTVGNCDICGEQSDALLSLMTTKNYGANYAMWQHPLTPYRVPLKEGGEFYSVKPQPGGLIWRDWLGLIETGKSENNTELPALVVKLFNASSLKQAKVGLWGFGYDFDNMKARCWYEHHFPLLLDKKEGQIPKLRLAAQTASRILSLLRSALKEAWFSDPKGARGDFSFVDIDFWNKTQHRFLRLVRQIEEGQDADELLSKWNKEIWLFARQDFDERVFTNPYEPVDLERVMTARKKYFTTSAEKQSAKAAREKKQEAAE

SEQ ID NO: 5298 - protein, 543 aa, Escherichia coli MS 182-1
MIYRKGWKDGQPTWDGLFYERMRMNSFSLLTTPWLPVRFKDGTTGKLAPVDLADENVVDIAAPRADLQGAAWQFLLGLLQTSFAPKDQRRWDDIWEDGLEAEKLREALLSLEHAFQFGPDSPSFMQDFDELKVKATSIASLLPDAPGKQTKERNTDHFIKRDTTQHLCLHCVPLALFSIQLNAPIGGRGYYPGLRGGGPLTTLIELLEYQGNQQTPLWRKLWLNVMPQDEADLPLPKTFDDLVFPWLAPTRTSELDGAVVTDEQVNKLQAYWGMPRRIRIDFKTTSIGNCDICGRQSDALLGLMSLKNYGVQYVMWRHPLTPYRLPLKEGGDFYSVKPQPGGLIWRDWLGLIEVGNSKNNTELPAQVVKLLNASNLKQTRVGLWGFGFDFEDMKVRCWYEHHFPLLLNKKEDLIPKLRLAAQAASHILSLLHRALKEAWFSEKKTTKLDFGFVDIDFWNKTQHRFLRLVRKIEEGQDPYELLSKWQKEMWLFARQDFDDRVFTNPYEPVDLERVMTARKKYFTTSAEKQNANAAREKKQEAAE

SEQ ID NO: 5299 - protein, 524 aa, delta proteobacterium NaphS2
MNLINDPWIPVIRELGKDRIAPWQIVERDNPVMEIDAPRPDFQGALYQFLIGLLQTCFAPEDEDEWEIYWEEWPEPERLKQAFVNPVSAFELYNSEGVAFMQDYDLPDGKGKEIAALLIEAPGEKTIVDNLDHFVKRNQIAGFCPACTAMALFTLQINSPSGGAGQRVGLRGGGPLTTLIVPQGNGSQLWEKLWLNVLSVEELPGMDSVDSAIMPWLSPTRLSDDNGRITTPSDVHTLQMYWGMPRRIRLESSEGSDKCDLCGRETDSVYRHYRTKKHGINYDGPFVHPLTPYRFDDKKKNPPLSLKGQKSGLGYRHWLSLAFQDLDRGEKAAKIVQFFNEERGQSLFGSSSAALWCFGYDMDNMKARCWYEAHFPVFSLDKNQKENLVAWAGELIAVAREAVKILRNQIKAARFRRPGDAKGDMTFVDQQFWEETEQDFYRLLDAMAKLPGDTRLPPAELFLTWLQALQRHVFSIFEESTLESAPEGLDLKRIVLAKQELKKRFYGNKRVKDLKAKSTIREGV

SEQ ID NO: 5300 - protein, 460 aa, Escherichia coli MS 116-1
MELAALALLVCIGQIIAPAKDDVEFRHRIMNPLTEDEFQQLIAPWIDMFYLNHAEHPFMQTKGVKANDVTPMEKLLAGVSGATNCAFVNQPGQGEALCGGCTAIALFNQANQAPGFGGGFKSGLRGGTPVTTFVRGIDLRSTVLLNVLTLPRLQKQFPNESHTENQPTWIKPIKSNESIPASSIGFVRGLFWQPAHIELCDPIGIGKCSCCGQESNLRYTGFLKEKFTFTVNGLWPHPHSPCLVTVKKGEVEEKFLAFTTSAPSWTQISRVVVDKIIQNENGNRVAAVVNQFRNIAPQSPLELIMGGYRNNQASILERRHDVLMFNQGWQQYGNVINEIVTVGLGYKTALRKALYTFAEGFKNKDFKGAGVSVHETAERHFYRQSELLIPDVLANVNFSQADEVIADLRDKLHQLCEMLFNQSVAPYAHHPKLISTLALARATLYKHLRELKPQGGPSNG

SEQ ID NO: 5301 - protein, 522 aa, Escherichia coli MS 21-1
MRMNSFSLLTTPWLPVRFKDGTTGKLASVDLADENVVDIAAPRADLQGAAWQFLLGLLQTSFAPKDHRRWDDIWEDGLEAEKLREALLSLEHAFQFGPDSSSFMQDFEALTGDKVPVASLLPEIPGSQTTKFNKDHFIKRGVTEYLCPHCLALALFSLQLNAPAGGKGYRTGLRGGGPMTTLIELQEYQGNQQTPLWRKLWLNVMPQDEADLPLPKKFDDLIFPWLGPTRTSELAGAVVTHDQVNKLQAYWGMPRRIRIDFNTTTVGNCDICDEQNDALLSLMTTKNYGANYAMWQHPLTPYRVPLKEGGEFYSVKPQPGGLIWRDWLGLIETGKSENNTELPALVVKLFNASSLKQAKVGLWGFGYDFDNMKARCWYEHHFPLLLNKKEGQIPKLRLAAQTASRILSLLRSALKEAWFSDPKGARGDFSFVDIDFWNKTQHRFLRLVRQIEEGQDADELLGKWQKEIWLFARQDFDERVFTNPYEPVDLKRVMTARKKYFTTSAEKQSAKAAREKKQEAAE

SEQ ID NO: 5302 - protein, 574 aa, Lactobacillus delbrueckii subsp. bulgaricus PB2003/044-T3-4
MESYNLITEPWIKVLDGKTNSEHMVSIKELLQNASDYRQLAGEMHVQDLAILRLLEAILTTVYTRVDQNDEEYEWVTLDEQMHVQSYDDEIEGSTLLQVLTKTWNALYKEGSFSEAVFDYLDKNKGLFDFFGDRPFYQVTAEQYDSFVPDNKKIAKGSGTVDLMQINRLISQSGNSVAIFAPKSANRKNKLTLDELVRWVITYQNFTGVTDKTKVKAKEKMSNSRGWLYTLNPVYAQGNNLFETLMLNLLLFNPNKPTYTQQRPVWEEDLGEYVKRRLSQVKPDNFAETYTVWSRLLHIEWQDGTPTIFSAGLPAFDSANAYDIEPMSTWRMNKKDENYYPATRQLSSIGIAMWRNFGQYVDIEGHTESREPLTVAWLNYLKTKNELLNQQMINLHTSGIISNGGATSLMPAAEFDDNLRIEADVLFDETEDRKNAWPQRIEEMVDLNQEVGRKYYGFLMEVGRIRFGPQGAVDFAGRKSQTFYDNLNEPFENWLANLSGGDDRDEQQKFWKKQLKQIALRTLDDFLEIIAPRDISGIKADKSQSGTKSTESNIFIAANKYRAGINKALNKNEK

SEQ ID NO: 5303 - protein, 572 aa, Peptoniphilus sp. oral taxon 836 str. F0141
MGKYNLLEEKWIPVIESKSLKNIKVSLIDIFENAQSYKDLACEMKAQDFVLLRFLLAVLMTVFTRFDESGEIYEQISLDENFIPKEEVDRDDIKDYKKKLINTWSILWENKKFPPIVKTYLEKWKDHFYLFDDKYPFFQVNESDIKNNIRKKSAFTLVSGKNINRLISESDNKISLFSPKYQKNSNKEILKADELVRWLLTFQAYTGLADKAIFGDDKYEVSNSKGWPYDLGGIYFKASNLFETLMLNLTILHPQEVYNGKIQRPCWEYASDDLIKSYLSYRDVDNLSELFTNWSRAIYIDPKIDITKSFSMKIIKLPEIRHINNFLEPMTLWRFNNNGPNKDKYTPKKHMADESLWRNFAMLISPQNSSEKIHIPGLMEWKNSWEEYKNEKKSRLIDIIGDINLRIEAISMKDDGNATSWVPIDELTDYLNINNFVLTDVNQNDWENHIIDMVNITKISVGKTYGIFIENIIKIRNIKSKTYKTQKLEELYSTIDGPFKDWICSIKSQDLVEKKILQWKTTLKNLVLRQADKDFEEASTRDFKGIVEGDKIINIATSYNSFKHFLKESLKI

SEQ ID NO: 5304 - protein, 530 aa, Escherichia coli MS 119-7
MDGLFYERMRMNSFSLLTTPWLPVRFKDGTTGKLAPVDLADENVVDIAAPRADLQGAAWQFLLGLLQTSFAPKDHRRWDDIWEDGLEAEKLREALLSLEHAFQFGPDSPSFMQDFDELKVKATSIASLLPDAPGKQTKERNTDHFIKRDTTQHLCLHCVPLALFSIQLNAPIGGRGYYPGLRGGGPLTTLIELLEYQGNQQTPLWRKLWLNIMPQDEADLPLPKTFDDLVFPWLAPTRTSELDGAVVTDEQVNKLQAYWGMPRRIRIDFKTTSIGNCDICGRQSDALLGLMSLKNYGVQYVMWRHPLTPYRLPLKEGGDFYSVKPQPGGLIWRDWLGLIEVGNSKNNTELPAQVVKLLNASNLKQTRVGLWGFGFDFEDMKVRCWYEHHFPLLLNKKEDLIPKLRLAAQAASHFLSLLHRALKEAWFSEKKTTKLDFGFVDIDFWNKTQHRFLRLVRQIEEGQDPDELLGKWQKEMWLFARQDFDDRVFTNPYEPVDLERVMTARKKYFTTSAEKQNANAAREKKQEAAE

SEQ ID NO: 5305 - protein, 520 aa, Escherichia coli MS 107-1
MNSFSLLTTPWLPVRFKDGTTGKLAPVDLADENVVDIAAPRADLQGAVWQFLLGLLQTSFAPKDHRRWDDIWEDGLEAEKLREALQSLEHAFQFGPDSPSFMQDFEALKGDKVQVASLLPEIPGAQTTKFNKDHFIKRGVTEHVCPHCSALALFSLQLNAPSGGKGYRTGLRGGGPMTTLIELQEYQGNQQTPLWRKLWPNVMPQDEADLPLPKKFDDLVFPWLGPTRTSELAGAVVTHDQVNKLQAYWGMPRRIRIDFNTTTVGNCDICGEQSDALLSLMTTKNYGANYAMWQHPLTPYRIPLKEGGEFYSVKPQPGGLIWRDWLGLIETGKSENNTELPALVVKLFNASSLKQAKVGLWGFGYDFDNMKARCWYEHHFPLLLKKKEGQIPKLRLAAQTASRILSLLRSALKEAWFSDPKGARGDFSFVDIDFWNKTQHRFLRLVRQIEEGQDADELLGKWQKEIWLFARQDFDERVFTNPYEPVDLKRVMTARKKYFTTSAEKQSAKAAREKKQEAAE

SEQ ID NO: 5306 - protein, 522 aa, Escherichia coli MS 124-1
MRMNSFSLLTTPWLPVRFKDGTTGKLAPVDLADENVVDIAAPRADLQGAAWQFLLGLLQTSFAPKDHRRWDDIWEDGLEVEKLREALLSLEHAFQFGPDSPSFMQDFEALTGDKVQVASLLPEIPGAQTTKFNKDHFIKRGVTEYLCPHCSALALFSLQLNAPSGGKGYRTGLRGGGPMTTLIELQEYQGNQQTPLWRKMWLNVMPQDEADLPLPKKFDDLVFPWLGPTRTSELAGAVVTDDQVNKLQAYWGMPRRIRIDFNTTTVGNCDICGEQNDALLSLMTTKNYGANYAMWQHPLTPYRVPLKEGGEFYSVKPQPGGLIWRDWLGLIETGKSENNTELPALVVKLFNASSLKQAKVGLWGFGYDFDNMKARCWYEHHFPLLLNKKEGQIPKLRLAAQTASRILSLLRSALKEAWFSDPKGARGDFSFVDIDFWNKTQHRFLRFVRQIEEGQDADELLSKWNKEIWLFARQDFDERVFTNPYEPVNLERIMTARKKYFTTSAEKQSAKAAREKKQEAAE

SEQ ID NO: 5307 - protein, 543 aa, Escherichia coli MS 78-1; identical to SEQ ID NO: 5298

SEQ ID NO: 5308 - protein, 570 aa, Mobiluncus curtisii subsp. curtisii ATCC 35241
MFSLIDDPWILVVDTDGNQRTVGIREIFAGEVKVASLQGESPAQNYAIVRLLLAIFWRAHSRESKVDPGKTFNFAAWFQRLRAQLQRDGRDDAVLDYLEHYRDRFELLDSPTPFMQVADLSVPSGELKHVTTIVPEAQEDYFTMRAGKARDSLSYAEAARWLVYAQAYDYSGIKSGAVGDSRVKGGKGYPIGTGWTGMTGGVLVVGENLLDTLILNTCSSALTIPQDKPVWERQPDGSDTREKVGENAYPQGPSDLLTWQSRRIRLHSEGNRVTGVILSNGDKIPDAGANVFGDPMTPYRYSTNKSKKNMDIYYPATFSPQRTVWRALDALIVAETDGGFNGKVKAPKRPQNLDNLANLSQYIDGIPSVLNVDLVAVEYGPQSSSVASTYAAQMGMPLVLLLEQSGQLRQAVRDAASVTSEAAIGLGRFAANLLVAAGKEYEFTPAPTDQVLAELEPLFNAWLQNLANFVSEIVSGNGDDTENDIVRLVQDWQSKVREIIVSQALILLRGAGPKAMVGKIVTDSNGEGTKKVVSAGTYYQKLQRYLDQVLPLTSKQYKNEIEQERKVNHE

SEQ ID NO: 5309 - protein, 576 aa, Peptoniphilus duerdenii ATCC BAA-1640
MGKYNLLDEKWIPVILNEKGSIEKVSILELFKNASSYLALGGDTETQKFALLRFLLAIPQTVYSRFGINGDPYEFFEVDEKFMQIEEVEDADSEDYKYELGSTWSDLWKEKKYSKIMFDYLERWRDRFYLFDDKYPFYQVTADVVAEDKINKASPTSISGKTMNRIISESGNKIALFSPKNEFKNNKEILTEDEITRWLITFQGYVGTSDKVMFGKEKYTASKGWIYDIGGIYLEGDNLFETLMLNTILGNRDNFYYKKQKPCWEYSGQEIIDRYLVKNDPDNIAELYTTWSRAIYINPETDVEKPFEMQVVKVPDIDHRDMFLEPMTVYRENKQGPNKDSFTPRKHISNQSMWRSFGNIFLAGSGEDNVQIPGVIRWFSEISEIIGRDKIITINAISMEDDGNATSWMPVGEIHDRLDIHDIIITDGRNDGWNNIVNDVVEETKFAVSVIYRNLLADISDMRRFKGTGFIDENISEMYYIIDQPFRNWISSIDENSSKEEKVFEWRKTVKGLILKSAEEIALKSGSREYKGIIVKRKNEPITENCIKNLAKSYSRFKYFLDKKIKTKEEEYAESK

SEQ ID NO: 5310 - protein, 581 aa, Corynebacterium accolens ATCC 49726
MTDTETFNLLDEPWILCMDSADNRKALSIRDIFSGQGDAHKIVGDSPTQDYAVIRLLLAIFWRAHAQELAEAAGGRRKRASFDWGEWFAEKREELCETKRDQVVLDYLDAFRDRFDLLSDTVPFMQVADLHSKNMETRPIVHIVPEAADDHFTMRTAKGRQSVSFAEAARWLVHLQAYDYSGIKTGAVGDPRVKGGKGYPIGAGWTGRTGGTLVLGTEGLLETLLLNTPMAAVMTEQGTNPIELDKPVWEREPDTAAQRRGSDDKLGAVPQGAADLATWQARRVRLVAEEGQITRVLVSNGDRIPDAGKNVMGDPMTPYRYSPNQSKAGQDAYYARPYDSTQTMWRALDALVAVEDDPGFDQKKAKAPKRPANLSNLAALDVDGYLNQGAFDIALVSMEYGPQESSVATTFSTTIGLPLVVLREDDLGRQARNAVRTAAQKTYETAVSLGWFEGQLRVAAGDDYEFGVKSKDRFYAQLEPEFIAWMQTISVENADSAQINWQERVRTVAISHAMELLRGAGMKAVIGREVDTGEDGKGRIVSAGSLFQQLQRRFDKNLPLTGKSTRNQNPSSPMKEGVAHA

SEQ ID NO: 5311 - protein, 522 aa, Escherichia coli MS 145-7
MRMNSFSLLTTPWLPVRFKDGTTGKLAPVDLADENVVDIAAPRADLQGAVWQFLLGLLQTSFAPKDHRRWDDIWEDGLEAEKLREALQSLEHAFQFGPASPSFMQDFEALKGDKVQVASLLPEIPGAQTTKFNKDHFIKRGVTEHVCPHCSALALFSLQLNAPSGGKGYRTGLRGGGPMTTLIELQEYQGNQQTPLWRKLWPNVMPQDEADLPLPKKFDDLVFPWLGPTRTSELAGAVVTHDQVNKLQAYWGMPRRIRIDFNTTTVGNCDICGEQSDALLSLMTTKNYGANYAMWQHPLTPYRIPLKEGGEFYSVKPQPGGLIWRDWLGLIETGKSENNTELPALVVKLFNASSLKQAKVGLWGFGYDFDNMKARCWYEHHFPLLLKKKEGQIPKLRLAAQTASRILSLLRSALKEAWFSDPKGARGDFSFVDIDFWNKTQHRFLRLVRQIEEGQDADELLGKWQKEIWLFARQDFDERVFTNPYEPVDLKRVMTARKKYFTTSAEKQSAKAAREKKQEAAE

SEQ ID NO: 5312 - protein, 479 aa, Lactobacillus iners LactinV 01V1-a
MIELNDRMQQIEKVDLEDEEDYEDALMETWRDLWNAKKFPEIVVKYLDAWHDRFYLFDDKYPFYQVTKEEIENIDSKFADNTDAKATIKFRSMNRTISESGNKATLFSPKIEENKDLLSNAELARWLITFQGVSNASDKKTINKIEGKSIGWIYNLGGVFLSSDNIFKTLMLNLILRHDDSQYNNIQNPCWEKKPETIYNEYLKNKTIDNVSELYTNWSRLVYYFPFKPKKSEIKQNMFRIVKTNSIPSENNFLEPMTIWKYYDKKYTPQKYKTNKAAWRSFGSFLNVNEDVRMPGVISHLNDIKKFIDESEVIQINAISAIDNNDASSRTMINEFYDYFDLGLFIVNDLQSDGWIARINDIVDKTKDVVEKIYRAFLNDIAKIRGIESGAFTSSSIESMYFKIDKPFRDWLTNINYDDNKDEKEQIWNKELKNLVIRQAKIIIEQASPKDFTGIIENDSVKNIVTAYNNLMSNINKKL

SEQ ID NO: 5313 - protein, 537 aa, Faecalibacterium cf. prausnitzii KLE1255
MKEIEFNLLTEPWIRVRLRDNTVREVSLTEALVSAQDYVDLAGEMPTQNAAVLRLLLAVLFTVFSRVDAKGKTQPLAQSDDALERWSELWQLGHFPAEPVRDYLEQWKDRFWLFHPTHPFWQVPQAKIGTEYGAAKLNGEMSESSNKLRLFPLYAGQSKEQLSYPQAARWLLCVNGYDDTSAKPKGKGLPSVGAGWLGKIGFIQAQGDNLYETLMLNLTLLRDSRECWGESKPCWELEAPKSAERTEICCPDNPAQLLTLQSRRLLLHRTGENVDGFCLLGGDFFPRENVFAEQMTIWRTMPIKKNEPVVFVPCRHDPAKQFWREFPAVFCQGSGHRPGVVCWIEKLQEKRLKLLDPRRKVHFRISGVQYGDKDFFVNDSFSDSLTFQAGILDEIGRPWQSRIVREIERCEQTAALVGHFAQELAIAAGDRNENAGGAVRAQFYFAVDQPFRQWLQAIDPEQDDPDEAALRWQAQARNIAEKLGKQMVMEAGNAALKGHRIVVDKDKKTERTILYTSPKAYNRFRTRLWEIYPKTEP

SEQ ID NO: 5314 - protein, 524 aa, Aminomonas paucivorans DSM 12260
MEGTFDLTERPWILCRLRDGSTVSLGLLDLFLRAPEIEGIVGGDPLEEGALYRFLVVVAHRILQGPVSSAQWEDLWDRGAFDPPGVREYFRVWKDRFDLFHREFPFFQHPGCGDVEANSATVMAHSLASGNNAVLFDHHEDGVSVRWSPATAARKLLVAQGYSLGGLGPSYKGSRQQFYQAPLVPGALVILRGDNLFQTVMLNLLVLGKDHPLPGSGSASDLPLWEQDPRPFRPGEERVPKGYLDYMTWQARLVQILPEEDGTVARVRWIQGVRTPDIGTGEPMMVFRRQEAKAGKAKPGSPEWFPLRFSEGRACWRDSAALAAPVKDQTDRYRPPETLLALVNDHRDHPGVPQVVRVNLYGLLADKAKPLLWRKESLPIPVAYLAEDRWYLALEQALLLAEEVASRSLGWGLRLAADDLEDPLRKEAKEAFAQWARNTVQTSYWASLEVPFYRLFLAGNPATLPQEDLESRWRRQLGRSARSAFHQVGGALEGKSEGLRAWARGKQGLDGSLYRLLGDDAKEG

SEQ ID NO: 5315 - protein, 562 aa, Lactobacillus iners LEAF 2053A-b
MSDYNLIDEPWISVVVDYKGTTKLVGLKEFFEHAHEYIALAGDMPTQDFAVMRFLLAILHTVFSRYDAHGEPYEMIELNDRMQQIEKVDLEDEEDYEDALMETWKDLWNAKKFPEIVVKYLDAWHDRFYLFDDKYPFYQVTKEEIDTSKISKASPSKILGKNINRLISESGNKIALFSPKYDANNNKGLLTYDELTRWLITFQSYTGLSDKVIFGNEKYKASKGWLFDLGGVYLSSDNLYQTLILNLRLINRSNVNYNYSVQKPCWENAPSKLVEKAIRSSCIDNIAELYTTWSRAIYFNKFNMDDVFQMEIVKLPDIKHEDMFLEPMTLWKYNNVGDNKGKFTPRKHQLNKSLWRSFGLMTKFEEAGEVNAKIPKRKPGIIEWLNDIDESIKNQHIKINAISMEDDGNATSWVPINEVEDKLDIGEFIVNDLQKNGWVDRINNIVDRTKDIIEKNYRAFLNDIAKIRGIESGAFTSSSIESMYFKIDKPFRDWLTNINYDDNKDEKEQIWNKELKNLVIRQAKIIIEQASPKDFTGIIENDSVKNIVTAYNNLMSNINKKL

SEQ ID NO: 5316 - protein, 562 aa, Lactobacillus iners LEAF 2052A-d
MSDYNLIDEPWISVVVDYKGTTKLVGLKEFFEHAHEYIALAGDMPTQDFAVMRFLLAILHTVFSRYDAHGEPYEMIELNDRMQQIEKVDLEDEEDYEDALMETWKDLWNAKKFPEIVVKYLDAWHDRFYLFDDKYPFYQVTKEEIDTSKISKASPSKILGKNINRLISESGNKIALFSPKYDANNNKGLLTYDELTRWLITFQSYTGLSDKVIFGNEKYKASKGWLFDLGGVYLSSDNLYQTLILNLILINRSNVNYNYSVQKPCWENAPSKLVEKAIRSSCIDNIAELYTTWSRAIYFNKFNMDDVFQMEIVKLPDIKHEDMFLEPMTLWKYNNVGDNKGKFTPRKHQLNKSLWRSFGLMTKFEEAGEVNSKIPKRKPGIIEWLNDIDESIKNQHIKINAISMEDDGNATSWVPINEVEDKLDIGEFIVNDLQKNGWVDRINNIVDRTKDIIEKNYRAFLNDIAKIRGIESGAFTSSSIESMYFKIDKPFRDWLTNINYDDNKDEKEQIWNKELKNLVIRQAKIIIEQASPKDFTGIIENDSVKNIVTAYNNLMSNINKKL

SEQ ID NO: 5317 - protein, 572 aa, Lactobacillus iners LEAF 3008A-a
MSDYNLIDEPWISVVVDYKGTTKLVGLKEFFEHAHEYIALAGDMPTQDFAVMRFLLAILHTVFSRYDAHGEPYEMIELNDRMQQIEKVDLEDEEDYEDALMETWKDLWNAKKFPEIVVKYLDAWHDRFYLFDDKYPFYQVTEDIFKEATIYNNQKSVVEDVGKISFKTINRLISESNEKVSIFSMKNSDKNKLTTAQLTRWIIHYMGYSTTSDKYKFKAFHEITDIEKYDAPAGWLYTIGGLNYKVDNLFETLLLNFIIAHPEERYRYNIQRPSWEFTPSENTEFYLNKNGSSIDNLARLYTDYGRAIKIVNQENIYDGCLESVQLPILDKKYNLLECMTIWDKQKNAFNFSKRKTYESLWRNFGMIYCKSDDYQIPGIVDWIRKVSTLIDVDNIRLVVQVLVSDQTASNKIKSEIYDELYLNLKIIGDDVESGWIFRIKNIVDNTKNFLERYYKNFISDLMQLCNNDKLCNNDKKTRDQRICQYMANIYYKIDKPFNDWLHSIKLDENKDEKEKQWLGILKSIILDEINKIYNSLGNKFYIGREIKRGKKNEYINIAIIYNNLRSNINKKL

SEQ ID NO: 5318 - protein, 552 aa, Cutibacterium acnes HL001PA1
MTSAFNLMDEPWISVRTPDNGVTEVSIREAFHRATEFRGLAGEIPTQEAAVLRLLLAIAIQATARFRSDDEKIDDWGQWWEEGLPLDEIDSYSDRWLNRFNLFDDSAPFMQVTDLHTSNGGYSGLTKIISEVPPNDKFFTTRDGAGTTSLSFAEAARWLVHTHAFDVSGIKSGAVGDPRVKGGRGYPIGTGISGPMGIVIVEGKSLAETILLNLFLQDDPQQDVPVWERPPQTATPDREHPVPTGCSDLFTWQSRRVRLIADGDRVVDVLLCNGDKVEWKYLLHNDSTTAWRYSAPQTKAAGETVYMPRSHDSTKAMWRGLEPLLVREPAADDRRRKKAGEPDELWLRPEIFEQLAAFSSDGALPRDHVTRIRTIGMEYGSQSSVVTTTIDDAMPAAMAVIADEQLGRLAVESAQTADSLIFALQNLATDLAAATGSESEGVRPRASEMGYAALDPTYRDWFSRLSSRTDVETATLSWRRRARQVVREIGEQLCRDAGPTALTGRMVPVPNTEREDLMDRARAWQRFVARVRISAPLPEDPHRDTKTSRKEQ

SEQ ID NO: 5319 - protein, 552 aa, Cutibacterium acnes HL082PA2; identical to SEQ ID NO: 5285

SEQ ID NO: 5320 - protein, 552 aa, Cutibacterium acnes HL110PA3; identical to SEQ ID NO: 5285

SEQ ID NO: 5321 - protein, 552 aa, Cutibacterium acnes HL110PA4; identical to SEQ ID NO: 5285

SEQ ID NO: 5322 - protein, 552 aa, Cutibacterium acnes HL060PA1; identical to SEQ ID NO: 5285

SEQ ID NO: 5323 - protein, 522 aa, Escherichia coli MS 85-1; identical to SEQ ID NO: 5306

SEQ ID NO: 5324 - protein, 555 aa, Streptococcus oralis ATCC 49296
MSRFNLLDEPWISVVYDEKGTTKEVSLQELFINAHQYKDLAGDTKTQDFAVLRVLLAVLHTVFSRFDADGNVYEYLAVDERFKQIEPVEESDIADYQDDLYDTWIDLWESGKFPDIVSHYLEKWRDRFYLFDKEYPFFQVRKEDIVADKISKAKASSISGKNINRTISESENKLALFSPKNSKNKEQLTASEVTRWLLTFQGYSGLSDKVIFGKEKYKVSKGWLFDIGAVFIQGTSLFETLLLNCILPFYDHGNLESIQCPCWEFASSDNINRYLFGSECTDLANLYTIWSRGIYIDPEYDLNKPFSFEIVKLPEINHRDNFLEPMTTWKYNTTGENKDSYTPRKHLLNQSLWRSFGLLAVEDRTGHFRKPGIIDWLGDIGDIIGNRLFNIISISMQDDGNATSWLPTDEVIDSILINDLVLADFNESGWVPRINEVVEETKTVISKVYKRYIEELKEIRNISNNNYTNQMVEMLYFKIDHPFREWLSSILPDDEKDPKIKEWRDLLKKMVKAEAKSILGHGGTRDYLGIEKDGRIKNIATAYNSFEYLLHQQLK

SEQ ID NO: 5325 - protein, 553 aa, Lachnoanaerobaculum saburreum DSM 3986
MPRYNLLDEKWIMVADDKAVTKVSIKELFNNAGRYKEFAGDMKTQDFAIMRVMLAILHTVFSRFNAEGEAYEFFDVDSESFLQTTEIAEEDIEDYEEELYQTWIDIWKAKKFPDIVSEYLEKWRDKFFLYDDKFPFFQVTKEVIEKDAKGGGEFYGKNINRLVSESNNKQAYFSPRDDSYKEYMRDDESARWLITLQGYMGTADKKKVGNAKTYSKGWIYDLGGIYLVGSNLFETLMLNLTIVNNESNNLLKIQRPCWETDTIERNVEAYFYSGIDNISALYTAWSREIFIDPNHAESDKFVCSIAKLPEIEHSDNFLEPMTVWKYNKDGEYKDKYRPKKHDANQSMWRNFGLLTGVGETVRKPGVIEWLNKLDNISDSMKLELDKENITLSAVSMIDDGNATSWAPIDEISDTLTMKERVLADIGDGGWVDRINKTVTDTKSTIDNVLRIFLLGLFEIRNMDKSGIPKYIEQFYFRIDLSFRQWMESVDIGDDKDEKEIEWHNILKTAMKNYVDELVSNATLRDYKGIEGSGSVKNIATIYNSFLYRLNQKK

SEQ ID NO: 5326 - protein, 555 aa, Streptococcus sp. C150
MSRFNLLDEPWISVVYDEKGSTKDVSLQDLFTNAHQYKELAGDTKTQDFAVLRVLLAVLHTVFSRFDIDGNAYEYLTIDEGWNQLEPVDEMDIENYEEALYETWEKLWTNKRFPNIVNQYLEKWRDRFYLFDEKYPFFQVTKEEITRDKISKAKASRILGKNINRIISESGNKVALFSPKDEENKNTLTATELARWLITFQGYSGLSDKVIFGNEKYKSSKGWLFDIGAIYIKGNTLFETLLLNYISPYNECGNVENIQRPCWELKSSDIIKSYLDEKGITNIASLYTIWSRGIYIDPDFNLKKPFSFEIVKLPDINHRDNFLEPMTIWKYNVSGENRDTYTPKKHLLNQSLWRSFGLLSIKDTSLQHRKPGVIDWLTYIDDIIGNRLSNIVAISMQDDGNATSWLPTDEVIDSIFINDLVLTDLDEGGWVPRINEAVEETKKIISRTYKTYINDIKEIRNISNGSYTQQMVESLYFKIDQPFRQWLASIQPEDDKDSKIQEWRDLLNKIVKAEAEVILHQGGTRDYLGIQKDGRIKNIATAYNSFDYWLRQQLK

SEQ ID NO: 5327 - protein, 543 aa, Escherichia coli MS 117-3
MIHRKGWKDGQPTWDGLFYERMRMNSFSLLTTPWLPVRFKDGTTGKLAPVDLADENVVDIAAPRADLQGAVWQFLLGLLQTSFAPKDHRRWDDIWEDGLEAEKLREALQSLEHAFQFGPDSPSFMQDFEALKGDKVQVASLLPEIPGAQTTKFNKDHFIKRGVTEHVCPHCSALALFSLQLNAPSGGKGYRTGLRGGGPMTTLIELQEYQGNQQTPLWRKLWPNVMPQDEADLPLPKKFDDLVFPWLGPTRTSELAGAVVTHDQVNKLQAYWGMPRRIRIDFNTTTVGNCDICGEQSDALLSLMTTKNYGANYAMWQHPLTPYRIPLKEGGEFYSVKPQPGGLIWRDWLGLIETGKSENNTELPALVVKLFNASSLKQAKVGLWGFGYDFDNMKARCWYEHHFPLLLKKKEGQIPKLRLAAQTASRILSLLRSALKEAWFSDPKGARGDFSFVDIDFWNKTQHRFLRLVRQIEEGQDADELLGKWQKEIWLFARQDFDERVFTNPYEPVDLKRVMTARKKYFTTSAEKQSAKAAREKKQEAAE

SEQ ID NO: 5328 - protein, 565 aa, Anaerococcus prevotii ACS-065-V-Col13
MGRFNLVDEAWIEVMIDKSGEKSLVSLRDIFENSQNYLDIAGDMHIQDFAIMRVILSIMHTVFSRYDAYGNPYDEVEVNEKMQQTEPVDEEDYEDYEDDLMSTWEDLWQAGKFPKIVTDYLDKWHDRFYLYDEKYPFFQVTKNNMSVDKIKGKSIGQISGKTFNRTITESNNKQALFSPKSEASKNILRDDEIARWLICFQGYTGLSDKTIYGNENYKTRNSKGWLYDLGAIYFKGANLFKTLMLNFVIFTNQSYSYNIQKPAWEFTDSELLHSYLNYLPIDNISELYTTYSRALYIDPTYKADEDFNMNLIKLPELDHLDNFLEPMTIYGTNKTGPNKGRFTPKKHPANQSMWRSFGQITLGKVSSYGLSSEYKVPKPGIISWLKVIEGKINDRNISVNALSLEDDGNATSWVPVNEIYDYMPMYIELLVGENKEDWTHHIYEMVEKTKNVISNIYGGFLRDIVKIRGLDKSGYVNNEIEKMYYLVDKPFRDLIESIGKDTDKKKVLIEWDKTLKKLVYKEAYKKLETASIRDYRYIGDSKNSLNIVTSFNKFTSILNKVIERR

SEQ ID NO: 5329 - protein, 552 aa, Cutibacterium acnes HL103PA1
MTSAFNLMDEPWISVRTPDNGVTEVSIREAFHRATEFRGLAGEIPTQEAAVLRLLLAIAIQATARFRSDDEKIDDWGQWWEEGLPLDEIDSYSDRWLNRFNLFDDSAPFMQVTDLHTSNGGYSGLTKIISEVPPNDKFFTTRDGAGTTSLSFAEAARWLVHTHAFDVSGIKSGAVGDPRVKGGRGYPIGTGISGPMGIVIVEGKSLAETILLNLFLQDDPQQDVPVWERPPQTATPDREHPVPTGCADLFTWQSRRVRLIADGDRVVDVLLCNGDKVEWKYLLHNDSTTAWRYSAPQTKAAGETVYMPRSHDSTKAMWRGLEPLLVREPAADDRRRKKAGKPDELWLRPEIFEQLAAFSSDGALPRDHVTRIRTIGMEYGSQSSVVTTTIDDAMPAAMAVIADEQLGRLAVESAQTADSLIFALQNLATDLAAATGSESEGVRPRASEMGYAALDPTYRDWFSRLSSRTDVETATLSWRRRARQVVREIGEQLCRDAGPTALTGRMVPVPNTEREDLMDRARAWQRFVARVRTSAPLPEDPHRDTKTSRKEQ

SEQ ID NO: 5330 - protein, 558 aa, Atopobium vaginae DSM 15829
MHEFNLLEEPWISVIVDDLGHTKLVSMIDIFQSAHEYKALAGDMKAQDFSILRLLLAVLHTVFSRYDAKGYSRTFDPDEDEAEDFDEESIEIWREVWLERRFPNIVCDYLDNWHNRFYLFDDEYPFMQVLAEDISSDKLGGKKPSEISGKNINRLISESNNKIALFSPKSGNEKDKNRLTCAELARWLVTLQGYVGLSDKTIFGTQKYKASKGWLFDLGGITLAGSNLFETLLLNWVAANPFQLAASDQKPCWEYSGAENIQHAFSSSRVDNIAQLYTRWSRAVYIPSREDENEPFTPFMVKLPDLDHKNAFIEPMTFWHYNKTGDNKDTFTPRKHRTEEAMWRSYSLLTLAYSLDDKEKYHRPEAISWLDCISSYIENSRIVLEAISVKDDGNATSWVPTDEVYDNLYVHEELITDIGNDGWVYRVNNEVNHTKTAVSSTYRGFLKDMCDIQNRSDDNAATFINRTINHVYFLLDHPFRDWLAGINPSDSKNECCDRWRATVKQLLAKEASQMVANANTRDLNGITVTEKTSGAATTKNIITAYNAFIYRLNKLSEQ

SEQ ID NO: 5331 - protein, 554 aa, Actinomyces sp. oral taxon 170 str. F0386
MTQRFNLLDEPWIRVSRLDGAPDEVSLLTLFREATDIAGIHGEIASQDVAILRLLLAICHRAMDGPEDLDTWREYWEAEHLGRDVIDYLERYRERFDLRDPDRPFFQVAGIHAASGKTSGLESLIADVPNGNPFFTTRMARGLESIGWAEAARWLVHVHAFDPSGIRSGAVGDPSVKRGKGYPIGPGWTGQIGTVTVTGESLERTLLLNTAVCENLPDLVDVDPEQDLAPWERENDGPAGSHDLEPTGPVSCYTWQTRRVLLHGDDAGVTSLFLGNGDKATPQNRYLVEPMTAWRYSEPQTKKFKTPVYMPRKLPTDRAFWRGLSTVVAQLSPKVTVKGAGTVTQYRSPGVVSFYQELMRRRIVPAGGLIPLRAVGIEYGNNESTVSELVDDVLPLPAGLLDPENTRLLAVVHDAMEETEQVASALRNLAGNLDRARGGSPDTASAARKHSSESFYQVIDERFPRWLASLDEADPVRARDQWRRLLHSEAWEQQEALASAVPDTAFAGRGEGKGRMDVGKALFFFRRALNVAVPAPVQQDSIAENNKNEERTPA

SEQ ID NO: 5332 - protein, 518 aa, Klebsiella sp. MS 92-3
MNTFSLLTTAWLPVRYRDGTTGKLAPVGLTDEDVVDIAATRADLQGAAWQFLIGLLQCAVAPKNRNGWEDTWEEGLSAETLVAALAPLEAAFQFGPDTPSFMQDFDSLGGDKVSIASLLPEVPGAQTTKFNKDHFIKRGVTNSFCPHCAALALFSLQLNAPAGGKGYRTGLRGGGPLTTLIELQEYEGERLTPLWRKLWLNVLPQDAADMPLPAAYDESVFPWLAPTRTSEQASAITTPEQVDKLQAYWGMPRRIRLDFAATQPGTCDTCASESDGLLSQMAVKNYGINYDGWRHPLTPYRLALKGDGGFFSVKPQPGGLIWRDWLGLSQDNQTESNSEYPAQVVKVFNARGLRNIKAGLWGFGADFDNMKIRCWYEHHFPLLTDESTIPDLRKAAQTAARLLSLLRSALKEAWFDDPKGARGDFSFIDIDFWNQTQPLFLNLIHELENGQPAQERLDKWQRELWLFVRRCFDDRVFTNPYENNDLARCMTARKKYFATSAEKQSAKAARAKKQEAAQ

SEQ ID NO: 5333 - protein, 562 aa, Lactobacillus iners SPIN 1401G; identical to SEQ ID NO: 5316

SEQ ID NO: 5334 - protein, 503 aa, Parasutterella excrementihominis YIT 11859
MTQISLISEQWIPVRDRKGVVRKISPLEILDEEIVDIAAERADFQTALWQFLIGLIQTTLAPEDEDAWFDIWEEGLEKADLAKAFSKVGPAFIFGPQSPSFMQDFDQLEGEAVPLAALLPESPGENTIKHNKDFFIKRGEKRFCPHCAAMALFSLQLNAPSGGQGYRTGLRGGGPLTTLIELHSYKGDRNVPLWRKLWANVMPEFESNLPVPKEFDAAVFPWMGKTRTSKAKGSETTPEQVNPLQAYWGMPRRVRIDFEDLEEGRCDFCGEESDQLLSKMKVQNYGINYSGWVHPLTPYRCKLKTPGELNSVKLQPGGLVWKDWLGLNEETTRKDTKEIPALVVETFKHHIGTETKHGLWGFGYDFDNMKVRCWYEHHLPQLLSKEMQSSLQVAQDKAARTLLGLKRAFSKLNRECSYLDVEFWNLTQNLFLGLIRELDEKNSDSESLSAFIKNINRFALIFFDDRTFSSQMNPKDYKECSEARKNLLASLYAKSRSTPKEAK

SEQ ID NO: 5335 - protein, 520 aa, Escherichia coli D9
MNSFSLLTTPWLPVRFKDGTTGKLAPVDLADENVVDIAAPRADLQGAAWQFLLGLLQTSFAPKNHGRWDDIWQDGLEAEKLREALLSLEHAFQFGPDSPSFMQDFEALTGDKVPVASLLPEIPGAQTTKFNKDHFIKRGVTEYLCPHCSALALFSLQLNAPSGGKGYRTGLRGGGPMTTLIELQEYQGNQQTPLWRKLWINVMPQDEADLPLPKKFDDLVFPWLGPTRTSELAGAVVTDEQVNKLQAYWGMPRRIRIDFNTTTVGNCDICGEQSDALLSLMTTKNYGANYAMWQHPLTPYRIPLKEGGEFYSVKPQPGGLIWRDWLGLIETGKSENNTELPALVVKLFNASSLKQAKVGLWGFGYDFDNMKARCWYEHHFPLLLKKKEGQIPKLRLAAQTASRILSLLRSALKEAWFSDPKGARGDFSFVDIDFWNKTQHRFLRLVRQIEEGQDADELLGKWQKEIWLFARQDFDERVFTNPYEPVDLKRVMTARKKYFTTSAEKQSAKAAREKKQEAAE

SEQ ID NO: 5336 - protein, 556 aa, Gardnerella vaginalis 315-A
MSRFNLLDEPWISVIVDEKGHNKLVSMTDVFKHASEYKALAGDMKTQDFALLRVLLAALHTVFSRYDIQGNSREFDSGEDTEDDFNEETMDIWREVWNSKKFPDAVFKYLEQWHDHFYLFDDKYPFFQVLKQDVDSKNLGGKSPSEISGKNINRLISESNNKIAVFSPKDNVDNNKSSLTEPQLARWIITLQSYAGLADKTMFGTEKYKASKGWLFDLGGIEIIGANLFETLMLNCVLVGEMQSPEKKQKPCWEYSGTENIENSFYDTFIDNISQLYTRWSRAIYINPDISVDKPISVSIVKLPDINHKNSFIEPMTVWQYNKEGENKDKYTPRKHRTEEAMWRSFGLLTSQELYDGSVKNHKPGIMEWLNKIKHDITGSSISLQAISMKDDGNATSWVPTDEICDTLYIDEVVVTDNADDGWVYRINNEVEYTRSAIGFIYKQFLLDICEIRNRNKDDATKYSAKYISQAYFLVDQPFREWLANIKPKDSMNERCTQWRNTLHNILIDEAKGMLENATLRDFTGRPSDQSEKESTKNIVTAYNIFTSRLKKLSGK

SEQ ID NO: 5337 - protein, 569 aa, Oribacterium sp. oral taxon 108 str. F0425
MSRFNLLEENWIRVLEEGEMKEVSLITLFENAEKYRCLAGEMATQDFAMLRFILAVLHTVFSRVNADGEAYEFLEIDEKFRQKEAVSEDDEEEYNDALMETWKTLWQRGKFPSVVREYLEAWKEHFYLLDEKYPFYQVTKEEIDSLPRNYQNLGPILGKQFNRTISESNNKVALFSPKLEEGKSKMLESELARWLIMLQGYFGNFDKVKFCQEYTPSIGWLYELGGIYLRGQNLFETLMMNFKITVEQVGEEIPRQSPCWENSGVENIKRAFHGVEDNLAALYTNWSRAMLVNPELNFFEDILVEVVKLPKLDYSIMEIEPMTLWEYDMKGDNKYNFVPKCHEPNQALWRSYGSIAIPDEIIQIGKEPGIITWLNKIRPYFYSHKLMISAVGIQDDGIDASRMMVNEINDDLALHEIVLFEKGVEGWVARIKGIVDETKEIISTKYRKYLKDIAELRRKKSYEGGNNKKKIEDKNLTIYLEDNLKQIYFEIDKPFRNWLIGIEISSKKEEKAKEWKDFLIRFIKEHAFQKIKEADARDIQGTYIEDGKIIINIFTIYESFCHELKKYEI

SEQ ID NO: 5338 - protein, 555 aa, Streptococcus sp. oral taxon 058 str. F0407
MSRFNLLDEPWISVVYDEKGTTKEVSLQELFINAHQYKDLAGDTKTQDFAVLRVLLAVLHTVFSRFDADGNVYEYLAVDERFKQIEPVEESDIADYQDDLYDTWIDLWESGKFPDIVNHYLEKWRDRFYLFDEEYPFFQVRKEDIAADRISKAKASSISGKNINRTISESGNKLALFSPKNSKNKEQLTPSELTRWLLTFQGYSGLSDKVIFGKEKYKVSKGWLFDIGAVFIQGTSLFETLLLNCILPFYDYGNLESIQCPCWEFASSDNINRYLFGSECTDLANLYTIWSRGIYIDPEYDLNKPFSFEIVKLPDINHQDNFLEPMTTWKYNTTGENKDSYTPKKHLLNQSLWRSFGLLAVEDRTGHFRKPGIIDWLGDIGDTIGNRLFNIISISMQDDGNATSWLPTDEVIDSILINDLVLADFNESGWVPRINEVVEETKTVISKVYKRYIEDLKEIRNISNNNYTNQMVEMLYFKIDHPFREWLSSILPDDEKDPKIKEWRDLLKKMVKAEAKSILGQGGTRDYLGIEKDGRIKNIATAYNSFDYLLHQQLK

SEQ ID NO: 5339 - protein, 563 aa, Lachnospiraceae bacterium oral taxon 082 str. F0431
MMPRYNLLDEKWIQVASKDTVEKVSIKELFAGAAKYKELAGDMKTQDFAVMRVMLAILHTVFSRFDSKGDPYEFFEVDEKSFLQIGELEENDLEDYEDALYQTWIDIWNAKEFPKVVYEYLEKWRERFFLYDDKYPFFQVTKDVFKENTGIDTEGKKGGGNFFGKNINRLISESDNKTKYAIFSPKDESYKEYIVDDELARWLITLQGYIGTSDKQKVGSAKTYSKGWLYDLGGVYLQGNNLFETLMLNFVIAHNENNNLLKTQKPCWEAETIEKNIELYFHNGIDNIASLYTAWCREIFIDPNRTKEDKFACFIAKLPEIEHSDAFLEPMTVWRYNDTGEYKDKYRPRKHDANKSMWRNFGLLTGVGEGTRKPGVIEWLNKLCDISESEELGLYKENIKLCAVSMIDDGNSSSWVPIDEVKDTLNLKERVLVDTEDNGWIIRINKTISDTKKTIKSVLEKFIKDLLEIRKMEKSDVSKYYVEQFYFRIDLSFRNWIESIDIDNDKDTKEIEWRNILKKAMKEYVDELVSNAGLRDYKGIETSTGVKNIATIYNSFLYRLNQN

SEQ ID NO: 5340 - protein, 535 aa, Leptonema illini DSM 21528
MNLLKEAWIPVLRRSGRREIIRPAQMVENLESDPVVRLDAVRPDFNGALIQFFIGLLQTVLTPAEPEDWEELFLKPPAMADLESSMAVYATAFELDGPGPRFFQDLELAAEEGTPIGSLLIEAPGANTIKNNADHFVKRNQIQQMCPACTATALLTLQTNAPSGGAGHRTSLRGGGPLTTIVLPQEPKFQTLWHTAWLNVLLKEDLSATQCKPSLKALQAIFPWMAATKLSKTAGTEILGSHIHPAQTFWATPRRIRLFPASEEEGACSICNAAGAKFYRQYATVPHGANYAAGILHPLSPYYNDKGVLRPVHPQPGGFTYRHWPDFVIADVGEKERAIVVRVLGNRLRSGSTTKDYAIYAFGYDMDNMKARCWYEARMPYWPMPDEALRKEFAPYATAMADVANDIASNTRKAVQLAFFDSGASVRGDLDFVKTEFWQSTEPNYYDSLREVMKVIEDPAPVLRNWLKALQKVSMDLYDHYSSQISLDEGKEDGMRKDEKMPRVVRARRDLLIFNRSNKFSEKLGISAAAKGGMV

SEQ ID NO: 5341 - protein, 539 aa, Thiorhodovibrio sp. 970
MLNLALDEWIPARRAANNVCTELAPWQITMDIDDDPFVTLDAPRADFNAALMQFLIGLLQTTFAPRDADQWFERMELPPTPEELQAAFRPFAHAFELGGQDARFMQDQDALADREPLPISALLIDMAGSETHFVKGLAHQGFSPAMAAMALYTLQTNAPSGGVGHRTSVRGGGPLTTLVLATRDNDDRQPTLWQTLWLNVLDEETLGYSATPADAERIFPWLVATRTSEKGGRDTSPEKAHPLQVFWGMPRRIRLDLENIGESSAECVCALSGQPSANIVSAYRTKNYGTNYIGAWQHPLSPYSYDGKELLCMHPRGSINYRHWLGLVQSSKDSKTERLPALVVQRFTDGAYRLEREGWRFRLWACGYDMDNMKPRCWFESTLPLFPIQDRNTREMVESAAERMIEAAGHFLGNLRGAIKDAWFAANDPRRKSARLDHVSDAFWQETESAFYDGLGAVAGAADTQAKRFEQFQNWHRYLQVYTQNAFDLWVDYNQITDQSHPRRIAEARRNLRRFNYKKKIKDLLEISDKRGSAQQEAA

SEQ ID NO: 5342 - protein, 496 aa, Methylomicrobium album BG8
MNLLTDAWIPIQQQGSYQKITLQQLLCGEQSGELCLPRDDMELACLQLLCAITQVLFTPKNKKELGQYIQQPMTAQDYVEISREKMSWFDLNHAKTPFMQIRGVKSTQPTGMDKLLAGVADGTNKAFVNPQGLGEVLCGGCAAIALFNAANNCPSMGGGFKGSLRGSTPITILIRGKELRQTIWLNVLTEETAEAAMPWYQNTKDQLPNYLDTVKADVKIAASTIGLNRGLLWQPAHFELLPPKASGCCSCCGCIEPVYDGFNKAKFNYTVEGVWPHPLSARIFTVKKGEKEEKFPSFTTTAPTWTHLSRLVVDQQTDKEGQQTAPVIQQARTFMASDKIQLIVGGYRNNQATILERRHELFSLAQGWATHGEVIHQIIAAGLAYKTALRKALYLFAVGIKDKVHGSGINLCEPAETNYYQQTENLLHYSLASVDYAAPSAALNAQNGKLKAMVTALFEQATEPYRQEPKMLKALALARRSLNKSLQELKPEGANT

SEQ ID NO: 5343 - protein, 571 aa, Rothia aeria F0474
MSDDQSVQSNTSPDFNLCNEPWIPVLYVSGQTQEVSLKQLFDESNSIRKIHSGDATTDVAILGVAVAIFFRAVLENTEEYGELYREPKKWIQNISSGGSEQLYFVQDYLKKYQDRFNLFDAERPFMQVADLHTSKGEVKPVSRLVLDSESEYFSMRAEQALTSLSYAEAARYLVTVQAYDYSGIKSGAVGDPRVKGGRGYPIGVGWYGTTGKIIIHGENLIETLLYCIDYEQLLNVEKVKGKSHRIALQDKPVWERELPDTAAPRAYKGGDPTKYKDEPAPAAGMCEILTWQSRRVRLFPENGRVTGVLVSNGDKWLDRNTYTDPLTAYRFSKNQSTQTHYVWMPQTHSAERTLWRGADALLTRLSSSQEKQNKPATVIRQISSGKYFSPDTKTKIQLVGMVYGTQSSIVEETIDESVTLELGILTEQGAEISAMVRDNIQLTMDASIALGQYAGNLLRAAGKEYEFRPSVTESILHRMEDEFRSWLADLSVSDDVSAQAAKWQSKVRRILESEADQLAVSAGPKAAIGTIYDEQLYNTAKARRQFGGRLYKLLPLAYSSTITRVQEENHA

SEQ ID NO: 5344 - protein, 523 aa, Saccharomonospora glauca K62
MPPGFDLAERGFCPVRWRAGQRPETFSPETPLGLVDLLLHAHRIEDVEISPPPALSGFLRILVVLTGRITGLDRMESFEDWEEAREDLLHTGRFDETAIRRYFDEFSGRFELFHTATAHPFLQDARLLEQCRNPQGDQVSSGVNKLVLNRAAGQAFVWHSHTVDADPSPVPAAEAVWSLLTWLYYGPPGRCTARQVGKTRAGDTKSGPLRGTVSYHPVGKSLFHTLVLGLPYVPWHEHDAAPWEEEPHDPLSVPPPAQGLARKLTGRFRHAVLLTPSESGDAVVDARITWAWREEHAPTEDPYVMHRVPTNGGAPISESASATRAVWRDLDALLGRTEQRRRPEVLAHLDELAVEEGAFTAIRALGFDQDRSQAKERQYFSGITPPVLEAWQARDPRRWAQLREAREAAEQTAWQLQEALSGLWQQLSKTTNGKARDRGVPWLHKAMTTYWQSAERCFWEAVHAEEASAPVRNRMIEVALRTYDDTTADLMRQPKQVKAVEEHRRGLWRGWRSEAKANGEDDG

SEQ ID NO: 5345 - protein, 502 aa, Escherichia coli 1.2741
MNLLIDNWIPVRPRNGGKVQILNLQSLYCSRDQWRLSLPRDDMELAALALLVCIAQIIAPAKDDVEFRHRIMNPLTEDEFQRLIAPWIDMFYLNHAEHPFMQTKGVKANDVTPMEKLLAGVSGATNCAFVNQPGQGEALCGGCTAIALFNQANQAPGFGGGFKSGLRGGTPITTFVCGIDLRSTVLLNVLTIPRLQKQFPNESNTENQPTWIKPVKPNESVPASSIGFVRGLFWQPAHIELCDPIGIGKCSCCGQESNLRYTGFLKEKFTFTVNGLWPHPHSPCLVTVKKGEVEEKFLAFTTSAPSWTQISRVVVDKIIQNENGNRVAAVVNQFRNIAPQSPLELIMGGYRNNQASILERRHDVLMFNQGWQQYGNVINEIVTVGLGYKTALRKALYTFVEGIKNKDFKGAGVSVHETAERHFYRQSELLIPDVLANVNFSQADEVIADLRDKLHQLCEMLFNQSVAPYAHHPKLISTLALARATLYKHLRELKPQGGPSNG

SEQ ID NO: 5346 - protein, 520 aa, Escherichia coli 5.0588
MNSFSLLTTPWLPVRFKDGTTGKLAPVDLADENVVDIAAPRADLQGAVWQFLLGLLQTSFAPKDHRRWDDIWEDGLEAEKLREALQSLEHAFQFGPDSPSFMQDFEALKGDKVQVASLLPEIPGAQTTKFNKDHFIKRGVTEHVCPHCSALALFSLQLNAPSGGKGYRTGLRGGGPMTTLIELQEYQGNQQTPLWRKLWPNVMPQDEADLPLPKKFDDLVFPWLGPTRTSELAGAVVTHDQVNKLQAYWGMPRRIRIDFNTTTVGNCDICGEQSDALLSLMTTKNYGANYAMWQHPLTPYRIPLKEGGEFYSVKPQPGGLIWRDWLGLIETGKSENNTELPALVVKLFNASSLKQAKVGLWGFGYDFDNMKTRCWYEHHFPLLLKKKEGQIPKLRLAAQTASRILSLLRSALKEAWFSDPKGARGDFSFVDIDFWNKTQHRFLRLVRQIEEGQDADELLGKWQKEIWLFARQDFDERVFTNPYEPVDLKRVMTARKKYFTTSAEKQSAKAAREKKQEAAE

SEQ ID NO: 5347 - protein, 520 aa, Escherichia coli 1.2264
MNSFSLLTTPWLPVRFKDGTTGKLAPVDLADENVVDIAAPRADLQGAAWQFLLGLLQTSFAPKDHRRWDDIWQDGLEAEKLREALLSLEHAFQFGADSPSFMQDFEALKGDKVQVASLLPEIPGAQTTKFNKDHFIKRGVTEHVCPHCSALALFSLQLNAPSGGKGYRTGLRGGGPMTTLIELQEYQGNQQTPLWRKLWPNVMPQDEADLPLPKKFDDLVFPWLGPTRTSELAGAVVTHDQVNKLQAYWGMPRRIRIDFNTTTVGNCDICGEQSDALLSLMTTKNYGANYAMWQHPLTPYRIPLKEGGEFYSVKPQPGGLIWRDWLGLIETGKSENNTELPALVVKLFNASSLKQAKVGLWGFGYDFDNMKARCWYEHHFPLLLKKKEGQIPKLRLAAQTASRILSLLRSALKEAWFSDPKGARGDFSFVDIDFWNKTQHRFLRLVRQIEEGQDADELLGKWQKEIWLFARQDFDERVFTNPYEPVDLKRVMTARKKYFTTSAEKQSAKAAREKKQEAAE

SEQ ID NO: 5348 - protein, 520 aa, Escherichia coli 96.0497; identical to SEQ ID NO: 5305

SEQ ID NO: 5349 - protein, 520 aa, Escherichia coli 99.0741
MNSFSLLTTPWLPVRFKDGTTGKLAPVDLADENVVDIAAPRADLQGAAWQFLLGLLQTSFAPKNHGRWDDIWQDGLEAEKLREALLSLEHAFQFGPDSPSFMQDFDELKVKATSIASLLPDAPGKQTKERNTDHFIKRDTTQHLCLHCVPLALFSIQLNAPIGGRGYYPGLRGGGPLTTLIELLEYQGNQQTPLWRKLWLNVMPQDEADLPLPKTFDDLVFPWLAPTRTSELDGAVVTDEQVNKLQAYWGMPRRIRIDFKTTSIGNCDICGRQSDALLGLMSLKNYGVQYVMWRHPLTPYRLPLKEGGDFYSVKPQPGGLIWRDWLGLIEVGNSKNNTELPAQVVKLLNASNLKQTRVGLWGFGFDFEDMKVRCWYEHHFPLLLNKKEDLIPKLRLAAQAASHILSLLHRALKEAWFSEKKTTKLDFGFVDIDFWNKTQHRFLRLVRKIEEGQDPYELLSKWQKEMWLFARQDFDDRVFTNPYEPVDLERVMTARKKYFTTSAEKQNANAAREKKQEAAE

SEQ ID NO: 5350 - protein, 520 aa, Escherichia coli 3.2608
MNSFSLLTTPWLPVRFKDGTTGKLAPVDLADENVVDIAAPRADLQGAAWQFLLGLLQTSFAPKDQRRWDDIWEDGLEAEKLREALLSLEHAFQFGPDSPSFMQDFDELKVKATSIASLLPDAPGKQTKERNTDHFIKRDTTQHLCLHCVPLALFSIQLNAPIGGRGYYPGLRGGGPLTTLIELLEYQGNQQTPLWRKLWLNVMPQDEADLPLPKTFDDLVFPWLAPTRTSELDGAVVTDEQVNKLQAYWGMPRRIRIDFKTTSIGNCDICGRQSDALLGLMSLKNYGVQYVMWRHPLTPYRLPLKEGGDFYSVKPQPGGLIWRDWLGLIEVGNSKNNTELPAQVVKLLNASNLKQTRVGLWGFGFDFEDMKVRCWYEHHFPLLLNKKEDLIPKLRLAAQAASHILSLLHRALKEAWFSEKKTTKLDFGFVDIDFWNKTQHRFLRLVRKIEEGQDPYELLSKWQKEMWLFARQDFDDRVFTNPYEPVDLERVMTARKKYFTTSAEKQNANAAREKKQEAAE

SEQ ID NO: 5351 - protein, 520 aa, Escherichia coli 93.0624; identical to SEQ ID NO: 5350

SEQ ID NO: 5352 - protein, 520 aa, Escherichia coli 4.0522
MNSFSLLTTPWLPVRFKDGTTGKLAPVDLADENVVDIAAPRADLQGTAWQFLLGLLQTSFAPKNHGRWDDIWQDGLEAEKLREALLSLEHAFQFGADSPSFMQDFEALKGDKVQVASLLPEIPGAQTTKFNKDHFIKRGVTEHVCPHCSALALFSLQLNAPSGGKGYRTGLRGGGPMTTLIELQEYQGNQQTPLWRKLWPNVMPQDEADLPLPKKFDDLVFPWLGPTRTSELAGAVVTHDQVNKLQAYWGMPRRIRIDFNTTTVGNCDICGEQSDALLSLMTTKNYGANYAMWQHPLTPYRIPLKEGGEFYSVKPQPGGLIWRDWLGLIETGKSENNTELPALVVKLFNASSLKQAKVGLWGFGYDFDNMKARCWYEHHFPLLLKKKEGQIPKLRLAAQTASRILSLLRSALKEAWFSDPKGARGDFSFVDIDFWNKTQHRFLRLVRQIEEGQDADELLGKWQKEIWLFARQDFDERVFTNPYEPVDLKRVMTARKKYFTTSAEKQSAKAAREKKQEAAE

SEQ ID NO: 5353 - protein, 520 aa, Escherichia coli JB1-95; identical to SEQ ID NO: 5352

SEQ ID NO: 5354 - protein, 520 aa, Escherichia coli 96.154
MNSFSLLTTPWLPVRFKDGTTGKLAPVDLADENVVDIAAPRADLQGAAWQFLLGLLQSSFAPKDYRRWDDIWEDGLEAEKLREALLSLEHAFQFGPDSPSFMQDFEVLMGDKVQVASLLPEIPGAQTTKFNKDHFIKRGVTEHVCSHCSALALFSLQLNAPSGGKGYRTGIRGGGPMTTLIELQEYQGNQQAPLWRKLWLNVMPQDEADLPLPKKFDDLVFPWLGPTRTSELAGAVVTDDQVNKLQAYWGMPRRIRIDFNTTTVGNCDICGEQDDALLSLMTTKNYGANYAMWQHPLTPYRVPLKEGGEFYSVKPQPGGLIWRDWLGLIETGKSENNTELPALVVKLFNASSLKQAKVGLWGFGYDFDNMKARCWYEHRFPLLLNKKEGQIPKLRLAAQTASRILSLLRSALKEAWFSDPKGARGDFSFVDIDFWNKTQHRFLRLVRQIEEGQDADGLLSKWNKEIWLFARQDFDERVFTNPYEPVDLKRVMTARKKYFTTSAEKQSAKAAREKKQEAAE

SEQ ID NO: 5355 - protein, 520 aa, Escherichia coli 5.0959
MNSFSLLTTPWLPVRFKDGTTGKLAPVDLADENVVDISAPRADLQGAVWQFLLGLLQTSFAPKDHRRWDDIWEDGLEAEKLREALQSLEHAFQFGPDSPSFMQDFEALTGDKVPVASLLPEIPGAQTTKFNKDHFIKRGVTEYLCPHCSALALFSLQLNAPSGGKGYRTGLRGGGPMTTLIELQEYQGNQQTPLWRKLWINVMPQDEADLPLPKKFDDLVFPWLGPTRTSELAGAVVTDEQVNKLQAYWGMPRRIRIDFNTTTVGNCDICGEQSDALLSLMTTKNYGANYAMWQHPLTPYRVPLKEGGEFYSVKPQPGGLIWRDWLGLIETGKSENNTELPALVVKLFNASSLKQAKVGLWGFGYDFDNMKARCWYEHHFPLLLDKKEGQIPKLRLAAQTASRILSLLRSALKEAWFSDPKGARDDFSFVDIDFWNKTQHRFLRLVRQIEEGQDADELLSKWNKEIWLFARQDFDERVFTNPYEPVDLERVMTARKKYFTTSAEKQSAKAAREKKQEAAE

SEQ ID NO: 5356 - protein, 520 aa, Escherichia coli 9.0111
MNSFSLLTTPWLPVRFKDGTTGKLAPVDLADENVVDISAPRADLQGAVWQFLLGLLQTSFAPKDHRRWDDIWEDGLEAEKLREALQSLEHAFQFGPDSPSFMQDFEALTGDKVPVASLLPEIPGAQTTKFNKDHFIKRGVTEYLCPHCSALALFSLQLNAPSGGKGYRTGLRGGGPMTTLIELQEYQGNQQTPLWRKLWINVMPQDEADLPLPKKFDDLVFPWLGPTRTSELAGAVVTDEQVNKLQAYWGMPRRIRIDFNTTTVGNCDICGEQSDALLSLMTTKNYGANYAMWQHPLTPYRVPLKEGGEFYSVKPQPGGLIWRDWLGLIETGKSENNTELPALVVKLFNASSLKQAKVGLWGFGYDFDNMKARCWYEHHFPLLLDKKEGQIPKLRLAAQTASRILSLLRSALKEAWFSDPKGARGDFSFVDIDFWNKTQHRFLRLVRQIEEGQDADELLSKWNKEIWLFARQDFDERVFTNPYEPVDLERVMTARKKYFTTSAEKQSAKAAREKKQEAAE

SEQ ID NO: 5357 - protein, 520 aa, Escherichia coli 4.0967; identical to SEQ ID NO: 5350

SEQ ID NO: 5358 - protein, 520 aa, Escherichia coli 2.3916; identical to SEQ ID NO: 5356

SEQ ID NO: 5359 - protein, 520 aa, Escherichia coli 3.3884; identical to SEQ ID NO: 5354

SEQ ID NO: 5360 - protein, 460 aa, Escherichia coli B41; identical to SEQ ID NO: 5300

SEQ ID NO: 5361 - protein, 520 aa, Escherichia coli 900105 (10e); identical to SEQ ID NO: 5261

SEQ ID NO: 5362 - protein, 480 aa, Desulfobacter postgatei 2ac9
MNLTDTPWIPIIRDNGSREKVSLIALFKEGETIRDLAVNPPQRIALMRFLICITQAALDGPQDEKAWFHAKKDLVNNVIVYLETWAHAFDLYGETPFMQAKDLDPLDNAVLDKLNFDLSAGNNSVLFDHEASPSGRIHSPEWCALMLLTFQCFSPGGLIGTTQWGKDKTTKTSEHAPAIEGSMLHTYIRGENLQVTIWMNLLTKEMLAEFPGMTFGRPIWEDDDVFKGNPEAARMSTQSYLGRLVPLSRAVFLDQNQKTFTLANGLSYPKLPVQREPCATVVRRGKEKNEKDMYISVNLARHPWRELSSVLSLSKTAIAGGAVCLRHLKYIKSDRVDIWTGGMAADKGKILDVAGWNFSLPIEMLNTTELLIYEKGVELARKGEYLLREAVKTWHKEMAVDSKSISYDKALMNYWALLDEQYLILIRCIGNSEPLGQAWFSVICRAMNIAYINNCPHTTPRQIQAFAIAAQKLRLKKPDH

SEQ ID NO: 5363 - protein, 520 aa, Escherichia coli FRIK1996
MNSFSLLTTPWLPVRFKDGTTGKLAPVDLADENVVDIAAPRADLQGAAWQFLLGLLQSSFAPKDYRRWDDIWEDGLEAEKLREALLSLEHPFQFGPDSPSFMQDFEVLMGDKVQVASLLPEIPGAQTTKFNKDHFIKRGVTEHVCSHCSALALFSLQLNAPSGGKGYRTGLRGGGPMTTLIELQEYQGNQQAPLWRKLWLNVMPQDEADLPLPKKFDDLVFPWLGPTRTSELAGAVVTDDQVNKLQAYWGMPRRIRIDFNTTTVGNCDICGEQSDALLSLMTTKNYGANYAMWQHPLTPYRVPLKEGGEFYSVKPQPGGLIWRDWLGLIETGKSENNTELPALVVKLFNASSLKQAKVGLWGFGYDFDNMKARCWYEHHFPLLLNKKEGQIPKLRLAAQTASRILSLLRSALKEAWFSDPKGARGDFSFVDIDFWNKTQHRFLRLVRQIEEGQDADELLGKWQKEIWLFARQDFDERVFTNPYEPVDLERVMTARKKYFTTSAEKQSAKAAREKKQEAAE

SEQ ID NO: 5364 - protein, 520 aa, Escherichia coli FDA517; identical to SEQ ID NO: 5363

SEQ ID NO: 5365 - protein, 520 aa, Escherichia coli FDA505; identical to SEQ ID NO: 5363

SEQ ID NO: 5366 - protein, 520 aa, Escherichia coli 93-001; identical to SEQ ID NO: 5363

SEQ ID NO: 5367 - protein, 520 aa, Escherichia coli FRIK1985; identical to SEQ ID NO: 5363

SEQ ID NO: 5368 - protein, 520 aa, Escherichia coli FRIK1990; identical to SEQ ID NO: 5363

SEQ ID NO: 5369 - protein, 520 aa, Escherichia coli PA3; identical to SEQ ID NO: 5363

SEQ ID NO: 5370 - protein, 520 aa, Escherichia coli PA5; identical to SEQ ID NO: 5363

SEQ ID NO: 5371 - protein, 520 aa, Escherichia coli PA9; identical to SEQ ID NO: 5363

SEQ ID NO: 5372 - protein, 520 aa, Escherichia coli PA10; identical to SEQ ID NO: 5363

SEQ ID NO: 5373 - protein, 520 aa, Escherichia coli PA15; identical to SEQ ID NO: 5363

SEQ ID NO: 5374 - protein, 520 aa, Escherichia coli PA14; identical to SEQ ID NO: 5363

SEQ ID NO: 5375 - protein, 520 aa, Escherichia coli PA22; identical to SEQ ID NO: 5363

SEQ ID NO: 5376 - protein, 520 aa, Escherichia coli PA25; identical to SEQ ID NO: 5363

SEQ ID NO: 5377 - protein, 520 aa, Escherichia coli PA24; identical to SEQ ID NO: 5363

SEQ ID NO: 5378 - protein, 520 aa, Escherichia coli PA28; identical to SEQ ID NO: 5363

SEQ ID NO: 5379 - protein, 520 aa, Escherichia coli PA31; identical to SEQ ID NO: 5363

SEQ ID NO: 5380 - protein, 520 aa, Escherichia coli PA32; identical to SEQ ID NO: 5363

SEQ ID NO: 5381 - protein, 520 aa, Escherichia coli PA33; identical to SEQ ID NO: 5363

SEQ ID NO: 5382 - protein, 520 aa, Escherichia coli PA40; identical to SEQ ID NO: 5363

SEQ ID NO: 5383 - protein, 520 aa, Escherichia coli PA41; identical to SEQ ID NO: 5363

SEQ ID NO: 5384 - protein, 520 aa, Escherichia coli PA39; identical to SEQ ID NO: 5363

SEQ ID NO: 5385 - protein, 520 aa, Escherichia coli PA42; identical to SEQ ID NO: 5363

SEQ ID NO: 5386 - protein, 520 aa, Escherichia coli TW06591
MNSFSLLTTPWLPVRFKDGTTGKLAPVDLADENVVDIAAPRADLQGAAWQFLLGLLQSSFAPKDYRRWDDIWEDGLEAEKLREALLSLEHAFQFGPDSPSFMQDFEVLMGDKVQVASLLPEIPGAQTTKFNKDHFIKRGVTEHVCSHCSALALFSLQLNAPSGGKGYRTGLRGGGPMTTLIELQEYQGNQQAPLWRKLWLNVMPQDEADLPLPKKFDDLVFPWLGPTRTSELAGAVVTDDQVNKLQAYWGMPRRIRIDFNTTTVGNCDICGEQSDALLSLMTTKNYGANYAMWQHPLTPYRVPLKEGGEFYSVKPQPGGLIWRDWLGLIETGKSENNTELPALVVKLFNASSLKQAKVGLWGFGYDFDNMKARCWYEHHFPLLLNKKEGQIPKLRLAAQTASRILSLLRSALKEAWFSDPKGARGDFSFVDIDFWNKTQHRFLRLVRQIEEGQDADELLGKWQKEIWLFARQDFDERVFTNPYEPVDLERVMTARKKYFTTSAEKQSAKAAREKKQEAAE

SEQ ID NO: 5387 - protein, 520 aa, Escherichia coli TW07945; identical to SEQ ID NO: 5363

SEQ ID NO: 5388 - protein, 520 aa, Escherichia coli TW10246; identical to SEQ ID NO: 5363

SEQ ID NO: 5389 - protein, 520 aa, Escherichia coli TW11039; identical to SEQ ID NO: 5363

SEQ ID NO: 5390 - protein, 520 aa, Escherichia coli TW09098; identical to SEQ ID NO: 5363

SEQ ID NO: 5391 - protein, 109 aa, Escherichia coli TW09109
MKEAWFSDPKGARGDFSFVDIDFWNKTQHRFLRLVRQIEEGQDADELLGKWQKEIWLFARQDFDERVFTNPYEPVDLERVMTARKKYFTTSAEKQSAKAAREKKQEAAE

SEQ ID NO: 5392 - protein, 520 aa, Escherichia coli TW10119; identical to SEQ ID NO: 5363

SEQ ID NO: 5393 - protein, 520 aa, Escherichia coli EC4203; identical to SEQ ID NO: 5363

SEQ ID NO: 5394 - protein, 520 aa, Escherichia coli TW09195; identical to SEQ ID NO: 5363

SEQ ID NO: 5395 - protein, 520 aa, Escherichia coli EC4196; identical to SEQ ID NO: 5363

SEQ ID NO: 5396 - protein, 520 aa, Escherichia coli O157:H7 str. TW14313; identical to SEQ ID NO: 5363

SEQ ID NO: 5397 - protein, 520 aa, Escherichia coli TW14301; identical to SEQ ID NO: 5363

SEQ ID NO: 5398 - protein, 520 aa, Escherichia coli EC4421; identical to SEQ ID NO: 5363

SEQ ID NO: 5399 - protein, 520 aa, Escherichia coli EC4422; identical to SEQ ID NO: 5363

SEQ ID NO: 5400 - protein, 520 aa, Escherichia coli EC4013; identical to SEQ ID NO: 5363

SEQ ID NO: 5401 - protein, 520 aa, Escherichia coli EC4402; identical to SEQ ID NO: 5363

SEQ ID NO: 5402 - protein, 520 aa, Escherichia coli EC4439; identical to SEQ ID NO: 5363

SEQ ID NO: 5403 - protein, 520 aa, Escherichia coli EC4436; identical to SEQ ID NO: 5363

SEQ ID NO: 5404 - protein, 520 aa, Escherichia coli EC4437; identical to SEQ ID NO: 5363

SEQ ID NO: 5405 - protein, 520 aa, Escherichia coli EC4448; identical to SEQ ID NO: 5363

SEQ ID NO: 5406 - protein, 520 aa, Escherichia coli EC1738; identical to SEQ ID NO: 5363

SEQ ID NO: 5407 - protein, 520 aa, Escherichia coli EC1734; identical to SEQ ID NO: 5363

SEQ ID NO: 5408 - protein, 520 aa, Escherichia coli EC1863; identical to SEQ ID NO: 5363

SEQ ID NO: 5409 - protein, 520 aa, Escherichia coli EC1845; identical to SEQ ID NO: 5363

SEQ ID NO: 5410 - protein, 549 aa, Frankia sp. QA3
MTQGWTGKQVDVFRLNDDGWIAVDRRGARVEVGVRDALVNAHDIDGLALDDPLEAVAILRQVLLPVLLDACGVPRTDDEWAQQWDAGRFDGQRITEYLTEHADRFDLFSVERPFAQVAGLHTAKNETRPVSLLVPRLAAGNSVPLFSSRTEGDPPRLTPAAAARALLAAHCWDTAAIKTGVVGDPQVKGGKTTGNHTGPLGQLGVVVPLGETLFHTLMLNLPILPAGRRPDDRPQWAGEEPAGPRWMVRPARGLLDLLTWQSRRIRLIPQEDPTVPGGVSVRQVVLAAGDRLLGSVHHLEPHTAWRQVDKPKADQPPVRPARHQPGRAAWRGFEALLATAPSPGEKVSAPTLLSQAAGLREDGLLPADLALRVLTVGVQYGTQSAVIDEVTVDEIPLPVTALLRDSEVRRVVLAVADQAESLRVAANRLGDTLREAAGAREKLSWDKGQRLGDMLVHNFTPAVRRLLAGLARHPQDAGRAELAWKIIARQVIWETVDPLLSAAGPRAFLGPHPDELFGARLAVAETSLRRTLNDVLGQDADNRRDLAAA

SEQ ID NO: 5411 - protein, 556 aa, Actinomyces sp. ICM58
MKNPEYNLLDEPWIPVRLLDGTIADVGLLELLRRTTEIADLACELPTQSIAIQRLVLAIAYRVAPPRDARDWVRQWDEGAPTEQMIEYLERWRDRFFLFGGRFPFMQVADLRTAKDAVSGLEKLIADVPNGEQFFTTRHGRALACIPPSEAARWLVHAQAYDPSGIRSGAVGDSQVKGGKGYPIGPSWCGHLGLVWLKGKDLDETLVLNLVPTDAAQLRGVESSTEWGACSWEVSEAESAVRGDYSLLDPSGTPRDISIPRLLTWHSRRVRLVGNREGVTGVVLAQGDKLAPQQMYRYEPQSLWRYSTPQSKKFKQDVYMPRKYEAGRALWRNLPGTLPTVTTVQGVDKQPKQEFLPSATLSFHYQLDNASIETTYPKVMRIQAVGVTYGPQEATFEDIYSDELTLSVAVMRVEHEDLSAEIDRQVRLTEEIARDVGNLAANLARAAGESGEGAGDGARDRAKELFFSAVDTDFRTWLTQVDGREGARDAGRRWECSLRQHAVGIQGALVRGASSSAIIGRDTGRGYMNVGIAENYFRAALNKHLPLQKTNQEGTK

SEQ ID NO: 5412 - protein, 566 aa, Slackia sp. CM382
MSEDVHFNLVDEPWIRVRDMRGISRELSLWDLFACAGELKCLANDLPTQDIAILRLLLAILQRSLSPSLDEDDDPAEVWARLWEADTLPVEEIHSYLEKWRHRFDLLDKNEPFMQIAGLVRSNDAIKDEDGEPYLKRIIADVPSRRNRRLFSVRMGEGINRLSYAEAARWLIHVHSFDTGGPKNAAKGDSSDVIKKEGRSYPGGTGWLGRIGCLYFEGSTIKETLILNFVPLYRNEIDSLFSENDLPIWERRQRCVSDGHEPRVLPDGRADLYTWQSRWVNFSHEDGMITNVVLSAGDLLSVEAAELYTVENMTSWKEGTSKSKSSAPKLIPVHFDSDKALWRGLNAVFAQNCSNKDPACHLSGTAVWLRHLSSNNGGRAISKEYLLNVHAVDFKYDDSQSSSYHSMVDDKLEMSSYLLSPEGAPLVNFACRCVEKTEEAVKTLGSLAVNLYLASGGDSESSLGVREAAKSRAFFEIDRLFRVWFSALGSQTNAEAARAGWYAQLRDVLMRLAQELIGEAGPAAVRGSQLKNKKDWMTAGKAEARFYATLDCILSCGSKEEKVKEG

SEQ ID NO: 5413 - protein, 520 aa, Escherichia coli PA7; identical to SEQ ID NO: 5363

SEQ ID NO: 5414 - protein, 520 aa, Escherichia coli FRIK920; identical to SEQ ID NO: 5363

SEQ ID NO: 5415 - protein, 520 aa, Escherichia coli PA34; identical to SEQ ID NO: 5363

SEQ ID NO: 5416 - protein, 520 aa, Escherichia coli FDA506; identical to SEQ ID NO: 5363

SEQ ID NO: 5417 - protein, 520 aa, Escherichia coli FDA507; identical to SEQ ID NO: 5363

SEQ ID NO: 5418 - protein, 109 aa, Escherichia coli FDA504; identical to SEQ ID NO: 5391

SEQ ID NO: 5419 - protein, 520 aa, Escherichia coli FRIK1999; identical to SEQ ID NO: 5363

SEQ ID NO: 5420 - protein, 520 aa, Escherichia coli FRIK1997; identical to SEQ ID NO: 5363

SEQ ID NO: 5421 - protein, 520 aa, Escherichia coli NE1487; identical to SEQ ID NO: 5363

SEQ ID NO: 5422 - protein, 520 aa, Escherichia coli NE037; identical to SEQ ID NO: 5363

SEQ ID NO: 5423 - protein, 520 aa, Escherichia coli FRIK2001; identical to SEQ ID NO: 5363

SEQ ID NO: 5424 - protein, 520 aa, Escherichia coli PA4; identical to SEQ ID NO: 5363

SEQ ID NO: 5425 - protein, 520 aa, Escherichia coli PA23; identical to SEQ ID NO: 5363

SEQ ID NO: 5426 - protein, 520 aa, Escherichia coli PA49; identical to SEQ ID NO: 5363

SEQ ID NO: 5427 - protein, 520 aa, Escherichia coli PA45; identical to SEQ ID NO: 5363

SEQ ID NO: 5428 - protein, 520 aa, Escherichia coli TT12B; identical to SEQ ID NO: 5363

SEQ ID NO: 5429 - protein, 520 aa, Escherichia coli MA6; identical to SEQ ID NO: 5363

SEQ ID NO: 5430 - protein, 520 aa, Escherichia coli 5905; identical to SEQ ID NO: 5386

SEQ ID NO: 5431 - protein, 520 aa, Escherichia coli CB7326
MNSFSLLTTPWLPVRFKDGTTGKLAPVDLADENVVDIAAPRADLQGAAWQFLLGLLQSSFAPKDYRRWDDIWEDGLEAEKLREALLSLEHPFQFGPDSPSFMQDFEVLMGDKVQVASLLPEIPGAQTTKFNKDHFIKRGVTEHVCSHCSALALFSLQLNAPSGGKGYRTGLRGGGPMTTLIELQEYQGNQQAPLWRKLWLNVMPQDEADLPLPKKFDDLVFPWLGPTRTSELAGAVVTDDQVNKLQAYWGMPRRIRIDFNTTTVGNCDICGEQSDALLSLMTTKNYGANYAMWQHPLTPYRVPLKEGGEFYSVKPQPGGLIWRDWLGLIETGKSENNTELPALVVKLFNASSLKQAKVGLWGFGYDFDNMKARCWYEHHFPLLLNKKEGQIPKLRLAAQTASRILSLLRSALKEAWFSDPKGARGDFSFVDIDFWNKTQHRFLRLVRQIEEGQDADELLGKWQKEIWLFARQDFDERVFINPYEPVDLERVMTARKKYFTTSAEKQSAKAAREKKQEAAE

SEQ ID NO: 5432 - protein, 520 aa, Escherichia coli EC96038; identical to SEQ ID NO: 5363

SEQ ID NO: 5433 - protein, 520 aa, Escherichia coli 5412; identical to SEQ ID NO: 5386

SEQ ID NO: 5434 - protein, 520 aa, Escherichia coli 3006
MNSFSLLTTPWLPVRFKDGTRGKLAPVDLADENVVDISAPRADLQGAVWQFLLGLLQTSFAPKDHRRWDDIWEDGLEAEKLREALQSLEHAFQFGPDSPSFMQDFEALTGDKVPVASLLPEIPGAQTTKFNKDHFIKRGVTEYLCPHCSALALFSLQLNAPSGGKGYRTGLRGGGPMTTLIELQEYQGNQQTPLWRKLWINVMPQDEADLPLPKKFDDLVFPWLGPTRTSELAGAVVTDEQVNKLQAYWGMPRRIRIDFNTTTVGNCDICGEQSDALLSLMTTKNYGANYAMWQHPLTPYRVPLKEGGEFYSVKPQPGGLIWRDWLGLIETGKSENNTELPALVVKLFNASSLKQAKVGLWGFGYDFDNMKARCWYEHHFPLLLDKKEGQIPKLRLAAQTASRILSLLRSALKEAWFSDPKGARGDFSFVDIDFWNKTQHRFLRLVRQIEEGQDADELLSKWNKEIWLFARQDFDERVFTNPYEPVDLKRVMTARKKYFTTSAEKQSAKAAREKKQEAAE

SEQ ID NO: 5435 - protein, 520 aa, Escherichia coli PA38; identical to SEQ ID NO: 5363

SEQ ID NO: 5436 - protein, 520 aa, Escherichia coli EC1735; identical to SEQ ID NO: 5363

SEQ ID NO: 5437 - protein, 520 aa, Escherichia coli EC1736; identical to SEQ ID NO: 5363

SEQ ID NO: 5438 - protein, 520 aa, Escherichia coli EC1737; identical to SEQ ID NO: 5363

SEQ ID NO: 5439 - protein, 520 aa, Escherichia coli EC1846; identical to SEQ ID NO: 5363

SEQ ID NO: 5440 - protein, 520 aa, Escherichia coli EC1847; identical to SEQ ID NO: 5363

SEQ ID NO: 5441 - protein, 520 aa, Escherichia coli EC1848; identical to SEQ ID NO: 5363

SEQ ID NO: 5442 - protein, 520 aa, Escherichia coli EC1849; identical to SEQ ID NO: 5363

SEQ ID NO: 5443 - protein, 520 aa, Escherichia coli EC1850; identical to SEQ ID NO: 5363

SEQ ID NO: 5444 - protein, 520 aa, Escherichia coli EC1856; identical to SEQ ID NO: 5363

SEQ ID NO: 5445 - protein, 520 aa, Escherichia coli EC1862; identical to SEQ ID NO: 5363

SEQ ID NO: 5446 - protein, 520 aa, Escherichia coli EC1864; identical to SEQ ID NO: 5363

SEQ ID NO: 5447 - protein, 520 aa, Escherichia coli EC1865; identical to SEQ ID NO: 5261

SEQ ID NO: 5448 - protein, 520 aa, Escherichia coli EC1868; identical to SEQ ID NO: 5363

SEQ ID NO: 5449 - protein, 520 aa, Escherichia coli EC1866; identical to SEQ ID NO: 5363

SEQ ID NO: 5450 - protein, 520 aa, Escherichia coli EC1869; identical to SEQ ID NO: 5363

SEQ ID NO: 5451 - protein, 520 aa, Escherichia coli EC1870; identical to SEQ ID NO: 5363

SEQ ID NO: 5452 - protein, 520 aa, Escherichia coli NE098; identical to SEQ ID NO: 5363

SEQ ID NO: 5453 - protein, 520 aa, Escherichia coli FRIK523; identical to SEQ ID NO: 5363

SEQ ID NO: 5454 - protein, 520 aa, Escherichia coli 0.1288
MNSFSLLTTPWLPVRFKDGTTGKLAPVDLADENVVDIAAPRADLQGAAWQFLLGLLQTSFAPKNHGRWDDIWQDGLEAEKLREALLSLEHAFQFGPDSPSFMQDFEALTGDKVPVASLLPEIPGAQTTKFNKDHFIKRGVTEYLCPHCSALALFSLQLNAPSGGKGYRTGLRGGGPMTTLIELQEYQGNQQTPLWRKLWINVMPQDEADLPLPKKFDDLVFPWLGPTRTSELAGAVVTDEQVNKLQAYWGMPRRIRIDFNTTTVGNCDICGEQSDALLSLMTTKNYGANYAMWQHPLTPYRIPLKEGGEFYSVKPQPGGLIWRDWLGLIETGKSENNTELPALVVKLFNASSLKQAKVGLWGFGYDFDNMKARCWYEHHFPLLLKKKEGQIPKLRLVAQTASRILSLLRSALKEAWFSDPKGARGDFSFVDIDFWNKTQHRFLRLVRQIEEGQDADELLGKWQKEIWLFARQDFDERVFTNPYEPVDLKRVMTARKKYFTTSAEKQSAKAAREKKQEAAE

SEQ ID NO: 5455 - protein, 520 aa, Escherichia coli 0.1304; identical to SEQ ID NO: 5363

SEQ ID NO: 5456 - protein, 109 aa, Escherichia coli 3.4870; identical to SEQ ID NO: 5391

SEQ ID NO: 5457 - protein, 520 aa, Escherichia coli 5.2239; identical to SEQ ID NO: 5363

SEQ ID NO: 5458 - protein, 520 aa, Escherichia coli 6.0172; identical to SEQ ID NO: 5363

SEQ ID NO: 5459 - protein, 520 aa, Escherichia coli 8.0586; identical to SEQ ID NO: 5363

SEQ ID NO: 5460 - protein, 520 aa, Escherichia coli 10.0833; identical to SEQ ID NO: 5363

SEQ ID NO: 5461 - protein, 520 aa, Escherichia coli 8.2524; identical to SEQ ID NO: 5363

SEQ ID NO: 5462 - protein, 520 aa, Escherichia coli 10.0869; identical to SEQ ID NO: 5363

SEQ ID NO: 5463 - protein, 520 aa, Escherichia coli 88.0221; identical to SEQ ID NO: 5363

SEQ ID NO: 5464 - protein, 520 aa, Escherichia coli 8.0416; identical to SEQ ID NO: 5363

SEQ ID NO: 5465 - protein, 520 aa, Escherichia coli 10.0821; identical to SEQ ID NO: 5363

SEQ ID NO: 5466 - protein, 533 aa, Leptospira santarosai str. MOR084
MNLIKDVWIPTLRFSGKSAEISPFEITSQIENDSDPIVSLNSPRPDFNGALLQFLTGLLQVVFPPENEIEWEDLFVNPPSPEILKEAMTKAESAFELFGDGSRFMQDTNLNEEDTIFDISALFIESPGENTIKLKKDFFIKRNSISQICEKCAGIGLFSFQTNSPSGGQGHLTSIRGGGPLTTFVTSKLKNPKKNSLWSILWLNVLPKSYFQVNGHKKIPFQSVFPWTNPKIEDLQSKGKTTTPQDLHPLSVYWSYPRRILLRKETENGVCDVCNRSSSVLVRSYHTRTYGLSYSEGGWIHPFSPYYKSKESWLPYHPQPGGILYHYWQTITLGKDQENQAALVIRRFLNRKIPGEQTSILTFGYDMDNMKARCWYESEIPFFNVPPDTIEKFEEQISQILNASAEVKKNLRQAVRNAWLDKKNDSKGDLTFLDVSFLKVTESPFYDLIRIVKETLISGITDLSTLKETWLNLLNESALKLFDQYADSGNFEFENIERIVNARKDLRTKDLGSKTRTTLGLIIPEKKSKRSKK

SEQ ID NO: 5467 - protein, 533 aa, Leptospira sp. Fiocruz LV3954
MNLIKDVWIPTLRFSGKSAEISPFEITSQIENDSDPIVSLNSPRPDFNGALLQFLTGLLQVVFPPENEIEWEDLFVNPPSPEILKEAMTKAESAFELFGDGSRFMQDTNLNEEDTIFDISALFIESPGENTIKLKKDFFIKRNSISRICEKCAGIGLFSFQTNSPSGGQGHLTSIRGGGPLTTFVTSKLKNPKKNSLWSILWLNVLPKSYFQVNGHKKIPFQSVFPWTNPKIEDLQSKGKTTTPQDLHPLSVYWSYPRRILLRKETENGVCDVCNRSSSVLVRSYHTRTYGLSYSEGGWIHPFSPYYKSKESWLPYHPQPGGILYHYWQTITLGKDQENQAALVIRRFLNRKIPGEQTSILTFGYDMDNMKARCWYESEIPFFNVPPDTIEKFEEQISQILNASAEVKKNLRQAVRNAWLDKKNDSKGDLTFLDVSFLKVTESPFYDLIRIVKETLISGITDLSTLKETWLNLLNESALKLFDQYADSGNFEFENIERIVNARKDLRTKDLGSKTRTTLGLIIPEKKSKRSKK

SEQ ID NO: 5468 - protein, 533 aa, Leptospira borgpetersenii str. 200801926
MNLIKDVWIPVQRFSEKLEEISPFEITSRIENDSDPIMSLNAPRPDFNGALLQFLVGLLQAVFPPENETEWEDLFVNPPSPEVLKEAMEKVKSAFELFGDGPRFMQDTNLNEEDTVFDISALFIESPGENTIKLKKDFFIKRNSISQICEKCAGIGLFSFQTNSPSGGQGHLTSIRGGGPLTTFVTSKLKNPKKNSLWSKLWLNVLPKSYFQVNGQKKIPFQSVFPWTNPKIEDLQSKGKTTTPKDLHPLSVYWSYPRRILLRKDVENGICDVCNRSSSVLVRSYHTKTYGLSYSEGGWIHPLSPYYKSKESWFPYHPQPGGILYHYWQTIALGKEQEDQAALVIRRFLNRKIPGEQTSILTFGYDMDNMKARCWYESEIPFFNIPSDKIEKFEEQVSQILNASTEVKKNLRQAVRNAWLNKKNDSKGDLTFLDVSFLKDTENSFYDLIRNVQENLISGVADFAALKETWLKLLNESACKLFDQYADSGSFEFENIERIVEAKKNLKISNLGSKTRIILGLIVSEKTSKRNKK

SEQ ID NO: 5469 - protein, 533 aa, Leptospira borgpetersenii str. UI 09149
MNLIKDVWIPVQRFSEKLEEISPFEITSRIENDSDPIMSLNAPRPDFNGALLQFLVGLLQAVFPPENETEWEDLFVNPPSPEVLKEAMEKVKSAFELFGDGPRFMQDTNLNEEDTVFDISALFIESPGENTIKLKKDFFIKRNSISQICEKCAGIGLFSFQTNSPSGGQGHLTSIRGGGPLTTFVTSKLKNPKKNSLWSKLWLNVLPKSYFQVNGQKKIPFQSVFPWTNPKIEDLQSKGKTTTPKDLHPLSVYWSYPRRILLRKDVENGICDVCNRSSSVLVRSYHTKTYGLSYSEGGWIHPLSPYYKSKESWFPYHPQPGGILYHYWQTIALGKEQEDQAALVIRRFLNRKIPGEQTSILTFGYDMDNMKARCWYESEIPFFNIPSDKIEKFEEQVSQILNASTEVKKNLRQAVRNAWLDKKNDSKGDLTFLDVSFLKDTENSFYDLIRNVQENLISGVADFAALKETWLKLLNESACKLFDQYAESGSFEFENIERIVKARKNLKISNLGSKTRIILGLIVSEKTSKRNKK

SEQ ID NO: 5470 - protein, 533 aa, Leptospira borgpetersenii serovar Castellonis str. 200801910
MNLIKDVWIPVQRFSEKLEEISPFEITSRIENDSDPIMSLNAPRPDFNGALLQFLVGLLQAVFPPENETEWEDLFVNPPSPEVLKEAMEKVKSAFELFGDGPRFMQDTNLNEEDTVFDISALFIESPGENTIKLKKDFFIKRNSISQICEKCAGIGLFSFQTNSPSGGQGHLTSIRGGGPLTTFVTSKLKNPKKNSLWSKLWLNVLPKSYFQVNGQKKIPFQSVFPWTNPKIEDLQSKGKTTTPKDLHPLSVYWSYPRRILLRKDVENGICDVCNRSSSVLVRSYHTKTYGLSYSEGGWIHPLSPYYKSKESWFPYHPQPGGILYHYWQTIALGKEQEDQAALVIRRFLNRKIPGEQTSILTFGYDMDNMKARCWYESEIPFFNISSDKIEKFEEQVSQILNASTEVKKNLRQAVRNAWLDKKNDSKGDLTFLDVSFLKDTENSFYDLIRNVQENLISGVADFAALKETWLKLLNESACKLFDQYAESGSFEFENIERIVKARKNLKISNLGSKTRIILGLIVSEKTSKRNKK

SEQ ID NO: 5471 - protein, 533 aa, Leptospira weilii str. 2006001853
MNLIKDVWIPAQRFSGKFEEISPFEITSQIENDSDPVVSLNAPRPDFNGALLQFLIGLLQAVFPPENETEWEDLFVNPPSPEVLKEAMEKVESAFELFGDGPRFMQDKNLNEEDTIFDISALFIESPGENTIKLKKDFFIKRDSISQICEKCAGIGLFSFQTNSPSGGQGHLTSIRGGGPLTTFVTSKLKDPKKNSLWSKLWLNVLPKSYFQVNGQKKIPFQSVFPWTNPKIEDLQTKGKTTTPQDLHPLSVYWSYPRRILLRKEEENGACDVCNRSSSVLVRSYHTKTYGLSYSEGGWIHPFSPYYKSKESWLPYHPQPGGILYHYWQTIALGKGQEDQAALVIRRSLNRKIPGEQTSILTFGYDMDNMKARCWYESEIPFFNIPSDKIEKFEEQVSQILNTSTEIKKNLRQAVRNAWFDKKNDTKGDLAFLDVSFLKDTESSFYDLIRNVKENLISGATDFAALKKTWLKLLNESACKLFDQYAESGNFEFEDDERIVEAKKNLKIFNLGSKTRNILGLTTPEKPSKRRKK

SEQ ID NO: 5472 - protein, 524 aa, Leptospira noguchii str. 2006001870
MPDFSFNLLTEPWIPVVHKTSKKQLLNLNDFLRTAHKLERFDFPLPGLETAVIRFLVALVHIVGAPETLKEWEEKLSKGKFEESFIKELNEKYFDKLDLFSKKDPFMQERISDEKFIKPISKLIDEFPSGNNSIHFSPLEQKTSRAQEMQISATSAAALLLYANMTPRSGLGGFLSGVINAKTPYFILLKGKNLFESVYLNVIHQSQYSDNIGSKQIGKNDLGWPKKYEGQITLDKINIQNGLLWKSRSILLIPYASEAQVCIITGNRSSINIKKIFYAPQIANLTPKTLWSDPYQGVIQIKNKIKKTSPTGKSMPIWKDYPAFIFFEEEQKEKIKRTPPLVITRILQSKLAKKFDISIFVFGVFTKQDKVFQATENSFPFVPKFVENEDFTKSIKYFIIQTANFEKHIQSALIKSLIKDNEKISRDRKKKITDNIRNSFQSSYWQEIGSNFEQTLQRLSSEDDPNLVQNEWNELLANHVRKTFYKHTEKLIRNPKNLKQYQAGYQFLEKRVQGILLKHKRESK

SEQ ID NO: 5473 - protein, 533 aa, Leptospira santarosai str. CBC379; identical to SEQ ID NO: 5466

SEQ ID NO: 5474 - protein, 533 aa, Leptospira mayottensis 200901122
MNLIKDVWIPTQRFSGKLEEISPFEITSQIENDSDPIVSLNAPRPDFNGALLQFLIGLLQAVFPPENETEWEDLFVNPPSPKVLKEAMEKVESAFELFGDGPRFMQDTNLNEEDTVFDISALFIESPGENTIKLKKDFFIKRDSISQICEKCAGIGLFSFQTNSPSGGQGHLTSIRGGGPLSTFVTSKLKNPKKNSLWSKLWLNVLPKSYFQVNGQKKIPFQSVFPWTNPKIEDLQSKGKTTTTNDLHPLSVYWSYPRRILMRKEAENGICDVCNRSSFVLVRSYHTKTYGLSYSEGGWIHPFSPYYKSKESWLPYHPQPGGILYHYWQTIALGKEQADQAALVVRRFLNRKIPGEQTSILTFGYDMDNMKARCWYESEIPFFNIPSDKIEKFEEQVSQILNASTEIKKNLRQAVRNAWFDKNKDTKGDLAFLDVSFLKDTENSFYDLIRNVKENLISGVADFAALKETWLKLLNKSACKLFDQYADSGSFEFEDPERIVEARKNLKIFNLGSKTRIILGLIVPEKTSKRSKK

SEQ ID NO: 5475 - protein, 533 aa, Leptospira santarosai str. JET
MNLIKDVWIPTLRFSGKSAEISPFEITSQIENDSDPIVSLNSPRPDFNGALLQFLTGLLQVVFPPENEIEWEDLFVNPPSPEILKEAMTKAESAFELFGDGSRFMQDTNLNEEDTIFDISALFIESPGENTIKLKKDFFIKRNSISQICEKCAGIGLFSFQTNSPSGGQGHLTSIRGGGPLTTFVTSKLKNPKKNSLWSILWLNVLPKSYFQVNGHKKIPFQSVFPWTNPKIEDLQSKGKTTTPQDLHPLSVYWSYPRRILLRKETENGVCDVCNRSSSVLVRSYHTRTYGLSYSEGGWIHPFSPYYKSKESWLPYHPQPGGILYHYWQTITLGKDQENQAALVIRRFLNRKIPGEQTSILTFGYDMDNMKARCWYESEIPFFNVPPDTIEKFEEQISQILNASAEVKKNLRQAVRNAWLDKKNDSKGDLTFLDVSFLKVTESPFYDLIRIVKETLISGITDLSTLKETWLNLLNESALKLFDQYADSGNFEFENIERIVNARRNLKTFNLGSKTRTTLGLIIPEKKSKRSKK

SEQ ID NO: 5476 - protein, 518 aa, Salmonella enterica subsp. enterica serovar Typhimurium str. STm1; identical to SEQ ID NO: 5256

SEQ ID NO: 5477 - protein, 518 aa, Salmonella enterica subsp. enterica serovar Typhimurium str. STm8; identical to SEQ ID NO: 5256

SEQ ID NO: 5478 - protein, 518 aa, Salmonella enterica subsp. enterica serovar Typhimurium str. STm9; identical to SEQ ID NO: 5256

SEQ ID NO: 5479 - protein, 518 aa, Salmonella enterica subsp. enterica serovar Typhimurium str. STm3; identical to SEQ ID NO: 5256

SEQ ID NO: 5480 - protein, 518 aa, Salmonella enterica subsp. enterica serovar Typhimurium str. STm4; identical to SEQ ID NO: 5256

SEQ ID NO: 5481 - protein, 518 aa, Salmonella enterica subsp. enterica serovar Typhimurium str. STm6; identical to SEQ ID NO: 5256

SEQ ID NO: 5482 - protein, 518 aa, Salmonella enterica subsp. enterica serovar Typhimurium str. STm10; identical to SEQ ID NO: 5256

SEQ ID NO: 5483 - protein, 518 aa, Salmonella enterica subsp. enterica serovar Typhimurium str. STm11; identical to SEQ ID NO: 5256

SEQ ID NO: 5484 - protein, 518 aa, Salmonella enterica subsp. enterica serovar Typhimurium str. STm12; identical to SEQ ID NO: 5256

SEQ ID NO: 5485 - protein, 518 aa, Salmonella enterica subsp. enterica serovar Typhimurium str. STm5; identical to SEQ ID NO: 5256

SEQ ID NO: 5486 - protein, 520 aa, Escherichia coli 88.1042; identical to SEQ ID NO: 5363

SEQ ID NO: 5487 - protein, 520 aa, Escherichia coli 89.0511; identical to SEQ ID NO: 5363

SEQ ID NO: 5488 - protein, 520 aa, Escherichia coli 88.1467; identical to SEQ ID NO: 5363

SEQ ID NO: 5489 - protein, 520 aa, Escherichia coli 90.0091
MNSFSLLTTPWLPVRFKDGTTGKLAPVDLADENVVDIAAPRADLQGAAWQFLLGLLQSSFAPKDYRRWDDIWEDGLEAEKLREALLSLEPPFQFGPDSPSFMQDFEVLMGDKVQVASLLPEIPGAQTTKFNKDHFIKRGVTEHVCSHCSALALFSLQLNAPSGGKGYRTGLRGGGPMTTLIELQEYQGNQQAPLWRKLWLNVMPQDEADLPLPKKFDDLVFPWLGPTRTSELAGAVVTDDQVNKLQAYWGMPRRIRIDFNTTTVGNCDICGEQSDALLSLMTTKNYGANYAMWQHPLTPYRVPLKEGGEFYSVKPQPGGLIWRDWLGLIETGKSENNTELPALVVKLFNASSLKQAKVGLWGFGYDFDNMKARCWYEHHFPLLLNKKEGQIPKLRLAAQTASRILSLLRSALKEAWFSDPKGARGDFSFVDIDFWNKTQHRFLRLVRQIEEGQDADELLGKWQKEIWLFARQDFDERVFTNPYEPVDLERVMTARKKYFTTSAEKQSAKAAREKKQEAAE

SEQ ID NO: 5490 - protein, 520 aa, Escherichia coli 90.2281; identical to SEQ ID NO: 5363

SEQ ID NO: 5491 - protein, 520 aa, Escherichia coli 90.0039; identical to SEQ ID NO: 5363

SEQ ID NO: 5492 - protein, 520 aa, Escherichia coli 93.0056; identical to SEQ ID NO: 5363

SEQ ID NO: 5493 - protein, 520 aa, Escherichia coli 93.0055; identical to SEQ ID NO: 5363

SEQ ID NO: 5494 - protein, 520 aa, Escherichia coli 94.0618; identical to SEQ ID NO: 5363

SEQ ID NO: 5495 - protein, 520 aa, Escherichia coli 95.0183; identical to SEQ ID NO: 5363

SEQ ID NO: 5496 - protein, 520 aa, Escherichia coli 95.0943; identical to SEQ ID NO: 5363

SEQ ID NO: 5497 - protein, 520 aa, Escherichia coli 95.1288; identical to SEQ ID NO: 5363

SEQ ID NO: 5498 - protein, 520 aa, Escherichia coli 96.0428; identical to SEQ ID NO: 5363

SEQ ID NO: 5499 - protein, 520 aa, Escherichia coli 96.0427; identical to SEQ ID NO: 5363

SEQ ID NO: 5500 - protein, 520 aa, Escherichia coli 96.0939; identical to SEQ ID NO: 5363

SEQ ID NO: 5501 - protein, 520 aa, Escherichia coli 96.0932; identical to SEQ ID NO: 5363

SEQ ID NO: 5502 - protein, 520 aa, Escherichia coli 96.0107; identical to SEQ ID NO: 5363

SEQ ID NO: 5503 - protein, 520 aa, Escherichia coli 97.0003; identical to SEQ ID NO: 5363

SEQ ID NO: 5504 - protein, 520 aa, Escherichia coli 97.1742; identical to SEQ ID NO: 5363

SEQ ID NO: 5505 - protein, 520 aa, Escherichia coli 97.0007; identical to SEQ ID NO: 5363

SEQ ID NO: 5506 - protein, 520 aa, Escherichia coli 99.0672; identical to SEQ ID NO: 5363

SEQ ID NO: 5507 - protein, 520 aa, Escherichia coli 99.0678; identical to SEQ ID NO: 5363

SEQ ID NO: 5508 - protein, 520 aa, Escherichia coli 99.0713; identical to SEQ ID NO: 5363

SEQ ID NO: 5509 - protein, 520 aa, Escherichia coli 96.0109; identical to SEQ ID NO: 5363

SEQ ID NO: 5510 - protein, 520 aa, Escherichia coli 97.0010; identical to SEQ ID NO: 5363

SEQ ID NO: 5511 - protein, 520 aa, Escherichia coli 99.0814; identical to SEQ ID NO: 5363

SEQ ID NO: 5512 - protein, 520 aa, Escherichia coli 09BKT078844; identical to SEQ ID NO: 5363

SEQ ID NO: 5513 - protein, 520 aa, Escherichia coli 99.0815; identical to SEQ ID NO: 5363

SEQ ID NO: 5514 - protein, 520 aa, Escherichia coli 99.0839; identical to SEQ ID NO: 5363

SEQ ID NO: 5515 - protein, 520 aa, Escherichia coli 99.0816; identical to SEQ ID NO: 5363

SEQ ID NO: 5516 - protein, 520 aa, Escherichia coli 99.0848; identical to SEQ ID NO: 5363

SEQ ID NO: 5517 - protein, 520 aa, Escherichia coli 99.1753; identical to SEQ ID NO: 5363

SEQ ID NO: 5518 - protein, 520 aa, Escherichia coli 99.1775; identical to SEQ ID NO: 5363

SEQ ID NO: 5519 - protein, 520 aa, Escherichia coli 99.1793; identical to SEQ ID NO: 5363

SEQ ID NO: 5520 - protein, 520 aa, Escherichia coli PA11; identical to SEQ ID NO: 5363

SEQ ID NO: 5521 - protein, 520 aa, Escherichia coli ATCC 700728; identical to SEQ ID NO: 5363

SEQ ID NO: 5522 - protein, 520 aa, Escherichia coli 99.1805; identical to SEQ ID NO: 5363

SEQ ID NO: 5523 - protein, 520 aa, Escherichia coli PA13; identical to SEQ ID NO: 5363

SEQ ID NO: 5524 - protein, 520 aa, Escherichia coli PA19; identical to SEQ ID NO: 5363

SEQ ID NO: 5525 - protein, 520 aa, Escherichia coli PA2; identical to SEQ ID NO: 5363

SEQ ID NO: 5526 - protein, 520 aa, Escherichia coli PA47; identical to SEQ ID NO: 5363

SEQ ID NO: 5527 - protein, 520 aa, Escherichia coli PA48; identical to SEQ ID NO: 5363

SEQ ID NO: 5528 - protein, 520 aa, Escherichia coli PA8; identical to SEQ ID NO: 5363

SEQ ID NO: 5529 - protein, 520 aa, Escherichia coli 7.1982; identical to SEQ ID NO: 5363

SEQ ID NO: 5530 - protein, 520 aa, Escherichia coli 99.1781; identical to SEQ ID NO: 5363

SEQ ID NO: 5531 - protein, 520 aa, Escherichia coli 99.1762; identical to SEQ ID NO: 5363

SEQ ID NO: 5532 - protein, 520 aa, Escherichia coli PA35; identical to SEQ ID NO: 5363

SEQ ID NO: 5533 - protein, 520 aa, Escherichia coli 3.4880; identical to SEQ ID NO: 5363

SEQ ID NO: 5534 - protein, 520 aa, Escherichia coli 95.0083; identical to SEQ ID NO: 5363

SEQ ID NO: 5535 - protein, 520 aa, Escherichia coli 99.0670; identical to SEQ ID NO: 5363

SEQ ID NO: 5536 - protein, 533 aa, Leptospira weilii serovar Topaz str. LT2116
MNLIKDVWIPAQRFSGKFEEISPFEITSQIENDSDPVVSLNAPRPDFNGALLQFLIGLLQAVFPPENETEWEDLFVNPPSPEILKEAMEKVESAFELFGDGPRFMQDKNLNEEDTIFDISALFIESPGENTIKLKKDFFIKRDSISQICEKCAGIGLFSFQTNSPSGGQGHLTSIRGGGPLTTFVTSKLKDPKKNSLWSKLWLNVLPKSYFQVNGQKKIPFQSVFPWTNPKIEDLQTKGKTTTPQDLHPLSVYWSYPRRILLRKEEENGACDVCNRSSSVLVRSYHTKTYGLSYSEGGWIHPFSPYYKSKESWLPYHPQPGGILYHYWQTIALGKGQEDQAALVVRRSLNRKIPGEQTSILTFGYDMDNMKARCWYESEIPFFNIPSDKIEKFEEQVSQILNTSTEIKKNLRQAVRNAWFDKKNDTKGDLAFLDVSFLKDTESSFYDLIRNVKENLISGETDFAALKEIWLKLLNESACKFFDQYSESGNFEFEDPKRIVEAKKNLKIFNLTSKTRNILGLNTPEKPSKRRKK

SEQ ID NO: 5537 - protein, 533 aa, Leptospira santarosai str. ST188
MNLIKDVWIPTLRFSGKSAEISPFEITSQIENDSDPIVSLNSPRPDFNGALLQFLTGLLQVVFPPENEIEWEDLFVNPPSPEILKEAMTKAESAFELFGDGSRFMQDTNLNEEDTIFDISALFIESPGENTIKLKKDFFIKRNSISRICEKCAGIGLFSFQTNSPSGGQGHLTSIRGGGPLTTFVTSKLKNPKKNSLWSILWLNVLPKSYFQVNGHKKIPFQSVFPWTNPKIEDLQSKGKTTTPQDLHPLSVYWSYPRRILLRKETENGVCDVCNRSSSVLVRSYHTRTYGLSYSEGGWIHPFSPYYKSKESWLPYHPQPGGILYHYWQTITLGKDQENQAALVIRRFLNRKIPGEQTSILTFGYDMDNMKARCWYESEIPFFNIPPDTIEKFEEQISQILNASAEVKKNLRQAVRNAWLDKKNDSKGDLTFLDVSFLKVTESPFYDLIRIVKETLISGITDLSTLKETWLNLLNESALKLFDQYADSGNFEFENIERIVNARRNLKTFNLGSKTRTTLGLIIPEKKSKRSKK

SEQ ID NO: 5538 - protein, 507 aa, Klebsiella pneumoniae JHCK1
MENRFNLIDEPWIAVVDVGLVSLTDIFSQPELRALGGNPVEKIALTKLLLAIAQAAATPTDDSDWQQMGWQGMAHCCLQYLAKWHDRFYLYGEKPFLQMPAIQAAECKSLGVLSPEVSTGNTTVLTESQQQQQLTDADKALAIVMQMGFGLGGKKTDNSVVLTPGYRGKQNDKGKPGSGKAGVSVGHMGLLHSFWQGNSIVQSIWLNLFTAEDITQLAMYPTLGTAPWERMPTGEDDDIARSLKASLLGRLISMGKFCLLAEDGIHYSDGISHAGYLEGKTDPSVSVDFSGKKPKALWVNPGKRPWRELTSLLQFIEQDSPRGYETRQLSLPLKRITHHAEQFALWSGGLRVSSNAGEQYASGTDDYVQSEIWLSSDLINHTFLEYLKYEMTQLDAVQKQLWGAVVRYFRQLSDIDKSATGKAQPFVAKQAEKATTIFWQLCERQAQTLINACLNSGEDHTARLQLRKIFARYAGQVFDQLCPADSARQLDAWALARPNFSQYLTLD

SEQ ID NO: 5539 - protein, 560 aa, Leptospira noguchii str. Bonito
MNLLQDKWITVVRKNGEAEKIAPFEITDKIVTNPILEIITPRPDFKGALYQFLIGLFQTVYAPKDESEWVDRLNDPPKPEILKLETDKVAFAFDLFGKKIRFMQDMSLNTNDTQTNISSLFIDSPGENTLKENKDHFIKRDTIEKVCPICATLGIFTLQTNSPSGGQGHLTSIRGGGPLTTILKFSKHPHHLWDDIWLNIQSQSSIKTQKKEGKKYEFIFPWVINQFSENDERNVLIREQNKKLKDKSKKQELSGRITTIQDLHTYSVFWSYPRRILFPETSQEGICDVCGENSKHITTSYFTKTYGFDYGGGSWIHPLSPYYFKKDKELGDTWFPYHPQPGGILYENWQTIAYGATSTGQNAKVVRAFHELRKVSDEQTLIWAFGYDMDNMKARCWYESLIPIYRIPPHNIEKYESTISTILSAATQVANNLQTKVKDAWFSERQKPKGDTNYLKIIFFKATESKFFTLAKSIRDNLQSETIFDDSEKLNWLKYLNEESLKIFDHYVESGSIEYENIQRIVNARRDLTLWNFGDKIKKVIGLPIRDKKQPKEKTKNETI

SEQ ID NO: 5540 - protein, 533 aa, Leptospira sp. Fiocruz LV4135; identical to SEQ ID NO: 5467

SEQ ID NO: 5541 - protein, 533 aa, Leptospira santarosai str. HAI1349
MNLIKDVWIPTLRFSGKSAEISPFEITSQIENDSDPIVSLNSPRPDFNGALLQFLTGLLQVVFPPENEIEWEDLFVNPPSPEILKEAMTKAESAFELFGDGSRFMQDTNLNEEDTIFDISALFIESPGENTIKLKKDFFIKRNSISQICEKCAGIGLFSFQTNSPSGGQGHLTSIRGGGPLTTFVTSKLKNPKKNSLWSILWLNVLPKSYFQVNGHKKIPFQSVFPWTNPKIEDLQSKGKTTTPQDLHPLSVYWSYPRRILLRKETENGVCDVCNRSSSVLVRSYHTRTYGLSYSEGGWIHPFSPYYKSKESWLPYHPQPGGILYHYWQTITLGKDQENQAALVIRRFLNRKIPGEQTSILTFGYDMDNMKARCWYESEIPFFNVPPDTIEKFEEQISQILNASAEVKKNLRQAVRNAWLDKKNDSKGDLTFLDVSFLKVTESPFYDLIRIVKETLISGITDLSTLKETWLNLLNESALKLFDQYADSGNFEFENIERIVNARKDLKTFNLGSKTRTTLGLIIPEKKSKRSKK

SEQ ID NO: 5542 - protein, 533 aa, Leptospira sp. P2653
MNLIKDVWIPAQRFSGKFEEISPFEITSQIENDSDPVVSLNAPRPDFNGALLQFLIGLLQAVFPPENETEWEDLFVNPPSPEVLKEAMEKVESAFELFGDGPRFMQDKNLNEEDTIFDISALFIESPGENTIKLKKDFFIKRDSISQICEKCAGIGLFSFQTNSPSGGQGHLTSIRGGGPLTTFVTSKLKDPKKNSLWSKLWLNVLPKSYFQVNGQKKIPFQSVFPWTNPKIEDLQTKGKTTTPQDLHPLSVYWSYPRRILLRKEEENGACDVCNRSSSVLVRSYHTKTYGLSYSEGGWIHPFSPYYKSKESWLPYHPQPGGILYHYWQTIALGKGQEDQAALVIRRSLNRKIPGEQTSILTFGYDMDNMKARCWYESEIPFFNIPSDKIEKFEEQVSQILNTSTEIKKNLRQAVRNAWFDKKNDTKGDLAFLDIYFLKDTESSFYDLIRNVKENLISGATDFTALKETWLKLLNESACKLFDQYADSGNFEFEAPKRIVEAKKNLKIFNLGSKTRNILGLTTPEKPSKRRKK

SEQ ID NO: 5543 - protein, 533 aa, Leptospira borgpetersenii serovar Hardjo-bovis str. Sponselee
MNLIKDVWIPVQRFSEKLEEISPFEITSRIENDSDPVMSLSAPRPDFNGALLQFLVGLLQAVFSPENETEWEDLFVNPPSPEVLKEAMEKVKSAFELFGDGPRFMQDTNLNEEDTVFDISALFIESPGENTIKLKKDFFIKRNSISQICEKCAGIGLFSFQTNSPSGGQGHLTSIRGGGPLTTFVTSKLKNPKKNSLWSKLWLNVLPKSYFQVNGQKKIPFQSVFPWTNPKIEDLQSKGKTTTPQDLHPLSVYWSYPRRILLRKDVENGICDVCNRSSSVLVRSYHTKTYGLSYSEGGWIHPLSPYYKSKESWFPYHPQPGGILYHYWQTIALGKEQEDQAALVIRRFLNRKIPGEQTSILTFGYDMDNMKARCWYESEIPFFNIPSDKIEKFEEQVSQILNASTEVKKNLRQAVRNAWLDKKNDSKGDLTFLDVSFLKDTENSFYDLIRNVQENLISDVADFAALKETWLKLLNESACKLFDQYADSGSFEFENIERIVKARKNLKISNLGSKTRIILGLIVSEKTSKRNKK

SEQ ID NO: 5544 - protein, 533 aa, Leptospira sp. serovar Kenya str. Sh9
MNLIKDVWIPVQRFSEKLEEISPFEITSRIENDSDPIMSLNAPRPDFNGALLQFLVGLLQAVFPPENETEWEDLFVNPPSPEVLKEAMEKVKSAFELFGDGPRFMQDTNLNEEDTVFDISALFIESPGENTIKLKKDFFIKRNSISQICEKCAGIGLFSFQTNSPSGGQGHLTSIRGGGPLTTFVTSKLKNPKKNSLWSKLWLNVLPKSYFQVNGQKKIPFQSVFPWTNPKIEDLQSKGKTTTPKDLHPLSVYWSYPRRILLRKDVENGICDVCNRSSSVLVRSYHTKTYGLSYSEGGWIHPLSPYYKSKESWFPYHPQPGGILYHYWQTIALGKEQEDQAALVIRRFLNRKIPGEQTSILTFGYDMDNMKARCWYESEIPFFNIPSDKIEKFEEQVSQILNASTEVKKNLRQAVRNAWLDKKNDSKGDLTFLDVSFLKDTENSFYDLIRNVQENLISGVADFAALKETWLKLLNESACKLFDQYAESDFSELEDYERIVKAKENLKISNLGSKTRIILGLIVSEKTSKRNKK

SEQ ID NO: 5545 - protein, 534 aa, Leptospira kirschneri serovar Bulgarica str. Nikolaevo
MPQKKTQPKEEVKKSDQADFSFNLLTEPWLPVVISSNKEKQFLSLNEFLENAHTLERFDFSLPGLETAVIRFLVALVHIVGAPETLKEWEEKLLKGKFEKGFIKELNEKYFDKLDLFSKKDPFMQEATLRKSQEEADGIDRLINFFPYATNQVHWNHKFAESSFNLTSISPASAVSLLLFSHATMMAGGSGYKPGINGVPPLMILLKGKNLYNSILLNVLNGNFVNSLFDQKNLGKNATEFPVFKKGEISAEKINLQMGLLWKSRDLLLIPEESKDFICSLSGRNSKTLIRKVIFNPQSNFIKKESYWHDPAIIKVDLGNKGVKKLTVQNRDIPSWREYPSLINTQGRDGNKRKFFPPLVIQQLSTIQPSKKRPQGNILTLSLATDNKAKIFEISENEYFFHPSFIDNEDFIKIIEGFVSNIEQFQWKLQTALKISYKIKPGSSMNPPSFEASYWREIGSNFEESLRKLSNKEDINLIINDWNELLASHVRKTFYKHTEKLILNPKNLKQYQAGNKFLEKQIQTILLKHKRKSE

SEQ ID NO: 5546 - protein, 533 aa, Leptospira weilii str. 2006001855
MNLIKDVWIPAQRFSGKFEEISPFEITSQIENDSDPVVSLNAPRPDFNGALLQFLIGLLQAVFPPENETEWEDLFVNPPSPEILKEAMEKVESAFELFGDGPRFMQDKNLNEEDTIFDISALFIESPGENTIKLKKDFFIKRDSISQICEKCAGIGLFSFQTNSPSGGQGHLTSIRGGGPLTTFVTSKLKDPKKNSLWSKLWLNVLPKSYFQVNGQKKIPFQSVFPWTNPKIEDLQTKGKTTTPQDLHPLSVYWSYPRRILLRKEEENGACDVCNRSSSVLVRSYHTKTYGLSYSEGGWIHPFSPYYKSKESWLPYHPQPGGILYHYWQTIALGKGQEDQAALVVRRSLNRKIPGEQTSILTFGYDMDNMKARCWYESEIPFFNIPSDKIEKFEEQVSQILNTSTEIKKNLRQAVRNAWFDKKNDTKGDLAFLDIYFLKDTESSFYDLIRNVKENLISGATDFTALKETWLKLLNESACKLFDQYADSGNFEFEAPKRIVEAKKNLKIFNLGSKTRNILGLTTPEKPSKRRKK

SEQ ID NO: 5547 - protein, 533 aa, Leptospira santarosai str. 2000030832
MNLIKDVWIPTLRFSGKSAEISPFEITSQIENDSDPIVSLNSPRPDFNGALLQFLTGLLQVVFPPENEIEWEDLFVNPPSPEILKEAMTKAESAFELFGDGSRFMQDTNLNEEDTIFDISALFIESPGENTIKLKKDFFIKRNSISQICEKCAGIGLFSFQTNSPSGGQGHLTSIRGGGPLTTFVTSKLKNPKKNSLWSILWLNVLPKSYFQVNGHKKIPFQSVFPWTNPKIEDLQSKGKTTTPQDLHPLSVYWSYPRRILLRKETENGVCDVCNRSSSVLVRSYHTRTYGLSYSEGGWIHPFSPYYKSKESWLPYHPQPGGILYHYWQTITLGKDQENQAALVIRRFLNRKIPGEQTSILTFGYDMDNMKARCWYESEIPFFNVPPDTIEKFEEQISQILNASAEVKKNLRQAVRNAWLDKKNDSKGDLTFLDVSFLKVTESPFYDLIRIVKETLISGITDLSTLKEAWLNLLNESALKLFDQYADSGNFEFENIERIVNARRNLKTFNLGSKTRTTLGLIIPEKKSKRSKK

SEQ ID NO: 5548 - protein, 533 aa, Leptospira santarosai str. 2000027870
MNLIKDVWIPTLRFSGKSAEISPFEITSQIENDSDPIVSLNSPRPDFNGALLQFLTGLLQVVFPPENEIEWEDLFVNPPSPEILKEAMTKAESAFELFGDGPRFMQDTNLNEEDTIFDISALFIESPGENTIKLKKDFFIKRNSISQICEKCAGIGLFSFQTNSPSGGQGHLTSIRGGGPLTTFVTSKLKNPKKNSLWSILWLNVLPKSYFQVNGHKKIPFQSVFPWTNPKIEDLQSKGKTTTPQDLHPLSVYWSYPRRILLRKETENGVCDVCNRSSSVLVRSYHTRTYGLSYSEGGWIHPFSPYYKSKESWLPYHPQPGGILYHYWQTITLGKDQENQAALVIRRFLNRKIPGEQTSILTFGYDMDNMKARCWYESEIPFFNVPPDTIEKFEEQISQILNASAEVKKNLRQAVRNAWLDKKNDSKGDLTFLDVSFLKVTESPFYDLIRIVKETLISGITDLSTLKETWLNLLNESALKLFDQYADSGNFEFENIERIVNAGKNLKTFNLGSKTRTTLGLIIPEKKSKRSKK

SEQ ID NO: 5549 - protein, 557 aa, Leptospira noguchii str. 2007001578
MNLLQDKWITVVRKNGEAEKIAPFEITDKIVTNPILEIITPRPDFKGALYQFLIGLFQTVYAPKDESEWEDRLNRPPKPEILKLETDKVAFAFDLFGKKIRFMQDMSLNTNDTQTNISSLFIDSPGENTLKENKDHFIKRNTIEKVCPICAAFGIFTLQTNSPSGGQGHLTSIRGGGPLTTILKFSKHPHHLWDDIWLNIQSQSSIKTQKKEGKKYEFIFPWVINQFSENDERNVLIREQNKKLKDKSKKQELSGRVATIQDLHTYSVFWSYPRRILFPEIFQEGICDVCGENSKYIITSYFTKTYGFDYGGGGWIHPLSPYYFKKDKDLGDTWFPYHPQPGGILYENWQSIAYGATSTNQNAKVVRAFNELRKVSDEQTLIWAFGYDMDNMKARCWYESLIPIYRIPPHNIEKYESTISTILSAATQVANNLQTKVKDAWFNERQKPKGDTNYLKIIFFKATESKFFSLAKSIRDNLQSETIFDDSEKLNWLKYLNEESLKVFDQYVESGSIEYENIQRIVNARRDLTLWNFGDKIKKAIGLPIRDKKQPKEKTKK

SEQ ID NO: 5550 - protein, 533 aa, Leptospira santarosai serovar Arenal str. MAVJ 401; identical to SEQ ID NO: 5466

SEQ ID NO: 5551 - protein, 533 aa, Leptospira weilii str. LNT 1234
MNLIKDVWIPAQRFSGKFEEISPFEITSQIENDSDPVVSLNAPRPDFNGALLQFLIGLLQAVFPPENETEWEDLFVNPPSPEILKEAMEKVESAFELFGDGPRFMQDKNLNEEDTIFDISALFIESPGENTIKLKKDFFIKRDSISQICEKCAGIGLFSFQTNSPSGGQGHLTSIRGGGPLTTFVTSKLKDPKKNSLWSKLWLNVLPKSYFQVNGQKKIPFQSVFPWTNPKIEDLQTKGKTTTPQDLHPLSVYWSYPRRILLRKEEENGACDVCNRSSSVLVRSYHTKTYGLSYSEGGWIHPFSPYYKSKESWLPYHPQPGGILYHYWQTIALGKGQEDQAALVVRRSLNRKIPGEQTSILTFGYDMDNMKARCWYESEIPFFNIPSDKIEKFEEQVSQILNTSTEIKKNLRQAVRNAWFDKKNDTKGDLAFLDVSFLKDTESSFYDLIRNVKENLISGATDFAALKKTWLKLLNESACKLFDQYAESGNFEFEDDERIVEAKKNLKIFNLGSKTRNILGLTTPEKPSKRRKK

SEQ ID NO: 5552 - protein, 533 aa, Leptospira borgpetersenii serovar Javanica str. MK146; identical to SEQ ID NO: 5469

SEQ ID NO: 5553 - protein, 533 aa, Leptospira weilii str. UI 13098
MNLIKDVWIPAQRFSGKFEEISPFEITSQIENDSDPVVSLNAPRPDFNGALLQFLIGLLQAVFPPENETEWEDLFVNPPSPEILKEAMEKVESAFELFGDGPRFMQDKNLNEEDTIFDISALFIESPGENTIKLKKDFFIKRDSISQICEKCAGIGLFSFQTNSPSGGQGHLTSIRGGGPLTTFVTSKLKDPKKNSLWSKLWLNVLPKSYFQVNGQKKIPFQSVFPWTNPKIEDLQTKGKTTTPQDLHPLSVYWSYPRRILLRKEEENGACDVCNRSSSVLVRSYHTKTYGLSYSEGGWIHPFSPYYKSKESWLPYHPQPGGILYHYWQTIALGKGQEDQAALVIRRSLNRKIPGEQTSILTFGYDMDNMKARCWYESEIPFFNIPSDKIEKFEEQVSQILNTSTEIKKNLRQAVRNAWFDKKNDTKGDLAFLDVSFLKDTESSFYDLIRNVKENLISGATDFAALKKTWLKLLNESACKLFDQYAESGNFEFEDDERIVEAKKNLKIFNLGSKTRNILGLTTPEKPSKRRKK

SEQ ID NO: 5554 - protein, 533 aa, Leptospira santarosai str. CBC523; identical to SEQ ID NO: 5466

SEQ ID NO: 5555 - protein, 533 aa, Leptospira santarosai str. HAI134; identical to SEQ ID NO: 5466

SEQ ID NO: 5556 - protein, 533 aa, Leptospira santarosai str. HAI821
MNLIKDVWIPTLRFSGKSAEISPFEITSQIQNDSDPIVSLNSPRPDFNGALLQFLTGLLQVVFPPENEIEWEDLFVNPPSPEILKEAMTKAESAFELFGDGSRFMQDTNLNEEDTIFDISALFIESPGENTIKLKKDFFIKRNSISQICEKCAGIGLFSFQTNSPSGGQGHLTSIRGGGPLTTFVTSKLKNPKKNSLWSILWLNVLPKSYFQVNGHKKIPFQSVFPWTNPKIEDLQSKGKTTTPQDLHPLSVYWSYPRRILLRKETENGVCDVCNRSSSVLIRSYHTRTYGLSYSEGGWIHPFSPYYKSKESWLPYHPQPGGILYHYWQTITLGKDQENQAALVIRRFLNRKIPGEQTSILTFGYDMDNMKARCWYESEIPFFNVPPDTIEKFEEQISQILNASAEVKKNLRQAVRNAWLDKKNDSKGDLTFLDVSFLKVTESPFYDLIRIVKETLISGITDLSTLKETWLNLLNESALKLFDQYADSGNFEFENIERIVNARKDLRTKDLGSKTRTTLGLIIPEKKSKRSKK

SEQ ID NO: 5557 - protein, 556 aa, Leptospira noguchii serovar Autumnalis str. ZUN142
MVAKKKIQKKATPPKSKISPKENMPDFSFNLLTEPWIPVIHETNKKQLLNLNDFLRTAHKLERFDFPLPGLETAVIRFLVALVHIVGAPETLKEWEEKLSKGKFEESFIKELNEKYFDKLDLFSKKDPFMQDLNLHSTKTKSASQLIFSVSTTSVNTHWSHFLEENQINLSPAISIPIILLSFTMAMSGGRGYFPGINREPPILVFLKGSNTFESIYLNVINNKLNLSIHENHKLIGKPETGFTIITPKEYPPKSINIQTGLLWKSRSILLIPEKNEQNLVCDITGIKGVTIIKRIHFEPPTARIKQVAKNQAKPFDPKKNRTNAFWSDPMTIRVEEDGMEAQPLRIQSNELPTLPSWHEYPSALYITGNLKEKSKKFAPPIIHQLNNLTERKRPKCRISIACVSFEPGQAKIYEYFENEYYFDPKFLSQQDKITAIESFINKTSSFEKYIQDALQKAFKIPKKSNNKPPSFQSSYWFELGSNFEKSLQRLSSEDDPNLVQNEWNELLANHVRKTFYKHTEKLIRNPKNLKQYQAGYQFLEKRVQGILLKHKRESK

SEQ ID NO: 5558 - protein, 533 aa, Leptospira santarosai str. ZUN179
MNLIKDVWIPTLRFSGKSAEISPFEITSQIENDSDPIVSLNSPRPDFNGALLQFLTGLLQVVFPPENEIEWEDLFVNPPSPEILKEAMTKAESAFELFGDGSRFMQDTNLNEEDTIFDISALFIESPGENTIKLKKDFFIKRNSISQICEKCAGIGLFSFQTNSPSGGQGHLTSIRGGGPLTTFVTSKLKNPKKNSLWSILWLNVLPKSYFQVNGHKKIPFQSVFPWTNPKIEDLQSKGKTTTPQDLHPLSVYWSYPRRILLRKETENGVCDVCNRSSSVLIRSYHTRTYGLSYSEGGWIHPFSPYYKSKESWLPYHPQPGGILYHYWQTITLGKDQENQAALVIRRFLNRKIPGEQTSILTFGYDMDNMKARCWYESEIPFFNVPPDTIEKFEEQISQILNASAEVKKNLRQAVRNAWLDKKNDSKGDLTFLDVSFLKVTESPFYDLIRIVKETLISGITDLSTLKETWLNLLNESALKLFDQYADSGNFEFENIERIVNARRNLKTFNLGSKTRTTLGLIIPEKKSKRSKK

SEQ ID NO: 5559 - protein, 533 aa, Leptospira mayottensis 200901116; identical to SEQ ID NO: 5474

SEQ ID NO: 5560 - protein, 533 aa, Leptospira santarosai str. CBC1416
MNLIKDVWIPTLRFSGKSAEISPFEITSQIENDSDPIVSLNSPRPDFNGALLQFLTGLLQVVFPPENEIEWEDLFVNPPSPEILKEAMTRAESAFELFGDGPRFMQDTNLNEEDTIFDISALFIESPGENTIKLKKDFFIKRNSISQICEKCAGIGLFSFQTNSPSGGQGHLTSIRGGGPLTTFVTSKLKNPKKNSLWSILWLNVLPKSYFQVNGHKKIPFQSVFPWTNPKIEDLQSKGKTTTPQDLHPLSVYWSYPRRILLRKETENGVCDVCNRSSSVLVRSYHTRTYGLSYSEGGWIHPFSPYYKSKESWLPYHPQPGGILYHYWQTITLGKDQENQAALVIRRFLNRKIPGEQTSILTFGYDMDNMKARCWYESEIPFFNVPPDTIEKFEEQISQILNASAEVKKNLRQAVRNAWLDKKNDSKGDLTFLDVSFLKVTESPFYDLIRIVKETLISGITDLSTLKETWLNLLNESALKLFDQYADSGNFEFENIERIVNARKDLRTKDLGSKTRTTLGLIIPEKKSKRSKK

SEQ ID NO: 5561 - protein, 533 aa, Leptospira santarosai str. 200403458; identical to SEQ ID NO: 5537

SEQ ID NO: 5562 - protein, 533 aa, Leptospira santarosai str. AIM
MNLIKDVWIPTLRFSGKSAEISPFEITSQIENDSDPIVSLNSPRPDFNGALLQFLTGLLQVVFPPENEIEWEDLFVNPPSPEILKEAMTKAESAFELFGDGSRFMQDTNLNEEDTIFDISALFIESPGENTIKLKKDFFIKRNSISQICEKCAGIGLFSFQTNSPSGGQGHLTSIRGGGPLTTFVTSKLKNPKKNSLWSILWLNVLPKSYFQVNGHKKILFQSVFPWTNPKIEDLQSKGKTTTPQDLHPLSVYWSYPRRILLRKETENGVCDVCNRSSSVLVRSYHTRTYGLSYSEGGWIHPFSPYYKSKESWLPYHPQPGGILYHYWQTITLGKDQENQAALVIRRFLNRKIPGEQTSILTFGYDMDNMKARCWYESEIPFFNVPPDTIKKFEEQISQILNASAEVKKNLRQAVRNAWLDKKNDSKGDLTFLDVSFLKVTESPFYDLIRIVKETLISGITDLSTLKETWLNLLNESALKLFDQYADSGNFEFENIERIVNARRNLKTFNLGSKTRTTLGLIIPEKKSKRSKK

SEQ ID NO: 5563 - protein, 452 aa, Leptospira noguchii str. 2001034031
MSLNTNDTQTNISSLFIDSPGENTLKENKDHFIKRNTIEKVCPICAAFGIFTLQTNSPSGGQGHLTSIRGGGPLTTILKFSKHPHHLWDDIWLNIQSQSSIKTQKKEGKKYEFIFPWVINQFSENDERNVLIREQNKKLKDKSKKQELSGRVATIQDLHTYSVFWSYPRRILFPEIFQEGICDVCGENSKYIITSYFTKTYGFDYGGGGWIHPLSPYYFKKDKDLGDTWFPYHPQPGGILYENWQSIAYGATSTNQNAKVVRAFNELRKVSDEQTLIWAFGYDMDNMKARCWYESLIPIYRIPPHNIEKYESTISTILSAATQVANNLQTKVKDAWFNERQKPKGDTNYLKIIFFKATESKFFSLAKSIRDNLQSETIFDDSEKLNWLKYLNEESLKVFDQYVESGSIEYENIQRIVNARRDLTLWNFGDKIKKAIGLPIRDKKQPKEKTKK

SEQ ID NO: 5564 - protein, 533 aa, Leptospira santarosai str. 200702252; identical to SEQ ID NO: 5537

SEQ ID NO: 5565 - protein, 545 aa, Leptospira santarosai str. HAI1380
MNLIKDVWIPTLRFSGKSAEISPFEITSQIENDSDPIVSLNSPRPDFNGALLQFLTGLLQVVFPPENEIEWEDLFVNPPSPEILKEAMTKAESAFELFGDGSRFMQDTNLNEEDTIFDISALFIESPGENTIKLKKDFFIKRNSISQICEKCAGIGLFSFQTNSPSGGQGHLTSIRGGGPLTTFVTSKLKNPKKNSLWSILWLNVLPKSYFQVNGHKKIPFQSVFPWTNPKIEDLQSKGKTTTPQDLHPLSVYWSYPRRILLRKETENGVCDVCNRSSSVLVRSYHTRTYGLSYSEGGWIHPFSPYYKSKESWLPYHPQPGGILYHYWQTITLGKDQENQAALVIRRFLNRKIPGEQTSILTFGYDMDNMKARCWYESEIPFFNVPPDTIEKFEEQISQILNASAEVKKNLRQAVRNAWLDKKNDSKGDLTFLDVSFLKVTESPFYDLIRIVKETLISGITDLSTLKETWLNLLNESALKLFDQYADSGNFEFENIERIVNARKDLRTKDLGSKTRTTLGLIIPEKKSKRSKNKDDEIPRKQRQI

SEQ ID NO: 5566 - protein, 560 aa, Streptococcus ratti FA-1 = DSM 20564
MGKFNLLNEPWVSVVYDDRGATKEVSLLDLFQNAHNYKDLAGDTKTQDFAVLRVLLAVLHTVFSRFDANGQVYEYLEVDERFRQLEAVDEADLIDYEDDLYDTWVNLWNRGQFPEIVSHYLEKWRDRFYLFDEDYPFFQVRKEDISEEKINKAKAGSVSGKFINRTISESGNKVSLFAPRSSQKKELLGFGEIARWLLAFQGYTGTGDKTKFNNLDNEVKLSKGWLFDIGAIFVKGENLYETLLLNCILPYSQRDNLEHIQRPCWELASKELLEEYLSGKAINNLSSLYTSWSRSVYINPEIGLETPFSVQIVKLPEVPHQDNFLEPFTLWKYNLSGESKGSHTPNKHSVNQSLWRSFALLTTTVDNQRKPGIIDWLDVLKEEIGEQQIILNAVSMQDDGNATSWLPTDEIIDTLSINEFVLTDLHEKGWVTRINDVVEETKTVVSRTYRKFITDIREIRNIKSDAFTSQKVEECYFKIDQPFRQWLSSIQYEDEKDQKVFEWRGELKRLVLEEAKTLLHEGGPRDYIGIVDKDKGTVKNIATAYDHFTYWLNQNVKEGK

SEQ ID NO: 5567 - protein, 533 aa, Leptospira santarosai str. CBC1531; identical to SEQ ID NO: 5466

SEQ ID NO: 5568 - protein, 507 aa, Vibrio cholerae O1 str. 95412
MENCFNLIDEPWIPVTNAGLVSLREIFLNNALRSLGGNPVQKIALTKLLLAIAQSAATPEDDEDWRRMGYLGMADKCLSYLDQWHNRFYLYGNMPFLQMPAIQSAEVKSFGVLSPEVSTGNTTVLTESQQEQAHSDADKALLLVVQMAFGLSGKKTDNSVVLSPGYQGKYNDKGKAASGKAGSAVGHMGLLHSFWLAESVVESLWLNLLTQEDIGDLPMYSILGTAPWELMPSGEADSVAEALKTSLMGRLVPLGKFCLLTDNGIHYSDGIAHPSYLEGKADPSASVDFSQKKLKALWVNPDKRPWRELTALLQFIESGKSIGYETPQLARTIRRVKYGVESFAIWSGGLRVSSNAGEQYASGTDDYVQSEFWLLSSELGDSFLAQLKQEMSELSALQKTLWGAVVRYFRQLSDIDKSSAGKAQPFVANQAERATHLFWQLCERQAQALLDACNDDIDAKIERQRLRKIFAGYALRVFDQVCPNDSTRQLDAWAQFRPNYHQYLNVE

SEQ ID NO: 5569 - protein, 518 aa, Salmonella enterica subsp. enterica serovar Dublin str. UC16; identical to SEQ ID NO: 5260

SEQ ID NO: 5570 - protein, 556 aa, Leptospira noguchii str. Hook
MVAKKKIQKKATPPKSKISPKENMPDFSFNLLTEPWIPVVHKTSKKQLLNLNDFLRTAHKLERFDFPLPGLETAVIRFLVALVHIVGAPETLKEWEEKLSKGKFEESFIKELNEKYFDKLDLFSKKDPFMQDLNLHSTKTKSASQLIFSVSTTSGNTHWSHFLEENQINLSPAISIPIILLSFTMAMSGGRGYFPGINRDPPILVSLKGSNTFESIYLNVINNKLNLSIHENHKFIGKPETGFTKITPKEYPPKSINIQTGLLWKSRSILLIPEKNEQKLACDITGINAVTIIKRIHFEPPTARIKQVAKNQAKPFDPKKNRTNAFWSDPMTIRVEEDGMEAQPLRIQSNELPTLPSWHEYPSALYITGNLKEKSKKFAPPIIHQLNNLTERKRPKCRISIACVSFEPGQAKIYEYFENEYYFDPKFLSQQDKITAIESFINKTSSFEKYIQDALQKAFKIPKKSNNKPPSFQSSYWFELGSNFEKSLQRLSSEDDPNLVQNEWNELLANHVRKTFYKHTEKLIRNPKNLKQYQAGYQFLEKRVQGILLKHKRESK

SEQ ID NO: 5571 - protein, 540 aa, Leptospira noguchii str. Cascata
MVAKKKIQKKATPPESKISPKENAPDFSFNLLTEPWIPVVHKTSKKQLLNLNDFLQTAHKLERFDFPLPGLETAVIRFLVALVHIVGAPETLKEWEEKLSKGKFEESFIKELNEKYFDKLDLFSKKNPFMQDESLIKSNKDPDGVDRLISFFPYATNQIHWNHKFFDGNFNLTAISPASAVSLLLFSNSTMMAGGSGYKPGINGVPPLLVLFKGKTLFNSIFLNVLNGNFVNAVHDQKFLAKNTPGFPNSKKGELTSDKINLQTGLLWQSRSLLLIPELSDEFDCSLLGSKSVISIRKVHFNPQSVSLKKDSFWHDPSIIKIDLGTKGLKKFTVQNRDLPSWKEYPSILNTQGRTEKKKTFFPPLVIQQISSIQPAKKRPQGNILTLSLATDNKAKIFEISEREYFFNTSFIDNPELILKIETFVSNVDQFQWNLQTALKIAYKIRPNTNSKPPIFQSSYWQEIGSNFEQTLQRLSSEDDPNLVQNEWNELLANHVRKTFYKHTEKLIQNPKNLKQYQAGYQFLEKRVQGILLKHKRESK

SEQ ID NO: 5572 - protein, 520 aa, Escherichia coli MP021017.9
MNSFSLLTTPWLPVRFKDGTTGKLAPVDLADENVVDIAAPRADLQGAVWQFLLGLLQTSFAPKDHRRWDDIWEDGLEAEKLREALLSLEHAFQFGPDSPSFMQDFEALTGDKVPVASLLPEIPGAQTTKFNKDHFIKRGVTEYLCPQCSALALFSLQLNAPSGGKGYRTGLRGGGPMTTLIELQEYQGNQQTPLWRKMWLNVMPQDEADLPLPKKFDDLVFPWLGPTRTSELAGAVVTDDQVNKLQAYWGMPRRIRIDFNTTTVGNCDICGEQSDALLSLMTTKNYGANYAMWQHPLTPYRVPLKEGGEFYSVKPQPGGLIWRDWLGLIETGKSENNTELPALVVKLFNASSLKQAKVGLWGFGYDFDNMKARCWYEHHFPLLLDKKEGQIPKLRLAAQTASRILSLLRRALKEAWFSDPKGARGDFSFVDIDFWNKTQHRFLRLVRQIEEGQDADELLSKWNKEIWLFARQDFDERVFTNPYEPVDLERVMTARKKYFTTSAEKQSAKAAREKKQEAAE

SEQ ID NO: 5573 - protein, 520 aa, Escherichia coli MP021017.6
MNSFSLLTTPWLPVRFKDGTTGKLAPVDLADENVVDIAAPRADLQGAVWQFLLGLLQTSFAPKDHRRWDDIWEDGLEAEKLREALLSLEHAFQFGPDSPSFMQDFEALTGDKVPVASLLPEIPGAQTTKFNKDHFIKRGVTEYLCPQCSALALFSLQLNAPSGGKGYRTGLRGGGPMTTLIELQEYQGNQQTPLWRKMWLNVMPQDEADLPLPKKFDDLVFPWLGPTRTSELAGAVVTDDQVNKLQAYWGMPRRIRIDFNTTTVGNCDICGEQSDALLSLMTTKNYGANYAMWQHPLTPYRVPLKEGGEFYSVKPQPGGLIWRDWLGLIETGKSENNTELPALVVKLFNASSLKQAKVGLWGFGYDFDNMKARCWYEHHFPLLLDKKEGQIPKLRLAAQTASRILSLLRSALKEAWFSDPKGARGDFSFVDIDFWNKTQHRFLRLVRQIEEGQDADELLSKWNKEIWLFARQDFDERVFTNPYEPVDLERVMTARKKYFTTSAEKQSAKAAREKKQEAAE

SEQ ID NO: 5574 - protein, 520 aa, Escherichia coli MP021017.5; identical to SEQ ID NO: 5573

SEQ ID NO: 5575 - protein, 520 aa, Escherichia coli MP021017.4; identical to SEQ ID NO: 5573

SEQ ID NO: 5576 - protein, 520 aa, Escherichia coli MP021017.3
MNSFSLLTTPWLPVRFKDGTTGKLAPVDLADENVVDIAAPRADLQGAVWQFLLGLLQTSFAPKDHRRWDDIWEDGLEAEKLREALLSLEHAFQFGPDSPSFMQDFEALTGDKVPVASLLPEIPGAQTTKFNKDHFIKRGVTEYLCPQCSALALFSLQLNAPSGGKGYRTGLRGGGPMTTLIELQEYQGNQQTPLWRKMWLNVMPQDEADLPLPKKFDDLVFPWLGPTRTSELAGAVVTDDQVNKLQADWGMPRRIRIDFNTTTVGNCDICGEQSDALLSLMTTKNYGANYAMWQHPLTPYRVPLKEGGEFYSVKPQPGGLIWRDWLGLIETGKSENNTELPALVVKLFNASSLKQAKVGLWGFGYDFDNMKARCWYEHHFPLLLDKKEGQIPKLRLAAQTASRILSLLRSALKEAWFSDPKGARGDFSFVDIDFWNKTQHRFLRLVRQIEEGQDADELLSKWNKEIWLFARQDFDERVFTNPYEPVDLERVMTARKKYFTTSAEKQSAKAAREKKQEAAE

SEQ ID NO: 5577 - protein, 520 aa, Escherichia coli MP021017.2; identical to SEQ ID NO: 5573

SEQ ID NO: 5578 - protein, 520 aa, Escherichia coli MP021017.10; identical to SEQ ID NO: 5573

SEQ ID NO: 5579 - protein, 520 aa, Escherichia coli MP021017.11
MNSFSLLTTPWLPVRFKDGTTGKLAPVDLADENVVDIAAPRADLQGAVWQFLLGLLQTSFAPKDHRRWDDIWEDGLEAEKLREALLSLEHAFQFGPDSPSFMQDFEALTGDKVPVASLLPEIPGAQTTKFNKDHFIKRGVTEYLCPQCSALALFSLQLNAPSGGKGYRTGLRGGGPMTTLIELQEYQGNQQTPLWRKMWLNVMPQDEADLPLPKKFDDLVFPWLGPTRTSELAGAGVTDDQVNKLQAYWGMPRRIRIDFNTTTVGNCDICGEQSDALLSLMTTKNYGANYAMWQHPLTPYRVPLKEGGEFYSVKPQPGGLIWRDWLGLIETGKSENNTELPALVVKLFNASSLKQAKVGLWGFGYDFDNMKARCWYEHHFPLLLDKKEGQIPKLRLAAQTASRILSLLRSALKEAWFSDPKGARGDFSFVDIDFWNKTQHRFLRLVRQIEEGQDADELLSKWNKEIWLFARQDFDERVFTNPYEPVDLERVMTARKKYFTTSAEKQSAKAAREKKQEAAE

SEQ ID NO: 5580 - protein, 520 aa, Escherichia coli BCE034_MS-14; identical to SEQ ID NO: 5261

SEQ ID NO: 5581 - protein, 520 aa, Escherichia coli MP021017.12; identical to SEQ ID NO: 5573

SEQ ID NO: 5582 - protein, 520 aa, Escherichia coli BCE002_MS12; identical to SEQ ID NO: 5296

SEQ ID NO: 5583 - protein, 520 aa, Escherichia coli 2875000; identical to SEQ ID NO: 5261

SEQ ID NO: 5584 - protein, 244 aa, Escherichia coli BCE019_MS-13
MKPFWVKPVKPNESVPASSIGFVRGLFWQPAHIELCDPIGIGKCSCCGQESNLRYTGFLKEKFTFTVNGLWPHPHSPCLVTVKKGVVEEKFLAFTTSAPSWTQISRVVVDKIIQNENGNRVAAVVNQFRNIAPQSPLELIMGGYRNNQASILERRHDVLMFNQGWQQYGNVINEIVTVGLGYKTALRKALYTFAEGFKNKDFKGAGVSVHETAERHFYRQSELLIPDVLANVNFSQADEVIADL

SEQ ID NO: 5585 - protein, 520 aa, Escherichia coli 2872800; identical to SEQ ID NO: 5261

SEQ ID NO: 5586 - protein, 408 aa, Escherichia coli 2872000
MELAALALLVCIGQIIDPAKDDVEFRHRIMNPLTEDEFQQLIAPWIDMFYLNHAEHPFMQTKGVKANDVTPMEKLLAGVSGATNCAFVNQPGQGEALCGGCTAIALFNQANQAPGFGGGFKSGLRGGTPITTFVRGIDLRSTVLLNVLTIPRLQKQFPNESHTENQPTWVKPVKPNESVPASSIGFVRGLFWQPAHIELCDPIGIGKCSCCGQESNLRYTGFLKEKFTFTVNGLWPHPHSPCLVTVKKGEVEEKFLAFTTSAPSWTQISRVVVDKIIQNENGNRVAAVVNQFRNIAPQSPLELIMGGYRNNQASILERRHDVLMFNQGWQQYGNVINEIVTVGLGYKTALRKALYTFAEGFKNKDFKGAGVSVHETAERHFYRQSELLIPDVLANVNFSQADEVIADL

SEQ ID NO: 5587 - protein, 408 aa, Escherichia coli 2871950; identical to SEQ ID NO: 5586

SEQ ID NO: 5588 - protein, 520 aa, Escherichia coli 2867750
MNSFSLLTTPWLPVRFKDGTTGKLAPVDLADENVVDIAAPRADLQGAAWQFLLGLLQTSFAPKNHGRWDDIWQDGLEAEKLREALLSLEHAFQFGADSPSFMQDFEALKGDKVQVASLLPEIPGAQTTKFNKDHFIKRGVTEHVCPHCSALALFSLQLNAPSGGKGYRTGLRGGGPMTTLIELQEYQGNQQTPLWRKLWPNVMPQDEADLPLPKKFDDLVFPWLGPTRTSELAGAGVTHDQVNKLQAYWGMPRRIRIDFNTTTVGNCDICGEQSDALLSLMTTKNYGANYAMWQHPLTPYRIPLKEGGEFYSVKPQPGGLIWRDWLGLIETGKSENNTELPALVVKLFNASSLKQAKVGLWGFGYDFDNMKARCWYEHHFPLLLKKKEGQIPKLRLAAQTASRILSLLRSALKEAWFSDPKGARGDFSFVDIDFWNKTQHRFLRLVRQIEEGQDADELLGKWQKEIWLFARQDFDERVFTNPYEPVDLKRVMTARKKYFTTSAEKQSAKAAREKKQEAAE

SEQ ID NO: 5589 - protein, 520 aa, Escherichia coli 2866550; identical to SEQ ID NO: 5261

SEQ ID NO: 5590 - protein, 520 aa, Escherichia coli 2866450; identical to SEQ ID NO: 5261

SEQ ID NO: 5591 - protein, 520 aa, Escherichia coli 2866750; identical to SEQ ID NO: 5588

SEQ ID NO: 5592 - protein, 520 aa, Escherichia coli 2861200; identical to SEQ ID NO: 5573

SEQ ID NO: 5593 - protein, 520 aa, Escherichia coli 2865200
MNSFSLLTTPWLPVRFKDGTTGKLAPVDLADENVVDIAAPRADLQGAAWQFLLGLLQTSFAPKDHRRWDDIWEDGLEAEKLREALLSLEHAFQFGPDSPSFMQDFDELKVKATSIASLLPDAPGKQTKERNTDHFIKRDTTQHLCLHCVPLALFSIQLNAPIGGRGYYPGLRGGGPLTTLIELLEYQGNQQTPLWRKLWLNIMPQDEADLPLPKTFDDLVFPWLAPTRTSELDGAVVTDEQVNKLQAYWGMPRRIRIDFKTTSIGNCDICGRQSDALLGLMSLKNYGVQYVMWRHPLTPYRLPLKEGGDFYSVKPQPGGLIWRDWLGLIEVGNSKNNTELPAQVVKLLNASNLKQTRGGLWGFGFDFEDMKVRCWYEHHFPLLLNKKEDLIPKLRLAAQAASHFLSLLHRALKEAWFSEKKTTKLDFGFVDIDFWNKTQHRFLRLVRQIEEGQDPDELLGKWQKEMWLFARQDFDDRVFTNPYEPVDLERVMTARKKYFTTSAEKQNANAAREKKQEAAE

SEQ ID NO: 5594 - protein, 520 aa, Escherichia coli 2860050; identical to SEQ ID NO: 5296

SEQ ID NO: 5595 - protein, 520 aa, Escherichia coli 2853500; identical to SEQ ID NO: 5261

SEQ ID NO: 5596 - protein, 520 aa, Escherichia coli 2851500; identical to SEQ ID NO: 5261

SEQ ID NO: 5597 - protein, 520 aa, Escherichia coli 2850750; identical to SEQ ID NO: 5261

SEQ ID NO: 5598 - protein, 520 aa, Escherichia coli 2850400; identical to SEQ ID NO: 5588

SEQ ID NO: 5599 - protein, 520 aa, Escherichia coli 2848050; identical to SEQ ID NO: 5305

SEQ ID NO: 5600 - protein, 502 aa, Escherichia coli 2845350
MNLLIDNWIPVRPRNGGKVQIINLQSLYCSRDQWRLSLPRDDMELAALALLVCIGQIIDPAKDDVEFRHRIMNPLTEDEFQQLIAPWIDMFYLNHAEHPFMQTKGVKANDVTPMEKLLAGVSGATNCAFVNQPGQGEALCGGCTAIALFNQANQAPGFGGGFKSGLRGGTPITTFVRGIDLRSTVLLNVLTIPRLQKQFPNESHTENQPTWVKPVKPNESVPASSIGFVRGLFWQPAHIELCDPIGIGKCSCCGQESNLRYTGFLKEKFTFTVNGLWPHPHSPCLVTVKKGEVEEKFLAFTTSAPSWTQISRVVVDKIIQNENGNRVAAVVNQFRNIAPQSPLELIMGGYRNNQASILERRHDVLMFNQGWQQYGNVINEIVTVGLGYKTALRKALYTFAEGFKNKDFKGAGVSVHETAERHFYRQSELLIPDVLANVNFSQADEVIADLRDKLHQLCEMLFNQSVAPYAHHPKLISTLALARATLYKHLRELKPQGGPSNG

SEQ ID NO: 5601 - protein, 520 aa, Escherichia coli 2788150
MNSFSLLTTPWLPVRFKDGTTGKLAPVDLADENVVDIAAPRADLQGAAWQFLLGLLQTSFAPKDHRRWDDIWEDGLEAEKLREALLSLEHAFQFGPDSPSFMQDFDELKVKATSIASLLPDAPGKQTKERNTDHFIKRDTTQHLCLHCVPLALFSIQLNAPIGGRGYYPGLRGGGPLTTLIELLEYQGNQQTPLWRKLWLNIMPQDEADLPLPKTFDDLVFPWLAPTRTSELDGAVVTDEQVNKLQAYWGMPRRIRIDFKTTSIGNCDICGRQSDALLGLMSLKNYGVQYVMWRHPLTPYRLPLKEGGDFYSVKPQPGGLIWRDWLGLIEVGNSKNNTELPAQVVKLLNASNLKQTRVGLWGFGFDFEDMKVRCWYEHHFPLLLNKKEDLIPKLRLAAQAASHFLSLLHRALKEAWFSEKKTTKLDFGFVDIDFWNKTQHRFLRLVRQIEEGQDPDELLGKWQKEMWLFARQDFDDRVFTNPYEPVDLERVMTARKKYFTTSAEKQNANAAREKKQEAAE

SEQ ID NO: 5602 - protein, 520 aa, Escherichia coli 2780750
MNSFSLLTTPWLPVRFKDGTTGKLAPVDLADENVVDIAAPRADLQDAAWQFLLGLLQTSFAPKNHGRWDDIWEDGLEAEKLREALLSLEHAFQFGPDSPSFMQDFEALKGDKVQVASLLPEIPGAQTTKFNKDHFIKRGVTEHVCPHCSALALFSLQLNAPSGGKGYRTGLRGGGPMTTLIELQEYQGNQQTPLWRKLWPNVMPQDEADLPLPKKFDDLVFPWLGPTRTSELAGAVVTHDQVNKLQAYWGMPRRIRIDFNTTTVGNCDICGEQSDALLSLMTTKNYGANYAMWQHPLTPYRIPLKEGGEFYSVKPQPGGLIWRDWLGLIETGKSENNTELPALVVKLFNASSLKQAKVGLWGFGYDFDNMKARCWYEHHFPLLLDKKEGQIPKLRLAAQTASRILSLLRSALKEAWFSDPKGARGDFSFVDIDFWNKTQHRFLRLVRQIEEGQDADELLSKWQKEIWLFARQDFDERVFTNPYEPVDLKRVMTARKKYFTTSAEKQNAKAAREKKQEAAE

SEQ ID NO: 5603 - protein, 520 aa, Escherichia coli 2770900; identical to SEQ ID NO: 5296

SEQ ID NO: 5604 - protein, 408 aa, Escherichia coli 2762100; identical to SEQ ID NO: 5586

SEQ ID NO: 5605 - protein, 520 aa, Escherichia coli 2756500; identical to SEQ ID NO: 5261

SEQ ID NO: 5606 - protein, 520 aa, Escherichia coli 2749250
MNSFSLLTTPWLPVRFKDGTTGKLAPVDLADENVVDIAAPRADLQGAAWQFLLGLLQTSFAPKDHRRWDDIWEDGLEVEKLREALLSLEHAFQFGPDSPSFMQDFEALTGDKVQVASLLPEIPGAQTTKFNKDHFIKRGVTESLCPHCSALALFSLQLNAPSGGKGYRTGLRGGGPMTTLIELQEYQGNQQTPLWRKMWLNVMPQDEADLPLPKKFDDLVFPWLGPTRTSELAGAVVTDDQVNKLQAYWGMPRRIRIDFNTTTVGNCDICGEQNDALLSLMTTKNYGANYAMWQHPLTPYRVPLKEGGEFYSVKPQPGGLIWRDWLGLIETGKSENNTELPALVVKLFNASSLKQAKVGLWGFGYDFDNMKARCWYEHHFPLLLNKKEGQIPKLRLAAQTASRILSLLRSALKEAWFSDPKGARGDFSFVDIDFWNKTQHRFLRFVRQIEEGQDADELLSKWNKEIWLFARQDFDERVFTNPYEPVNLERIMTARKKYFTTSAEKQSAKAAREKKQEAAE

SEQ ID NO: 5607 - protein, 520 aa, Escherichia coli 2747800; identical to SEQ ID NO: 5296

SEQ ID NO: 5608 - protein, 408 aa, Escherichia coli 2731150
MELAALALLVCIGQIIDPAKDDVEFRHRIMNPLTEDEFQQLIAPWIDMFYLNHAEHPFMQTKGVKANDVTPMEKLLAGVSGATNCAFVNQPGQGEALCGGCTAIALFNQANQAPGFGGGFKSGLRGGTPITTFVRGIDLRSTVLLNVLTIPRLQKQFPNESHTENQPTWVKPVKPNESVPASSIGFVRGLFWQPAHIELCDPIGIGKCSCCGQESNLRYTGFLKEKFTFTVNGLWPHPHSPCLVTVKKGEVEEKFLAFTPSAPSWTQISRVVVDKIIQNENGNRVAAVVNQFRNIAPQSPLELIMGGYRNNQASILERRHDVLMFNQGWQQYGNVINEIVTVGLGYKTALRKALYTFAEGFKNKDFKGAGVSVHETAERHFYRQSELLIPDVLANVNFSQADEVIADL

SEQ ID NO: 5609 - protein, 520 aa, Escherichia coli 180600
MNSFSLLTTPWLPVRFKDGTTGKLAPVDLADENVVDIAAPRADLQGAAWQFLLGLLQTSFAPKDHRRWDDIWEDGLEVEKLREALLSLEHAFQFGPDSPSFMQDFEALTGDKVQVASLLPEIPGAQTTKFNKDHFIKRGVTEYLCPHCSALALFSLQLNAPSGGKGYRTGLRGGGPMTTLIELQEYQGNQQTPLWRKMWLNVMPQDEADLPLPKKFDDLVFPWLGPTRTSELAGAVVTDDQVNKLQAYWGMPRRIRIDFNTTTVGNCDICGEQNDALLSLMTTKNYGANYAMWQHPLTPYRVPLKEGGEFYSVKPQPGGLIWRDWLGLIETGKSENNTELPALVVKLFNASSLKQAKVGLWGFGYDFDNMKARCWYEHHFPLLLKKKEGQIPKLRLAAQTASRILSLLRSALKEAWFSDPKGARGDFSFVDIDFWNKTQHRFLRLVRQIEEGQDADELLGKWQKEIWLFARQDFDERVFTNPYEPVDLKRVMTARKKYFTTSAEKQSAKAAREKKQEAAE

SEQ ID NO: 5610 - protein, 520 aa, Escherichia coli ThroopD; identical to SEQ ID NO: 5296

SEQ ID NO: 5611 - protein, 520 aa, Escherichia coli P0304777.1; identical to SEQ ID NO: 5609

SEQ ID NO: 5612 - protein, 520 aa, Escherichia coli P0302308.1; identical to SEQ ID NO: 5305

SEQ ID NO: 5613 - protein, 520 aa, Escherichia coli P0302293.2; identical to SEQ ID NO: 5354

SEQ ID NO: 5614 - protein, 234 aa, Escherichia coli 174750
MNLLIDNWIPVRPQSGGKVQIINLQSLFCSKNQWRLSLPRDDMELAALALLVCIGQIIAPAKDDVEFRHRIMNPLSEDEFQRLIAPWIDMFYLNHAEHPFMQTKGVKANDVTPMEKLLAGVSGATNCAFVNQPGQGEALCGGCTAIALFNQANQAPGFGGGFKSGLRGGTPITTFVRGIDLRSTVLLNVLTIPRLQKQFPNESHTENQPTWIKPVKPNESVPASSIGFVRGLFW

SEQ ID NO: 5615 - protein, 408 aa, Escherichia coli MP021566.1; identical to SEQ ID NO: 5586

SEQ ID NO: 5616 - protein, 520 aa, Escherichia coli MP021561.2
MDLTREKWLPVVLTNGERTKISLVDLLNDSIHDVAWPRADFQGAAWEMLIGLLTVTVPPKDDEDWEEVWDEGIEPEVWEKALQKIAPVLQFGAQKPSFLQSFEPLDSEYGSISGLLIDAPGGNTLKLNKDHFVKRGVVEHICPHCAAIALYTIQTNSPAGGAGYRVGMRGGGPQTTLVVPQEEAKYPLWKKLWLNVLPQTKMPALADFPLIFPWIAPTITSDKKGNIVTPDNSHYLQAYWGMPRRIELDFTHTENGICDLCGEHHEALLLQMRSKNYGVQYDGWIHPFSPYRQAVKDPSAPWLALKGQPGGLSYRDWLGLILEREDKFNKMQPAKVVRIFAKQKNLGLWCFAWDMDNAKARCWYQHRLPLVCVTHQDQFVSVLNSVLNLATESLSFLKTALKSAWFENPKEAKVDFSMVEIAFWQETEASFRSLFNVLVNDPQRSEKNTRNALRQWEAELHTYIVNVFDWDAFSDPDCPDKILLRQLNARQVLINFYRKSKALKDVLALAEEQKDAKHDE

SEQ ID NO: 5617 - protein, 520 aa, Escherichia coli MP021017.1; identical to SEQ ID NO: 5573

SEQ ID NO: 5618 - protein, 520 aa, Escherichia coli MP020980.2; identical to SEQ ID NO: 5602

SEQ ID NO: 5619 - protein, 509 aa, Escherichia coli Jurua 20/10
MPVRFKDGTTGKLAPVDLADENVVDIAAPRADLQGAAWQFLLGLLQTSFAPKNHGRWDDIWQDGLEAEKLREALLSLEHAFQFGADSPSFMQDFEALKGDKVQVASLLPEIPGAQTTKFNKDHFIKRGVTEHVCPHCSALALFSLQLNAPSGGKGYRTGLRGGGPMTTLIELQEYQGNQQTPLWRKLWPNVMPQDEADLPLPKKFDDLVFPWLGPTRTSELAGAVVTHDQVNKLQAYWGMPRRIRIDFNTTTVGNCDICGEQSDALLSLMTTKNYGANYAMWQHPLTPYRIPLKEGGEFYSVKPQPGGLIWRDWLGLIETGKSENNTELPALVVKLFNASSLKQAKVGLWGFGYDFDNMKARCWYEHHFPLLLKKKEGQIPKLRLAAQTASRILSLLRSALKEAWFSDPKGARGDFSFVDIDFWNKTQHRFLRLVRQIEEGQDADELLGKWQKEIWLFARQDFDERVFTNPYEPVDLKRVMTARKKYFTTSAEKQSAKAAREKKQEAAE

SEQ ID NO: 5620 - protein, 520 aa, Escherichia coli MP020940.1; identical to SEQ ID NO: 5305

SEQ ID NO: 5621 - protein, 520 aa, Escherichia coli Jurua 18/11; identical to SEQ ID NO: 5609

SEQ ID NO: 5622 - protein, 520 aa, Escherichia coli Envira 10/1; identical to SEQ ID NO: 5296

SEQ ID NO: 5623 - protein, 520 aa, Escherichia coli Envira 8/11; identical to SEQ ID NO: 5296

SEQ ID NO: 5624 - protein, 520 aa, Escherichia coli 2726800; identical to SEQ ID NO: 5305

SEQ ID NO: 5625 - protein, 520 aa, Escherichia coli BCE001_MS16; identical to SEQ ID NO: 5296

SEQ ID NO: 5626 - protein, 520 aa, Escherichia coli 2720900; identical to SEQ ID NO: 5261

SEQ ID NO: 5627 - protein, 520 aa, Escherichia coli 174900; identical to SEQ ID NO: 5305

SEQ ID NO: 5628 - protein, 520 aa, Escherichia coli 2735000; identical to SEQ ID NO: 5261

SEQ ID NO: 5629 - protein, 413 aa, Escherichia coli 2846750
MPRDDMELAALALLVCIGQIIDPAKDDVEFRHRIMNPLTEDEFQQLIAPWIDMFYLNHAEHPFMQTKGVKANDVTPMEKLLAGVSGATNCAFVNQPGQGEALCGGCTAIALFNQANQAPGFGGGFKSGLRGGTPITTFVRGIDLRSTVLLNVLTIPRLQKQFPNESHTENQPTWVKPVKPNESVPASSIGFVRGLFWQPAHIELCDPIGIGKCSCCGQESNLRYTGFLKEKFTFTVNGLWPHPHSPCLVTVKKGEVEEKFLAFTPSAPSWTQISRVVVDKIIQNENGNRVAAVVNQFRNIAPQSPLELIMGGYRNNQASILERRHDVLMFNQGWQQYGNVINEIVTVGLGYKTALRKALYTFAEGFKNKDFKGAGVSVHETAERHFYRQSELLIPDVLANVNFSQADEVIADL

SEQ ID NO: 5630 - protein, 520 aa, Escherichia coli 199900.1; identical to SEQ ID NO: 5609

SEQ ID NO: 5631 - protein, 520 aa, Escherichia coli p0305293.1; identical to SEQ ID NO: 5296

SEQ ID NO: 5632 - protein, 408 aa, Escherichia coli P0305260.1; identical to SEQ ID NO: 5586

SEQ ID NO: 5633 - protein, 520 aa, Escherichia coli P0304816.1; identical to SEQ ID NO: 5305

SEQ ID NO: 5634 - protein, 408 aa, Escherichia coli P0299438.2; identical to SEQ ID NO: 5586

SEQ ID NO: 5635 - protein, 520 aa, Escherichia coli P0299917.1
MNSFSLLTTPWLPVRFKDGTTGKLAPVDLADENVVDIAAPRADLQGAAWQFLLGLLQTSFAPKNHGRWDDIWEDGLEAEKLREALLSLEHAFQFGADSPSFMQDFEALKGDKVQVASLLPEIPGAQTTKFNKDHFIKRGVTEHVCPHCSALALFSLQLNAPSGGKGYRTGLRGGGPMTTLIELQEYQGNQQTPLWRKLWPNVMPQDEADLPLPKKFDDLVFPWLGPTRTSELAGAVVTHDQVNKLQAYWGMPRRIRIDFNTTTVGNCDICGEQSDALLSLMTTKNYGANYAMWQHPLTPYRIPLKEGGEFYSVKPQPGGLIWRDWLGLIETGKSENNTELPALVVKLFNASSLKQAKVGLWGFGYDFDNMKARCWYEHHFPLLLKKKEGQIPKLRLAAQTASRILSLLRSALKEAWFSDPKGARGDFSFVDIDFWNKTQHRFLRLVRQIEEGQDADELLGKWQKEIWLFARQDFDERVFTNPYEPVDLKRVMTARKKYFTTSAEKQSAKAAREKKQEAAE

SEQ ID NO: 5636 - protein, 520 aa, Escherichia coli BCE008_MS-13; identical to SEQ ID NO: 5573

SEQ ID NO: 5637 - protein, 460 aa, Escherichia coli 201600.1
MELAALALLVCIGQIIDPAKDDVEFRHRIMNPLTEDEFQQLIAPWIDMFYLNHAEHPFMQTKGVKANDVTPMEKLLAGVSGATNCAFVNQPGQGEALCGGCTAIALFNQANQAPGFGGGFKSGLRGGTPITTFVRGIDLRSTVLLNVLTIPRLQKQFPNESHTENQPTWVKPVKPNESVPASSIGFVRGLFWQPAHIELCDPIGIGKCSCCGQESNLRYTGFLKEKFTFTVNGLWPHPHSPCLVTVKKGEVEEKFLAFTTSAPSWTQISRVVVDKIIQNENGNRVAAVVNQFRNIAPQSPLELIMGGYRNNQASILERRHDVLMFNQGWQQYGNVINEIVTVGLGYKTALRKALYTFAEGFKNKDFKGAGVSVHETAERHFYRQSELLIPDVLANVNFSQADEVIADLRDKLHQLCEMLFNQSVAPYAHHPKLISTLALARATLYKHLRELKPQGGPSNG

SEQ ID NO: 5638 - protein, 502 aa, Escherichia coli P0298942.1; identical to SEQ ID NO: 5600

SEQ ID NO: 5639 - protein, 244 aa, Escherichia coli BCE007_MS-11; identical to SEQ ID NO: 5584

SEQ ID NO: 5640 - protein, 520 aa, Escherichia coli 2729250; identical to SEQ ID NO: 5296

SEQ ID NO: 5641 - protein, 520 aa, Escherichia coli 179550; identical to SEQ ID NO: 5261

SEQ ID NO: 5642 - protein, 520 aa, Escherichia coli 180200; identical to SEQ ID NO: 5261

SEQ ID NO: 5643 - protein, 159 aa, Escherichia coli 2730450
MVEEKFLAFTTSAPSWTQISRVVVDKIIQNENGNRVAAVVNQFRNIAPQSPLELIMGGYRNNQASILERRHDVLMFNQGWQQYGNVINEIVTVGLGYKTALRKALYTFAEGFKNKDFKGAGVSVHETAERHFYRQSELLIPDVLANVNFSQADEVIADL

SEQ ID NO: 5644 - protein, 408 aa, Escherichia coli 2741950
MELAALALLVCIGQIIDPAKDDVEFRHRIMNPLTEDEFQQLIAPWIDMFYLNHAEHPFMQTKGVKANDVTPMEKLLAGVSGATNCAFVNQPGQGEALCGGCTAIALFNQANQAPGFGGGFKSGLRGGTPITTFVRGIDLRSTVLLNVLTIPRLQKQFPNESHTENQPTWVKPVKPNESVPASSIGFVRGLFWQPAHIELCDPIGIGKCSCCGQESNLRYTGFLKEKFTFTVNGLWPHPHSPCLVTVKKGVVEEKFLAFTPSAPSWTQISRVVVDKIIQNENGNRVAAVVNQFRNIAPQSPLELIMGGYRNNQASILERRHDVLMFNQGWQQYGNVINEIVTVGLGYKTALRKALYTFAEGFKNKDFKGAGVSVHETAERHFYRQSELLIPDVLANVNFSQADEVIADL

SEQ ID NO: 5645 - protein, 520 aa, Escherichia coli 2730350; identical to SEQ ID NO: 5606

SEQ ID NO: 5646 - protein, 520 aa, Escherichia coli 2860650; identical to SEQ ID NO: 5296

SEQ ID NO: 5647 - protein, 520 aa, Escherichia coli 2864350; identical to SEQ ID NO: 5602

SEQ ID NO: 5648 - protein, 502 aa, Escherichia coli 2862600; identical to SEQ ID NO: 5600

SEQ ID NO: 5649 - protein, 520 aa, Escherichia coli 2866350; identical to SEQ ID NO: 5296

SEQ ID NO: 5650 - protein, 520 aa, Escherichia coli BCE008_MS-01; identical to SEQ ID NO: 5573

SEQ ID NO: 5651 - protein, 244 aa, Escherichia coli BCE030_MS-09
MKPFWVKPVKPNESVPASSIGFVRGLFWQPAHIELCDPIGIGKCSCCGQESNLRYTGFLKEKFTFTVNGLWPHPHSPCLVTVKKGVVEEKFLAFTPSAPSWTQISRVVVDKIIQNENGNRVAAVVNQFRNIAPQSPLELIMGGYRNNQASILERRHDVLMFNQGWQQYGNVINEIVTVGLGYKTALRKALYTFAEGFKNKDFKGAGVSVHETAERHFYRQSELLIPDVLANVNFSQADEVIADL

SEQ ID NO: 5652 - protein, 244 aa, Escherichia coli BCE032_MS-12; identical to SEQ ID NO: 5584

SEQ ID NO: 5653 - protein, 177 aa, Escherichia coli MP021561.3
MVKLFNASSLKQAKVGLWGFGYDFDNMKARCWYEHRFPLLLNKKEGQIPKLRLAAQTASRILSLLRSALKEAWFSDPKGARGDFSFVDIDFWNKTQHRFLRLVRQIEEGQDADGLLSKWNKEIWLFARQDFDERVFTNPYEPVDLKRVMTARKKYFTTSAEKQSAKAAREKKQEAAE

SEQ ID NO: 5654 - protein, 502 aa, Escherichia coli P0298942.10; identical to SEQ ID NO: 5600

SEQ ID NO: 5655 - protein, 502 aa, Escherichia coli P0298942.12; identical to SEQ ID NO: 5600

SEQ ID NO: 5656 - protein, 502 aa, Escherichia coli P0298942.11; identical to SEQ ID NO: 5600

SEQ ID NO: 5657 - protein, 502 aa, Escherichia coli P0298942.6
MNLLIDNWIPVRPRNGGKVQIINLQSLYCSRDQWRLSLPRDDMELAALALLVCIGQIIDPAKDDVEFRHRIMNPLTEDEFQQLIAPWIDMFYLNHAEHPFMQTKGVKANDVTPMEKLLAGVSGATNCAFVNQPGQGEALCGGCTAIALFNQANQAPGFGGGFKSGLRGGTPITTFVRGIDLRSTVLLNVLTIPRLQKQFPNESHTENQPTWVKPVKPNESVPASSIGFVRGLFWQPAHIELCDPIGIGKCSCCGQESNLRYTGFLKEKFTFTVNGLWPHPHSPCLVTVKKGEVEEKFLAFTTSAPSWTQISRVVVDKIIQNENGNRVAAVVNQFRNIAPQRPLELIMGGYRNNQASILERRHDVLMFNQGWQQYGNVINEIVTVGLGYKTALRKALYTFAEGFKNKDFKGAGVSVHETAERHFYRQSELLIPDVLANVNFSQADEVIADLRDKLHQLCEMLFNQSVAPYAHHPKLISTLALARATLYKHLRELKPQGGPSNG

SEQ ID NO: 5658 - protein, 502 aa, Escherichia coli P0298942.15; identical to SEQ ID NO: 5600

SEQ ID NO: 5659 - protein, 502 aa, Escherichia coli P0298942.7; identical to SEQ ID NO: 5600

SEQ ID NO: 5660 - protein, 502 aa, Escherichia coli P0298942.2; identical to SEQ ID NO: 5600

SEQ ID NO: 5661 - protein, 460 aa, Escherichia coli P0299438.10; identical to SEQ ID NO: 5637

SEQ ID NO: 5662 - protein, 502 aa, Escherichia coli P0298942.8; identical to SEQ ID NO: 5600

SEQ ID NO: 5663 - protein, 411 aa, Escherichia coli P0298942.9
MNLLIDNWIPVRPRNGGKVQIINLQSLYCSRDQWRLSLPRDDMELAALALLVCIGQIIDPAKDDVEFRHRIMNPLTEDEFQQLIAPWIDMFYLNHAEHPFMQTKGVKANDVTPMEKLLAGVSGATNCAFVNQPGQGEALCGGCTAIALFNQANQAPGFGGGFKSGLRGGTPITTFVRGIDLRSTVLLNVLTIPRLQKQFPNESHTENQPTWVKPVKPNESVPASSIGFVRGLFWQPAHIELCDPIGIGKCSCCGQESNLRYTGFLKEKFTFTVNGLWPHPHSPCLVTVKKGEVEEKFLAFTTSAPSWTQISRVVVDKIIQNENGNRVAAVVNQFRNIAPQSPLELIMGGYRNNQASILERRHDVLMFNQGWQQYGNVINEIVTVGLGYKTALRKALYTFAEGFKNKDFKGA

SEQ ID NO: 5664 - protein, 520 aa, Escherichia coli P0299438.11; identical to SEQ ID NO: 5349

SEQ ID NO: 5665 - protein, 520 aa, Escherichia coli P0299438.3; identical to SEQ ID NO: 5349

SEQ ID NO: 5666 - protein, 460 aa, Escherichia coli P0299438.4; identical to SEQ ID NO: 5637

SEQ ID NO: 5667 - protein, 520 aa, Escherichia coli P0299438.5; identical to SEQ ID NO: 5349

SEQ ID NO: 5668 - protein, 520 aa, Escherichia coli P0299438.6; identical to SEQ ID NO: 5349

SEQ ID NO: 5669 - protein, 520 aa, Escherichia coli P0299438.7; identical to SEQ ID NO: 5349

SEQ ID NO: 5670 - protein, 520 aa, Escherichia coli P0299438.8; identical to SEQ ID NO: 5349

SEQ ID NO: 5671 - protein, 408 aa, Escherichia coli P0299438.9; identical to SEQ ID NO: 5586

SEQ ID NO: 5672 - protein, 520 aa, Escherichia coli P02997067.6; identical to SEQ ID NO: 5635

SEQ ID NO: 5673 - protein, 520 aa, Escherichia coli P0299917.10; identical to SEQ ID NO: 5354

SEQ ID NO: 5674 - protein, 520 aa, Escherichia coli P0299917.2; identical to SEQ ID NO: 5354

SEQ ID NO: 5675 - protein, 520 aa, Escherichia coli P0299917.3; identical to SEQ ID NO: 5354

SEQ ID NO: 5676 - protein, 520 aa, Escherichia coli P0299917.4; identical to SEQ ID NO: 5354

SEQ ID NO: 5677 - protein, 520 aa, Escherichia coli P0299917.5; identical to SEQ ID NO: 5354

SEQ ID NO: 5678 - protein, 520 aa, Escherichia coli P0299917.8; identical to SEQ ID NO: 5354

SEQ ID NO: 5679 - protein, 520 aa, Escherichia coli P0299917.6; identical to SEQ ID NO: 5354

SEQ ID NO: 5680 - protein, 520 aa, Escherichia coli P0299917.7; identical to SEQ ID NO: 5354

SEQ ID NO: 5681 - protein, 520 aa, Escherichia coli P0299917.9; identical to SEQ ID NO: 5354

SEQ ID NO: 5682 - protein, 520 aa, Escherichia coli P0302308.10; identical to SEQ ID NO: 5305

SEQ ID NO: 5683 - protein, 520 aa, Escherichia coli P0302308.11; identical to SEQ ID NO: 5305

SEQ ID NO: 5684 - protein, 520 aa, Escherichia coli P0302308.3; identical to SEQ ID NO: 5305

SEQ ID NO: 5685 - protein, 520 aa, Escherichia coli P0302308.2; identical to SEQ ID NO: 5305

SEQ ID NO: 5686 - protein, 520 aa, Escherichia coli P0302308.5; identical to SEQ ID NO: 5305

SEQ ID NO: 5687 - protein, 520 aa, Escherichia coli P0302308.4; identical to SEQ ID NO: 5305

SEQ ID NO: 5688 - protein, 520 aa, Escherichia coli 179100
MNSFSLLTTPWLPVRFKDGTTGKLAPVDLADENVVDIAAPRADLQGAVWQFLLGLLQTSFAPKDHRRWDDIWEDGLEAEKLREALQSLEHAFQFGPDSPSFMQDFEALKGDKVQVASLLPEIPGAQTTKFNKDHFIKRGVTEHVCPHCSALALFSLQLNAPSGGKGYRTGLRGGGPMTTLIELQEYQGNQQTPLWRKLWPNVMPQDEADLPLPKKFDNLVFPWLGPTRTSELAGAVVTHDQVNKLQAYWGMPRRIRIDFNTTTVGNCDICGEQSDALLSLMTTKNYGANYAMWQHPLTPYRIPLKEGGEFYSVKPQPGGLIWRDWLGLIETGKSENNTELPALVVKLFNASSLKQAKVGLWGFGYDFDNMKARCWYEHHFPLLLKKKEGQIPKLRLAAQTASRILSLLRSALKEAWFSDPKGARGDFSFVDIDFWNKTQHRFLRLVRQIEEGQDADELLGKWQKEIWLFARQDFDERVFTNPYEPVDLKRVMTARKKYFTTSAEKQSAKAAREKKQEAAE

SEQ ID NO: 5689 - protein, 520 aa, Escherichia coli 2854350; identical to SEQ ID NO: 5305

SEQ ID NO: 5690 - protein, 502 aa, Escherichia coli 2733950; identical to SEQ ID NO: 5600

SEQ ID NO: 5691 - protein, 520 aa, Escherichia coli p0305293.13]; identical to SEQ ID NO: 5296

SEQ ID NO: 5692 - protein, 520 aa, Escherichia coli MP020980.1; identical to SEQ ID NO: 5602

SEQ ID NO: 5693 - protein, 244 aa, Escherichia coli BCE006_MS-23; identical to SEQ ID NO: 5584

SEQ ID NO: 5694 - protein, 502 aa, Escherichia coli P0298942.3; identical to SEQ ID NO: 5600

SEQ ID NO: 5695 - protein, 520 aa, Escherichia coli P0299483.1; identical to SEQ ID NO: 5305

SEQ ID NO: 5696 - protein, 520 aa, Escherichia coli P0299483.2; identical to SEQ ID NO: 5305

SEQ ID NO: 5697 - protein, 502 aa, Escherichia coli P0298942.4; identical to SEQ ID NO: 5600

SEQ ID NO: 5698 - protein, 520 aa, Escherichia coli P0299483.3; identical to SEQ ID NO: 5305

SEQ ID NO: 5699 - protein, 408 aa, Escherichia coli P0301904.3
MELAALALLVCVGQIIDPAKDDVEFRHRIMNPLTEDEFQQLIAPWIDMFYLNHAEHPFMQTKGVKANDVTPMEKLLAGVSGATNCAFVNQPGQGEALCGGCTAIALFNQANQAPGFGGGFKSGLRGGTPITTFVRGIDLRSTVLLNVLTIPRLQKQFPNESHTENQPTWVKPVKPNESVPASSIGFVRGLFWQPAHIELCDPIGIGKCSCCGQESNLRYTGFLKEKFTFTVNGLWPHPHSPCLVTVKKGEVEEKFLAFTTSAPSWTQISRVVVDKIIQNENGNRVAAVVNQFRNIAPQSPLELIMGGYRNNQASILERRHDVLMFNQGWQQYGNVINEIVTVGLGYKTALRKALYTFAEGFKNKDFKGAGVSVHETAERHFYRQSELLIPDVLANVNFSQADEVIADL

SEQ ID NO: 5700 - protein, 520 aa, Escherichia coli P0302293.7; identical to SEQ ID NO: 5354

SEQ ID NO: 5701 - protein, 408 aa, Escherichia coli P0305260.2; identical to SEQ ID NO: 5586

SEQ ID NO: 5702 - protein, 520 aa, Escherichia coli p0305293.14; identical to SEQ ID NO: 5296

SEQ ID NO: 5703 - protein, 520 aa, Escherichia coli P0302293.10; identical to SEQ ID NO: 5354

SEQ ID NO: 5704 - protein, 520 aa, Escherichia coli P0302293.3
MNSFSLLTTPWLPVRFKDGTTGKLAPVDLADENVVDIAAPRADLQGAAWQFLLGLLQSSFAPKDYRRWDDIWEDGLEAEKLREALLSLEHAFQFGPDSPSFMQDFEVLMGDKVQVASLLPEIPGAQTTKFNKDHFIKRGVTEHVCSHCSALALFSLQLNAPSGGKGYRTGIRGGGPMTTLIELQEDQGNQQAPLWRKLWLNVMPQDEADLPLPKKFDDLVFPWLGPTRTSELAGAVVTDDQVNKLQAYWGMPRRIRIDFNTTTVGNCDICGEQDDALLSLMTTKNYGANYAMWQHPLTPYRVPLKEGGEFYSVKPQPGGLIWRDWLGLIETGKSENNTELPALVVKLFNASSLKQAKVGLWGFGYDFDNMKARCWYEHRFPLLLNKKEGQIPKLRLAAQTASRILSLLRSALKEAWFSDPKGARGDFSFVDIDFWNKTQHRFLRLVRQIEEGQDADGLLSKWNKEIWLFARQDFDERVFTNPYEPVDLKRVMTARKKYFTTSAEKQSAKAAREKKQEAAE

SEQ ID NO: 5705 - protein, 520 aa, Escherichia coli P0302293.4; identical to SEQ ID NO: 5354

SEQ ID NO: 5706 - protein, 520 aa, Escherichia coli P0302293.6; identical to SEQ ID NO: 5354

SEQ ID NO: 5707 - protein, 520 aa, Escherichia coli P0302293.8; identical to SEQ ID NO: 5354

SEQ ID NO: 5708 - protein, 520 aa, Escherichia coli P0304777.10; identical to SEQ ID NO: 5609

SEQ ID NO: 5709 - protein, 520 aa, Escherichia coli P0302293.9; identical to SEQ ID NO: 5354

SEQ ID NO: 5710 - protein, 520 aa, Escherichia coli P0304777.11; identical to SEQ ID NO: 5609

SEQ ID NO: 5711 - protein, 520 aa, Escherichia coli P0304777.12; identical to SEQ ID NO: 5609

SEQ ID NO: 5712 - protein, 520 aa, Escherichia coli P0304777.13; identical to SEQ ID NO: 5609

SEQ ID NO: 5713 - protein, 520 aa, Escherichia coli P0304777.14; identical to SEQ ID NO: 5609

SEQ ID NO: 5714 - protein, 520 aa, Escherichia coli P0304777.15; identical to SEQ ID NO: 5609

SEQ ID NO: 5715 - protein, 520 aa, Escherichia coli P0304777.2; identical to SEQ ID NO: 5609

SEQ ID NO: 5716 - protein, 520 aa, Escherichia coli P0304777.3; identical to SEQ ID NO: 5609

SEQ ID NO: 5717 - protein, 520 aa, Escherichia coli P0304777.4; identical to SEQ ID NO: 5609

SEQ ID NO: 5718 - protein, 520 aa, Escherichia coli P0304777.7; identical to SEQ ID NO: 5609

SEQ ID NO: 5719 - protein, 520 aa, Escherichia coli P0304777.5; identical to SEQ ID NO: 5609

SEQ ID NO: 5720 - protein, 520 aa, Escherichia coli P0304777.8; identical to SEQ ID NO: 5609

SEQ ID NO: 5721 - protein, 520 aa, Escherichia coli P0304777.9; identical to SEQ ID NO: 5609

SEQ ID NO: 5722 - protein, 520 aa, Escherichia coli P0304816.11
MNSFSLLTTPWLPVRFKDGTTGKLAPVDLADENVVDIAAPRADLQGAVWQFLLGLLQTSFAPKDHRRWDDIWEDGLEAEKLREALQSLEHAFQFGPDSPSFMQDFEALKGDKVQVASLLPEIPGAQTTKFNKDHFIKRGVTEHVCPHCSALALFSLQLNAPSGGKGYRTGLRGGGPMTTLIELQEYQGNQQTPLWRKLWPNVMPQDEADLPLPKKFDDLVFPWLGPTRTSELAGAVVTHDQVNKLQAYWGMPRRIRIDFNTTTVGNCDICGEQSDALLSLMTTKNYGANYAMWQHPLTPYRIPLKEGGEFYSVKPQPGGLIWRDWLGLIETGKSENNTELPALVVKLFNASSLKQAKVGLWGFGYDFDNMKARCWYEHHFPLLLKKKEGQIPKLRLAAQTASRILSLLRRALKEAWFSDPKGARGDFSFVDIDFWNKTQHRFLRLVRQIEEGQDADELLGKWQKEIWLFARQDFDERVFTNPYEPVDLKRVMTARKKYFTTSAEKQSAKAAREKKQEAAE

SEQ ID NO: 5723 - protein, 520 aa, Escherichia coli P0304816.10; identical to SEQ ID NO: 5305

SEQ ID NO: 5724 - protein, 520 aa, Escherichia coli P0304816.12; identical to SEQ ID NO: 5305

SEQ ID NO: 5725 - protein, 520 aa, Escherichia coli P0304816.14; identical to SEQ ID NO: 5305

SEQ ID NO: 5726 - protein, 520 aa, Escherichia coli P0304816.13; identical to SEQ ID NO: 5305

SEQ ID NO: 5727 - protein, 520 aa, Escherichia coli P0304816.15; identical to SEQ ID NO: 5305

SEQ ID NO: 5728 - protein, 520 aa, Escherichia coli P0304816.2; identical to SEQ ID NO: 5305

SEQ ID NO: 5729 - protein, 520 aa, Escherichia coli P0304816.6; identical to SEQ ID NO: 5305

SEQ ID NO: 5730 - protein, 520 aa, Escherichia coli P0304816.7; identical to SEQ ID NO: 5305

SEQ ID NO: 5731 - protein, 520 aa, Escherichia coli P0304816.8; identical to SEQ ID NO: 5305

SEQ ID NO: 5732 - protein, 520 aa, Escherichia coli P0304816.9; identical to SEQ ID NO: 5305

SEQ ID NO: 5733 - protein, 408 aa, Escherichia coli P0305260.10
MELAALALLVCIGQIIDPAKDDVEFRHRIMNPLTEDEFQQLIAPWIDMFYLNHAEHPFMQTKGVKANDVTPMEKLLAGVSGATNCAFVNQPGQGEALCGGCTAIALFNQANQAPGFGGGFKSGLRGGTPITTFVRGIDLRSTVLLNVLTIPRLQKQFPNESHTENKPTWVKPVKPNESVPASSIGFVRGLFWQPAHIELCDPIGIGKCSCCGQESNLRYTGFLKEKFTFTVNGLWPHPHSPCLVTVKKGEVEEKFLAFTTSAPSWTQISRVVVDKIIQNENGNRVAAVVNQFRNIAPQSPLELIMGGYRNNQASILERRHDVLMFNQGWQQYGNVINEIVTVGLGYKTALRKALYTFAEGFKNKDFKGAGVSVHETAERHFYRQSELLIPDVLANVNFSQADEVIADL

SEQ ID NO: 5734 - protein, 408 aa, Escherichia coli P0305260.11; identical to SEQ ID NO: 5586

SEQ ID NO: 5735 - protein, 408 aa, Escherichia coli P0305260.12; identical to SEQ ID NO: 5586

SEQ ID NO: 5736 - protein, 408 aa, Escherichia coli P0305260.13; identical to SEQ ID NO: 5586

SEQ ID NO: 5737 - protein, 408 aa, Escherichia coli P0305260.15; identical to SEQ ID NO: 5586

SEQ ID NO: 5738 - protein, 408 aa, Escherichia coli P0305260.3; identical to SEQ ID NO: 5586

SEQ ID NO: 5739 - protein, 408 aa, Escherichia coli P0305260.4; identical to SEQ ID NO: 5586

SEQ ID NO: 5740 - protein, 408 aa, Escherichia coli P0305260.5; identical to SEQ ID NO: 5586

SEQ ID NO: 5741 - protein, 413 aa, Escherichia coli P0305260.6
MPRDDMELAALALLVCIGQIIDPAKDDVEFRHRIMNPLTEDEFQQLIAPWIDMFYLNHAEHPFMQTKGVKANDVTPMEKLLAGVSGATNCAFVNQPGQGEALCGGCTAIALFNQANQAPGFGGGFKSGLRGGTPITTFVRGIDLRSTVLLNVLTIPRLQKQFPNESHTENQPTWVKPVKPNESVPASSIGFVRGLFWQPAHIELCDPIGIGKCSCCGQESNLRYTGFLKEKFTFTVNGLWPHPHSPCLVTVKKGEVEEKFLAFTTSAPSWTQISRVVVDKIIQNENGNRVAAVVNQFRNIAPQSPLELIMGGYRNNQASILERRHDVLMFNQGWQQYGNVINEIVTVGLGYKTALRKALYTFAEGFKNKDFKGAGVSVHETAERHFYRQSELLIPDVLANVNFSQADEVIADL

SEQ ID NO: 5742 - protein, 413 aa, Escherichia coli P0305260.7; identical to SEQ ID NO: 5741

SEQ ID NO: 5743 - protein, 408 aa, Escherichia coli P0305260.8; identical to SEQ ID NO: 5586

SEQ ID NO: 5744 - protein, 520 aa, Escherichia coli p0305293.10; identical to SEQ ID NO: 5296

SEQ ID NO: 5745 - protein, 408 aa, Escherichia coli P0305260.9; identical to SEQ ID NO: 5586

SEQ ID NO: 5746 - protein, 520 aa, Escherichia coli p0305293.11; identical to SEQ ID NO: 5296

SEQ ID NO: 5747 - protein, 520 aa, Escherichia coli p0305293.12; identical to SEQ ID NO: 5296

SEQ ID NO: 5748 - protein, 520 aa, Escherichia coli p0305293.15; identical to SEQ ID NO: 5296

SEQ ID NO: 5749 - protein, 520 aa, Escherichia coli p0305293.2; identical to SEQ ID NO: 5296

SEQ ID NO: 5750 - protein, 520 aa, Escherichia coli p0305293.3; identical to SEQ ID NO: 5296

SEQ ID NO: 5751 - protein, 520 aa, Escherichia coli p0305293.4
MNSFSLLTTPWLPVRFKDGTTGKLAPVDLADENVVDIAAPRADLQGAAWQFLLGLLQTSFAPKDHRRWDDIWEDGLEVEKLREALLSLEHAFQFGPDSPSFMQDFEALTGDKVQVASLLPEIPGAQTTKFNKDHFIKRGVTEYLCPHCSALALFSLQLNAPSGGKGYRTGLRGGGPMTTLIELQEYQGNQQTPLWRKMWLNVMPQDEADLPLPKKFDDLVFPWLGPTRTSELAGAVVTDDQVNKLQAYWGMPRRIRIDFNTTTVGNCDICGEQNDALLSLMTTKNYGANYAMWQHPLTPYRVPLKEGGEFYSVKPQPGGLIWRDWLGLIETGKSENNTELPALVVKLFNASSLKQAKVGLWGFGYDFDNMKARCWYEHHFPLLLNKKEGQIPKLRLAAQTASRILSLLRRALKEAWFSDPKGARGDFSFVDIDFWNKTQHRFLRFVRQIEEGQDADELLSKWNKEIWLFARQDFDERVFTNPYEPVNLERIMTARKKYFTTSAEKQSAKAAREKKQEAAE

SEQ ID NO: 5752 - protein, 520 aa, Escherichia coli p0305293.8; identical to SEQ ID NO: 5296

SEQ ID NO: 5753 - protein, 520 aa, Escherichia coli p0305293.9; identical to SEQ ID NO: 5296

SEQ ID NO: 5754 - protein, 520 aa, Escherichia coli 178200; identical to SEQ ID NO: 5609

SEQ ID NO: 5755 - protein, 502 aa, Escherichia coli P0298942.14; identical to SEQ ID NO: 5600

SEQ ID NO: 5756 - protein, 88 aa, Escherichia coli P0301867.5
MNLLIDNWIPVRPQSGGKVQIINLQSLFCSKNQWRLSLPRDDMELAALALLVCIGQIIAPAKDDVEFRHRIMNPLSEDEFQLSTTDEK

SEQ ID NO: 5757 - protein, 413 aa, Escherichia coli P0301867.5
MFYLNHAEHPFMQTKGVKANDVTPMEKLLAGVSGATNCAFVNQPGQGEALCGGCTAIALFNQANQAPGFGGGFKSGLRGGTPITTFVRGIDLRSTVLLNVLTIPRLQKQFPNESHTENQPTWIKPVKPNESVPASSIGFVRGLFWQPAHIELCDPIGIGKCSCCGQESNLRYTGFLKEKFTFTVNGLWPHPHSPCLVTVKKGEVEEKFLAFTTSAPSWTQISRVVVDKIIQNENGNRVAAVVNQFRNIASQSPLELIMGGYRNNQASILERRHDVLMFNQGWQQYGNVINEIVTVGLGYKTALRKALYTFAEGFKNKDFKGAGVSVHETAERHFYRQSELLILDVLANINFSQADEVIADLRDKLHQLCEMLFNQSVAPYAHHPKLISTLALARATLYKHLRELKPQGGPSNG

SEQ ID NO: 5758 - protein, 520 aa, Escherichia coli P0302308.13; identical to SEQ ID NO: 5305

SEQ ID NO: 5759 - protein, 520 aa, Escherichia coli P0302308.12; identical to SEQ ID NO: 5305

SEQ ID NO: 5760 - protein, 520 aa, Escherichia coli P0302308.14; identical to SEQ ID NO: 5305

SEQ ID NO: 5761 - protein, 520 aa, Escherichia coli P0304816.3; identical to SEQ ID NO: 5305

SEQ ID NO: 5762 - protein, 520 aa, Escherichia coli P0304816.4; identical to SEQ ID NO: 5305

SEQ ID NO: 5763 - protein, 520 aa, Escherichia coli P0304816.5; identical to SEQ ID NO: 5305

SEQ ID NO: 5764 - protein, 520 aa, Escherichia coli p0305293.5; identical to SEQ ID NO: 5296

SEQ ID NO: 5765 - protein, 520 aa, Escherichia coli p0305293.7; identical to SEQ ID NO: 5296

SEQ ID NO: 5766 - protein, 520 aa, Escherichia coli p0305293.6; identical to SEQ ID NO: 5296

SEQ ID NO: 5767 - protein, 533 aa, Leptospira borgpetersenii serovar Mini str. 201000851; identical to SEQ ID NO: 5468

SEQ ID NO: 5768 - protein, 507 aa, Klebsiella pneumoniae UHKPC57; identical to SEQ ID NO: 5538

SEQ ID NO: 5769 - protein, 557 aa, Leptospira noguchii str. 1993005606; identical to SEQ ID NO: 5549

SEQ ID NO: 5770 - protein, 533 aa, Leptospira borgpetersenii serovar Javanica str. UI 09931; identical to SEQ ID NO: 5469

SEQ ID NO: 5771 - protein, 539 aa, Leptospira fainei serovar Hurstbridge str. BUT 6
MPQKKAVAKKKTQSREKAKEREQTDFSFNLLTEPWLPVISLKKEKQFLNLNEFLKNAHTLERFDFPLPGLETAVIRFLVALVHIVGAPETLKEWEEKLSKGKFEEGFIKELNAKYSDKLDLFSKKDPFMQEANLAKSEEGIDGVDRLISFFPYATNQIHWNHKFAEQSVNLTAISCASAVSLLLFSHSTMMAGGAGYKPGINGVPPLMILLKGTNLYNSIFLNVLNGNFVNSLFDQKYLGKNTSAFPIFKKGEISSEKINLQMGLLWKSRDLLLMPERSEEFSCSLSGRKSNILIKNVIFNPQSIFTKKDSFWHDPTIIKIDAGSKGIKKMTTQNRDLPAWKEYPSLINTKGRNGNKRIFFPPLVIQQLSTIQPIRKRPKGNIMIFSLATDNKAKIFEISENEYFFNPTFIDNEDSIKAIEGFVNSVEQFQWKLQSALKIAYKIRPGSNIRPPSFEAAYWHEIGSNFEEALERLSIEDDINLIQNSWNELLANHVWKTFYKHTEKLILNPKNLKQYQAGNQFLEKQIQNVLLKHKRKAK

SEQ ID NO: 5772 - protein, 533 aa, Leptospira santarosai serovar Shermani str. 1342KT
MNLIKDVWIPTLRFSGKSAEISPFEITSQIENDSDPIVSLNSPRPDFNGALLQFLTGLLQVVFPPENEIEWEDLFVNPPSPEILKEAMTKAESAFELFGDGPRFMQDTNLNEEDTIFDISALFIESPGENTIKLKKDFFIKRNSISQICEKCAGIGLFSFQTNSPSGGQGHLTSIRGGGPLTTFVTSKLKNPKKNSLWSILWLNVLPKSYFQVNGHKKILFQSVFPWTNPKIEDLQSKGKTTTPQDLHPLSVYWSYPRRILLRKETENGVCDVCNRSSSVLVRSYHTRTYGLSYSEGGWIHPFSPYYKSKESWLPYHPQPGGILYHYWQTITLGKDQENQAALVIRRFLNRKIPGEQTSILTFGYDMDNMKARCWYESEIPFFNVPPDTIEKFEEQISQILNASAEVKKNLRQAVRNAWLDKKNDSKGDLTFLDVSFLKVTESPFYDLIRIVKETLISGITDLSTLKETWLNLLNESALKLFDQYADSGNFEFENIERIVNARRNLKTFNLGSKTRTTLGLIIPEKKSKRSKK

SEQ ID NO: 5773 - protein, 558 aa, Gardnerella vaginalis JCP8481B
MSRFNLLDEPWISVIVDEKGHNKLVSMTDVFKHSSEYKALAGDMKTQDFAVLRVLLAVLHTVFSRYDIQGNSREFDSDEDNEEDFNEDSMDIWREVWDSKQFPDAVLKYLEQWHDRFYLFDDKYPFFQVVKSDIDKEKIGGKSPSEMSGKNINRLISESNNKIAVFSPKDNVDNNKSSLTESQLARWIITLQSYAGLADKTIFGTEKYKACKGWLFDLGGIEIVGANLFETLMLNCVLVSEVQSPEKRQKPCWEYSGAENIENSFSDTFIDNVSQLYTRWSRAIYINPDISIDKPISVSIVKLPDINHKNAFIEPMTVWQYNKEGENKDSYTPRKHRLEESMWRSFGLLTSQELYDGSVKNHKPGIMEWLNKISKDIAGSFISLQAVSMKDDGNATSWVPADEICDCLYIDEVVVTDNADEGWVYRINREVEYTKSAIGFIYRQFLLDVCEIRNKNKDDANQYAAEHTNHVYFLVDQPFREWLANIKPKDSMNERCAQWRNTLHNILINEAEDMLRRATLRDFTGLHKVDEKSEKETTKNIIIAYNIFVSRLKKLSEK

SEQ ID NO: 5774 - protein, 558 aa, Gardnerella vaginalis JCP8481A; identical to SEQ ID NO: 5773

SEQ ID NO: 5775 - protein, 556 aa, Gardnerella vaginalis JCP8017A
MSRFNLLDEPWISVIVDEKGHNKLVSITDVFKNASEYKALAGDMKTQDFALLRILLAVLHTVFSRYDIQGNSREFDSDEEDKEDFNEETMNIWREVWNSKKFPDVVFKYLEQWHDRFYLFDDKYPFLQVLKQDIDSKKLGGKSPSEISGKNINRLISESNNKIAVFSPKDNVDNNKSSLTEAQLARWIITLQSYAGLADKTIFGTEKYKASKGWLFDLGGIEIVGANLFETLMLNCVLVGEIQSPEKRQKPCWEYSGTENVENSFYETFIDNISQLYTRWSRAIYINPDTSIDKPISVSIVKLPDINHKNAFIEPMTVWQYNKEGESKDKYTPRKHRAEESMWRSFGLLTLQESDDGILKNHKPGIMEWLNKIKHDIAGSSISLQAISMKDDGNATSWVPTDEICDTLHIDEVVVTDNADNGWVYRINNEVEYTRSAIGFIYRQFLLDICEIRNRNKDDATKYSAKYISQAYFLVDQPFREWLANIKPKDLMNERCTQWRNTLHSILINEAKGMLENATLRDFTGRPAMQSEKETTKNIVTAYSIFTSRLKKLSKK

SEQ ID NO: 5776 - protein, 579 aa, Gardnerella vaginalis JCP7672
MLILKKVVLYVLRVRKKTERNKKVSRFNLLDEPWISVIVDEKGHNKLVSMTDVFKHASEYKALAGDMKTQDFALLRVLLAALHTVFSRYDIQGNSREFDSGEDSEDDFNEETMDIWREVWNSKKFPDAVFKYLEQWHDHFYLFDDKYPFFQVLKQDIDSKKLGGKSPSEISGKNINRLISESNNKIAVFSPKDNVDNNKSSLTEPQLARWIITLQSYAGLADKTMFGTEKYKASKGWLFDLGGIYIEGENLFETLMLNCVLVDEMQSPEKKQKPCWEYSGTENIENSFYDTFIDNISQLYTRWSRAIYINPDISVDKPISVSIVKLPDINHKNAFIEPMTVWQYNKEGENKDKYTPRKHRTEEAMWRSFGLLTSQELYDGSVKNHKPGIMEWLNEIKHDIAGSSISLQAVSMKDDGNATSWVPTDEICDTLYIDEVVVTDNDDDGWVYRINNEVEYTRSAIGFIYKQFLLDICEIRNRNKDDATKYSAKHISQVYFLVDKPFREWLANIKPKDSMNERCTQWRNTLHNILINEAKGMLENATLRDFTGRPSDQSEKESTKNIVLAYNIFTSRLKKLSGK

SEQ ID NO: 5777 - protein, 556 aa, Gardnerella vaginalis JCP7659; identical to SEQ ID NO: 5775

SEQ ID NO: 5778 - protein, 553 aa, Gardnerella vaginalis JCP7275
MSRFNLLDEPWISVIVDKKGHNKLVSITDVFKHASEYKALAGDMKTQDFALLRILLAVLHTVFSRYDIQGNSREFDSAEDDEYDFNKETMNIWREVWNSKKFPDAVFKYLEQWHDRFYLFDDKYPFFQVPKQDIYSKKLSHKNPTELLGKNINRLISESKNKVAIFSPKCGENKSILNESQLARWLIAFQAYSSVPDKTKFGSEKYDSSKGWLFDLGGIYIEGENLFETLMLNCVLVGDVQSPEKRQKPCWEYSGAENIENSFYDTFIDNISQLYTRWSRAIYINPSIRMDKGISIYTVILLKLNNEDAFIEPMTVWLHNKKNKVEDTYIPRKHSAEESMWRSFGLLTSQESDDESVKNHKPGIMEWLNKISKDIVGSFISLHAISMKGDNSSSDIPIDEIYDNLHFHEVVFTDNTNDGWVRRINKEVEYTKSAIDFIYRQFLLDICEIRNRNKDDTTKYAAKYVSHAYFLVDQPFREWLANIRPNDSKNERCTQWRNTLYNILINEAEVMLKNATLRDFTGLVGEKSKKSPAKNIVIAYSIFTSRLKKLSEK

SEQ ID NO: 5779 - protein, 556 aa, Gardnerella vaginalis JCP8070
MSRFNLLDEPWISVIVDEKGHNKLVSITDVFKHASEYKALAGDMKTQDFVLLRILLAVLHTVFSRYDIQGNSREFDSNEDNEYYFNKETMNIWREFWNSKEFPDAVFKYLEQWHDRFYLFDDKYPFFQVLKQDIDSKKLGGKSPSEISGKNINRLISESNNKVAVFSPKDNVDNNKSSLSEAQLARWIITLQSYVGLADKTMFGTEKYKASKGWLFDLGGIYVEGENLFETLMLNCVLVGEMQSPEKRQKPCWEYSGAENIENSFYETFIDNISQLYTRWSRAIYINPDISIENPISVSIVKLPDINHKDAFIEPMTVWQYNKERENKDKYTPRKHKVEESMWRSFGLLTLQESDDGILKNHKPGIMEWLNKISKDIEGSSISLQAVSMKDDGNATSWVPTDEICDTLHIDEVVVTDNSDNGWVGRINNEVEYTRSAIGFIYRQFLLDICEIRNRNKDDATKYAGKCISHVYFLVDQPFRQWLANIKPKDSMNERCAQWRNTLHNILINEAKGMLENATLRDFTGRPVVQSEKESTKNIVTAYSIFTSRLKKLSKK

SEQ ID NO: 5780 - protein, 553 aa, Gardnerella vaginalis JCP8066
MSRFNLLDEPWISVIVDKKGHNKLVSITDVFKHASEYKALAGDMKTQDFALLRILLAVLHTVFSRYDIQGNSREFDSSEDDEYDFNKETMNIWREVWNSKKFPDAVFKYLEQWHDRFYLFDDKYPFFQVLKQDIYSKKLSHKNPTELLGKNINRLISESKNKIAIFSPKCGENKSILNESQLARWLIAFQAYSSVPDKTKFGSEKYDSSKGWLFDLGGIYIEGENLFETLMLNCVLVGEMQSPEKRQKPCWEYSGAENIENSFYDTFIDNISQLYTRWSRAIYINPDIRMDKGISIYTVILLKLNNEDAFIEPMTVWQYNKKGKNKDKYTPRKHKVEESMWRSFGLLTSQESDDGSVKNHKPGIMEWLNKISKDIAGSFISLHAISMKGDSSSSDIPIDEIYDNLYFHEVVFTDNTNDGWVCRINKEVEYTRSAIEFIYRQFLLDICEIRNRNKDDATKYSDKCISHVYFLVDEPFRQWLANIKPKDSMNERCIQWRNTLHSILINEAKSMLENATLRDFTGLVGEKSKKSPAKNIVIAYSIFTSRLKKLSEK

SEQ ID NO: 5781 - protein, 556 aa, Gardnerella vaginalis JCP8017B; identical to SEQ ID NO: 5775

SEQ ID NO: 5782 - protein, 518 aa, Salmonella enterica subsp. enterica serovar Dublin str. DG22; identical to SEQ ID NO: 5260

SEQ ID NO: 5783 - protein, 518 aa, Salmonella enterica subsp. enterica serovar Enteritidis str. 2009K0958; identical to SEQ ID NO: 5260

SEQ ID NO: 5784 - protein, 518 aa, Salmonella enterica subsp. enterica serovar Enteritidis str. 08-1080; identical to SEQ ID NO: 5260

SEQ ID NO: 5785 - protein, 518 aa, Salmonella enterica subsp. enterica serovar Enteritidis str. 2010K-0262; identical to SEQ ID NO: 5260

SEQ ID NO: 5786 - protein, 518 aa, Salmonella enterica subsp. enterica serovar Enteritidis str. 2009K1726; identical to SEQ ID NO: 5260

SEQ ID NO: 5787 - protein, 518 aa, Salmonella enterica subsp. enterica serovar Enteritidis str. 2009K1651; identical to SEQ ID NO: 5260

SEQ ID NO: 5788 - protein, 518 aa, Salmonella enterica subsp. enterica serovar Enteritidis str. 2010K-0267; identical to SEQ ID NO: 5260

SEQ ID NO: 5789 - protein, 518 aa, Salmonella enterica subsp. enterica serovar Enteritidis str. 2010K-0284; identical to SEQ ID NO: 5260

SEQ ID NO: 5790 - protein, 518 aa, Salmonella enterica subsp. enterica serovar Enteritidis str. 2010K-0271; identical to SEQ ID NO: 5260

SEQ ID NO: 5791 - protein, 518 aa, Salmonella enterica subsp. enterica serovar Enteritidis str. 2010K-0286; identical to SEQ ID NO: 5260

SEQ ID NO: 5792 - protein, 518 aa, Klebsiella pneumoniae DMC0799; identical to SEQ ID NO: 5332

SEQ ID NO: 5793 - protein, 507 aa, Klebsiella pneumoniae UHKPC179; identical to SEQ ID NO: 5538

SEQ ID NO: 5794 - protein, 518 aa, Salmonella enterica subsp. enterica serovar Typhimurium str. STm7; identical to SEQ ID NO: 5256

SEQ ID NO: 5795 - protein, 533 aa, Leptospira alexanderi serovar Manhao 3 str. L 60
MNLIKDVWIPAQRFSGKFEEISPFEITSQIENDSDPVVSLNAPRPDFNGALLQFLIGLLQAVFPPENETEWEDLFVNPPSPEVLKEAMEKVESAFELFGDGPRFMQDTNLNEEDTIFDISALFIESPGENTIKLKKDFFIKRDSISQICEKCAGIGLFSFQTNSPSGGQGHLTSIRGGGPLTTFVTSKLKNPKKNSLWSKLWLNVLPKSYFQVNGQKKIPFQSVFPWTNPKIKDLQTKGKTTTPKDLHPLSVYWSYPRRILLRKEDENGACDVCNRSSSVLVRSYHTKTYGLSYSDGGWIHPFSPYYKSKESWLPYHPQPGGILYHYWQTIALGKGQEDQAALVIRRSLNRKIPGEQTSILTFGYDMDNMKARCWYESEIPFFNIPSNKIEKFEEQVSQILNTSTEIKKNLRQAVRNAWFDKKNDTKGDLAFLDVSFLKDTESSFYDLIRNVKENLISGAADFAALKKNWLKLLNESACKLFDQYAESGNFEFENPKRIVEAKKNLKIFNLGSKTRNILGLNTPEKPSKRRKK

SEQ ID NO: 5796 - protein, 520 aa, Escherichia coli 95NR1; identical to SEQ ID NO: 5352

SEQ ID NO: 5797 - protein, 520 aa, Escherichia coli B107; identical to SEQ ID NO: 5363

SEQ ID NO: 5798 - protein, 520 aa, Escherichia coli B102; identical to SEQ ID NO: 5363

SEQ ID NO: 5799 - protein, 520 aa, Escherichia coli 09BKT076207; identical to SEQ ID NO: 5363

SEQ ID NO: 5800 - protein, 520 aa, Escherichia coli B26-1; identical to SEQ ID NO: 5363

SEQ ID NO: 5801 - protein, 520 aa, Escherichia coli B26-2; identical to SEQ ID NO: 5363

SEQ ID NO: 5802 - protein, 520 aa, Escherichia coli B28-2; identical to SEQ ID NO: 5363

SEQ ID NO: 5803 - protein, 520 aa, Escherichia coli B28-1; identical to SEQ ID NO: 5363

SEQ ID NO: 5804 - protein, 520 aa, Escherichia coli B29-1; identical to SEQ ID NO: 5363

SEQ ID NO: 5805 - protein, 520 aa, Escherichia coli B29-2; identical to SEQ ID NO: 5363

SEQ ID NO: 5806 - protein, 520 aa, Escherichia coli B36-1; identical to SEQ ID NO: 5363

SEQ ID NO: 5807 - protein, 520 aa, Escherichia coli B36-2; identical to SEQ ID NO: 5363

SEQ ID NO: 5808 - protein, 520 aa, Escherichia coli B7-1; identical to SEQ ID NO: 5363

SEQ ID NO: 5809 - protein, 520 aa, Escherichia coli B7-2; identical to SEQ ID NO: 5363

SEQ ID NO: 5810 - protein, 520 aa, Escherichia coli B93; identical to SEQ ID NO: 5363

SEQ ID NO: 5811 - protein, 520 aa, Escherichia coli B94; identical to SEQ ID NO: 5363

SEQ ID NO: 5812 - protein, 520 aa, Escherichia coli B95; identical to SEQ ID NO: 5363

SEQ ID NO: 5813 - protein, 520 aa, Escherichia coli TW07509; identical to SEQ ID NO: 5305

SEQ ID NO: 5814 - protein, 520 aa, Escherichia coli 08BKT055439; identical to SEQ ID NO: 5363

SEQ ID NO: 5815 - protein, 520 aa, Escherichia coli Bd5610_99; identical to SEQ ID NO: 5363

SEQ ID NO: 5816 - protein, 520 aa, Escherichia coli T1840_97; identical to SEQ ID NO: 5363

SEQ ID NO: 5817 - protein, 520 aa, Escherichia coli T234_00; identical to SEQ ID NO: 5363

SEQ ID NO: 5818 - protein, 520 aa, Escherichia coli 14A; identical to SEQ ID NO: 5363

SEQ ID NO: 5819 - protein, 520 aa, Escherichia coli T924_01; identical to SEQ ID NO: 5363

SEQ ID NO: 5820 - protein, 520 aa, Escherichia coli 2886-75; identical to SEQ ID NO: 5363

SEQ ID NO: 5821 - protein, 520 aa, Escherichia coli B103; identical to SEQ ID NO: 5363

SEQ ID NO: 5822 - protein, 520 aa, Escherichia coli B104; identical to SEQ ID NO: 5363

SEQ ID NO: 5823 - protein, 520 aa, Escherichia coli B105; identical to SEQ ID NO: 5363

SEQ ID NO: 5824 - protein, 520 aa, Escherichia coli B108; identical to SEQ ID NO: 5363

SEQ ID NO: 5825 - protein, 520 aa, Escherichia coli B106; identical to SEQ ID NO: 5363

SEQ ID NO: 5826 - protein, 520 aa, Escherichia coli B109; identical to SEQ ID NO: 5363

SEQ ID NO: 5827 - protein, 520 aa, Escherichia coli B112; identical to SEQ ID NO: 5363

SEQ ID NO: 5828 - protein, 520 aa, Escherichia coli B113; identical to SEQ ID NO: 5363

SEQ ID NO: 5829 - protein, 520 aa, Escherichia coli B114; identical to SEQ ID NO: 5363

SEQ ID NO: 5830 - protein, 520 aa, Escherichia coli B15; identical to SEQ ID NO: 5363

SEQ ID NO: 5831 - protein, 520 aa, Escherichia coli B17; identical to SEQ ID NO: 5363

SEQ ID NO: 5832 - protein, 520 aa, Escherichia coli B40-2; identical to SEQ ID NO: 5363

SEQ ID NO: 5833 - protein, 520 aa, Escherichia coli B40-1; identical to SEQ ID NO: 5363

SEQ ID NO: 5834 - protein, 520 aa, Escherichia coli B49-2; identical to SEQ ID NO: 5363

SEQ ID NO: 5835 - protein, 520 aa, Escherichia coli B5-2; identical to SEQ ID NO: 5363

SEQ ID NO: 5836 - protein, 520 aa, Escherichia coli B83; identical to SEQ ID NO: 5363

SEQ ID NO: 5837 - protein, 520 aa, Escherichia coli B84; identical to SEQ ID NO: 5363

SEQ ID NO: 5838 - protein, 520 aa, Escherichia coli B85; identical to SEQ ID NO: 5363

SEQ ID NO: 5839 - protein, 520 aa, Escherichia coli B86; identical to SEQ ID NO: 5363

SEQ ID NO: 5840 - protein, 520 aa, Escherichia coli 08BKT77219; identical to SEQ ID NO: 5363

SEQ ID NO: 5841 - protein, 520 aa, Escherichia coli 95JB1; identical to SEQ ID NO: 5352

SEQ ID NO: 5842 - protein, 520 aa, Escherichia coli 09BKT024447; identical to SEQ ID NO: 5363

SEQ ID NO: 5843 - protein, 520 aa, Escherichia coli T1282_01; identical to SEQ ID NO: 5363

SEQ ID NO: 5844 - protein, 520 aa, Escherichia coli B89; identical to SEQ ID NO: 5363

SEQ ID NO: 5845 - protein, 520 aa, Escherichia coli B90; identical to SEQ ID NO: 5363

SEQ ID NO: 5846 - protein, 520 aa, Escherichia coli Tx1686; identical to SEQ ID NO: 5363

SEQ ID NO: 5847 - protein, 520 aa, Escherichia coli Tx3800; identical to SEQ ID NO: 5363

SEQ ID NO: 5848 - protein, 520 aa, Escherichia coli O104:H21 str. CFSAN002236; identical to SEQ ID NO: 5261

SEQ ID NO: 5849 - protein, 518 aa, Salmonella enterica subsp. enterica serovar Heidelberg str. SARA33; identical to SEQ ID NO: 5258

SEQ ID NO: 5850 - protein, 520 aa, Escherichia coli O104:H21 str. CFSAN002237; identical to SEQ ID NO: 5261

SEQ ID NO: 5851 - protein, 519 aa, Salmonella enterica subsp. enterica serovar Muenchen str. RKS4129
MDNFSLLTTPWLPVRFKDGSTGKLAPVNLADENVVDIAATRADLQGAAWQFLLGLLQCSIAPKRYKNWEDIWFDGLHADALHKALAPLEHAFQFGAETPSFMQDFEELPDNKITIASLLPETPGIQTTELNTDHFIKRGVMECFCPHCAALALFSMQLNAPSGGQGYRTGLRGGGPLTTLIELQEYQGERQTPLWRKLWLNVMPQDAADLPLPVVYDAAVFPWLAATRTSEPPAHTITTDEQVNKLQAYWGMPRRIRLDFATIRQGVCNICGNNSDELLIQMLVKNYGVNYDRWRHPLTPHRLQIKNSKGFEPVITQPGGLLWRDWLGLSQENPTEKNTEYPAQVIKVFNARELRNIKVGLWGFGADFKKMKIRCWYEHHFPLLMTEGLIPDLRKATQTATRLLSLLRSALKEAWFANAKGARGDFSFIDIDFWNLTQGRFLNLIHDLENGHKPDERLNKWQRELWLFTRCYFDDHVFTNPYESSDLERIMKARKKYFTSSAEKQSAKAAKAKKQEAAE

SEQ ID NO: 5852 - protein, 556 aa, Actinomyces graevenitzii F0530
MKPPEYNLLDEPWVPVRLLDGTITEVGLLELLQRSTDIADLACELPTQNISIQRLVLAVAYRVATPLDAEEWLEQLEEGAPIEQMIEYLEKWRERFYLLGGQYPFMQVADLRTPKDTVLGLEKVIADVPNGEQFFTTRNGKALERISAAEAARWVVHTQAYDPSGIRSGAVGDREVKGGKGYPIGPAWCGHLGLVWLKGKNFNETLLLNLVPADAGDLKGVPVTTEWDWCTWEVSTPETSARGNYSRLDPKGTPRDLSIPRLLTWHSRRIKLIGDPSGVTSVVLAQGDKLAPQQMQRYEPQSLWRYSLPQSRDFKQDVYMPSKFKAGRALWRDLPGTLPVCEMIKGADKQPKREFLQSAVLSFHAELKSSMLAEGYPTQIQIQAVGVAYGPQEATVDDIYADELTLSVAMMRTEREDLATEVDRQARLTEQVAVTVGMLAANLARAAGESGDGAGNGARDRAKEQFFSRIDDPFRAWLAQVDGRLSALEVGQMWASELRRYATELGEQLVASASSSAIIGRDTGWGFMNVSIAENFFRSALQKLVPNPDNKQEGMK

SEQ ID NO: 5853 - protein, 555 aa, Actinomyces johnsonii F0510
MTQRFNLLDEPWIRVTRLDGAPDEVSLLTLFREATDIAGIHGEIASQDVAILRLLLAICHRAMDGPEDLDTWREYWEEPERLGRDASAYLERYRERFDLRDPDRPFFQVAGIHAASGKTSGLESLIVDVPNGNPFFTTRIAQGLESIGWAEAARWLVHVHAFDPSGIRTGAVGDPWVKGGKGYPIGPGWTGQIGTVTVTGESLERTLLLNTAVCEDLPDLVDVDPEQDLAPWEHENDGPAGSHDLEPTGPVSCYTWQTRRVLLHGDDAGVTGLFLGNGDKATPQNRYLVEPMTAWRFSEPQTKKFKTPVYMPRKLPTDRAFWRGLSTVVAQLSPKVTVKGAGEVTRYRSPGVVSFYQELMRRRIVPAGGLIPLRAVGIEYGAQEAVVTELVDDVLSLPAGLLDPENTRLLAVVHDAMEETEHAASALRNLAGNLDRARGGSPDTASAAREHASAAFYQVIDERFPRWLASLDAADPVRAREQWRRLLRSEAWEQQEALASAAPDTAFAGRGEGKGRMDVGKALFFFRRALNVAVPAPAQQDSTAENNKNEERTPA

SEQ ID NO: 5854 - protein, 550 aa, Actinobaculum sp. oral taxon 183 str. F0552
MKMTQSFNLLDEPWIRVTWLDGEPGEVSLLTAFRDAVRISGIHGEIASQDMALLRLLLAIAHRATGGPEDLDDWRAYWANPEKLRADAGDYLERYRDRFDLRDPEAPFFQVAGIHAKSGKISDLESLIADVPNGEPFFTTRIGPGLDRMGWAEAARWLVHVHAFDPSGIRSGAVGDPRVKGGKVYPIGPGWTGQIGVVAVEGRNLAETILLNTVVTESLADLAEVEHEADLPPWEKKPDGPAGSMDLEPIGPVSCYTWQTRRALLHGDEKGVTGLFLGNGDKATPRNRYLVEPMSAWRYSEPQTKKFKEIVFMPRKHDKDRAMWRGLSSLIPQLIPKLKIKGKGEFTRYRIPGVISFYEKLLAQEIVSHRGVIPVHAVGIEYGAQEAVVSEHFDDVLNLPAGLLAPDNKRLVTLVRDAMEKTEEVAKVVRQLGGDLIRARGGDPDDVSSAREKAGVAFYLAIDEGFPRWLASLDGIEPEAARDDWRNRLRSEARRQKENLVDSAPPAAYAGRGEGRSRIDVGLAMKWFDTALSRALPISIISQQAKEKDQ

SEQ ID NO: 5855 - protein, 555 aa, Actinomyces johnsonii F0542
MTQRFNLLDEPWIRVTRLDGAPDEVSLLTLFREATDIAGIHGEIASQDVAILRLLLAICHRAMDGPEDLDTWREYWEEPERLGRDASAYLERYRERFDLRDPDRPFFQVAGIHAASGKTSGLESLIVDVPNGNPFFTTRIAQGLESIGWAEAARWLVHVHAFDPSGIRTGAVGDPWVKGGKGYPIGPGWTGQIGTVTVTGESLERTLLLNTAVCEDLPDLVDVDPEQDLAPWEHENDGPAGSHDLEPTGPVSCYTWQTRRVLLHGDDAGVTGLFLGNGDKATPQNRYLVEPMTAWRFSEPQTKKFKTPVYMPRKLPTDRAFWRGLSTVVAQLSPKVTVKGAGEVTRYRSPGVVSFYQELMRRRIVPAGGLIPLRAVGIEYGAQEAVVTELVDDVLSLPAGLLDPENTRLLAVVHDAMEETEHAASALRNLAGNLDRARGGSPDTASAAREHASAAFYQVIDERFPRWLASLDEADPVRARDQWRRLLRSEAWEQQEALASAAPDTAFAGRGEGKGRMDVGKALFFFRRALNVAVPAPAQQDSTAENNKNEERTPA

SEQ ID NO: 5856 - protein, 556 aa, Actinomyces sp. oral taxon 172 str. F0311
MKNPEYNLLDEPWIPVRLLDGTIADVGLLELLRRTTEIADLACELPTQSIAIQRLVLAIAYRVAPPRDARDWVRQWDEGAPTEQMIEYLERWRDRFFLFGGRFPFMQVADLRTAKEAVSGLEKLIADVPNGEQFFTTRHGCALACIPPSEAARWLVHAQAYDPSGIRSGAVGDSQVKGGKGYPIGPSWCGHLGLVWLKGKDLDETLVLNLVPTDAAQLRGVESSTEWGACSWEVSEAESAVRGDYSLLDPSGTPRDISIPRLLTWHSRRVRLVGNREGVTGVVLAQGDKLAPQQMHRYEPQSLWRYSTPQSKKFKQDVYMPRKYEAGRALWRNLPGTLPTVTTVQGVDKQPKQEFLPSATLSFHYQLDNASIETAYPKVMRIQAVGVTYGPQEATFEDIYSDELTLSVAVMRVEHEDLSAEIDRQVRLTEEIARDVGNLAANLARAAGESGEGAGDGARDRAKELFFSAVDTDFRTWLTQVDGRESARDAGRRWECTLRQHATDVQAVLVRGASSSAIIGRDTGRGYMNVGIAENYFRAALNKHLPLQKTNQEGTK

SEQ ID NO: 5857 - protein, 554 aa, Actinomyces sp. oral taxon 877 str. F0543
MTDPDYNLLDEAWIPVRLLDGSVEKMGLLDVFRNTNEIADLACELPTQKIAIQRILLAVCYRVTSLKSVKEWKRQWAAGAPTEEAIAYLERWRDRFFLFGGDYPFMQAPGLWTRSGDIKMLDVLIADVPNNKRLFSMRHGKAIESIPPSEAAMWIVHAHAFDVSGIHSAAVDDSHSSGPRGFGIGPSWCGQNLIVLLKGDNLDETLVLNLVPRNHGGLKSRSSDDPGQGCTWEDASIETGDRIVLGKQQLNVDDISVPRLLTWHSRRVRLFGGRSGVTGAICCQGDELKGRNMFHYEPMGAWRYNLDASKKFRTPVYTPVPVNIGRAFWRDVPAVLHSVAEVEGVKGMKQRAYRSPAVVDFYYEADFESLPDFPPRVRMEAFGMKYGSNQSVYGDSYNDELPLSSALLKKGSDALGSLVESQVHCAEELANALGRFAANLARAAGQSGEGAGDGARSRAKEQFFALVDDPFRRWLARLDGDSDVDVVRDEWHGEVRRIVRLLAKRLVDEAPPSATIGRDTGMVFMNTGIAENFLWAAVNKTMPRTEDQVKEGEK

SEQ ID NO: 5858 - protein, 518 aa, Salmonella enterica subsp. enterica serovar Enteritidis str. 10-34587; identical to SEQ ID NO: 5260

SEQ ID NO: 5859 - protein, 557 aa, Streptococcus sobrinus W1703
MSRFNLLDEPWLSVVVDDKGSTKEVSLLDLFINAHQYKDLAGDTKTQDFAVLRVLLAVLHTVFSRFDADGNPYDYLEIDERFRQIEEVEEDDIDKYEEDLYDTWTNLWEQGKFPEIISQYLEKWRDRFYLFDDDYPFFQVKMKVLQKKFDLSNKLGELTGKTMNRLISESGNKAALFSPRADLDNNKEKLSEPEIVRWLLTYHSSTEVGGRLKSLGSTTSSGWLFRKGGIYFKGTNLFETLLMNCILPYKEYNNLKHTQKPCWEYEYLEIIQNYFDEVEPDNIASLYTTWSKGVDIDAKLNLPYFKCNIIKLPSINCEDYFLEPMTLWKYQDKIGKFIPKEHTINQSLWRSFGLLTENSSGKNYRTPGVINWFREIKNEIAKDKLVSICAVGVEMKSDANHTISDEITDYLFINEFVLADLEEGGWIPRINDTVEETKKVISRTYKRYIDDIKEIRKARSDLFTSQKVEELYFKIDQPFRQWLASLQPNDEKDTRVLEWREILDELVREEAELTLHSGGPRDYIGIVKRDPNKDSSEFINIATAYNKFNYCLNQNLK

SEQ ID NO: 5860 - protein, 573 aa, Peptostreptococcaceae bacterium oral taxon 113 str. W5053
MGKFNLLDEPWISVVIDTKGKTKEVSLKELFRNAHTYLDLAGDTKTQDFAVMRILLAIIHTVFSRFNAQGEEYGYFDLDERLRQVEKIDEEDVNDYREDLYMTWFALWKSQKFPEIVCEYLEKWRNRFYLFDEEHPFMQVRKEDIAADKINRPKASKVAGKNMNRLISESDNKIALFSPKYSVDDNKEKLKEAEIARWLITFQAYTGLSDKVIFGKEKYKSSKGWLFDLGGIYFKGSNLFEILLLNCVLVSDENGNVKNAQKPCWEFNCDENIKRSFYEGNMDSIAGLYTAWSRGLYMNPDFDNTNLFVCHIVKLPDIDHRDKFLEPMTIWKYNDSGDNKNTYTPRKHQQNQSMWRSFGLLAVNDKESNQRKPKLIEWFSDIKRIAKNKNITVHTHPTLVAVSMQDDGNATSWVPTDEIVDSLFIGDFILTDLEENGWVERINEVIEKTKSIVGFTYKKYISDIKEIRNISSDLFTSQKVEDLYFKIDAPFRKWIAEIRYEDEKEIKTKEWWSVLYKLTTWEAQSILQSGSLRDYTGIEREGKIKNIATAYNTFVYFLNKEIGVEEVTSGDKE

SEQ ID NO: 5861 - protein, 547 aa, Ruminococcus callidus ATCC 27760
MKEIEFNLLDEPWIRVRDDSCQVHEVSLTDALLHAHQYTSLSGELPTQDIVILRLMLAVLHTVFSRVDADGNAAELEDEEEAVERWTDLWELGQLPEEPIREYLEKWHERFWLFHPERPFGQVAGLACGTQYGASKLNGEISESGNKVRLFSSYFGEEKTALSYAQAARWLLYLNAFDDTSAKPTKEGKEKSGGKLPSPGAGWLGKLGIVFTRGKNLFETLLLNLVMVNGDQVENEEKPLWESDTVRREERTEIPFPDNLAELYTLQSRRVFLERENDTVIRYYLIGGDFFQKENAFMEPMTVWRTPKKEKDSYVPRRHDANKQMWRDFALLYDYKEGNHVAGVIQWVQRIAEEIDMQMVQTTIVSVQYGDKDFFVQNVFWDSLMVNKQLLIDIGANWREKIKVEINRCEQLADAIRKLAGNLYLASGGTKGDAKSWDKTFLKSRESASAQLYFRLDMPFRRWLAGITPEEVDSADYETEERVFSAWQKTAKTIAYSCAEELAMHAGDAAMVGHEIKNEKSGDSVRYSAPKAIHQFRIQVAEIYKKI

SEQ ID NO: 5862 - protein, 518 aa, Salmonella enterica subsp. enterica serovar Kentucky str. 29166
MDNFSLLTTPWLPVRFKDGSTGKLAPVNLADENVVDIAATRADLQGAAWQFLLGLLQCSIAPKRYKNWEDIWFDGLHADALHKALAPLEHAFQFGAETPSFMQDFEPLTGEKVSIASLLPETPGAQTTKFNKDHFIKRGVTERFCPHCAALALFSLQLNAPSGGKGYRTGLRGGGPLTTLVELQEYQGERQTPLWRKLWLNVMPQDTADLPLPDQCDAAIFPWLAATRTSEQANAVTTPEQVNKLQAYWGMPRRIRLDFATLQSGCCDICGAESDELLGFMTVKNYGVNYDGWRHPLTPYRAPVKDQNAFFSVKPQPGGLIWRDWLGLSQNNQTEANYESPAQVVKVFNARSLTDVKAGIWGFGADFDNMKIRCWYEHHFPLLMTEGLIPDLRKAVQTAARLLSLLRSALKEAWFANAKDARGDFSFIDIDFWNLTQGRFLNLIHDLENGHKPDERLNKWQRELWLFTRCYFDDRVFTNPYESSDLERIMKARKKYFTSSAEKQSAKAAKAKKQEAAE

SEQ ID NO: 5863 - protein, 518 aa, Salmonella enterica subsp. enterica serovar Kentucky str. 22694; identical to SEQ ID NO: 5862

SEQ ID NO: 5864 - protein, 518 aa, Salmonella enterica subsp. enterica serovar Kentucky str. 13562; identical to SEQ ID NO: 5862

SEQ ID NO: 5865 - protein, 518 aa, Salmonella enterica subsp. enterica serovar Kentucky str. N312; identical to SEQ ID NO: 5862

SEQ ID NO: 5866 - protein, 518 aa, Salmonella enterica subsp. enterica serovar Typhimurium str. CDC_2009K1288; identical to SEQ ID NO: 5256

SEQ ID NO: 5867 - protein, 518 aa, Salmonella enterica subsp. enterica serovar Kentucky str. 20793; identical to SEQ ID NO: 5862

SEQ ID NO: 5868 - protein, 518 aa, Salmonella enterica subsp. enterica serovar Typhimurium str. CDC_2009K1158; identical to SEQ ID NO: 5256

SEQ ID NO: 5869 - protein, 518 aa, Salmonella enterica subsp. enterica serovar Typhimurium str. CDC_2009K1283; identical to SEQ ID NO: 5256

SEQ ID NO: 5870 - protein, 519 aa, Salmonella enterica subsp. enterica serovar Newport str. #11-4; identical to SEQ ID NO: 5851

SEQ ID NO: 5871 - protein, 519 aa, Salmonella enterica subsp. enterica serovar Newport str. #11-3; identical to SEQ ID NO: 5851

SEQ ID NO: 5872 - protein, 518 aa, Salmonella enterica subsp. enterica serovar Typhimurium str. CDC_2009K1277; identical to SEQ ID NO: 5256

SEQ ID NO: 5873 - protein, 519 aa, Salmonella enterica subsp. enterica serovar Newport str. #11-2; identical to SEQ ID NO: 5851

SEQ ID NO: 5874 - protein, 485 aa, Salmonella enterica subsp. enterica serovar Typhimurium str. 34502
MVDIAATRADLQGAAWQFLLGLLQCSIAPKRYKNWEDIWFDGLHADVLHKALAPLEHAFQFGAETPSFMQDFEPLSGEKVSIASLLPEIPGAQTTKFNKDHFVKRGVTERFCPHCAALALFSLQLNAPAGGKGYRTGLRGGGPLTTLVELQEYQGERQTPLWRKLWLNVMPQDTADLPLPDQCDATVFPWLAATRTSEQANAVTTPEQVNKLQAYWGMPRRIRLDFATLQSGCCDICGAESDELLGFMTVKNYGVNYDGWRHPLTPYRAPVKDQNAFFSVKPQPGGLIWRDWLGLSQNNQTEANYESPAQVVKVFNARSLTDVKAGIWGFGADFDNMKIRCWYEHHFPLLMTEGLIPDLRKAVQTAARLLSLLRSALKEAWFADAKGARGDFSFIDIDFWNLTQGRFLNLIHDLENGHKPDERLNKWQRELWLFTRHYFDDHVFTNPYESSDLERIMTARKKYFTTSAEKQSAKAAKAKKQEAAE

SEQ ID NO: 5875 - protein, 485 aa, Salmonella enterica subsp. enterica serovar Typhimurium str. 35423; identical to SEQ ID NO: 5874

SEQ ID NO: 5876 - protein, 518 aa, Salmonella enterica subsp. enterica serovar Typhimurium str. 36618; identical to SEQ ID NO: 5256

SEQ ID NO: 5877 - protein, 520 aa, Escherichia coli 113303; identical to SEQ ID NO: 5296

SEQ ID NO: 5878 - protein, 543 aa, Escherichia coli 113290
MIYRKGWKDGQPTWDGLFYERMRMNSFSLLTTSWLPVRFKDGTTGKLAPVDLADENVVDIAAPRADLQGAAWQFLLGLLQTSFAPKDHRRWDDIWEDGLESEKLREALLSLEHAFQFGPDSPSFMQDFEALTGDKVQVASLLPEIPGAQTTKFNKDHFIKRGVTEYLCPHCSALALFSLQLNAPSGGKGYRTGLRGGGPMTTLIELQEYQGNQQTPLWRKLWLNVMPQDEADLPLPKKFDDLIFPWLGPTRTSELAGAVVTDDQVNKLQAYWGMPRRIRIDFNTTTVGNCDICGEQNDALLNLMTTKNYGANYAMWQHPLTPYRIPLKEGGEFYSVKPQPGGLIWRDWLGLIETGKSENNTELPALVVKLFNASSLKQAKVGLWGFGYDFDNMKARCWYEHHFPLLLNKKEGQIPKLRLAAQTASRILSLLRSALKEAWFSDPKGARGDFSFVDIDFWNKTQHRFLRLVRQIEEGQDPDELLGKWQKEIWLFARQDFDERVFTNPYEPVDLKRVMTARKKYFTTSAEKQNAKAAREKKQEAAE

SEQ ID NO: 5879 - protein, 522 aa, Escherichia coli 907357
MRMNSFSLLTTPWLPVRFKDGTTGKLAPVDLADENVVDIAAPRADLQGAVWQFLLGLLQTSFAPKNHGRWDDIWEDGLEAEKLREALQSLEHAFQFGPDSPSFMQDFEALKGDKVQVASLLPEIPGAQTTKFNKDHFIKRGVTEHVCPHCSALALFSLQLNAPSGGKGYRTGLRGGGPMTTLIELQEYQGNQQTPLWRKLWPNVMPQDEADLPLPKKFDDLVFPWLGPTRTSELAGAVVTHDQVNKLQAYWGMPRRIRIDFNTTTVGNCDICGEQSDALLSLMTTKNYGANYAMWQHPLTPYRIPLKEGGEFYSVKPQPGGLIWRDWLGLIETGKSENNTELPALVVKLFNASSLKQAKVGLWGFGYDFDNMKARCWYEHHFPLLLKKKEGQIPKLRLAAQTASRILSLLRSALKEAWFSDPKGARGDFSFVDIDFWNKTQHRFLRLVRQIEEGQDADELLGKWQKEIWLFARQDFDERVFTNPYEPVDLKRVMTARKKYFTTSAEKQSAKAAREKKQEAAE

SEQ ID NO: 5880 - protein, 522 aa, Escherichia coli 110957
MRMNSFSLLTTPWLPVRYKDGTTGKLAPVDLADENVVDIAAPRADLQGAAWQFLLGLLQTSFAPKDHRRWDDIWEDGLESEKLREALLSLEHAFQFGPDSPSFMQDFEALTGDKVQVASLLPEIPGAQTTKFNKDHFIKRGVTEYLCPHCSALALFSLQLNAPSGGKGYRTGLRGGGPMTTLIELQEYQGNQQTPLWRKLWLNVMPQDEADLPLPKKFDDLVFPWLGPTRTSELAGAVVTDDQVNKLQAYWGMPRRIRIDFNTTTVGNCDICGEQNDALLSLMTTKNYGANYAMWQHPLTPYRVPLKEGGEFYSVKPQPGGLIWRDWLGLIETGKSENNTELPALVVKLFNASSLKQAKVGLWGFGYDFDNMKARCWYEHHFPLLLDKKEGQIPKLRLAAQTASRILSLLRSALKEAWFSDPKGARGDFSFVDIDFWNKTQHRFLRLVRHIEEGQDADELLSKWQKEIWLFARQDFDERVFTNPYEPVDLKRVMTARKKYFTTSAEKQNAKAAREKKQEAAE

SEQ ID NO: 5881 - protein, 502 aa, Escherichia coli 909945-2
MNLLIDNWIPVRPQSGGKVQIINLQSLFCSKNQWRLSLPRDDMELAALALLVCIGQIIAPAKDDVEFRHRIMNPLSEDEFQRLIAPWIDMFYLNHAEHPFMQTKGVKANDVTPMEKLLAGVSGATNCAFVNQPGQGEALCGGCTAIALFNQANQAPGFGGGFKSGLRGGTPITTFVRGIDLRSTVLLNVLTIPRLQKQFPNESHTENQPTWIKPVKPNESVPASSIGFVRGLFWQPAHIELCDPIGIGKCSCCGQESNLRYTGFLKEKFTFTVNGLWPHPHSPCLVTVKKGEVEEKFLAFTTSAPSWTQISRVVVDKIIQNENGNRVAAVVNQFRNIASQSPLELIMGGYRNNQASILERRHDVLMFNQGWQQYGNVINEIVTVGLGYKTALRKALYTFAEGFKNKDFKGAGVSVHETAERHFYRQSELLILDVLANINFSQADEVIADLRDKLHQLCEMLFNQSVAPYAHHPKLISTLALARATLYKHLRELKPQGGPSNG

SEQ ID NO: 5882 - protein, 522 aa, Escherichia coli 907713; identical to SEQ ID NO: 5880

SEQ ID NO: 5883 - protein, 522 aa, Escherichia coli 113302
MRMNSFSLLTTPWLPVRFKDGTTGKLAPVDLADENVVDIAAPRADLQGAVWQFLLGLLQTSFAPKDHRRWDDIWEDGLEAEKLREALQSLEHAFQFGPDSPSFMQDFEALKGDKVQVASLLPEIPGAQTTKFNKDHFIKRGVTEHVCPHCSALALFSLQLNAPSGGKGYRTGLRGGGPMTTLIELQEYQGNQQTPLWRKLWPNVMPQDEADLPLPKKFDDLVFPWLGPTRTSELAGAVVTHDQVNKLQAYWGMPRRIRIDFNTTTVGNCDICGEQSDALLSLMTTKNYGANYAMWQHPLTPYRIPLKEGGEFYSVKPQPGGLIWRDWLGLIETGKSENNTELPALVVKLFNASSLKQAKVGLWGFGYDFDNMKARCWYEHHFPLLLKKKEGQIPKLRLAAQTASRILSLLRSALKEAWFSDPKGARGDFSFVDIDFWNKTQHRFLRLVRQIEEGQDADELLGKWQKEIWLFARQDFDERVFTNPYEPVDLKRVMTARKKYFTTSAEKQSAKAAREKKQEAAE

SEQ ID NO: 5884 - protein, 543 aa, Escherichia coli 907672
MIHKKGWKDGQPTRDGLFYERMRMNSFSLLTTPWLPVRFKDGTTGKLAPVDLADENVVDIAAPRADLQGAAWQFLLGLLQTSFAPKDHRRWDDIWEDGLEAEKLREALLSLEHAFQFGPDSSSFMQDFEALTGDKVPVASLLPEIPGSQTTKFNKDHFIKRGVTEYLCPHCLALALFSLQLNAPAGGKGYRTGLRGGGPMTTLIELQEYQGNQQTPLWRKLWLNVMPQDEADLPLPKKFDDLIFPWLGPTRTSELVGAVVTHDQVNKLQAYWGMPRRIRIDFNTTTVGNCDICDEQNDALLSLMTTKNYGANYAMWQHPLTPYRVPLKEGGEFYSVKPQPGGLIWRDWLGLIETGKSENNTELPALVVKLFNASSLKQAKVGLWGFGYDFDNMKARCWYEHHFPLLLNKKEGQIPKLRLAAQTASRILSLLRSALKEAWFSDPKGARGDFSFVDIDFWNKTQHRFLRLVRQIEEGQDADELLGKWQKEMWLFARQDFDERVFTNPYEPVDLKRVMTARKKYFTTSAEKQSAKAAREKKQEAAE

SEQ ID NO: 5885 - protein, 522 aa, Escherichia coli 907710; identical to SEQ ID NO: 5883

SEQ ID NO: 5886 - protein, 520 aa, Escherichia coli 907715; identical to SEQ ID NO: 5294

SEQ ID NO: 5887 - protein, 522 aa, Escherichia coli 907889; identical to SEQ ID NO: 5880

SEQ ID NO: 5888 - protein, 520 aa, Escherichia coli 908521; identical to SEQ ID NO: 5294

SEQ ID NO: 5889 - protein, 520 aa, Escherichia coli 908522; identical to SEQ ID NO: 5294

SEQ ID NO: 5890 - protein, 338 aa, Escherichia coli 908525
LQEYQGNQQTPLWRKLWLNVMPQDEADLPLPKKFDDLIFPWLGPTRTSELVGAVVTHDQVNKLQAYWGMPRRIRIDFNTTTVGNCDICDEQNDALLSLMTTKNYGANYAMWQHPLTPYRVPLKEGGEFYSVKPQPGGLIWRDWLGLIETGKSENNTELPALVVKLFNASSLKQAKVGLWGFGYDFDNMKARCWYEHHFPLLLNKKEGQIPKLRLAAQTASRILSLLRSALKEAWFSDPKGARGDFSFVDIDFWNKTQHRFLRLVRQIEEGQDADELLGKWQKEMWLFARQDFDERVFTNPYEPVDLKRVMTARKKYFTTSAEKQSAKAAREKKQEAAE

SEQ ID NO: 5891 - protein, 212 aa, Escherichia coli 908525
MIHKKGWKDGQPTRDGLFYERMRMNSFSLLTTPWLPVRFKDGTTGKLAPVDLADENVVDIAAPRADLQGAAWQFLLGLLQTSFAPKDHRRWDDIWEDGLEAEKLREALLSLEHAFQFGPDSSSFMQDFEALTGDKVPVASLLPEIPGSQTTKFNKDHFIKRGVTEYLCPHCLALALFSLQLNAPAGGKGYRTGLRGGGPMTTLIELQEYQGN

SEQ ID NO: 5892 - protein, 522 aa, Escherichia coli 908541
MRMNSFSLLTTPWLPVRFKDGTTGKLAPVDLADENVVDIAAPRADLQGAAWQFLLGLLQSSFAPKDYRRWDDIWEDGLEAEKLREALLSLEHAFQFGPDSPSFMQDFEVLMGDKVQVASLLPEIPGAQTTKFNKDHFIKRGVTEHVCSHCSALALFSLQLNAPSGGKGYRTGIRGGGPMTTLIELQEYQGNQQAPLWRKLWLNVMPQDEADLPLPKKFDDLVFPWLGPTRTSELAGAVVTDDQVNKLQAYWGMPRRIRIDFNTTTVGNCDICGEQDDALLSLMTTKNYGANYAMWQHPLTPYRVPLKEGGEFYSVKPQPGGLIWRDWLGLIETGKSENNTELPALVVKLFNASSLKQAKVGLWGFGYDFDNMKARCWYEHRFPLLLNKKEGQIPKLRLAAQTASRILSLLRSALKEAWFSDPKGARGDFSFVDIDFWNKTQHRFLRLVRQIEEGQDADGLLSKWNKEIWLFARQDFDERVFTNPYEPVDLKRVMTARKKYFTTSAEKQSAKAAREKKQEAAE

SEQ ID NO: 5893 - protein, 520 aa, Escherichia coli 908573; identical to SEQ ID NO: 5295

SEQ ID NO: 5894 - protein, 520 aa, Escherichia coli 908585; identical to SEQ ID NO: 5294

SEQ ID NO: 5895 - protein, 520 aa, Escherichia coli 908616; identical to SEQ ID NO: 5294

SEQ ID NO: 5896 - protein, 522 aa, Escherichia coli 908658; identical to SEQ ID NO: 5880

SEQ ID NO: 5897 - protein, 552 aa, Cutibacterium acnes HL042PA3; identical to SEQ ID NO: 5285

SEQ ID NO: 5898 - protein, 518 aa, Salmonella enterica subsp. enterica serovar Cubana str. CVM42234; identical to SEQ ID NO: 5257

SEQ ID NO: 5899 - protein, 550 aa, Frankia sp. CcI6
MNGFNLIDGQWIPVIKRGRRLEVGIRKALVDAHTIDGLALDDPLEAVAVLRQVLLPVVLDVFGAPRTDEEWSQRWEAGCFDRIIRKDRAEDEEGIESYLIRQAARFHLFHPTAPFAQVAGLRTAKDETKPVSLLVPRLASGNNVPLFSSRTENDPPSLTPAAAARALLAAHCWDTAAIKTGAADDPKVKTGKTMGNPTGPLGQFGIVLPLGETLFHTLMLSIPVLRHGLRQKDRPQWRSESSATSRWETRAPEGLLDLLTWQSRRIRLVPEADPTAVEDVSVRRVVLTAGDRLTGSVHALEPHTAWRQVDKPKADEPPVRPVRHQPGRSAWRGLEALLTTTPLSSDKVFAPTALSQLARLRDDGYVPDDLPLQVLTVGVKYGTQSAVIDEVMADEIPLPVTALARDSAVRETVLAVAAQAESLRIAANRLGDDLREAAGATDKLPWDKGQRLGEILIHSFNPTVHRLLAGLQQHPEDAKRAELAWRILARRLAWEVVDPVLSAAGPETFLGRDPGEPFGARLAGAEMSFRRTLNDVLGKDEDNRLALAAA

SEQ ID NO: 5900 - protein, 518 aa, Salmonella enterica subsp. enterica serovar Cubana str. 76814; identical to SEQ ID NO: 5257

SEQ ID NO: 5901 - protein, 518 aa, Salmonella enterica subsp. enterica serovar Give var. 15 str. CFSAN004343; identical to SEQ ID NO: 5256

SEQ ID NO: 5902 - protein, 518 aa, Salmonella enterica subsp. enterica serovar Montevideo str. CFSAN004346
MDNFSLLTTPWLPVRFKDGSTGKLAPVDLADENVVDIAATRADLQGAAWQFLLGLLQCSIAPKRYKNWEDIWFDGLHADVLHKALAPLEHAFQFGAESPSFMQDFEPLSGEKVSIASLLPEIPGAQTTKFNKDHFVKRGVTERFCPHCAALALFSLQLNAPAGGKGYRTGLRGGGPLTTLVELQEYQGERQTPIWRKLWLNVMPQDTADLPLPDQCDATVFPWLAATRTSEQANAVTTPEQVNKLQAYWGMPRRIRLDFATLQSGCCDICGAESDELLGFMTVKNYGVNYDGWRHPLTPYRAPVKDQNAFFSVKPQPGGLIWRDWLGLSQNNQTEANYESPAQVVKVFNARSLTDVKAGIRGFGADFDNMKIRCWYEHHFPLLMTEGLIPDLRKAVQTAARLLSLLRSALKEAWFTNAKDARGDFSFIDIDFWNLTQGRFLNLIHDLENGHKPDERLNKWQRELWLFTRCYFDDHVFTNPYESSDLERIMKARKKYFTSSAEKQSAKAAKAKKQGAAE

SEQ ID NO: 5903 - protein, 518 aa, Salmonella enterica subsp. enterica serovar Typhimurium var. Copenhagen str. 0084; identical to SEQ ID NO: 5256

SEQ ID NO: 5904 - protein, 446 aa, Escherichia coli ATCC BAA-2215
MNSFSLLTTPWLPVRFKDGTTGKLAPVDLADENVVDIAAPRADLQGAAWQFLLGLLQTSFAPKDQRRWDDIWEDGLEAEKLREALLSLEHAFQFGPDSPSFMQDFDELKVKATSIASLLPDAPGKQTKERNTDHFIKRDTTQHLCLHCVPLALFSIQLNAPIGGRGYYPGLRGGGPLTTLIELLEYQGNQQTPLWRKLWLNVMPQDEADLPLPKTFDDLVFPWLAPTRTSELDGAVVTDEQVNKLQAYWGMPRRIRIDFKTTSIGNCDICGRQSDALLGLMSLKNYGVQYVMWRHPLTPYRLPLKEGGDFYSVKPQPGGLIWRDWLGLIEVGNSKNNTELPAQVVKLLNASNLKQTRVGLWGFGFDFEDMKVRCWYEHHFPLLLNKKEDLIPKLRLAAQAASHILSLLHRALKEAWFSEKKTTKLDFGFVDIDFWNKTQHRFLRLV

SEQ ID NO: 5905 - protein, 520 aa, Escherichia coli ATCC BAA-2209; identical to SEQ ID NO: 5352

SEQ ID NO: 5906 - protein, 522 aa, Escherichia coli LAU-EC10
MRMNSFSLLTTPWLPVRYKDGTTGKLAPVDLADENVVDIAAPRADLQGAAWQFLLGLLQTSFAPKDQRRWDDIWEDGLEAEKLREALLSLDHAFQFGPDSPSFMQDFEALTGDKVPVASLLPEIPGVQTTKFNKDHFIKRGVTEHLCPQCSALALFSLQLNAPSGGKGYRTGLRGGGPMTTLIELQEYQGNQQTPLWRKLWLNVMPQDEADLPLPKKFDDLIFPWLGPTRTSELAGAVVTHDQVNKLQAYWGMPRRIRIDFNTTTVGNCDICDEQNDALLSLMTTKNYGANYAMWQHPLTPYRVPLKEGGEFYSVKPQPGGLIWRDWLGLIETGKSENNTELPALVVKLFNASSLKQAKVGLWGFGYDFDNMKARCWYEHHFPLLLNKKEGQIPKLRLAAQTASRILSLLRSALKEAWFSDPKGARGDFSFVDIDFWNKTQHRFLRLVRQIEEGQDADELLGKWQKEIWLFARQDFDERVFTNPYEPVDLKRVMTARKKYFTTSAEKQSAKAAREKKQEAAE

SEQ ID NO: 5907 - protein, 518 aa, Salmonella enterica subsp. enterica serovar Infantis str. 335-3; identical to SEQ ID NO: 5256

SEQ ID NO: 5908 - protein, 520 aa, Escherichia coli ATCC BAA-2196; identical to SEQ ID NO: 5261

SEQ ID NO: 5909 - protein, 520 aa, Escherichia coli ATCC BAA-2219; identical to SEQ ID NO: 5355

SEQ ID NO: 5910 - protein, 520 aa, Escherichia coli ATCC BAA-2193; identical to SEQ ID NO: 5261

SEQ ID NO: 5911 - protein, 520 aa, Escherichia coli ATCC BAA-2192; identical to SEQ ID NO: 5363

SEQ ID NO: 5912 - protein, 518 aa, Salmonella enterica subsp. enterica serovar Gallinarum/pullorum str. FCAV198; identical to SEQ ID NO: 5260

SEQ ID NO: 5913 - protein, 565 aa, Olsenella uli MSTE5
MDEMVSFNLIDEPWIRVRDDAGAVREVSLLELFSQAPRFRCLANDLPTQDFAILRVLLAILQRAISPMLDDLDEDVEPAEVWGRLWESPELPMKDIEAYLAKWHDRFDLFDPERPFMQVPDLRTSKDELSPVSKIIADVPDGDRLFSLRSGYNLDKLSFAEAARWLIHVQAFDTAGIKSGVVGDPNVKDGKSYPRGTGWAGNLGGVFIEGDTFRDTLLLNLIVRGDGDNEVFPDDDLPAWEQPLSRYGSLDKTSTGRADIFTWQSRRTRLVVQQGAVVGLVLTNGDKLESRNMHRTEPMTAWRRSPNQEKKLHQTPIYLPATHGSNRALWRGLSSLFSEDNQDDGPVRGFMPGVLAWAGFLASANGGRRLSHKNTLQIHGIGFEYGKRSSSVVESIDDAVLLSSFLLSPEGAPLVALACNCVDNTDKAVSALGSLAANLLIAAGGDQAGTTGLNNKAKAEAYFELDSLFRSWLASLGDGSNPADVRTQWNSQARELLNSRARGYVVGAGPNAVTGALKKGSRGMSDVWVTAAKAEAWFHAALKKALPLESDIERKEDFTDGKLER

SEQ ID NO: 5914 - protein, 555 aa, Streptococcus thermophilus TH985
MSRFNLLDEPWISVVYDEKGSTKDVSLQDLFTNAHQYKELAGDTKTQDFAVLRVLLAVLYTVFSRFDVDGNVYEYLTIDERWNQLEPVDEIDIENYEEALYETWEKLWTNKRFPNIVNQYLEKWRDRFYLLDENYPFFQVTKEEIAGDKISKTKASSILGKNINRIISESGNKIALFSPKDGENKNTLTAAELARWLITFQGYSGLSDKVIFGNEKYKSSKGWLFDIGAIYIKGNTLFETLLLNYISPYNECGNVENIQRPCWELESSDIIKSYLDEKVITNIASLYTVWSRGIYIDPDINLNKPFSFEIVKLPDINHRDNFLEPMTIWKYNVSGENRDSYTPKKHLLNQSLWRSFGLLSIKDTNLQHRKPGVIDWLTYIDDIIGNRLSNIVAISMQDDGNATSWLPTDEVIDSIFINDLVLTDLDEGGWVPRINEVVEETKKIISRTYKTYINDIKEIRNISNGSYNQQMVESLYFKIDQPFRQWLASIQPEDDKDSKIQEWRVLLKKIVKAEAEVILHQGGTRDYLGIQKDGRIKNIATAYNSFDFWLRQQLK

SEQ ID NO: 5915 - protein, 520 aa, Escherichia coli 1-176-05_S3_C1; identical to SEQ ID NO: 5356

SEQ ID NO: 5916 - protein, 518 aa, Salmonella enterica subsp. enterica serovar Aqua str. NVSL2001; identical to SEQ ID NO: 5256

SEQ ID NO: 5917 - protein, 502 aa, Escherichia coli str. K-12 substr. MG1655; identical to SEQ ID NO: 5235

SEQ ID NO: 5918 - protein, 502 aa, Escherichia coli str. K-12 substr. MG1655; identical to SEQ ID NO: 5235

SEQ ID NO: 5919 - protein, 502 aa, Thermus thermophilus HB8
MGSLEKFNLIDEPWIPVLKGGRVVEVGIGEALLRAHEFARIETPSPLEEAVLHRLLLAVLHRALSGPRCPEDVLDWWRKGGFPQDPIRDYLNRFRDRFFLFHPEAPFLQVADLPEENPLPWSKLLPELASGNNPTLFDHTTEENLPKATYAQAARALLVHQAFAPGGLLRRYGVGSAKDAPVARPALFLPTGQNLLETLLLNLVPYTPEDDAPIWEVPPLRLGDLEGARTKWPLTGRTRVYTWPARGVRLLDEGDGVRFMGYGPGVEPLEATHRDPMVAQRLDAKGNLLVLRLSEERSFWRDFSAMLPRQGGKVAATLEHAENLQGELEDEGLEGRITLRVLGQVSDQAKVLDIRREVYPLPSGLLTPKAEENLEKALKMAEELGQGLKHLAQEVAKAVVGERDRGHGRSPYLEELTKLANSLPLERLYWHALDGAFPRFFARVEEEASLDLWREALRGAALEAWKATRRFLGTGARHLKALAQGEQEFGRLLGELGEEVRT

SEQ ID NO: 5920 - protein, 555 aa, Streptococcus sp. oral taxon 058; identical to SEQ ID NO: 5338

SEQ ID NO: 5921 - protein, 555 aa, Streptococcus oralis
MSRFNLLDEPWISVVYDEKGTTKEVSLQELFINAHQYKDLAGDTKTQDFAVLRVLLAVLHTVFSRFDADGNVYEYLAVDERFKQIEPVEESDIADYQDDLYDTWIDLWESGKFPDIVSHYLEKWRDRFYLFDKEYPFFQVRKEDIVADKISKAKASSISGKNINRTISESENKLALFSPKNSKNKEQLTASEVIRWLLTFQGYSGLSDKVIFGKEKYKVSKGWLFDIGAVFIQGTSLFETLLLNCILPFYDHGNLESIQCPCWEFASSDNINRYLFGSECTDLANLYTIWSRGIYIDPEYDLNKPFSFEIVKLPEINHRDNFLEPMTTWKYNTTGENKDSYAPRKHLLNQSLWRSFGLLAVEDRTGHFRKPGIIDWLGDIGDIIGNRLFNIISISMQDDGNATSWLPTDEVIDSILINDLVLADFNESGWVPRINEVVEETKTVISKVYKRYIEDLKEIRNISNNNYTNQMVEMLYFKIDHPFREWLSSILPDDEKDPKIKEWRDLLKKMVKAEAKSILGHGGTRDYLGIEKDGRIKNIATAYNSFEYLLHQQLK

SEQ ID NO: 5922 - protein, 555 aa, Streptococcus oralis; identical to SEQ ID NO: 5324

SEQ ID NO: 5923 - protein, 555 aa, Streptococcus
MSRFNLLDEPWISVVYDEKGTTKEVSLQELFINAHQYKDLAGDTKTQDFAVLRVLLAVLHTVFSRFDADGNVYEYLAVDERFKQIEPVEESDIADYQDDLYDTWKDLWESGKFPDIVSHYLEKWRDRFYLFDKEYPFFQVRKEDIVADKISKAKASSISGKNINRTISESENKLALFSPKNGKNKEQLTASEVTRWLLTFQGYSGLSDKVIFGKEKYKVSKGWLFDIGAVFIQGTSLFETLLLNCILPFYDHGNLESIQCPCWEFASSDNINRYLFGSECTDLTNLYTIWSRGIYIDPEYDLNKPFSFEIVKLPEINHRDNFLEPMTTWKYNTTGENKDSYTPRKHLLNQSLWRSFGLLAVEDRTGHFRKPGIIDWLGDIGDIIGNRLFNIISISMQDDGNATSWLPTDEVIDSILINDLVLADFNESGWVPRINEVVEETKTVISKVYKRYIEELKEIRNISNNNYTNQMVEMLYFKIDHPFREWLSSILPDDEKDPKIKEWRDLLKKMVKAEAKSILGHGGTRDYLGIEKDGRIKNIATAYNSFEYLLHQQLK

SEQ ID NO: 5924 - protein, 520 aa, Escherichia coli; identical to SEQ ID NO: 5295

SEQ ID NO: 5925 - protein, 474 aa, Shigella sp. SF-2015
MAWQFLLGLLQTSFAPKDYRRWDDIWEDGLESEKLREALRSLEHAFQFGPDSPSFMQDFEVLTGDKVPVASLLPEIPGAQTTKFNKDHFIKRGVTEYLCPHCSALALFSLQLNAPSGGKGYRTGLRGGGPMTTLIELQEYQGNQQTPLWRKLWLNVMPQDEADLPLPKKFDDLIFPWLGPTRTSELAGAVVTDDQVNKLQAYWGMPRRIRIDFNTTTVGNCDICGEQSDALLSLMTTRNYGANYAMWQHPLTPYRVPLKEGGEFYSVKPQPGGLIWRDWLGLIETGKSENNTELPAMVVKLFNPSSLKQAKVGLWGFGYDFDNMKARCWYEHHFPLLLNKKEGQIPKLRLAAQTASRILSLLRSALKEAWFSDPKGTRGDFSFVDIDFWNKTQHRFLRLVRQIEDGQDADELLGKWQKEMWLFARQDFDERVFTSPYEPVDLKRVMTARKKYFTTSAEKQNAKAAREKKQEAVE

SEQ ID NO: 5926 - protein, 530 aa, Escherichia coli; identical to SEQ ID NO: 5304

SEQ ID NO: 5927 - protein, 519 aa, Salmonella enterica
MDNFSLLTTPWLPVRFKDGSTGKLAPVDLADENVVDIAATRADLQGAAWQFLLGLLQCSIAPKRYKNWEDIWFDGLHADALHKALAPLEHAFQFGAETPSFMQDFEELPDNKITIASLLPETPGIQTTELNTDHFIKRGVMECFCPHCAALALFSMQLNAPSGGQGYRTGLRGGGPLTTLIELQEYQGERQTPLWRKLWLNVMPQDAADLPLPVVYDAAVFPWLAATRTSEPPAHTITTDEQVNKLQAYWGMPRRIRLDFATIRQGVCNICGNNGDELLIQMLGKNYGVNYDRWRHPLTPHRLQIKNSKGFEPVITQPGGLLWRDWLGLSQENPTEKNTEYPAQVIKVFNARELRNIKVGLWGFGADFKKMKIRCWYEHHFPLLMTEGLIPDLRKATQTATRLLSLLRGALKEAWFANAKDARGDFSFIDIDFWNLTQGRFLNLIHDLENGHKPDERLNKWQRELWLFTRCYFDDHVFTNPYESSDLERIMKARKKYFTSSAEKQSAKAAKAKKQEAAE

SEQ ID NO: 5928 - protein, 519 aa, Salmonella enterica
MDNFSLLTTPWLPVRFKDGSTGKLAPVDLADENVVDIAATRADLQGAAWQFLLGLLQCSIAPKRYKNWEDIWFDGLHADALHKALAPLEHAFQFGAETPSFMQDFEELPDNKITIASLLPETPGIQTTELNTDHFIKRGVMECFCPHCAALALFSMQLNAPSGGQGYRTGLRGGGPLTTLIELQEYQGERQTPLWRKLWLNVMPQDAADLPLPVVYDAAVFPWLAATRTSEPPAHTITTDEQVNKLQAYWGMPRRIRLDFATIRQGVCNICGNNGDELLIQMLVKNYGVNYDRWRHPLTPHRLQIKNSKGFEPVITQPGGLLWRDWLGLSQENPTEKNTEYPAQVIKVFNARELRNIKVGLWGFGADFKKMKIRCWYEHHFPLLMTEGLIPDLRKATQTATRLLSLLRGALKEAWFANAKDARGDFSFIDIDFWNLTQGRFLNLIHDLENGHKPDERLNKWQRELWLFTRCYFDDHVFTNPYESSDLERIMKARKKYFTSSAEKQSAKAAKAKKQEAAE

SEQ ID NO: 5929 - protein, 519 aa, Salmonella; identical to SEQ ID NO: 5264

SEQ ID NO: 5930 - protein, 518 aa, Salmonella; identical to SEQ ID NO: 5260

SEQ ID NO: 5931 - protein, 518 aa, Salmonella enterica
MDNFSLLTTPWLPVRFKDGSTGKLAPVDLADENVVDIAATRADLQGAAWQFLLGLLQCSIAPKRYKNWEDIWFDGLHADVLHKALAPLEHAFQFGAESPSFMQDFEPLSGEKVSIASLLPEIPGAQTTKFNKDHFVKRGVTERFCPHCAALALFSLQLNAPAGGKGYRTGLRGGGPLTTLVELQEYQGERQTPIWRKLWLNVMPQDTADLPLPDQCDATVFPWLAATRTSEQANAVTTPGQVNKLQAYWGMPRRIRLDFATLQSGCCDICGAESDELLGFMTVKNYGVNYDGWRHPLTPYRAPVKDQNAFFSVKPQPGGLIWRDWLGLSQNNQTEANYESPAQVVKVFNARSLTDVKAGIRGFGADFDNMKIRCWYEHHFPLLMTEGLIPDLRKAVQTAARLLSLLRSALKEAWFTNAKDARGDFSFIDIDFWNLTQGRFLNLIHDLENGHKPDERLNKWQRELWLFTRCYFDDHVFTNPYESSDLERIMKARKKYFTSSAEKQSAKAAKAKKQEAAE

SEQ ID NO: 5932 - protein, 518 aa, Salmonella enterica; identical to SEQ ID NO: 5258

SEQ ID NO: 5933 - protein, 519 aa, Salmonella enterica
MDNFSLLTTPWLPVRFKDGSTGKLAPVDLADENVVDIAATRADLQGAAWQFLLGLLQCSIAPKRYKNWEDIWFDGLHADVLHKALAPLEHAFQFGAETPSFMQDFEELPDNKITIASLLPETPGIQTTELNTDHFIKRGVMECFCPHCAALALFSMQLNAPSGGQGYRTGLRGGGPLTTLIELQEYQGERQTPLWRKLWLNVMPQDAADLPLPVVYDAAVFPWLAATRTSEPPAHTITTDEQVNKLQAYWGMPRRIRLDFATIRQGVCNICGNNSDELLIQMLVKNYGVNYDRWRHPLTPHRLQIKNSKGFEPVITQPGGLLWRDWLGLSQENPTEKNTEYPAQVIKVFNARELRNIKVGLWGFGADFKKMKIRCWYEHHFPLLMTEGLIPDLRKATQTATRLLSLLRSALKEAWFANAKGARGDFSFIDIDFWNLTQGRFLNLIHDLENGHKPDERLNKWQRELWLFTRCYFDDHVFTNPYESSDLERIMTARKKYFTTSAEKQSAKAAKAKKQEAAE

SEQ ID NO: 5934 - protein, 518 aa, Salmonella; identical to SEQ ID NO: 5256

SEQ ID NO: 5935 - protein, 518 aa, Salmonella enterica
MDNFSLLTTPWLPVRFKDGSTGKLAPVDLADENVVDIAATRADLQGAAWQFLLGLLQCSIAPKRYKNWEDIWFDGLRADALHKALAPLEHAFQFGPESPSFMQDFEPLTGEKVSIASLLPETPGVQTTKFNKDHFIKRGVTERFCPHCAALALFSLQLNAPSGGKGYRTGLRGGGPLTTLVELQEYQGERQTPLWRKLWLNVMPQDTADLPLPDQCDAAIFPWLAATRTSEQANAVTTPEQVNKLQAYWGMPRRIRLDFATLQSGCCDICGAESDELLGFMTVKNYGVNYDGWRHPLTPYRAPVKDQNAFFSVKPQPGGLIWRDWLGLSQNNQTEANYESPAQVVKVFNARSLTDVKAGIWGFGADFDNMKIRCWYEHHFPLLMTEGLIPDLRKATQTATRLLSLLRGALKEAWFTNAKDARGDFSFIDIDFWNLTQGRFLNLIHDLENGHKPDERLNKWQRELWLFTRRYFDDRVFTNPYESSDLKRIMTARKKYFTSSAEKQSAKAAKAKKQEAAE

SEQ ID NO: 5936 - protein, 519 aa, Salmonella; identical to SEQ ID NO: 5851

SEQ ID NO: 5937 - protein, 519 aa, Salmonella enterica
MDNFSLLTTPWLPVRFKDGSTGKLAPVNLADENVVDIAATRADLQGAAWQFLLGLLQCSIAPKRYKNWEDIWFDGLHADALHKALAPLEHAFQFGAETPSFMQDFEELPDNKITIASLLPETPGIQTTELNTDHFIKRGVMECFCPHCAALALFSMQLNAPSGGQGYRTGLRGGGPLTTLIELQEYQGERQTPLWRKLWLNVMPQDAADLPLPVVYDAAVFPWLAATRTSEPPAHTITTDEQVNKLQAYWGMPRRIRLDFATIRQGVCNICGNNSDELLIQMLVKNYGVNYDRWRHPLTPHRLQIKNSKGFEPVITQPGGLLWRDWLGLSQENPTEKNTEYPAQVIKVFNARELRNIKVGLWGFGADFKKMKIRCWYEHHFPLLMTEGLIPDLRKATQTATRLLSLLRSALKEAWFSNAKGARGDFSFIDIDFWNLTQGRFLNLIHDLENGHKPDERLNKWQRELWLFTRCYFDDHVFTNPYESSDLERIMKARKKYFTSSAEKQSAKAAKAKKQEAAE

SEQ ID NO: 5938 - protein, 518 aa, Salmonella enterica; identical to SEQ ID NO: 5862

SEQ ID NO: 5939 - protein, 518 aa, Salmonella
MDNFSLLTTPWLPVRFKDGSTGKLAPVNLADENVVDIAATRADLQGAAWQFLLGLLQCSIAPKRYKNWEDIWFDGLHADVLHKALAPLEHAFQFGAETPSFMQDFEPLTGEKVSIASLLPETPGAQTTKFNKDHFIKRGVTERFCPHCAALALFSLQLNAPSGGKGYRTGLRGGGPLTTLVELQEYQGERQTPLWRKLWLNVMPQDTADLPLPDQCDAAIFPWLAATRTSEQANAVTTPEQVNKLQAYWGMPRRIRLDFATLQSGCCDICGAESDELLGFMTVKNYGVNYDGWRHPLTPYRAPVKDQNAFFSVKPQPGGLIWRDWLGLSQNNQTEANYESPAQVVKVFNARSLTDVKAGIWGFGADFDNMKIRCWYEHHFPLLMTEGLIPDLRKAVQTAARQLSLLRSALKEAWFANAKDARGDFSFIDIDFWNLTQGRFLNLIHDLENGHKPDERLNKWQRELWLFTRRYFDDRVFTNPYESSDLERIMKARKKYFTSSAEKQSAKAAKAKKQEAAE

SEQ ID NO: 5940 - protein, 518 aa, Salmonella enterica
MFPINLLTTPWLPVRFKDGSTGKLAPVNLADENVVDIAATRADLQGAAWQFLLGLLQCSIAPKRYKNWEDIWFDGLHADALHKALAPLEHAFQFGAETPSFMQDFEPLTGEKVSIASLLPETPGAQTTKFNKDHFIKRGVTERFCPHCAALALFSLQLNAPSGGKGYRTGLRGGGPLTTLVELQEYQGERQTPLWRKLWLNVMPQDVADLPLSDQCDAAVFPWLAATRTSEQANAVTTPDQVDKLQAYWGMPRRIRLDFATLQSGCCDICGAESDELLGFMTAKNYGVNYDGWRHPLTPYRAPVKDQNAFFSVKPQPGGLIWRDWLGLSQNNQTEANYESPAQVVKVFNARRLRDVKAGVWGFGADFDNMKIRCWYEHHFPLLMTEGLIPDLRKATQTATRLLSLLRGALKEAWFANAKDARGDFSFIDIDFWNLTQGRFLNLIHDLENGHKPDERLNKWQRELWLFTRCYFDDHVFTNPYESSDLERIMKARKKYFTSSAEKQSAKAAKAKKQEAAE

SEQ ID NO: 5941 - protein, 516 aa, Salmonella enterica
MGSLLTTPWLPVRFKDGSTGKLAPVNLADENVVDIAATRADLQGAAWQFLLGLLQCSIAPKNSARWEDIWFDGLHADALHKALAPLEHAFQFGAESPSFMQDFEPLTGEKVSIASLLPEIPGAQTTKFNKDHFVKRGVTERFCPHCAALALFSLQLNAPAGGKGYRTGLRGGGPLTTLVELQEYQGERQTPLWRKLWLNVMPQDTADLPLPDQCDATVFPWLAATRTSEQANAVTTPEQVNKLQAYWGMPRRIRLDFATLQSGCCDICGAESDELLGFMTVKNYGVNYDGWRHPLTPYRAPVKDQNAFFSVKPQPGGLIWRDWLGLSQNNQTEANYESPAQVVKVFNARSLTDVKAGIWGFGADFDNMKIRCWYEHHFPLLMTEGLIPDLRKATQTATRLLSLLRSALKEAWFANAKDARGDFSFIDIDFWNLTQGRFLNLIHDLENGQNPDERLNKWQRELWLFARRYFDDHVFTNPYESSDLKRIMTTRKKYFTSSAEKQSAKAAKAKKQEAAE

SEQ ID NO: 5942 - protein, 518 aa, Salmonella bongori
MKSFSLLTSCWLPVRFKDGSMGKMAPVDLADENVVDIAATRADLQGAAWQFLLGVLQCSIAPKNSARWEDIWEDGLTEPMLREALAPLEHAFQFGAETPSFMQDFEPLTGEKVSIASLLPETPGAQTTKFNKDHFVKRGVTERFCPHCAALALFSLQLNAPSGGKGYRTGLRGGGPMTTLIELQMYQGERQTPLWRKLWLNVMPQDAADLPLPAACDASVFPWLAATRTSEQASAITTPEHVNKLQAYWGMPRRIRLDFTTTQSGACDICGTNSDDLLSVMTVKNYGVNYDGWRHPLTPYRLPVKEGSGFFSVKPQPGGLIWRDWLGLSQENQTEANKEYPAQVVKVFNARRLKGVKAGLWGFGADFDNMKIRCWYEHHFPLLMTEGLMPDLRKATQTAARLLSLLRSALKEAWFANAKDARGDFSFIDIDFWNLTQGDFLNLIRDLENGGEPDELLTKWRRELWLFTRRYFDDRVFTNPYESNDLKRIMTARKKYFTTSAEKQSAKAARAKKQEAAE

SEQ ID NO: 5943 - protein, 520 aa, Escherichia coli; identical to SEQ ID NO: 5434

SEQ ID NO: 5944 - protein, 520 aa, Enterobacteriaceae; identical to SEQ ID NO: 5354

SEQ ID NO: 5945 - protein, 520 aa, Escherichia coli
MNSFSLLTTPWLPVRFKDGTTGKLAPVDLADENVVDIAAPRADLQGAAWQFLLGLLQSSFAPKDYRRWDDIWEDGLEAEKLREALLSLEHAFQFGPDSPSFMQDFEVLMGDKVQVASLLPEIPGAQTTKFNKDHFIKRGVTEHVCSHCSALALFSLQLNAPSGGKGYRTGLRGGGPMTTLIELQEYQGNQQAPLWRKLWLNVMPQDEADLPLPKKFDDLVFPWLGPTRTSELAGAVVTDDQVNKLQAYWGMPRRIRIDFNTTTVGNCDICGEQDDALLSLMTTKNYGANYAMWQHPLTPYRVPLKEGGEFYSVKPQPGGLIWRDWLGLIETGKSENNTELPALVVKLFNASSLKQAKVGLWGFGYDFDNMKARCWYEHRFPLLLNKKEGQIPKLRLAAQTASRILSLLRSALKEAWFSDPKGARGDFSFVDIDFWNKTQHRFLRLVRQIEEGQDADELLSKWNKEIWLFSRQDFDERVFTNPYEPVDLKRVMTARKKYFTTSAEKQSAKAAREKKQEAAE

SEQ ID NO: 5946 - protein, 520 aa, Escherichia coli
MNSFSLLTTPWLPVRFKDGTTGKLAPVDLADENVVDIAAPRADLQGAAWQFLLGLLQSSFAPKDYRRWDDIWEDGLEAEKLREALLSLEHAFQFGPDSPSFMQDFEVLMGDKVQVASLLPEIPGAQTTKFNKDHFIKRGVTEHVCSHCSALALFSLQLNAPSGGKGYRTGLRGGGPMTTLIELQEYQGNQQAPLWRKLWLNVMPQDEADLPLPKKFDDLVFPWLGPTRTSELAGAVVTDDQVNKLQAYWGMPRRIRIDFNTTTVGNCDICGEQSDALLSLMTTKNYGANYAMWQHPLTPYRVPLKEGGEFYSVKPQPGGLIWRDWLGLIETGKSENNTELPALVVKLFNASSLKQAKVCLWGFGYDFDNMKARCWYEHHFPLLLNKKEGQIPKLRLAAQTASRILSLLRSALKEAWFSDPKGARGDFSFVDIDFWNKTQHRFLRLVRQIEEGQDADELLGKWQKEIWLFARQDFDERVFTNPYEPVDLERVMTARKKYFTTSAEKQSAKAAREKKQEAAE

SEQ ID NO: 5947 - protein, 520 aa, Escherichia coli; identical to SEQ ID NO: 5386

SEQ ID NO: 5948 - protein, 520 aa, Escherichia coli
MNSFSLLTTPWLPVRFKDGTTGKLAPVDLADENVVDIAAPRADLQGAAWQFLLGLLQSSFAPKDYRRWDDIWEDGLEAEKLREALLSLEHAFQFGPDSPSFMQDFEVLMGDKVQVASLLPEIPGAQTTKFNKDHFIKRGVTEHVCSHCSALALFSLQLNVPSGGKGYRTGLRGGGPMTTLIELQEYQGNQQAPLWRKLWLNVMPQDEADLPLPKKFDDLVFPWLGPTRTSELAGAVVTDDQVNKLQAYWGMPRRIRIDFNTTTVGNCDICGEQSDALLSLMTTKNYGANYAMWQHPLTPYRVPLKEGGEFYSVKPQPGGLIWRDWLGLIETGKSENNTELPALVVKLFNASSLKQAKVGLWGFGYDFDNMKARCWYEHHFPLLLNKKEGQIPKLRLAAQTASRILSLLRSALKEAWFSDPKGARGDFSFVDIDFWNKTQHRFLRLVRQIEEGQDADELLGKWQKEIWLFARQDFDERVFTNPYEPVDLERVMTARKKYFTTSAEKQSAKAAREKKQEAAE

SEQ ID NO: 5949 - protein, 520 aa, Escherichia coli; identical to SEQ ID NO: 5431

SEQ ID NO: 5950 - protein, 520 aa, Escherichia coli; identical to SEQ ID NO: 5363

SEQ ID NO: 5951 - protein, 520 aa, Escherichia coli
MNSFSLLTTPWLPVRFKDGTTGKLAPVDLADENVVDIAAPRADLQGAAWQFLLGLLQTSFAPKDHRRWDDIWEDGLEAEKLREALLSLEHAFQFGPDSPSFMQDFEALTGDKIPVASLLPEIPGAQTTKFNKDHFIKRGVTEYLCPHCSALALFSLQLNAPSGGKGYRTGLRGGGPMTTLIELQEYQGNQQTPLWRKLWLNVMPQDEADLPLPKKFDDLIFPWLGPTRTSELAGAVVTHDQVNKLQAYWGMPRRIRIDFNTTTVGNCDICGEQNDSLLSLMTTKNYGANYAMWQHPLTPYRVPLKEGGEFYSVKPQPGGLIWRDWLGLIETGKSENNTELPALVVKLFNASSLKQTKVGLWGFGYDFDNMKARCWYEHHFPLLLNKKEGQIPKLRLVAQTASRILSLLRSALKEAWFSDPKGARGDFSFVDIDFWNKTQHRFLRLVRQIEEGQDADELLGKWQKEIWLFARQDFDERVFTNPYEPVDLKRVMTARKKYFTTSAEKQSAKAAREKKQEAAE

SEQ ID NO: 5952 - protein, 520 aa, Bacteria; identical to SEQ ID NO: 5296

SEQ ID NO: 5953 - protein, 520 aa, Escherichia coli; identical to SEQ ID NO: 5347

SEQ ID NO: 5954 - protein, 446 aa, Escherichia coli; identical to SEQ ID NO: 5904

SEQ ID NO: 5955 - protein, 520 aa, Enterobacteriaceae; identical to SEQ ID NO: 5350

SEQ ID NO: 5956 - protein, 520 aa, Escherichia coli
MNSFSLLTTPWLPVRFKDGTTGKLAPVDLADENVVDIAAPRADLQGAAWQFLLGLLQTSFAPKDQRRWDDIWEDGLEAEKLREALLSLEHAFQFGPDSPSFMQDFDELKVKATSIASLLPDAPGKQTKERNTDHFIKRDTTQHLCLHCVPLALFSIQLNAPIGGRGYYPRLRGGGPLTTLIELLEYQGNQQTPLWRKLWLNVMPQDEADLPLPKTFDDLVFPWLAPTRTSELDGAVVTDEQVNKLQAYWGMPRRIRIDFKTTSIGNCDICGRQSDALLGLMSLKNYGVQYVMWRHPLTPYRLPLKEGGDFYSVKPQPGGLIWRDWLGLIEVGNSKNNTELPAQVVKLLNASNLKQTRVGLWGFGFDFEDMKVRCWYEHHFPLLLNKKEDLIPKLRLAAQAASHILSLLHRALKEAWFSEKKTTKLDFGFVDIDFWNKTQHRFLRLVRKIEEGQDPYELLSKWQKEMWLFARQDFDDRVFTNPYEPVDLERVMTARKKYFTTSAEKQNANAAREKKQEAAE

SEQ ID NO: 5957 - protein, 520 aa, Enterobacteriaceae
MNSFSLLTTPWLPVRFKDGTTGKLAPVDLADENVVDIAAPRADLQGAAWQFLLGLLQTSFAPKDQRSWDDIWEDGLEAEKLREALLSLEHAFQFGPDSPSFMQDFDELKVKATFIASLLPDAPGKQTKERNTDHFIKRDTTQHLCLHCVPLALFSIQLNAPIGGRGYYPGLRGGGPLTTLIELLEYQGNQQTPLWRKLWLNVMPQDEADLPLPKTFDDLVFPWLAPTRTSELDGAVVTDEQVNKLQAYWGMPRRIRIDFKTTSIGNCDICGRQSDALLGLMSLKNYGVQYVMWRHPLTPYRLPLKEGGDFYSVKPQPGGLIWRDWLGLIEVGNSKNNTELPAQVVKLLNASNLKQTRVGLWGFGFDFEDMKVRCWYEHHFPLLLNKKEDLIPKLRLAAQAASHILSLLHRALKEAWFSEKKTTKLDFGFVDIDFWNKTQHRFLRLVRKIEEGQDPDELLSKWQKEMWLFARQDFDDRVFTNPYEPVDLERVMTARKKYFTTSAEKQNANAAREKKQEAAE

SEQ ID NO: 5958 - protein, 520 aa, Escherichia coli
MNSFSLLTTPWLPVRFKDGTTGKLAPVDLADENVVDIAAPRADLQGAAWQFLLGLLQTSFAPKNHGRWDDIWEDGLEAEKLREALLSLEHAFQFGADSPSFMQDFEALKGDKVQVASLLPEIPGAQTTKFNKDHFIKRGVTEHVCPHCSALALFSLQLNAPSGGKGYRTGLRGGGPMTTLIELQEYQGNQQTPLWRKLWPNVMPQDEADLPLPKKFDDLVFPWLGPTRTSELADAVVTHDQVNKLQAYWGMPRRIRIDFNTTTVGNCDICGEQSDALLSLMTTKNYGANYAMWQHPLTPYRIPLKEGGEFYSVKPQPGGLIWRDWLGLIETGKSENNTELPALVVKLFNASSLKQAKVGLWGFGYDFDNMKARCWYEHHFPLLLKKKEGQIPKLRLAAQTASRILSLLRSALKEAWFSDPKGARGDFSFVDIDFWNKTQHRFLRLVRQIEEGQDADELLGKWQKEIWLFARQDFDERVFTNPYEPVDLKRVMTACKKYFTTSAEKQSAKAAREKKQEAAE

SEQ ID NO: 5959 - protein, 520 aa, Enterobacteriaceae; identical to SEQ ID NO: 5635

SEQ ID NO: 5960 - protein, 520 aa, Escherichia coli
MNSFSLLTTPWLPVRFKDGTTGKLAPVDLADENVVDIAAPRADLQGAAWQFLLGLLQTSFAPKNHGRWDDIWEDGLEAEKLREALLSLEHAFQFGADSPSFMQDFEALKGDKVQVASLLPEIPGAQTTKFNKDHFIKRGVTEHVCPHCSALALFSLQLNAPSGGKGYRTGLRGGGPMTTLIELQEYQGNQQTPLWRKLWPNVMPQDEADLPLPKKFDDLVFPWLGPTRTSELAGAVVTHDQVNKLQAYWGMPRRIRIDFNTTTVGNCDICGEQSDALLSLMTTKNYGANYAMWQHPLTPYRIPLKEGGEFYSVKPQPGGLIWRDWLGLIETGKSENNTELPALVVKLFNVSSLKQAKVGLWGFGYDFDNMKARCWYEHHFPLLLKKKEGQIPKLRLAAQTASRILSLLRSALKEAWFSDPKGARGDFSFVDIDFWNKTQHRFLRLVRQIEEGQDADELLGKWQKEIWLFARQDFDERVFTNPYEPVDLKRVMTARKKYFTTSAEKQSAKAAREKKQEAAE

SEQ ID NO: 5961 - protein, 520 aa, Escherichia coli
MNSFSLLTTPWLPVRFKDGTTGKLAPVDLADENVVDIAAPRADLQGAAWQFLLGLLQTSFAPKNHGRWDDIWQDGLEAEKLREALLSLEHAFQFGADSPSFMQDFEALKGDKVQVASLLPEIPGAQTTKFNKDHFIKRGVTEHVCPHCSALALFSLQLNAPSGGKGYRTGLRGGGPMTTLIELQEYQGNQQTPLWRKLWPNVMPQDEADLPLPKKFDDLVFPWLGPTRTSELAGAVVTHDQVNKLQAYWGMPRRIRIDFNTTTVGNCDICGEQSDALLSLMTTKNYGANYAMWQHPLTPYRIPLKEGGEFYSVKPQPGGLIWRDWLGLIETGKSENNTELPALVVKLFNASSLKQAKVGLWGFGYDFDNMKARCWYEHHFPLLLKKKEGQIPKLRLAAQTASRILSLLRSALKEAWFSDPKGARGDFSFVDIDFWNKTQHRFLRLVRQIEEGQDADELLGKWQKEIWLFARQDFDERVFTNLYEPVDLKRVMTARKKYFTTSAEKQSAKAAREKKQEAAE

SEQ ID NO: 5962 - protein, 520 aa, Enterobacteriaceae; identical to SEQ ID NO: 5261

SEQ ID NO: 5963 - protein, 520 aa, Escherichia coli
MNSFSLLTTPWLPVRFKDGTTGKLAPVDLADENVVDIAAPRADLQGAAWQFLLGLLQTSFAPKNHGRWDDIWQDGLEAEKLREALLSLEHAFQFGADSPSFMQDFEALKGDKVQVASLLPEIPGAQTTKFNKDHFIKRGVTEHVCPHCSALALFSLQLNAPSGGKGYRTGLRGGGPMTTLIELQEYQGNQQTPLWRKLWPNVMPQDEADLPLPKKFDDLVFPWLGPTRTSELAGAVVTHDQVNKLQAYWGMPRRIRIDFNTTTVGNCDICGEQSDALLSLMTTKNYGANYAMWQHPLTPYRIPLKEGREFYSVKPQPGGLIWRDWLGLIETGKSENNTELPALVVKLFNASSLKQAKVGLWGFGYDFDNMKARCWYEHHFPLLLKKKEGQIPKLRLAAQTASRILSLLRSALKEAWFSDPKGARGDFSFVDIDFWNKTQHRFLRLVRQIEEGQDADELLGKWQKEIWLFARQDFDERVFTNPYEPVDLKRVMTARKKYFTTSAEKQSAKAAREKKQEAAE

SEQ ID NO: 5964 - protein, 520 aa, Escherichia coli
MNSFSLLTTPWLPVRFKDGTTGKLAPVDLADENVVDIAAPRADLQGAAWQFLLGLLQTSFAPKNHGRWDDIWQDGLEAEKLREALLSLEHAFQFGADSPSFMQDFEALKGDKVQVASLLPEIPGAQTTKFNKDRFIKRGVTEHVCPHCSALALFSLQLNAPSGGKGYRTGLRGGGPMTTLIELQEYQGNQQTPLWRKLWPNVMPQDEADLPLPKKFDDLVFPWLGPTRTSELAGAVVTHDQVNKLQAYWGMPRRIRIDFNTTTVGNCDICGEQSDALLSLMTTKNYGANYAMWQHPLTPYRIPLKEGGEFYSVKPQPGGLIWRDWLGLIETGKSENNTELPALVVKLFNASSLKQAKVGLWGFGYDFDNMKARCWYEHHFPLLLKKKEGQIPKLRLAAQTASRILSLLRSALKEAWFSDPKGARGDFSFVDIDFWNKTQHRFLRLVRQIEEGQDADELLGKWQKEIWLFARQDFDERVFTNPYEPVDLKRVMTARKKYFTTSAEKQSAKAAREKKQEAAE

SEQ ID NO: 5965 - protein, 520 aa, Escherichia coli
MNSFSLLTTPWLPVRFKDGTTGKLAPVDLADENVVDIAAPRADLQGAAWQFLLGLLQTSFAPKNHGRWDDIWQDGLEAEKLREALLSLEHAFQFGADSPSFMQDFEALKGDKVQVASLLPEIPSAQTTKFNKDHFIKRGVTEHVCPHCSALALFSLQLNAPSGGKGYRTGLRGGGPMTTLIELQEYQGNQQTPLWRKLWPNVMPQDEADLPLPKKFDDLVFPWLGPTRTSELAGAVVTHDQVNKLQAYWGMPRRIRIDFNTTTVGNCDICGEQSDALLSLMTTKNYGANYAMWQHPLTPYRIPLKEGGEFYSVKPQPGGLIWRDWLGLIETGKSENNTELPALVVKLFNASSLKQAKVGLWGFGYDFDNMKARCWYEHHFPLLLKKKEGQIPKLRLAAQTASRILSLLRSALKEAWFSDPKGARGDFSFVDIDFWNKTQHRFLRLVRQIEEGQDADELLGKWQKEIWLFARQDFDERVFTNPYEPVDLKRVMTARKKYFTTSAEKQSAKAAREKKQEAAE

SEQ ID NO: 5966 - protein, 520 aa, Escherichia coli; identical to SEQ ID NO: 5349

SEQ ID NO: 5967 - protein, 520 aa, Escherichia coli; identical to SEQ ID NO: 5335

SEQ ID NO: 5968 - protein, 520 aa, Escherichia coli; identical to SEQ ID NO: 5454

SEQ ID NO: 5969 - protein, 520 aa, Enterobacteriaceae; identical to SEQ ID NO: 5305

SEQ ID NO: 5970 - protein, 520 aa, Escherichia coli; identical to SEQ ID NO: 5346

SEQ ID NO: 5971 - protein, 520 aa, Escherichia albertii
MNSFSLLTTPWLPVRFKDGTTGKLAPVDLADENVVDIAAPRADLQGAVWQFLLGLLQTSFAPKDHRRWDDIWQDGLEAAKLREALLSLEHAFQFGPDSPSFMQDFEALMGDKVPVASLLPEIPGSQTTKFNKDHFIKRGVTEYLCPHCLALALFSLQLNAPAGGKGYRTGLRGGGPMTTLIELQEYQGNQQSPLWRKLWLNVMPQDEADLPLPKKFDDLIFPWLGPTRTSELAGAVVTHDQVNKLQAYWGMPRRIRIDFNTTTVGNCDICGEQSDALLSLMMTKNYGANYAMWQHPLTPYRVPLKEGGEFYSVKPQPGGLIWRDWLGLIETGKSENNTELPALVVKLFNASSLKQAKVGLWGFGYDFDNMKARCWYEHHFPLLLNKKEGQIPKLRLAAQTASRILSLLRSALKEAWFSDPKGARGDFSFVDIDFWNKTQHRFLRLVRQIEEGQDADELLSKWNKEIWLFARQDFDERVFTNPYEPVDLKRVMAARKKYFTTSAEKQNAKAAREKKQEAAE

SEQ ID NO: 5972 - protein, 520 aa, Escherichia coli; identical to SEQ ID NO: 5352

SEQ ID NO: 5973 - protein, 520 aa, Shigella sonnei
MNSFSLLTTPWLPVRFKDGTTGKLAPVDLADENVVDISAPRADLQGAVWQFLLGLLQTSFAPKDHRRWDDIWEDGLEAEKLREALLSLEHAFQFGPDSPSFIQDFEALTGDKVPVASLLPEIPGAQTTKFNKDHFIKRGVTEYLCPHCSALALFSLQLNAPSGGKGYRTGLRGGGPMTTLIELQEYQGNQQTPLWRKLWINVMPQDEADLPLPKKFDDLVFPWLGPTRISELAGAVVTDEQVNKLQAYWGMPRRIRIDFNTTTVGNCDICGEQSDALLSLMTTKNYGANYAMWQHPLTPYRVLLKEGGEFYSVKPQPGGLIWRDWLGLIETGKSENNTELPALVVKLFNASSLKQAKVGLWGFGYDFDNMKARCWYEHHFPLLLNKKEGQIPKLRLAAQTASRILSLLRSALKEAWFSDPKGARGDFSFVDIDFWNKTQHRFLRLVRQIEEGQDADELLSKWNKEIWLFARQDFDERVFTNPYEPVDLERIMTARKKYFTTSAEKQSAKAAREKKQEAAE

SEQ ID NO: 5974 - protein, 520 aa, Escherichia coli; identical to SEQ ID NO: 5355

SEQ ID NO: 5975 - protein, 520 aa, Proteobacteria; identical to SEQ ID NO: 5356

SEQ ID NO: 5976 - protein, 520 aa, Escherichia coli
MNSFSLLTTPWLPVRFKDGTTGKLAPVHLADENVVDIAAPRADLQGAAWQFLLGLLQTSFAPKDHRRWDDIWEDGLEAEKLREALLPLEHAFQFGPDSPSFMQDFEALTGDKVPVASLLPEIPGVQTTKFNKDHFIKRGVTEHLCPQCSALALFSLQLNAPSGGKGYRTGLRGGGPMTTLIELQEYQGNQQTPLWRKMWLNVMPQDEADLPLPKKFDGLVFPWLGPTRTSELAGAVVTDDQVNKLQAYWGMPRRIRIDFNTTTVGNCDICGEQNDALLSLMTTKNYGANYAMWQHPLTPYRIPLKEGGEFYSVKPQPGGLIWRDWLGLIETGKSENNTELPALVVKLFNASSLKQAKVGLWGFGYDFDNMKARCWYEHHFPLLLNKKEGQIPKLRLAAQTASRILSLLRSALKEAWFSDPKGVRGDFSFVDIDFWNKTQHRFLRLVRQIEEGQDADELLGKWQKEIWLFARQDFDERVFTNPYEPVDLKRVMTARKKYFTTSAEKQSAKAAREKKQEAAE

SEQ ID NO: 5977 - protein, 520 aa, Enterobacteriaceae; identical to SEQ ID NO: 5294

SEQ ID NO: 5978 - protein, 520 aa, Escherichia
MNSFSLLTTPWLPVRYKDGTTGKLAPVDLADENVVDIAAPRADLQGAAWQFLLGLLQTSFAPKNHGRWDDIWEDGLEVEKLREALLSLEHAFQFGPDSPSFMQDFEALTGDKVPVASLLPEIPGSQTTKFNKDHFIKRGVTEHLCPHCLALALFSLQLNAPAGGKGYRTGLRGGGPMTTLIELQEYQGNQQTPLWRKLWLNVMPQDESDLPLPKKFDDLVFPWLGPTRTSELAGAVVTDDQVNKLQAYWGMPRRIRVDFNTTTVGNCDICGEQSDALLSLMTTKKYGANYAMWQHPLTPYRVPLKEGGELYSVKPQPGGLIWRDWLGLIETGKSENNTELPALVVKLFNASSLKQAKVGLWGFGYDFDNMKARCWYEHHFPLLLNKKEGQIPKLRLAAQTASRILSLLRSALKEAWFSDPKGARGDFSFVDIDFWNKTQHRFLRLVRQIEEGQEPDELLSKWQKEMWLFARQDFDERVFTNPYEPVDLKRVMTARKKYFTTSAEKQSAKAAREKKQEAAE

SEQ ID NO: 5979 - protein, 520 aa, Escherichia fergusonii
MNSFSLLTTPWLPVRYKDGTTGKLAPVDLADENVVDIAAPRADLQGAAWQFLLGLLQTSFAPKNHGRWDDIWEDGLEVEKLREALLSLEHAFQFGPDSPSFMQDFEELRVKASSIASLLPDTPGKQTKERNKDHFIKRDTIQHICLHCVPLALFSIQLNAPKGGRGYYPGLRGGGPLTTLIELLEYQGNPQPPLWRKLWLNVMPQDEADLPLPKTFDDLVFPWLAPTRTSELDGAVITDEQVNKLQAYWGMPRRIRIDFKTTSIGNCDICGSQSGALLSLMALKNNGVQYVMWRHPLTPYRMPLKEGGEFYSVKPQPGGLIWRDWLGLIEEGKSKNNTELPAQVVKLFNASNLKQTKIGLWGFGYDFEDMKVRCWYEHHFPLLLNKKEGQIPKLRLAAQTASRILSLLRSALKEAWFSDPKGARGDFSFVDIDFWNKTQHRFLRLVRQIEEGQDADELLSKWNKEIWLFARQDFDERVFTNPYEPVDLKRVMTARKKYFTTSAEKQSAKAAREKKQEAAE

SEQ ID NO: 5980 - protein, 522 aa, Escherichia coli; identical to SEQ ID NO: 5301

SEQ ID NO: 5981 - protein, 404 aa, Escherichia coli
MNSFSLLTTPWLPVRFKDGTTGKLAPVDLADENVVDIAAPRADLQGAAWQFLLGLLQSSFAPKDYRRWDDIWEDGLEAEKLREALLSLEHPFQFGPDSPSFMQDFEVLMGDKVQVASLLPEIPGAQTTKFNKDHFIKRGVTEHVCSHCSALALFSLQLNAPSGGKGYRTGLRGGGPMTTLIELQEYQGNQQAPLWRKLWLNVMPQDEADLPLPKKFDDLVFPWLGPTRTSELAGAVVTDDQVNKLQAYWGMPRRIRIDFNTTTVGNCDICGEQSDALLSLMTTKNYGANYAMWQHPLTPYRVPLKEGGEFYSVKPQPGGLIWRDWLGLIETGKSENNTELPALVVKLFNASSLKQAKVGLWGFGYDFDNMKARCWYEHHFPLLLNKKEARYRSCGWLRKRLHGF

SEQ ID NO: 5982 - protein, 520 aa, Escherichia coli
MNSFSLLTTPWLPVRYKDGTTGKLAPVDLADENVVDIAAPRADLQGAAWQFLLGLLQTSFAPKDHRRWDDIWEDGLEAEKLREALLSLEHAFQFGPDSPSFMQDFEALTGDKVQVASLLPDVPGAQTTKFNKDHFIKRGVTEYLCPHCLALALFSLQLNAPAGGKGYRTGLRGGGPMTTLIELQEYQGNQQTPLWRKLWLNVMPQDEADLPLPQKFDDLVFPWLGPTRTSELAGAVVTDDQVNKLQAYWGMPRRIRIDFNTTTVGNCDICGEQSDALLSLMTTKNYGANYAMWQHPLTPYRVPLKEGGEFYSVKPQPGGLIWRDWLGLIETGKSENNTELPALVVKLFNASSLKQAKVGLWGFGYDFDNMKARCWYEHHFPLLLNKKECQIPKLRLAAQTASRILSLLRSALKEAWFSDPKGARGDFSFVDIDFWNKTQHRFLRLVRQIEEGQDPDELLGKWQKEIWLFARQDFDERVFTNPYEPVDLKRVMTARKKYFTTSAEKQNAKAAREKKQEAAE

SEQ ID NO: 5983 - protein, 522 aa, Escherichia coli
MRMNSFSLLTTSWLPVRFKDGTTGKLAPVDLADENVVDIAAPRADLQGAAWQFLLGLLQTSFAPKDHRRWDDIWEDGLESEKLREALLSLEHAFQFGPDSPSFMQDFEALTGDKVQVASLLPEIPGAQTTKFNKDHFIKRGVTEYLCPHCSALALFSLQLNAPSGGKGYRTGLRGGGPMTTLIELQEYQGNQQTPLWRKLWLNVMPQDEADLPLPKKFDDLIFPWLGPTRTSELAGAVVTDDQVNKLQAYWGMPRRIRIDFNTTTVGNCDICGEQNDALLNLMTTKNYGANYAMWQHPLTPYRIPLKEGGEFYSVKPQPGGLIWRDWLGLIETGKSENNTELPALVVKLFNASSLKQAKVGLWGFGYDFDNMKARCWYEHHFPLLLNKKEGQIPKLRLAAQTASRILSLLRSALKEAWFSDPKGARGDFSFVDIDFWNKTQHRFLRLVRQIEEGQDPDELLGKWQKEIWLFARQDFDERVFTNPYEPVDLKRVMTARKKYFTTSAEKQNAKAAREKKQEAAE

SEQ ID NO: 5984 - protein, 406 aa, Escherichia coli
MRMNSFSLLTTPWLPVRFKDGTTGKLAPVDLADENVVDIAAPRADLQGAAWQFLLGLLQSSFAPKDYRRWDDIWEDGLEAEKLREALLSLEHAFQFGPDSPSFMQDFEVLMGDKVQVASLLPEIPGAQTTKFNKDHFIKRGVTEHVCSHCSALALFSLQLNAPSGGKGYRTGIRGGGPMTTLIELQEYQGNQQAPLWRKLWLNVMPQDEADLPLPKKFDDLVFPWLGPTRTSELAGAVVTDDQVNKLQAYWGMPRRIRIDFNTTTVGNCDICGEQDDALLSLMTTKNYGANYAMWQHPLTPYRVPLKEGGEFYSVKPQPGGLIWRDWLGLIETGKSENNTELPALVVKLFNASSLKQAKVGLWGFGYDFDNMKARCWYEHRFPLLLNKKKARYRNCGWLRKRLHAF

SEQ ID NO: 5985 - protein, 499 aa, Escherichia coli
MDGLFYERMRMNSFSLLTTPWLPVRFKDGTTGKLAPVDLADENVVDIAAPRADLQGAAWQFLLGLLQTSFAPKDHRRWDDIWEDGLEAEKLREALLSLEHAFQFGPDSPSFMQDFDELKVKATSIASLLPDAPGKQTKERNTDHFIKRDTTQHLCLHCVPLALFSIQLNAPIGGRGYYPGLRGGGPLTTLIELLEYQGNQQTPLWRKLWLNIMPQDEADLPLPKTFDDLVFPWLAPTRTSELDGAVVTDEQVNKLQAYWGMPRRIRIDFKTTSIGNCDICGRQSDALLGLMSLKNYGVQYVMWRHPLTPYRLPLKEGGDFYSVKPQPGGLIWRDWLGLIEVGNSKNNTELPAQVVKLLNASNLKQTRVGLWGFGFDFEDMKVRCWYEHHFPLLLNKKEDLIPKLRLAAQAASHFLSLLHRALKEAWFSEKKTTKLDFGFVDIDFWNKTQHRFLRLVRQIEEGQDPDELLGKWQCGYSRVRILTIVSLPIHMSPLIWNAS

SEQ ID NO: 5986 - protein, 522 aa, Proteobacteria; identical to SEQ ID NO: 5297

SEQ ID NO: 5987 - protein, 543 aa, Escherichia coli; identical to SEQ ID NO: 5298

SEQ ID NO: 5988 - protein, 543 aa, Escherichia coli; identical to SEQ ID NO: 5327

SEQ ID NO: 5989 - protein, 520 aa, Escherichia coli
MNSFSLLTTPWLPVRFKDGTTGKLAPVDLADENVVDISAPRADLQGAVWQFLLGLLQTSFAPKDHRRWDDIWEDGLEAEKLREALLSLEHAFQFGPDSPSFMQDFDELKVKATSIASLLPDAPGKQTKERNTDHFIKRDTTQHLCLHCVPLALFSIQLNAPIGGRGYYPGLRGGGPLTTLIELLEYQGNQQTPLWRKLWLNVMPQDEADLPLPKTFDDLVFPWLAPTRTSELDGAVVTDEQVNKLQAYWGMPRRIRIDFKTTSIGNCDICGRQSDALLGLMSLKNYGVQYVMWRHPLTPYRLPLKEGGDFYSVKPQPGGLIWRDWLGLIEVGNSKNNTELPAQVVKLLNASNLKQTRVGLWGFGFDFEDMKVRCWYEHHFPLLLNKKEDLIPKLRLAAQAASHILSLLHRALKEAWFSEKKTTKLDFGFVDIDFWNKTQHRFLRLVRKIEEGQDPDELLSKWQKEMWLFARQDFDDRVFTNPYEPVDLERVMTARKKYFTTSAEKQNANAAREKKQEAAE

SEQ ID NO: 5990 - protein, 522 aa, Escherichia coli; identical to SEQ ID NO: 5306

SEQ ID NO: 5991 - protein, 522 aa, Enterobacteriaceae; identical to SEQ ID NO: 5883

SEQ ID NO: 5992 - protein, 522 aa, Escherichia coli; identical to SEQ ID NO: 5311

SEQ ID NO: 5993 - protein, 389 aa, Escherichia coli
MNSFSLLTTPWLPVRFKDGTTGKLAPVDLADENVVDIAAPRADLQGAAWQFLLGLLQTSFAPKNHGRWDDIWQDGLEAEKLREALLSLEHAFQFGPDSPSFMQDFDELKVKATSIASLLPDAPGKQTKERNTDHFIKRDTTQHLCLHCVPLALFSIQLNAPIGGRGYYPGLRGGGPLTTLIELLEYQGNQQTPLWRKLWLNVMPQDEADLPLPKTFDDLVFPWLAPTRTSELDGAVVTDEQVNKLQAYWGMPRRIRIDFKTTSIGNCDICGRQSDALLGLMSLKNYGVQYVMWHHPLTPYRLPLKEGGDFYSVKPQPGGLIWRDWLGLIEVGNSKNNTELPAQVVKLLNASNLKQTRVGLWGFGFDFEDMKVRCWYEHHFPLLLNKKKT

SEQ ID NO: 5994 - protein, 389 aa, Escherichia coli
MNSFSLLTTPWLPVRFKDGTTGKLAPVDLADENVVDIAAPRADLQGAAWQFLLGLLQTSFAPKDQRRWDDIWEDGLEAEKLREALLSLEHAFQFGPDSPSFMQDFDELKVKATSIASLLPDAPGKQTKERNTDHFIKRDTTQHLCLHCVPLALFSIQLNAPIGGRGYYPGLRGGGPLTTLIELLEYQGNQQTPLWRKLWLNVMPQDEADLPLPKTFDDLVFPWLAPTRTSELDGAVVTDEQVNKLQAYWGMPRRIRIDFKTTSIGNCDICGRQSDALLGLMSLKNYGVQYVMWRHPLTPYRLPLKEGGDFYSVKPQPGGLIWRDWLGLIEVGNSKNNTELPAQVVKLLNASNLKQTRVGLWGFGFDFEDMKVRCWYEHHFPLLLNKKKT

SEQ ID NO: 5995 - protein, 520 aa, Escherichia coli
MNSFSLLTTPWLPVRYKDGTTGKLAPVDLADENVVDIAAPRADLQGAAWQFLLGLLQTSFAPKDHRRWDDIWEDGLEAEKLREALLSLEHAFQFGPDSPSFMQDFEALTGDKVQVASLLPDVPGAQTTKFNKDHFIKRGVTEYLCPHCLALALFSLQLNAPAGGKGYRTGLRGGGPMTTLIELQEYQGNQQTPLWRKLWLNVMPQDEADLPLPQKFDDLVFPWLGPTRTSELAGAVVTDDQVNKLQAYWGMPRRIRIDFNTTTVGNCDICGEQSDALLSLMTTKNYGANYAMWQHPLTPYRVPLKEGGEFYSVKPQPGGLIWRDWLGLIETGKSENNTELPALVVKLFNASSLKQAKVGLWGFGYDFDNMKARCWYEHHFPLLLNKKEGQIPKLRLAAQTASRILSLLRSALKEAWFSDPKGARGDFSFVDIDFWNKTQHRFLRLVRQIEEGQDPDELLGKWQKEIWLFARQDFDERVFTNPYEPVDLKRVMTARKKYFTTSAEKQNAKAAREKKQEAAE

SEQ ID NO: 5996 - protein, 522 aa, Escherichia coli
MRMNSFSLLTTPWLPVRFKDGTTGKLAPVDLADENVVDIAAPRADLQGAAWQFLLGLLQTSFAPKNHGRWDDIWEDGLEAEKLREALLSLEHAFQFGADSPSFMQDFEALKGDKVQVASLLPEIPGAQTTKFNKDHFIKRGVTEHVCPHCSALALFSLQLNAPSGGKGYRTGLRGGGPMTTLIELQEYQGNQQTPLWRKLWPNVMPQDEADLPLPKKFDDLVFPWLGPTRTSELAGAVVTHDQVNKLQAYWGMPRRIRIDFNTTTVGNCDICGEQSDALLSLMTTKNYGANYAMWQHPLTPYRIPLKEGGEFYSVKPQPGGLIWRDWLGLIETGKSENNTELPALVVKLFNASSLKQAKVGLWGFGYDFDNMKARCWYEHHFPLLLKKKEGQIPKLRLAAQTASRILSLLRSALKEAWFSDPKGARGDFSFVDIDFWNKTQHRFLRLVRQIEEGQDADELLGKWQKEIWLFARQDFDERVFTNPYEPVDLKRVMTARKKYFTTSAEKQSAKAAREKKQEAAE

SEQ ID NO: 5997 - protein, 522 aa, Escherichia coli
MRMNSFSLLTTPWLPVRFKDGTTGKLAPVDLADENVVDIAAPRADLQGAAWQFLLGLLQSSFAPKDYRRWDDIWEDGLEAEKLREALLSLEHAFQFGPDSPSFMQDFEVLMGDKVQVASLLPEIPGAQTTKFNKDHFIKRGVTEHVCSHCSALALFSLQLNAPSGGKGYRTGIRGGGPMTTLIELQEYQGNQQAPLWRKLWLNVMPQDEADLPLPKKFDDLVFPWLGPTRTSELAGAVVTDDQVNKLQAYWGMPRRIRIDFNTTTVGNCDICGEQDDALLSLMTTKNYGANYAMWQHPLTPYRVPLKEGGEFYSVKPQPGGLIWRDWLGLIETGKSENNTELPALVVKLFNASSLKQAKVGLWGFGYDFDNMKARCWYEHHFPLLLDKKEGQIPKLRLAAQTASRILSLLRSALKEAWFSDPKGARGDFSFVDIDFWNKTQHRFLRLVRQIEEGQDADELLSKWNKEIWLFARQDFDERVFTNPYEPVDLERVMTARKKYFTTSAEKQSAKAAREKKQEAAE

SEQ ID NO: 5998 - protein, 404 aa, Escherichia coli
MNSFSLLTTPWLPVRFKDGTTGKLAPVDLADENVVDIAAPRADLQGAAWQFLLGLLQSSFAPKDYRRWDDIWEDGLEAEKLREALLSLEHPFQFGPDSPSFMQDFEVLMGDKVQVASLLPEIPGAQTTKFNKDHFIKRGVTEHVCSHCSALALFSLQLNAPSGGKGYRTGLRGGGPMTTLIELQEYQGNQQAPLWRKLWLNVMPQDEADLPLPKKFDDLVFPWLGPTRTSELAGAVVTDDQVNKLQAYWGMPRRIRIDFNTTTVGNCDICGEQSDALLSLMTTKNYGANYAMWQHPLTPYRVPLKEGGEFYSVKPQPGGLIWRDWLGLIETGKSENNTELPALVVKLFNASSLKQAKVGLWGFGYDFDNMKARCWYEHHFPLLLNKKKARYRSCGWLRKRLHGF

SEQ ID NO: 5999 - protein, 404 aa, Escherichia coli
MNSFSLLTTPWLPVRFKDGTTGKLAPVDLADENVVDIAAPRADLQGAVWQFLLGLLQTSFAPKDHRRWDDIWEDGLEAEKLREALQSLEHAFQFGPDSPSFMQDFEALKGDKVQVASLLPEIPGAQTTKFNKDHFIKRGVTEHVCPHCSALALFSLQLNAPSGGKGYRTGLRGGGPMTTLIELQEYQGNQQTPLWRKLWPNVMPQDEADLPLPKKFDDLVFPWLGPTRTSELAGAVVTHDQVNKLQAYWGMPRRIRIDFNTTTVGNCDICGEQSDALLSLMTTKNYGANYAMWQHPLTPYRIPLKEGGEFYSVKPQPGGLIWRDWLGLIETGKSENNTELPALVVKLFNASSLKQAKVGLWGFGYDFDNMKARCWYEHHFPLLLKKKKARYRNCVWLRKRLHGF

SEQ ID NO: 6000 - protein, 518 aa, Salmonella enterica
MDNFSLLTTPWLPVRFKDGSTGKLAPVNLADENVVDIAATRADLQGAAWQFLLGLLQCSIAPKRYKNWEDIWFDGLHADALHKALAQLEHAFQFGAETPFFMQDFEPLTGEKVSMASLLPETPGAQTTKFNKDHFIKRGVTERFCPHCAALALFSLQLNAPSGGKGYRTGLRGGGPLTTLVELQEYQGERQTPLWRKLWLNVMPQDTADLPLPDQCDATVFPWLAATRTSEQANAVTTPEQVNKLQAYWGMPRRIRLDFATLQSGCCDICGAESDELLGFMTVKNYGVNYDGWRHPLTPYRAPVKDQNAFFSVKPQPGGLIWRDWLGLSQNNQTEANYESPAQVVKVFNARSLTDVKAGIWGFGADFDNMKIRCWYEHHFPLLMTEGLIPDLRKAVQTAARLLSLLRSALKEAWFADAKGARGDFSFIDIDFWNLTQGRFLNLIHDLENGHKPDERLNKWQRELWLFTRHYFDDHVFTNPYESSDLERIMTARKKYFTTSAEKQSAKAAKAKKQEAAE

SEQ ID NO: 6001 - protein, 518 aa, Salmonella enterica
MDNFSLLTTPWLPVRFKDGSTGKLAPVDLADENVVDIAATRADLQGAAWQFLLGLLQCSIAPKRYKNWEDIWFDGLHADALHKALAPLEHAFQFGAETPSFMQDFEELPDNKITIASLLPETPGIQTTELNTDHFIKRGVMECFCPHCAALALFSMQLNAPSGGQGYRTGLRGGGPLTTLIELQEYQGERQTPLWRKLWLNVMPQDAADLPLPVVYDAAVFPWLAATRTSEPPAHTITTDEQVNKLQAYWGMPRRIRLDFATIRQGVCNICGNNGDELLIQMLVKNYGVNYDRWRHPLTPHRLQIKNSKGFEPVITQPGGLLWRDWLGLSQENPTEKNTEYPAQVIKVFNARELRNIKVGLWGFGADFKKMKIRCWYEHHFPLLMTEGLIPDLRKATQTATRLLSLLRGALKEAWFANAKDARGDFSFIDIDFWNLTQGRFLNLIHDLENGHKPDERLNKWQRELWLFTRCYFDDHVFTNPYESSDLERIMKARQKIFYFIGGKAKRESRQSKEAGGC

SEQ ID NO: 6002 - protein, 522 aa, Escherichia fergusonii
MRMNSFSLLTTPWLPVRYKDGTTGKLAPVDLADENVVDIAAPRADLQGAAWQFLLGLLQTSFAPKNHGRWDDIWEDGLEVEKLREALLSLEHAFQFGPDSPSFMQDFEELRVKASSIASLLPDTPGKQTKERNKDHFIKRDTIQHICLHCVPLALFSIQLNAPKGGRGYYPGLRGGGPLTTLIELLEYQGNPQPPLWRKLWLNVMPQDEADLPLPKTFDDLVFPWLAPTRTSELDGAVITDEQVNKLQAYWGMPRRIRIDFKTTSIGNCDICGSQSGALLSLMALKNNGVQYVMWRHPLTPYRMPLKEGGEFYSVKPQPGGLIWRDWLGLIEEGKSKNNTELPAQVVKLFNASNLKQTKIGLWGFGYDFEDMKVRCWYEHHFPLLLNKKEGQIPKLRLAAQTASRILSLLRSALKEAWFSDPKGARGDFSFVDIDFWNKTQHRFLRLVRQIEEGQDADELLSKWNKEIWLFARQDFDERVFTNPYEPVDLKRVMTARKKYFTTSAEKQSAKAAREKKQEAAE

SEQ ID NO: 6003 - protein, 552 aa, Cutibacterium acnes; identical to SEQ ID NO: 5285

SEQ ID NO: 6004 - protein, 552 aa, Cutibacterium acnes; identical to SEQ ID NO: 5329

SEQ ID NO: 6005 - protein, 552 aa, Cutibacterium acnes; identical to SEQ ID NO: 5318

SEQ ID NO: 6006 - protein, 498 aa, Propionibacterium namnetense
MLAIAMRATARERSDDEKIDDWSRWWDEGLPLDEINSYLDAWHDRFNLFDDRAPFMQVADLRTAKGKYSGLVKIISEVSPNDKFFTTRDGRGIASLSYAEAARWLVHTHAFDVSGIKSGAVGDPRVKGGRGYPIGTGISGPMGIVIVEGKSLAETILLNLFLQDDPQQDVPVWERPPQTAAPDREHPVPTGCADLFTWQSRRVRLIADGGRVVDVLLCNGDKVEWKYLLHNDSTTAWRYSAPQTKAAGETVYMPRSHDSTKAMWRGLEPLLVREPAADDRRRKKAGEPDELWLRPEIFEQLAAFSSDGALPRDHVTRIRTIGMEYGSQSSVVTTTIDDAMPAAMAVIADEQLGRLAVESAQTADSLIFTLQNLATDLAAATGSESEGVRPRTSEMGYAALDPTYRDWFSRLSSRTDVETATLTWRRRARRVVREVGEQLCRDAGPRALTGRMVSGSKGGREDLMNLARAWQCFVSQLHIKAPLPEDPHRGTKTSRKEQ

SEQ ID NO: 6007 - protein, 560 aa, Streptococcus ratti; identical to SEQ ID NO: 5566

SEQ ID NO: 6008 - protein, 480 aa, Desulfobacter postgatei; identical to SEQ ID NO: 5362

SEQ ID NO: 6009 - protein, 573 aa, Gardnerella vaginalis
MVLYVLRIRKKTERNKKVSRFNLLDEPWISVIVDEKGHNKLVSMTDVFKHASEYKALAGDMKTQDFALLRVLLAALHTVFSRYDIQGNSREFDSGEDTEDDFNEETMDIWREVWNSKKFPDAVFKYLEQWHDHFYLFDDKYPFFQVLKQDIDSKKLGGKSPSEISGKNINRLISESNNKIAVFSPKDNVDNNKSSLTEPQLARWIITLQSYAGLADKTMFGTEKYKASKGWLFDLGGIEIIGANLFETLMLNCVLVDEMQSPEKKQKPCWEYSGTENIENSFYDTFIDNISQLYTRWSRAIYINPDISVDKPISVSIVKLPDINHKNAFIEPMTVWQYNKEGENKDKYTPRKYRTEEAMWRSFGLLTSQELYDGSVKNHKPGIMEWLNEIKHDIAGSSISLQAVSMKDDGNATSWVPTDEICDTLYIDEVVVTDNADDGWVYRINNEVEYTRSAIGFIYKQFLLDICEIRNRNKDDATKYSARYISQAYFLVDQPFREWLSNIKPKDSMNERCTQWRNTLHNILIDEAKGMLENATLRDFTGRPSDQSEKESTKNIITAYNIFTSRLKKLSGK

SEQ ID NO: 6010 - protein, 553 aa, Gardnerella vaginalis
MSRFNLLDEPWISVIVGKKGHNKLVSITDVFKHASEYKALAGDMKTQDFALLRILLAVLHTVFSRYDIQGNSREFDSAEDNEYDFNKETMNIWREVWNSKKFPDAVFKYLEQWHDRFYLFDDKYPFFQVLKQDIYSKKLSHKNPTELLGKNINRLISESKNKIAIFSPKCGENKSILNESQLARWLIAFQAYSSVPDKTQFGSEKYDSSKGWLFNLGGIYIEGENLFETLMLNCVLVGEMQSPEKRQKPCWEYSGAENIENSFYDTFIDNISQLYTRWSRAIYINPSIRMDKGISIYTVILLKLNNEDAFIEPMTVWLHNKKNKVDDTYIPRKHSAEESMWRSFGLLTSQESDDESVKNHKPGIMEWLNKISKNISGSFISLHAISMKGDSSSSDIPIDEIYDNLYFNEVVFTDNTNDGWVHRINKEVEYTRSAIEFIYRQFLLDICEIRNRNKDDATTYAAKYVNHAYFLVDQPFRQWLANIRPKDSMNERCTQWRNTLYNILINEAEVMLKNATLRDFTGLVGEKSKKSPAKNIVIAYNIFISRLKKLSEK

SEQ ID NO: 6011 - protein, 556 aa, Gardnerella vaginalis
MSRFNLLDEPWISVIVDEKGHNKLVSITDVFKHASEYKALAGDMKTQDFALLRVLLAAIHTVFSRYDIQGNSREFDSGEDSEDDFNEETMDIWREVWNSKKFPDAVFKYLEQWHDHFYLFDDKYPFFQVLKQDIDSKKLGGKSPSEISGKNINRLISESNNKIAVFSPKDNVDNNKSSLTEPQLARWIITLQSYAGLADKTMFGTEKYKASKGWLFDLGGIEIIGANLFETLMLNCVLVGDVQSPEKKQKPCWEYSGTENIENSFYETFIDNVSQLYTRWSRAIYINPDISIDKPISVSIVKLPDINHKNAFIEPMTVWQYNKEGENKDKYTPRKHRTEEAMWRSFGLLTSQELYDGSVKNHKPGIMEWLNEIKHDIAGSSISLQAISMKDDGNATSWVPTDEICDTLYIDEVVVTDNADDGWVYRINNEVEYTRSAIGFIYKQFLLDICEIRNRSKDDATKYSAKYISQAYFLVDQPFREWLANIKPKDSMNERCTQWRNTLHNILIDEAKGMLENATLRDFTGRPSDQSEKESTKNIVTAYNVFTSRLKKLSGK

SEQ ID NO: 6012 - protein, 556 aa, Gardnerella vaginalis
MSRFNLLDEPWISVIVDEKGHNKLVSMTDVFKHASEYKALAGDMKTQDFALLRVLLAALHTVFSRYDIQGNSREFDSGEDTEDDFNEETMDIWREVWNSKKFPDAVFKYLEQWHDHFYLFDDKYPFFQVLKQDVDSKNLGGKSPSEISGKNINRLISESNNKIAVFSPKDNVDNNKSSLTEPQLARWIITLQSYAGLADKTMFGTEKYKASKGWLFDLGGIEIIGANLFETLMLNCVLVGEMQSPEKKQKPCWEYSGTENIENSFYDTFIDNISQLYTRWSRAIYINPDISVDKPISVSIVKLPDINHKNSFIEPMTVWQYNKEGENKDKYTPRKHRTEEAMWRSFGLLTSQELYDGSVKNHKPGIMEWLNEIKHDIAGSSISLQAISMKDDGNATSWVPTDEICDTLYIDEVVVTDNADDGWVYRINNEVEYTRSAIGFIYKQFLLDICEIRNRSKDDATKYSAKYISQAYFLVDQPFREWLANIKPKDSMNERCTQWRNTLHNILIDEAKGMLENATLRDFTGRPSDQSEKESTKNIVTAYNVFTSRLKKLSGK

SEQ ID NO: 6013 - protein, 556 aa, Gardnerella vaginalis
MSRFNLLDEPWISVIVDEKGHNKLVSITDVFKHASEYKALAGDMKTQDFALLRVLLAAIHTVFSRYDIQGNSREFDSGEDSEDDFNEETMDIWREVWNSKKFPDAVFKYLEQWHDHFYLFDDKYPFFQVLKQDIDSKKLGGKSPSEISGKNINRLISESNNKIAVFSPKDNVDNNKSSLTEPQLARWIITLQSYAGLADKTMFGTEKYKASKGWLFDLGGIEIIGANLFETLMLNCVLVGDVQSPEKKQKPCWEYSGTENIENSFYETQIDNVSQLYTRWSRAIYINPDISIDKPISVSIVKLPDINHKNAFIEPMTVWQYNKEGENKDKYTPRKHRTEEAMWRSFGLLTSQELYDGSVKNHKPGIMEWLNEIKHDIAGSSISLQAISMKDDGNATSWVPTDEICDTLYIDEVVVTDNADDGWVYRINNEVEYTRSAIGFIYKQFLLDICEIRNRSKDDATKYSAKYISQAYFLVDQPFREWLANIKPKDSMNERCTQWRNTLHNILIDEAKGMLENATLRDFTGRPSDQSEKESTKNIVTAYNVFTSRLKKLSGK

SEQ ID NO: 6014 - protein, 556 aa, Gardnerella vaginalis
MSRFNLLDEPWISVIVDEKGHNKLVSITDAFKHASEYKALAGDMKTQDFALLRILLAVLHTVFSRYDIQGNSREFDSDEDDKEDFNKETMNIWREVWNSKKFPDVVFKYLEQWHDRFYLFDDKYPFLQVLKQDIDSKKLGGKSPSEISGKNINRLISESNNKIAVFSPKDNVDNNKSSLTEAQLARWIIMLQSYVGLADKTIFGTEKYKASKGWLFDLGGIYIEGENLFETLMLNCVLVGEMQSPEKRQKPCWEYSGAENIENSFYETFIDNISQLYTRWSRAIYINPDISIDSPISFSIVKLPDINHQNAFIEPMTVWQYNKERENKDKYTPRKHKVEESMWRSFGLLTLQDSDDGILKNHKPCIMEWLNKISKDIEGSSISLQAVSMKDDGNATSWVPTDEICDTLHIDEVVVTDNSDNGWVGRINNEVEYTRSAIGFIYRQFLLDICEIRNRNKDDTTKYADKCISHIYFLVDKPFRQWLANIKPKDLMNERCTQWRNTLHSILINEAKGMLENATLRDFTGRPAMQSEKETTKNIVTAYSIFTSRLKKLSKK

SEQ ID NO: 6015 - protein, 552 aa, Gardnerella vaginalis
MSRFNLLDEPWISVIVDEKGHNKLVSITDVFKNAYEYKALAGDMKTQDFALLRILLALLHTVFSRYDIHGNSREFDSNEEDKEDFNEETMDIWREVWAAKKFPDAVFKYLEQWHDRFYLFDDKYPFLQVLKQDIDSKKLGGKSPSEISGKNINRLISESNNKIAVFSPKDNVDNNKSSLTEAQLARWIIALQSYVGLADKTIFGTEKYKASKGWLFDLGGIEIVGANLFETLMLNCVLVGEMQSPEKRQKPCWEYSGTENIENSFYETSIDNISQLYTRWSRAIYINPDTRIDKPISVSIVKLPDINHKNAFIEPMTVWQYNKEGESKDKYTPRKHRVEESMWRSFGLLTSQELYDGSVKNHKPGIIEWLNKISKDIAGSSISLQAVSMKDDGNATSWVPTDEICDTLYVDEVVVTDNSDSGWVNRINNEVEYTRSAIGFIYKQFLLDICEIRNRNKDDATKYISNVYFLVDQPFREWLANIMPNDSKNESCAQWRNTLHNILINEAKRMLENATLRDFTGRPSEQNEKESTKNIVIAYNIFISRLKKLSEK

SEQ ID NO: 6016 - protein, 556 aa, Gardnerella vaginalis
MSRFNLLDEPWISVIVDEKGHNKLVSITDVFKNASEYKALAGDMKTQDFALLRILLAVLHAVFSRYDIQGNSREFDSDEEDKEDFNEETMNIWREVWNSKKFPDVVFKYLEQWHDRFYLFDDKYPFLQVLKQDIDSKKLGGKSPSEISGKNINRLISESNNKIAVFSPKDNVDNNKSSLTEAQLARWIITLQSYAGLADKTIFGTEKYKASKGWLFDLGGIEIVGANLFETLMLNCVLVGEIQSPEKRQKPCWEYSGTENVENSFYETFIDNISQLYTRWSRAIYINPDTSIDKPISVSIVKLPDINHKNAFIEPMTVWQYNKEGESKDKYTPRKHRAEESMWRSFGLLTLQESDDGILKNHKPGIMEWLNKIKHDIAGSSISLQAISMKDDGNATSWVPTDEICDTLHIDEVVVTDNADNGWVYRINNEVEYTRSAIGFIYRQFLLDICEIRNRNKDDATKYSAKYISQAYFLVDQPFREWLANIKPKDLMNERCTQWRNTLHSILINEAKGMLENATLRDFTGRPAMQSEKETTKNIVTAYSIFTSRLKKLSKK

SEQ ID NO: 6017 - protein, 556 aa, Gardnerella vaginalis
MSRFNLLDEPWISVIVDEKGHNKLVSITDVFKHASEYKALAGDMKTQDFALLRILLAVLHTVFSRYDIQGNSREFDSSEDDEYDFNKETMNIWREVWNSKEFPDAVFKYLEQWHDRFYLFDDKYPFLQVLKQDIDSKKLGGKSPGEISGKNINRLISESNNKVAVFSPKDNVDNNKSSLNEAQLARWIITLQSYAGLADKTFFGTGKYKASKGWLFDLGGIYVEGENLFETLMLNCVLVGEMQSPEKRQKPCWEYSGAENIENSFYETFIDNISQLYTRWSRAIYINPDISIENPISVSIVKLPDINHKDAFIEPMTVWQYNKERENKDKYTPRKHKVEESMWRSFGLLTLQESDDGILKNHKPGIMEWLNKISKDIEGSSISLQAVSMKDDGNATSWVPTDEICDTLHIDEVVVTDNSDNGWVVRINNEVEYTRSAIGFIYRQFLLDICEIRNRNKDDATKYADKCISHVYFLVDQPFRQWLANIKPKDSMNERCAQWRNTLHNILINEAKGMLENATLRDFTGRPVVQSEKESTKNIVTAYSIFTSRLKKLSKK

SEQ ID NO: 6018 - protein, 556 aa, Gardnerella vaginalis; identical to SEQ ID NO: 5336

SEQ ID NO: 6019 - protein, 518 aa, Klebsiella pneumoniae; identical to SEQ ID NO: 5280

SEQ ID NO: 6020 - protein, 556 aa, Gardnerella vaginalis; identical to SEQ ID NO: 5775

SEQ ID NO: 6021 - protein, 552 aa, Cutibacterium avidum
MTSAFNLIDEPWIAVRRPDNVVIEVSIHDAFHQASSLRGLAGEIPTQEAAVLRLLLAIAIRATAEYRSDDEKVDDWAQWWESGLPLQQIDDYLGRCHDRFNLFDDKAPFMQVAGLHTSKGGYSGLIKIISEVPPNDKFFTTRDGPGIASLSYAEAARWLVHAQAFDISGIKSGAVGDPRVNGGKGYPIGTGISGPMGIVVIEGTSLAETILLNLFLEDDPQTDVPVWERPPQTAAPDAEHPVPTGCADLFTWQSRRVRLIAEADHVVDVLLCNGDKVEWKYLLHKDPSTAWRFSAPQTKAAGEIVYMPRSHDSSRAMWRGLEPLLAREPSPEDRRRKKAGEPDRAWLRPEILEQLAILTSDGALPDDHLIRMRTIGMEYGSQSAVVSTTIDDSLPTSLAVIANEQLGRLAVDCAHTAESLVFALQNLASDLAAATGDESEGVRPRAAEAGFSALDPAYREWFSRLTSTTDVDAATLAWRRTARRIMCEVGLQLCRDAGSAALTGRMVPVPNTERDDLMDLARAWQRFLSRMRASAPLPDDPQRDTKSSSKEQ

SEQ ID NO: 6022 - protein, 562 aa, Anaerococcus lactolyticus; identical to SEQ ID NO: 5276

SEQ ID NO: 6023 - protein, 565 aa, Anaerococcus prevotii; identical to SEQ ID NO: 5328

SEQ ID NO: 6024 - protein, 520 aa, Shigella
MNSFSLLTTPWLPVRFKDGTTGKLAPVDLADENVVDIAAPRADLQGAAWQFLLGLLQTSFAPKDYRRWDDIWEDGLESEKLREALRSLEHAFQFGPDSPSFMQDFEVLTGDKVPVASLLPEIPCAQTTKFNKDHFIKRGVTEYLCPHCSALALFSLQLNAPSGGKGYRTGLRGGGPMTTLIELQEYQGNQQTPLWRKLWLNVMPQDEADLPLPKKFDDLIFPWLGPTRTSELAGAVVTDDQVNKLQAYWGMPRRIRIDFNTTTVGNCDICGEQSDALLSLMTTRNYGANYAMWQHPLTPYRVPLKEGGEFYSVKPQPGGLIWRDWLGLIETGKSENNTELPAMVVKLFNPSSLKQAKVGLWGFGYDFDNMKARCWYEHHFPLLLNKKEGQIPKLRLAAQTASRILSLLRSALKEAWFSDPKGTRGDFSFVDIDFWNKTQHRFLRLVRQIEDGQDADELLGKWQKEMWLFARQDFDERVFTSPYEPVDLKRVMTARKKYFTTSAEKQNAKAAREKKQEAVE

SEQ ID NO: 6025 - protein, 404 aa, Shigella sonnei
MNSFSLLTTPWLPVRFKDGTTGKLAPVDLADENVVDISAPRADLQGAVWQFLLGLLQTSFAPKDHRRWDDIWEDGLEAEKLREALLSLEHAFQFGPDSPSFIQDFEALTGDKVPVASLLPEIPGAQTTKFNKDHFIKRGVTEYLCPHCSALALFSLQLNAPSGGKGYRTGLRGGGPMTTLIELQEYQGNQQTPLWRKLWINVMPQDEADLPLPKKFDDLVFPWLGPTRISELAGAVVTDEQVNKLQAYWGMPRRIRIDFNTTTVGNCDICGEQSDALLSLMTTKNYGANYAMWQHPLTPYRVLLKEGGEFYSVKPQPGGLIWRDWLGLIETGKSENNTELPALVVKLFNASSLKQAKVGLWGFGYDFDNMKARCWYEHHFPLLLNKKKARYRNCGWLRKRLHGF

SEQ ID NO: 6026 - protein, 558 aa, Fannyhessea vaginae; identical to SEQ ID NO: 5330

SEQ ID NO: 6027 - protein, 518 aa, Citrobacter youngae; identical to SEQ ID NO: 5289

SEQ ID NO: 6028 - protein, 479 aa, Lactobacillus iners; identical to SEQ ID NO: 5312

SEQ ID NO: 6029 - protein, 562 aa, Lactobacillus iners; identical to SEQ ID NO: 5315

SEQ ID NO: 6030 - protein, 562 aa, Lactobacillus iners; identical to SEQ ID NO: 5316

SEQ ID NO: 6031 - protein, 572 aa, Lactobacillus iners; identical to SEQ ID NO: 5317

SEQ ID NO: 6032 - protein, 480 aa, Streptococcus ictaluri
MSRFNLLDEPRLSVVIDDQGITKEVSLLDLFTNAHHYKDLAGDTKTQDFAVLRVLLAVLHTVFSRFDADGHPYDYLEVDERFRQVEVVEEEDIEEYAEDLYDTWVKLWEQGRFPEIISQYLEKWRDRFYLFDEEYPFFQVRKEDIEEVLDLEKTSGTLYGKNINRLISESENTCALFSPKYRAQKNKDLLTASEIIRWLLTYQGYSGAGDKQKFASQSGKHFIGWLYGLGGVYLHGNNLFETLMLNLILPYNEYDNLFHIQKPCWEFKSSEIVELTNVNNIASLYTIWSRGVYIAPNIDTNQPFLCRIAKIGRISEQDNFLEPMTLWKYNKTGVNRDTFTPKKHLSNQALWRSFGLLTIDHITRKPGIIDWLRKIKEELGDKNIIISAVSLKDDGNKSSMVPTDEIIDSLSINDFIVTDLRENGWVNRINDEVEETKKVISRTYKKYIDDIKEIRNISSSLFTNQKVEELYFKIDQPFRQ

SEQ ID NO: 6033 - protein, 555 aa, Streptococcus sp. C150; identical to SEQ ID NO: 5326

SEQ ID NO: 6034 - protein, 518 aa, Klebsiella variicola; identical to SEQ ID NO: 5287

SEQ ID NO: 6035 - protein, 503 aa, Parasutterella excrementihominis; identical to SEQ ID NO: 5334

SEQ ID NO: 6036 - protein, 518 aa, Klebsiella
MNTFSLLTTAWLPVRYRDGTTGKLAPVGLTDEDVVDIAATRADLQGAAWQFLIGLLQCAVAPKNRNGWEDTWEEGLSAETLVAALAPLEAAFQFGPDTPSFMQDFDSLAGDKVSVASLLPEVPGAQTTKFNKDHFIKRGVTNSFCPHCAALALFSLQLNAPSGGKGYRTGLRGGGPLTTLIELQEYEGERLTPLWRKLWLNVLPQDAADMPLPAAYDESVFPWLAPTRTSEQASAITTPEQVDKLQAYWGMPRRIRLDFAATQPGTCDICASESDGLLSQMAVKNYGINYDGWRHPLTPYRLALKGDGGFFSVKPQPGGLIWRDWLGLSQDNQTESNSEYPAQVVKVFNARGLRNIKAGLWGFGADFDNMKIRCWYEHHFPLLTDESTIPDLRKAAQTAARLLSLLRSALKEAWFDDPKGARGDFSFIDIDFWNQTQPLFLNLIHELENGQPAQERLDKWQRELWLFVRRCFDDRVFTNPYENNDLARCMTARKKYFATSAEKQSAKAARAKKQEAAQ

SEQ ID NO: 6037 - protein, 562 aa, Lactobacillus iners
MSDYNLIDEPWISVVVDYKGTTKLVGLKEFFEHAHEYIALAGDMPTQDFAVMRFLLAILHTVFSRYDAHGEPYEMIELNDRMQQIEKVDLEDEEDYEDALMETWRDLWNAKKFPEIVVKYLDAWHDRFYLFDDKYPFYQVTKEEIDTSKISKASPSKILGKNINRLISESGNKIALFSPKYDANNNKGLLTYDELTRWLITFQSYTGLSDKVIFGNEKYKASKGWLFDLGGVYLSSDNLYQTLILNLILINRSNVNYNYSVQKPCWENAPSKLVEKAIRSSCIDNIAELYTTWSRAIYFNKFNMDDVFQMEIVKLPDIKHEDMFLEPMTLWKYNNVGDNKGKFTPRKHQLNKSLWRSFGLMTKFEEAGEVNSKIPKRKPGIIEWLNDIDESIKNQHIKINAISMEDDGNATSWVPINEVEDKLDIGEFIVNDLQKNGWVDRINNIVDRTKDIIEKNYRAFLNDIAKIRGIESGAFTSSSIESMYFKIDKPFRDWLTNINYDDNKDEKEQIWNKELKNLVIRQAKIIIEQASPKDFTGIIENDSVKNIVTAYNNLMSNINKKL

SEQ ID NO: 6038 - protein, 572 aa, Peptoniphilus sp. oral taxon 836; identical to SEQ ID NO: 5303

SEQ ID NO: 6039 - protein, 579 aa, Megasphaera genomosp. type_1; identical to SEQ ID NO: 5288

SEQ ID NO: 6040 - protein, 569 aa, Oribacterium sp. oral taxon 108; identical to SEQ ID NO: 5337

SEQ ID NO: 6041 - protein, 518 aa, Klebsiella; identical to SEQ ID NO: 5332

SEQ ID NO: 6042 - protein, 555 aa, Oribacterium parvum
MSRFNLLEENWIRVLEEGEMKEVSLITIFENAEKYRCLAGEMATQDFAMLRFLLAVLHTVFSRVNADGEAYEFLEIDEKFRQKEAVSEDDEEEYNDALMETWKTLWQRGKFPSVVRKYLETWKEHFYLLDEKYPFYQVTKEEILSRLKDGKNPSSISGKNLNRNISESDNKVALFSPTTIEYKSKMKEGEFARWLIMLQGYIGLSDKAIVGEEKYKASKGWLFDIGGIFLNGDTLFETLMLNLRVAVKAVGDILPIQRPCWEYSGAENIDRSFLGIADNLAELYTNWSRASLLDSAIDFSKDIKLDIVKLPELDHRMTEIEPMTLWKYNDSGENKNFYTPRKYRPGQALWRSFGLITVPSDLSEDSREPGIITWLSKIEKYIQKPQVRISAVGMQDDGNATSWVPVNEMIDNLALHEIVLFEKGKEGWVMRIKELVEDTKEVVGFIYKGFLKDMYDIRNTKKSVEEELEQAYFGLDKAFRDWLSGIDESSSKEDKIKEWKELLFFSIKERALEKVNECRQRDIKGIYEENAKGVKNIFTAYEYFLIRLKKKINQE

SEQ ID NO: 6043 - protein, 556 aa, Gardnerella vaginalis; identical to SEQ ID NO: 5241

SEQ ID NO: 6044 - protein, 520 aa, Escherichia coli
MNSFSLLTTPWLPVRFKDGTTGKLAPVDLADENVVDIAAPRADLQGAAWQFLLGLLQTSFAPKDHRRWDDIWEDGLEAEKLREALLSLEHAFQFGPDSSSFMQDFEALTGDKVPVASLLPEIPGSQTTKFNKDHFIKRGVTEYLCPHCLALALFSLQLNAPAGGKGYRTGLRGGGPMTTLIELQEYQGNQQTPLWRKLWLNVMPQDEADLPLPKKFDDLIFPWLGPTRTSELVGAVVTHDQVNKLQAYWGMPRRIRIDFNTTTVGNCDICDEQNDALLSLMTTKNYGANYAMWQHPLTPYRVPLKEGGEFYSVKPQPGGLIWRDWLGLIETGKSENNTELPALVVKLFNASSLKQAKVGLWGFGYDFDNMKARCWYEHHFPLLLNKKEGQIPKLRLAAQTASRILSLLRSALKEAWFSDPKGARGDFSFVDIDFWNKTQHRFLRLVRQIEEGQDADELLGKWQKEMWLFARQDFDERVFTNPYEPVDLKRVMTARKKYFTTSAEKQSAKAAREKKQEAAE

SEQ ID NO: 6045 - protein, 543 aa, Escherichia coli
MIYRKGWKDGQPTWDGLFYERMRMNSFSLLTTPWLPVRFKDGTTGKLAPVDLADENVVDIAAPRADLQGAAWQFLLGLLQTSFAPKNHGRWDDIWEDGLEAEKLREALLSLEHAFQFGADSPSFMQDFEALKGDKVQVASLLPEIPGAQTTKFNKDHFIKRGVTEHVCPHCSALALFSLQLNAPSGGKGYRTGLRGGGPMTTLIELQEYQGNQQTPLWRKLWPNVMPQDEADLPLPKKFDDLVFPWLGPTRTSELAGAVVTHDQVNKLQAYWGMPRRIRIDFNTTTVGNCDICGEQSDALLSLMTTKNYGANYAMWQHPLTPYRIPLKEGGEFYSVKPQPGGLIWRDWLGLIETGKSENNTELPALVVKLFNASSLKQAKVGLWGFGYDFDNMKARCWYEHHFPLLLKKKEGQIPKLRLAAQTASRILSLLRSALKEAWFSDPKGARGDFSFVDIDFWNKTQHRFLRLVRQIEEGQDADELLGKWQKEIWLFARQDFDERVFTNPYEPVDLKRVMTARKKYFTTSAEKQSAKAAREKKQEAAE

SEQ ID NO: 6046 - protein, 522 aa, Enterobacteriaceae; identical to SEQ ID NO: 5880

SEQ ID NO: 6047 - protein, 519 aa, Citrobacter rodentium
MFPVNLIFCQWLPVRFKNGATGKLAPVDLADENVVDIAATRADLQGAAWQFLLGLLQSSIAPKNYSRWEDIWEEGLTGEMLHKALAPLGHAFHFGAESPSFMQDFEPLAGEKVSIASLLPEIPGAQTIKFNKDHFIKRGVTERLCPHCAALALFSLQLNAPSGGKGYRTGLRGGGPLTTLIELQEYKGERQTPLWRKLWLNVMPQDTADLPLPAVCDASVFPWLAATRTSEPPANTVTTPEQVNKLQMYWGMPRRIRLDFATTQTGLCDICGVESDALLGFMTVKNYGVNYDGWRHPLTPYRAPVKDKSGFFSVKLQPGGLIWRDWLGLNQKNSTEANEEYPAQVVNVFNAHKLAGVKAGLWGFGADFDNMKIRCWYEHHFPLLMTENLLSDLRKAVQTAARLLSLLRSALKEAWFASAKDARGDFSFIDIDFWNLTQGRFLHLIHDLETGQKPDERLNQWQRELWLFTRRYFDDRAFTNPYENNDLQRIMAARRKYFTTSAEKQSAKAAREKKQEAAE

SEQ ID NO: 6048 - protein, 556 aa, Gardnerella vaginalis; identical to SEQ ID NO: 5239

SEQ ID NO: 6049 - protein, 572 aa, Streptococcus mutans
MSRFNLLDEPWISVVFDEKGSTKEVSLLDFFQNAHHYKDLAGDTKTQDFAVLRVLLAVLHTVFSRFDANGNAYGYLEIDEKYRQIEEIEEDDLEEYEDDLYETWLTLWQNRQFPDIIEEYLKKWRDRFYLFDEEYPFFQVRKEDIEMVMDLNKDAGKIFGKNINRLVSESSNKIALFSPKHNYDNNKERLSNSEIVRWLLTYHGYSEIGGRMKKIGKRDYSKGWLYNLGGLFLKGKNLYETLLLNLTLFYFEYDNHLHIQKPCWEFDSAVIIDSYVSGKRIDNLASLYTSWSKEVYIDPHVVQPEFECRVAKIPAISPNDLFLEPMTLWKYEENSFQPQSHYTNQSLWRSFGLITMGGMEKLNHIPGIIDWQRTIKDNIENASINICSVGMVSDKTANNTPIIEVFDTLSINEFVLTDIQKDGWVIRINDEVDRVKKVISHTYAYFVKDVIVIRKHIEEKEIPKLKKSILRGSLFRQDYEKQISNRIEELYFKIDQPFRQWLSNIQPGDDKDSKILEWREILEKIVLKEAKSLLYEGNPRDYIGWSYGEPKTFHNIATAYESFTYWLNKNLK

SEQ ID NO: 6050 - protein, 555 aa, Streptococcus
MSRFNLLDEPWISVVYDEKGSTKDVSLQDLFTNAHQYKELAGDTKTQDFAVLRVLLAVLHTVFSRFDVDGNVYEYLTIDERWNQLEPVDEMDIENYVEALYETWEKLWANKIFPNIVNQYLEKWRDRFYLFDEKYPFFQVTKEEIAGDKISKAKASSIWGKNINRIISESGNKIALFSPKDGENKNTLTAAELARWLITFQGYSGLSDKVIFGNEKYKSSKGWLFDIGAIYIKGNTLFETLLLNYISPYNERGNVENIQRPCWELESSDIIKSYLDEKDITNIASLYTVWSRGIYIDPDFNLNKPFSFEIVKLPDINHRDNFLEPMTIWKYNVSGENRDSYTPKKHFLNQSLWRSFGLLSIKDTNLQYRKPGVIDWLTYIDDIIGNRLSTIVAISMQDDGNATSWLPTDEVIDSIFINDLVLTDLDEGGWVPRINEVVEETKKIISRTYKTYINDIKEIRNISNGSYTQQMVESLYFKIDQPFRQWLASIQPEDNKDSKIQEWRVLLKKIVKAEAEVILHQGGTRDYLGIQKDGRIKNIATAYNSFDFWLRQQLK

SEQ ID NO: 6051 - protein, 555 aa, Streptococcus salivarius; identical to SEQ ID NO: 5248

SEQ ID NO: 6052 - protein, 492 aa, Klebsiella michiganensis
MNLADESVVDIAAARADLQGAAWQFLLGVLQCSMAPKNHSRWEDVWFEGLSADALQRALEPLKPAFQFGADTPSFMQDFEQLSGEKVSIASLLPEIPGAQTTKFNKDHFVKRGVTERFCPHCAALALFSLQLNAPSGGKGYRTGLRGGGPMTTLIELQEYQGNRQTPLWRKLWLNVMPQDSAGMPVPERYDETIFPWLAPTRTSEQASAVTTPEQVNPLQAYWGMPRRIRLDFNATHSGRCDLCESESHELLSGMTVKNYGVNYAGWIHPLTPYRLPLKEGSERYSVKPQPGGLIWRDWLGLNQQGASENNTEYPALVVTTSSARSLKDVKVGLWGFGYDFENMKARCWYEHHLPLILTENIIPELRQAAQTASRNLSLLRSALKEAWFADAKGARGDFSFIDIDFWHLTQGCFLELMRDLENGQNADERLNRWQTNIWLFTRSYFDDHVFTNPYEGIDLKRIMLARKKYFTKSAEKQSAKTARAKKQEAAE

SEQ ID NO: 6053 - protein, 558 aa, Gardnerella vaginalis; identical to SEQ ID NO: 5773

SEQ ID NO: 6054 - protein, 556 aa, Gardnerella vaginalis; identical to SEQ ID NO: 5779

SEQ ID NO: 6055 - protein, 486 aa, Citrobacter freundii
MVDIAATRADLQGAAWQFLLGLLQCSIAPKNSARWDDIWVEGLTEETLREALTPLEHAFQFGAESPSFMQDFEPLSGEKVSIASLLPETPGAQTTKFNKDHFIKRGVTERFCPHCAALALFSLQLNAPSGGKGYRTGLRGGGPMTTLIELQEYQGTRQTPLWRKLWLNVMPQDAAELPLPDLYDASIFPWLAATRTSEPPANRVTTPELVNKLQAYWGMPRRIRLDFATTQSGFCDMCGADSDELLSAMTVKNYGVNYEGWRHPLTPYRLPIKESDGFFSVKPQPGGLIWRDWLGLSQDNQTDTNKEYPALVVKVFNARSLKDIKAGLWGFGADFDNMKIRCWYEHHFPILMTENLIPHLRKAMQTATRLLSLLRNALKDAWFADAKGARGDFSFIDIDFWNLTQGRFLTLIHDLENGQEPGDRLNKWQRELWLFTRRYFDDRVFTNPYEDNDLKRSMMARKKYFTTSAEKQSAKTVRDKKQEAAE

SEQ ID NO: 6056 - protein, 522 aa, Escherichia coli; identical to SEQ ID NO: 5906

SEQ ID NO: 6057 - protein, 579 aa, Gardnerella vaginalis; identical to SEQ ID NO: 5776

SEQ ID NO: 6058 - protein, 553 aa, Gardnerella vaginalis; identical to SEQ ID NO: 5778

SEQ ID NO: 6059 - protein, 519 aa, Salmonella enterica; identical to SEQ ID NO: 5255

SEQ ID NO: 6060 - protein, 518 aa, Salmonella enterica; identical to SEQ ID NO: 5257

SEQ ID NO: 6061 - protein, 553 aa, Gardnerella vaginalis; identical to SEQ ID NO: 5780

SEQ ID NO: 6062 - protein, 550 aa, Actinobaculum sp. oral taxon 183; identical to SEQ ID NO: 5854

SEQ ID NO: 6063 - protein, 556 aa, Actinomyces graevenitzii; identical to SEQ ID NO: 5852

SEQ ID NO: 6064 - protein, 555 aa, Actinomyces johnsonii; identical to SEQ ID NO: 5853

SEQ ID NO: 6065 - protein, 555 aa, Actinomyces johnsonii; identical to SEQ ID NO: 5855

SEQ ID NO: 6066 - protein, 556 aa, Actinomyces sp. oral taxon 172; identical to SEQ ID NO: 5856

SEQ ID NO: 6067 - protein, 554 aa, Actinomyces sp. oral taxon 877; identical to SEQ ID NO: 5857

SEQ ID NO: 6068 - protein, 557 aa, Streptococcus sobrinus; identical to SEQ ID NO: 5859

SEQ ID NO: 6069 - protein, 573 aa, Peptostreptococcaceae bacterium oral taxon 113; identical to SEQ ID NO: 5860

SEQ ID NO: 6070 - protein, 547 aa, Ruminococcus callidus; identical to SEQ ID NO: 5861

SEQ ID NO: 6071 - protein, 503 aa, Parasutterella excrementihominis CAG:233; identical to SEQ ID NO: 5267

SEQ ID NO: 6072 - protein, 485 aa, Salmonella enterica; identical to SEQ ID NO: 5874

SEQ ID NO: 6073 - protein, 543 aa, Escherichia coli; identical to SEQ ID NO: 5884

SEQ ID NO: 6074 - protein, 212 aa, Escherichia coli; identical to SEQ ID NO: 5891

SEQ ID NO: 6075 - protein, 338 aa, Escherichia coli; identical to SEQ ID NO: 5890

SEQ ID NO: 6076 - protein, 543 aa, Escherichia coli; identical to SEQ ID NO: 5878

SEQ ID NO: 6077 - protein, 522 aa, Escherichia coli; identical to SEQ ID NO: 5879

SEQ ID NO: 6078 - protein, 518 aa, Salmonella enterica; identical to SEQ ID NO: 5902

SEQ ID NO: 6079 - protein, 519 aa, Salmonella bongori
MKSFSLLTSCWLPVRFKDGSMGKMAPVDLADENVVDIAATRADLQGAAWQFLLGVLQCSIAPKRYKNWEDIWLDGLQADTLRKALAPLEHAFQFGPESPSFMQDFEELPDNKITIASLLPETPGIQTTELNTDHFIKRGVMECFCPHCAALALFSMQLNAPSGGQGYRTGLRGGGPLTTLIELQEYQGERQTPLWRKLWLNVMPQDAADLPLPVVYDAAVFPWLAATRTSEPPAHTITTDEQVNKLQAYWGMPRRIRLDFATIRQGVCNICGNNSDELLIQMLVKNYGVNYDRWRHPLTPHRLQIKDSKGFEPVITQPGGLLWRDWLGLSQENPTEKNTEYPAQVIKVFNARKLRNIKVGLWGFGADFKKMKIRCWYEHHFPLLMTEGLMPDLRKATQTAARLLSLLRSALKEAWFANAKDARGDFSFIDIDFWNLTQGDFLNLIRDLENGGEPDELLTKWRRELWLFTRRYFDDRVFTNPYESNDLKRIMTARKKYFTTSAEKQSAKTARAKKQEAAE

SEQ ID NO: 6080 - protein, 518 aa, Salmonella enterica
MDNFSLLTTPWLPVRFKDGSTGKLAPVDLADENVVDIAATRADLQGAAWQFLLGLLQCSIAPKRYKNWEDIWFDGLHADALHKALAPLEHAFQFGAETPSFMQDFEPLTGEKVSIASLLPEIPGAQTTKFNKDHFIKRGVTERFCPHCAALALFSLQLNAPAGGKGYRTGLRGGGPLTTLVELQEYQGERQTPLWRKLWLNVMPQDVADLPLSDQCDAAVFPWLAATRTSEQANAVTTPDQVDKLQAYWGMPRRIRLDFATLQSGCCDICGAESDELLGFMTVKNYGVNYDGWRHPLTPYRAPVKDQNAFFSVKPQPGGLIWRDWLGLSQNNHTEANYESPAQVVKVFNARRLRDVKAGVWGFGADFDNMKIRCWYEHHFPLLMTEGLIPDLRKATQTATRLLSLLRGALKEAWFANAKDARGDFSFIDIDFWNLTQGRFLNLIHDLENGHKPDERLNKWQRELWLFTRCYFDDHVFTNPYESSDLERIMKARKKYFTSSAEKQSAKAAKAKKQEAAE

SEQ ID NO: 6081 - protein, 518 aa, Salmonella enterica
MDNFSLLTTPWLPARFKDGSTGKLAPVDLADENVVDIAATRADLQGAAWQFLLGLLQCSIAPKRYKNWEDIWFDGLHADALHKALAPLEHAFQFGAESPSFMQDFEPLTGEKVSIASLLPEIPGAQTTKFNKDHFVKRGVTERFCPHCAALALFSLQLNAPAGGKGYRTGLRGGGPLTTLVELQEYQGERQTPLWRKLWLNVMPQDTADLPLPDQCDATVFPWLAATRTSEQANAVTTPEQVNKLQAYWGMPRRIRLDFATLQSGCCDICGAESDELLGFMTVKNYGVNYDGWRHPLTPYRAPVKDQNAFFSVKPQPGGLIWRDWLGLSQNNQTEANYESPAQVVKVFNARSLTDVKAGIWGFGADFDNMKIRCWYEHHFPLLMTEGLIPDLRKAVQTAARLLSLLRSALKEAWFANAKDARGDFSFIDIDFWNLTQGRFLNLIHDLENGHKPDERLNKWQRELWLFTRCYFDDRVFTNPYESSDLERIMKARKKYFTSSAEKQSAKAAKAKKQEAAE

SEQ ID NO: 6082 - protein, 520 aa, Escherichia coli
MNSFSLLTTPWLPVRFKDGTTGKLAPVDLADENVVDIAAPRADLQGAAWQFLLGLLQSSFAPKDYRRWDDIWEDGLEAEKLREALLSLEHAFQFGPDSPSFMQDFEVLMGDKVQVASLLPEIPGAQTTKFNKDHFIKRGVTEHVCSHCSALALFSLQLNAPSGGKGYRTGLRGGGPMTTLIELQEYQGNQQAPLWRKLWLNVMPQDEADLPLPKKFDDLVFPWLGPTRTSELAGAVVTDDQVNKLQAYWGMPRRIRIDFNTTTVGNCDICGEQSDALLSLMTTKNYGANYAMWQHPLTPYRVPLKEGGEFYSVKPQPGGLIWRDWLGLIETGKSENNTELPVLVVKLFNASSLKQAKVGLWGFGYDFDNMKARCWYEHHFPLLLNKKEGQIPKLRLAAQTASRILSLLRSALKEAWFSDPKGARGDFSFVDIDFWNKTQHRFLRLVRQIEEGQDADELLGKWQKEIWLFARQDFDERVFTNPYEPVDLERVMTARKKYFTTSAEKQSAKAAREKKQEAAE

SEQ ID NO: 6083 - protein, 519 aa, Escherichia coli
MNSFSLLTTPWLPVRFKDGTTGKLAPVDLADENVVDISAPRADLQGAVWQFLLGLLQTSFAPKDHRRWDDIWEDGLEAEKLREALQSLEHAFQFGPDSPSFMQDFDELKVKATSIASLLPDAPGKQTKERNTDHFIKRDTTQHLCLHCVPLALFSIQLNAPIGGRGYYPGLRGGGPLTTLIELLEYQGNQQTPLWRKLWLNVMPQDEADLPLPKTFDDLVFPWLAPTRTSELDGAVVTDEQVNKLQAYWGMPRRIRIDFKTTSIGNCDICGRQSDALLGLMSLKNYGVQYVMWRHPLTPRLPLKEGGDFYSVKPQPGGLIWRDWLGLIEVGNSKNNTELPAQVVKLLNASNLKQTRVGLWGFGFDFEDMKVRCWYEHHFPLLLNKKEDLIPKLRLAAQAASHILSLLHRALKEAWFSEKKTTKLDFGFVDIDFWNKTQHRFLRLVRKIEEGQDPDELLSKWQKEMWLFARQDFDDRVFTNPYEPVDLERVMTARKKYFTTSAEKQNANAAREKKQEAAE

SEQ ID NO: 6084 - protein, 520 aa, Escherichia coli
MNSFSLLTTPWLPVRFKDGTTGKLAPVDLADENVVDIAAPRADLQGAAWQFLLGLLQTSFAPKNHGRWDDIWQDGLEAEKLREALLSLEHAFQFGADSPSFMQDFEALKGDKVQVASLLPEIPGAQTTKFNKDHFIKRGVTEHVCPHCSALALFSLQLNAPSGGKGYRTGLRGGGPMTTLIELQEYQGNQQTPLWRKLWPNVMPQDEADLPLPKKFDDLVFPWLGPTRTSELAGAVVTHDQVNKLQAYWGMPRRIRIDFNTMTVGNCDICGEQSDALLSLMTTKNYGANYAMWQHPLTPYRIPLKEGGEFYSVKPQPGGLIWRDWLGLIETGKSENNTELPALVVKLFNASSLKQAKVGLWGFGYDFDNMKARCWYEHHFPLLLKKKEGQIPKLRLAAQTASRILSLLRSALKEAWFSDPKGARGDFSFVDIDFWNKTQHRFLRLVRQIEEGQDADELLGKWQKEIWLFARQDFDERVFTNPYEPVDLKRVMTARKKYFTTSAEKQSAKAAREKKQEAAE

SEQ ID NO: 6085 - protein, 520 aa, Escherichia coli
MNSFSLLTTPWLPVRFKDGTTGKLAPVDLADENVVDIAAPRADLQGAAWQFLLGLLQTSFAPKDHRRWDDIWEDGLEAEKLREALLSLEHAFQFGPDSSSFMQDFEALTGDKIPVASLLPEIPGAQTTKFNKDHFIKRGVTEYLCPHCSALALFSLQLNAPAGGKGYRTGLRGGGPMTTLIELQEYQGNQQTPLWRKLWLNVMPQDEADLPLPKKFDDLIFPWLGPTRTSELAGAVVTHDQVNKLQAYWGMPRRIRIDFNTTTVGNCDICDEQNDALLSLMTTKNYGANYAMWQHPLTPYRVPLKEGGEFYSVKPQPGGLIWRDWLGLIETGKSENNTELPALVVKLFNASSLKQAKVGLWGFGYDFDNMKARCWYEHHFPLLLNKKEGQIPKLRLAAQTASRILSLLRSALKEAWFSDPKGARGDFSFVDIDFWNKTQHRFLRLVRQIEEGQDADELLGKWQKEIWLFARQDFDERVFTNPYEPVDLKRVMTARKKYFTTSAEKQSAKAAREKKQEAAE

SEQ ID NO: 6086 - protein, 520 aa, Escherichia coli
MNSFSLLTTPWLPVRFKDGTTGKLAPVDLADENVVDIAAPRADLQGPAWQFLLGLLQSSFAPKDYRRWDDIWEDGLEAEKLREALLSLEHPFQFGPDSPSFMQDFEVLMGDKVQVASLLPEIPGAQTTKFNKDHFIKRGVTEHVCSHCSALALFSLQLNAPSGGKGYRTGLRGGGPMTTLIELQEYQGNQQAPLWRKLWLNVMPQDEADLPLPKKFDDLVFPWLGPTRTSELAGAVVTDDQVNKLQAYWGMPRRIRIDFNTTTVGNCDICGEQSDALLSLMTTKNYGANYAMWQHPLTPYRVPLKEGGEFYSVKPQPGGLIWRDWLGLIETGKSENNTELPALVVKLFNASSLKQAKVGLWGFGYDFDNMKARCWYEHHFPLLLNKKEGQIPKLRLAAQTASRILSLLRSALKEAWFSDPKGARGDFSFVDIDFWNKTQHRFLRLVRQIEEGQDADELLGKWQKEIWLFARQDFDERVFTNPYEPVDLERVMTARKKYFTTSAEKQSAKAAREKKQEAAE

SEQ ID NO: 6087 - protein, 426 aa, Shigella boydii
MRFSTIVSVVTLVWGISPRQPSGKNIIRWLLKKRTNGSVRYCQYTSTEYLCPHCSALALFSLQLNAPSGGKGYRTGLRGGGPMTTLIELQEYQGNQQTPLWRKLWLNVMPQDEADLPLPKKFDDLIFPWLGPTRTSELAGAVVTDDQVNKLQAYWGMPRRIRIDFNTTTVGNCDICGEQSDALLSLMTTRNYGANYAMWQHPLTPYRVPLKEGGEFYSVKPQPGGLIWRDWLGLIETGKSENNTELPAMVVKLFNPSSLKQAKVGLWGFGYDFDNMKARCWYEHHFPLLLNKKEGQIPKLRLAAQTASRILSLLRSALKEAWFSDPKGTRGDFSFVDIDFWNKTQHRFLRLVRQIEDGQDADELLGKWQKEMWLFARQDFDERVFTSPYEPVDLKRVMTARKKYFTTSAEKQNAKAAREKKQEAVE

SEQ ID NO: 6088 - protein, 556 aa, Gardnerella vaginalis 409-05; identical to SEQ ID NO: 5239

SEQ ID NO: 6089 - protein, 472 aa, Oceanithermus profundus DSM 14977; identical to SEQ ID NO: 5242

SEQ ID NO: 6090 - protein, 523 aa, Deinococcus proteolyticus MRP; identical to SEQ ID NO: 5243

SEQ ID NO: 6091 - protein, 500 aa, Marinithermus hydrothermalis DSM 14884; identical to SEQ ID NO: 5245

SEQ ID NO: 6092 - protein, 574 aa, Coriobacterium glomerans PW2; identical to SEQ ID NO: 5244

SEQ ID NO: 6093 - protein, 502 aa, Sphaerochaeta coccoides DSM 17374; identical to SEQ ID NO: 5247

SEQ ID NO: 6094 - protein, 493 aa, Thermus thermophilus JL-18; identical to SEQ ID NO: 5249

SEQ ID NO: 6095 - protein, 555 aa, Streptococcus salivarius 57.I; identical to SEQ ID NO: 5248

SEQ ID NO: 6096 - protein, 517 aa, Thiocystis violascens DSM 198; identical to SEQ ID NO: 5250

SEQ ID NO: 6097 - protein, 545 aa, Desulfomonile tiedjei DSM 6799; identical to SEQ ID NO: 5251

SEQ ID NO: 6098 - protein, 521 aa, Pelobacter carbinolicus DSM 2380; identical to SEQ ID NO: 5237

SEQ ID NO: 6099 - protein, 578 aa, Lactobacillus buchneri CD034; identical to SEQ ID NO: 5252

SEQ ID NO: 6100 - protein, 506 aa, Geobacter sulfurreducens KN400; identical to SEQ ID NO: 5236

SEQ ID NO: 6101 - protein, 492 aa, Thermus oshimai JL-2; identical to SEQ ID NO: 5253

SEQ ID NO: 6102 - protein, 546 aa, Mycobacterium smegmatis JS623; identical to SEQ ID NO: 5254

SEQ ID NO: 6103 - protein, 518 aa, Salmonella enterica subsp. enterica serovar Heidelberg str. CFSAN002069; identical to SEQ ID NO: 5258

SEQ ID NO: 6104 - protein, 518 aa, Salmonella enterica subsp. enterica serovar Typhimurium var. 5- str. CFSAN001921; identical to SEQ ID NO: 5256

SEQ ID NO: 6105 - protein, 518 aa, Salmonella enterica subsp. enterica serovar Cubana str. CFSAN002050; identical to SEQ ID NO: 5257

SEQ ID NO: 6106 - protein, 518 aa, Salmonella enterica subsp. enterica serovar 4,[5,12:i:- str. 08-1736; identical to SEQ ID NO: 5256

SEQ ID NO: 6107 - protein, 519 aa, Salmonella enterica subsp. enterica serovar Bareilly str. CFSAN000189; identical to SEQ ID NO: 5255

SEQ ID NO: 6108 - protein, 518 aa, Salmonella enterica subsp. enterica serovar Pullorum str. S06004; identical to SEQ ID NO: 5260

SEQ ID NO: 6109 - protein, 520 aa, Escherichia coli LY180; identical to SEQ ID NO: 5261

SEQ ID NO: 6110 - protein, 518 aa, Salmonella enterica subsp. enterica serovar Thompson str. RM6836; identical to SEQ ID NO: 5256

SEQ ID NO: 6111 - protein, 519 aa, Salmonella enterica subsp. enterica serovar Agona str. 24249; identical to SEQ ID NO: 5264

SEQ ID NO: 6112 - protein, 160 aa, Escherichia coli str. K-12 substr. MG1655
MADEIDAMALYRAWQQLDNGSCAQIRRVSEPDELRDIPAFYRLVQPFGWENPRHQQALLRMVFCLSAGKNVIRHQDKKSEQTTGISLGRALANSGRINERRIFQLIRADRTADMVQLRRLLTHAEPVLDWPLMARMLTWWGKRERQQLLEDFVLTTNKNA

SEQ ID NO: 6113 - protein, 147 aa, Geobacter sulfurreducens PCA
MERTHDFMGLYQAWERLAPGPRAELRRVERPDDLLEVPAFYRLFSGRGTTEWEKGAYQRLIFCLPCIKHSGENISLGRALAKGRGVGEKRLFQVVRSSEPNDMIQLRRILRMAEPTVNWDLAARQLWYWNDRSKRDLLEDYFLNHSN

SEQ ID NO: 6114 - protein, 181 aa, Pelobacter carbinolicus DSM 2380
MREQEFWSEEAKQKLRAWFCWLDDNRGDRARLRRAETPDDVVLTEPFFNFLRQMPESWARPWNLPIAAMVAAVLAHVKKDEDKDKKDKDKKSFAAQLASPKPGTDRPCMSEMRFQQLQKSRTPDEFFRRLIRAVKLADSHVNIISLADSIRRWMNEYRYGISLKPLDRLAVRWASDYYTSK

SEQ ID NO: 6115 - protein, 173 aa, Desulfatibacillum aliphaticivorans
MEKDEQLRKTRGTEFVSYAIKRMAQDAGYGARLRRADNPATESQSWEHLVGWCDLEKPWERTSFASIAAALARAKPEKDGAWGIGRALASCYDEKKDSQPARARLRRLLACDDAEEACRVLRPMLALIRSKGKPLCYARLLDELLWFGEKRKLRWAEDFFGRREQDDSDHVHP

SEQ ID NO: 6116 - protein, 204 aa, Gardnerella vaginalis 409-05
MAENQNKSVEVSNAVRKIINQFIEIADTSSYRAMLAQLRHTIGKPLSQSVEIWPWILNNVPESFMDKYGEVSYQLRAVINTLQIYALYEQGVAEKSSYKDLNKSEDSVNEKSYNNMGTALRTLRSDEGVRGAMDRRFSVMITASDYESFYYYLRQLVRLLKSRTKENQQTIDYSKLARDLYLLQFEDSEKVRLSWAQEYYRFTK

SEQ ID NO: 6117 - protein, 147 aa, Geobacter sulfurreducens KN400; identical to SEQ ID NO: 6113

SEQ ID NO: 6118 - protein, 204 aa, Gardnerella vaginalis ATCC 14019
MAENKSKSVEVSNAVSKIINQFLNSSDIASRRTMLAQLRHTIGKPLSQSIEIWPWILNNVPESFIDKYGEVNYQLRAVINTLQIYALYEQGVAEKSSYKDLNKSEDSENEKSYNNMGTALRTLRSDEGVRGAMDRRFSVMITANDYESFYYYLRQLVRLLKSRTKENQQSIDYSKLARDLYLLQFEDSEKVRLSWAQEYYRLSK

SEQ ID NO: 6119 - protein, 160 aa, Oceanithermus profundus DSM 14977
MPEHPFANYLLGLKARPRALAELRRVAPATAHEDVTAIKHLAGWAGESALGPLRSPFVVAVLFAYHPAHEPLVPFAEAVRRLGRDEALDRRMERLLVAEWSVLPELLRQMVRRLKTADQGFDYGYLFADLERIETRRNPDPRIAWARTYYRLAKADQPTK

SEQ ID NO: 6120 - protein, 228 aa, Deinococcus proteolyticus MRP
MTNPPTTDDRPARFVRELVRLERGKLAQLRRGLGGDNRSVYWLEGLYARTGYAEATPTGKEALRLVAGLYALKPKALDDGDEPEQSAETAPEAPRKAVSIGKQMGQLYLQQDRRPSTEKRFLALLDTDREGIGYHMRQVVTLLDTADLTPDWERLVTDLLYWSDRTRKGWAQDFYAEIFREENRQDDKTGGTLPSSDTSVGSPASAPLFASSQPDHQPADQDDEGETL

SEQ ID NO: 6121 - protein, 219 aa, Coriobacterium glomerans PW2
MSNTYEVAGKLGAFAARKIQILQRDYLGSGSRAAHARSVLAQLRRLHEPGSSTWIMAGRELFENWPELDLGPSEETRALRAVATSFKFYAIHQQSNTVGMSMPHKKKDGAQVPRRNPYSFGQACRQIDPDIDRSGAIRRRLASIEAAYDFEGIAYHMRGLIKLMSSKQIGLDYFSLIKDLYLVQCDGLKDRVLIDWSRAYFGSLETEPQKAAAIEIEKA

SEQ ID NO: 6122 - protein, 168 aa, Marinithermus hydrothermalis DSM 14884
MKETAKRFVAYLEALKGQKAWTRARAALRRSLAFDPGAYPPAMPYVEPFVREEGWRREAHYLVAALYALKDGDHQEGRTLARALRGKAQDSASIERRFLALLDADRDQITHRLRQAVGLVEGGLDFALLLNDLIYWFYPEKTVQARWAREFFGTPSEGSGTEATEVTK

SEQ ID NO: 6123 - protein, 200 aa, Salmonella enterica subsp. enterica serovar Typhi
MLNSNTAVLCRILHPDAQKALLDWFATLSERYERKDGKRVNGRAWRAELKRMAPPYGVMICEGHDALRQALLKHMRLQPLDEMALALFVSVAVHIKSHKENISFAAQLGEKLKGSTSCVSGLRFERLQKASDPETFCQLLIQAVKIRGTEGVNVLSLADGIFLWMEEWQRRENHQPEFRNPFERSRIRWANEYLSTSRGK

SEQ ID NO: 6124 - protein, 175 aa, Sphaerochaeta coccoides DSM 17374
MGNDAFLSMISHAKTSKNKRLLAKLKKADHEETEFLCWDILVHWVDLEKTVQRRAYGLIAAGFAKSKDEGDGSLGLGDSLYQSFASTNKGGEPDTSSEAARLSRILSCSSALELIDVLRPIINLLISRSITLSFKQLLSDILSFDNEERRQKIRVHWAQQFYGKHKGKDNGEEQI

SEQ ID NO: 6125 - protein, 170 aa, Thermus thermophilus JL-18
MSQGEPFLDWLKRLQGQKVWTAARAALRRSLAFPPGAYPRAMPYVEPFLAKRDWRQEEREAYYLVAALYALKDGDHQVGRTLAQALALRKKATGSASVEKRFLALLEADRDQIAFRLRQAVALVEGGIDFARLLDDLLRWFSPERHVQARWAREFYGAEASEEEKKEVEA

SEQ ID NO: 6126 - protein, 191 aa, Thiocystis violascens DSM 198
MNLHKEIAVTDWGEYPFPQGKPDHPSFGLLIAWWRRLEDDKGERAFLRRAGTLTEVMLSPSFVDLLRTLRNQGYAVSNHNHPLSRIAAIAGLSARIKAPADAGLATRMGTPKAAGSTPTVSQLRLRRILACDDIEELYTLLRRALAVLDDKADLADLAATVWNWSPLDDKRPYDPRRRLAYDYYAAAPIKS

SEQ ID NO: 6127 - protein, 200 aa, Desulfomonile tiedjei DSM 6799
MAEKRFINFTRKTEWGEALQKWHRRLADNRGDRAALKKCKSLTQVVFVPAYHELYQEITTVGRAAAKAKAITWSWARLEGRVRDRLPIIASLTALIESPKESDRKNDPEDKVVSLPSQMGAIRSSGGGPLVSDLRFRRLLKCRTPEELYPMLRRVIGLLNNQTDIMSLAQSMFYWDEEMRKEWAYDYYTTEEIAKEGSES

SEQ ID NO: 6128 - protein, 200 aa, Lactobacillus buchneri subsp. silagei CD034
MERTINQITYEIIQELYGHGNPNKAVLASIRSAASMTSPRAQKVWPIMMDKLEKSMLSKNGQPTHAETAIYAALRLYAIHQQSSRDAFVYGSSGRDASADGLTFFQALANLRRNSDTREALDRRVQALFGTTNVNSVINSMTHLIDILKATNPTQKIDYPKLANDLYWFQKSYQDATQTRLKWGQQYYQFIKPTTEGEKK

SEQ ID NO: 6129 - protein, 166 aa, Thermus oshimai JL-2
MKEGARVFLARLEDLKGRKTWTPARAALRRSLAFEPGTYPPAIGMVEPLLPGEAEGWIREAYYLVAALYALKDGEHREGRTLAQALREKAGDSASVEHRFLALLDADRDQIAFRLRQSVVLVEGGLDFARLLADLLAWFSPDRWVQARWAREFYGVKEEEKEEVKA

SEQ ID NO: 6130 - protein, 216 aa, Mycobacterium sp. JS623
MTAETSVSEPRASLDDQLRTAVLRVVADLQRRYFSNPRDTYVAARLAKLRRAGPSAPGSDPDVWADTIGALPERLCQGTHTENEPTDFERAAHEAITLYALHQQSRSTGVHRRGISLGCAVRRLARATGRDEAIRRRFQVVATAGTSAAVVHHLRALIMLMRSENIPLDYAQLAVDLRQLRDGSRADQVRLRWGRDFHRATTGDPENPAPDDLPAH

SEQ ID NO: 6131 - protein, 160 aa, synthetic Escherichia coli C321.deltaA; identical to SEQ ID NO: 6112

SEQ ID NO: 6132 - protein, 190 aa, Lactobacillus pasteurii DSM 23907 = CRBIP 24.76
MIKVDQVTYSLINRIYNNGNMDRATLSTLRSTTSFSSSRARRVWPIILPMLDVQDLSRNGEPTYAENAIFVALRGYAIMQQANNERCANGDEELFAALASLRQITDISEGVDRRVKNLFLSTSFASMQVALIQLIKLLKSNLPAKQVNFSRLAKDLYFYQLNGHSAEKTFLKWGQQYYRASVKNNEKGDK

SEQ ID NO: 6133 - protein, 200 aa, Lactobacillus equicursoris DSM 19284 = JCM 14600 = CIP 110162
MAHDIERVTSQIIEQLYNNGDMDKAALAALRSTASLDGSRAQKVWPIFLANMKEEWLSKNGKQTHAEKAIFAAVRMYAVHQQANEVCVYAKKSKDANEDGGVEFFEALNRLKNSDSETALNRRVEALLGSTNVQAVIDQLTHLMQIVKGKKTGIKIDYARLASDLYRFQFGYQEANQVRLLWGEQYYRLNKQDQKNEDKN

SEQ ID NO: 6134 - protein, 183 aa, Parasutterella excrementihominis CAG:233
MSFIRGTEYANKLNSWHNNLEEDRQQRASLRRCSSLLDVYTSSGFRDLLFKLKPLWEGKAAWRFTALAIIAGVVSHVSENDPTLSFAERMAQKNGGAPVMSELRFRRLLAVRTEEGLFRELRRAVKLADGRLNIVSLADDVFRWCADNQMLAFNKGQDIRPTDLIQVRWSLDYYGASDDNNQE

SEQ ID NO: 6135 - protein, 111 aa, Schaalia odontolytica ATCC 17982
MHDTSDRPRSFASAVRVVAEGQSGDKRAEETPIYRRFSAAVQAPTFEGLLVHLRSLISQLEAAEIPCDYAQLAADLFTWQDPRDRTSVMRNWGRQFARPAETIHTETDSDD

SEQ ID NO: 6136 - protein, 204 aa, Faecalibacterium prausnitzii M21/2
MKTQDVKLYAAQQLHRLQALPDNQRRAELAKLRRGIGHAPGELPELWGCFLLGMPESFQGRSAPSAAEWAVYLALTLYAVHQQGNDRPMNCPGNTLGRAVRQLAERNSAGQDWTEASVLRRFNALATAEEITEISHHLRGMIRLLSAAKDGGIPLDYPQLAADLYELQCTDPRYAQIPANVRLRWGQDLYRDPKPAPEEKEKET

SEQ ID NO: 6137 - protein, 217 aa, Bifidobacterium catenulatum DSM 16992 = JCM 1194 = LMG 11043
MTMASLSRYDKAKAVGKYAASLVYDVQREYVSGSGSSARGRARLSRLHRDLDGVSPSWMLIGDELFSNWPAELDAPADNSPEFERQSNAIRAALGLYAVHQRSKKQGVAQKFQSNPSLRMTFGRACRRIEPDTDNAKGILRRLRVAENAPDFNGIVRSIRALIMLMRNTDIQVDYGSLASDLYLLQFSDSRGPVFQRWGRDYYAKLPSTQNGQKTDK

SEQ ID NO: 6138 - protein, 126 aa, Actinomyces urogenitalis DSM 15434
MTLYGIHQQSRTEPMHVPGRGLGQAARTLIGPPDDELSSARARFNALVTSTTTSELTHHLQAFVSQLRARRIPLDYAALADELVRFQQADGAKTVRLTWARQYAGLEHTPTPDNTDSTDSHSTLEH

SEQ ID NO: 6139 - protein, 223 aa, Corynebacterium accolens ATCC 49725
MHDTSHPQAGTTAEYTGPRLRTSVARTAEALQNDYLHSPQHNKQARARAVLAQLRKYSAVRLEQHPVALEEVLLLLEPALSEQEMGKGAAPSASELAAFQAMTMLGIHLQSASTEAHIKGQSFARACGRFYAHSQSQSTKPRFDAMLVSSDEASRLIHIRSLVTLLRGENLGFDYGAFAQDLRVLGSKNATQKAHTQRQGVLLKWARDFALGSYASSQTEPTS

SEQ ID NO: 6140 - protein, 208 aa, Corynebacterium glucuronolyticum ATCC 51867
MTTDEKPATGPGLSTSVGKTAARLQDSFFGAHGDRAQARARATLADLRRNAGKTAASDPLAMENVLLELNPPLGESLLGKGDRTSPSEDAAFAAISFFALHMQSAKRPMHVPDVSFARACGLLDLRSDSDSLKPRFDAILLTQDLQAQVIHIRSLIQLLRREELGFDYGRFALDLRSLHNPLKRNGVLVRWSRDFATAHYSTTGTTAN

SEQ ID NO: 6141 - protein, 202 aa, Corynebacterium striatum ATCC 6940
MTDQLRRSRLSLAVSNAAERLQNAYLQHGEKPGSEAAAKSTLSEMRRYAGRSPEKAPLAFQRVMNLMYPALLDEEPGLFATREEEAAFYALTLFASHMQSATQPVHVEGCSFARACGLMYTQSESESLKPRFDAILTAAGYESQLYHARSLVSILRSKNIGFDYGAFAQDLKTLRNPKFRNSVLLRWGRDFATAPFTKKTEK

SEQ ID NO: 6142 - protein, 203 aa, Anaerococcus lactolyticus ATCC 51172
MEDSKLNVYKETAKILRLLDNDRDKPSTKAIFANIRNSINKDSSVNMDALAFVFHNIPEEFLGSNKNLNDYEKAILTAVQMYALHQQAKVDTVLKLDYEEGEKKQNLGDALKTARDKEDDTKALDRRFNAMITSSNFDELSHHLRQMIKLLKAKSDVKVDYASLADDLYWFLKNQREGLKIKWSRSYYKFNKKEGDEKNAKQN

SEQ ID NO: 6143 - protein, 201 aa, Mobiluncus mulieris ATCC 35243
MSKDEPWKTLVSEVLRRRNEKNYRSTLAALKRGRSTYTENAAYPFVLPYSEGVPEKALLRGVSLIADFPEIPQVEKGEDEEKKPVYTPLGESFALTSKSLAYTRGAKIEFDKPDAIAQRLRFLPNLGLENAALTLRSILKFVEKYDHPIDWYQLVQLLTHWGKGVSVSSQKSRNRVLHDYYVNLRPYSSDNSNETPNGEEK

SEQ ID NO: 6144 - protein, 211 aa, Bifidobacterium angulatum DSM 20098 = JCM 7096
MTSSIYDKANAVGKYAAKLIFSVQHEYAAESGSSPSSRARLARMRRDLDGMSPSWMLIGDELFTDWPQDLAEPSDGSPEFDRQVNAVRAVLGLYAVHQQSKRQGVAQPYQKDPSKRMTFGRACRELAPDLEQGKGILRRLRVAENAPDFNGTVRAVRALITLMRKTDVQVDYGSLARDLYLVQLADKRGKVFQQWGKDYYCWKPVSAQKQQ

SEQ ID NO: 6145 - protein, 174 aa, Corynebacterium tuberculostearicum SK141
MLATLRKYSAVKLKHHPLALEEVLLLLEPPLSELELGRGDKPSASELAAFQALTMLGVHMQSATTDAHIAGQSFAKACGRFYSQSQSQSTKPRFDAMMVAQDEASRMVHIRSLVTLLRRAKLGFDYGQFANDLRVLGDQTVTQKEQARRQGVLLRWGRDFATGVYASSNNESES

SEQ ID NO: 6146 - protein, 211 aa, Corynebacterium jeikeium ATCC 43734
MDQTTDDRPRLSSAVAATCSQLQADYLGRTGYPNQARARGTLAELRKSAGQPVDKNPLVFESVLSSLVVLLSEKEVGRGDTPSPSEEAAFHALTFFALHMQGATHEVHDESHSFASACGRLAQTSESKSIKGRFDALVLARTAQSRLIQTRSLISLLRSNDLRFNYGWFAADLRKLSNPRTRNGVLLRWGRDFAFARYPRDIDGSATTQEN

SEQ ID NO: 6147 - protein, 180 aa, Klebsiella pneumoniae subsp. rhinoscleromatis ATCC 13884
MNVVSDEHKATLRQWHEELQEKRGLRASLRRSATLNDVCLSEGFHSLMVQTHSLWNTQGKAWRFTALALVAALAAQVKTIDDRQTFAAQLGQKTGDTPVMSRLRFARLSAVKTPDELLRQLRRAISLLHGSVNLLSLAEDIFRWCREQDDLLNHRRRQQRPIEFIRIRWALDYYQAGDAE

SEQ ID NO: 6148 - protein, 195 aa, Lactobacillus antri DSM 16041
MARIETATSRIIHQIWGNGNPNKAVLAALRNTNDILNKKATVVWPLLLDALEENDLSTTGRPTAAEQAVFAALHCYAVYQQGNQDCCEYADKDHDGKPLFKALAKLHNDPTTRAAIDRRVQNVLGNTNPGSVINAVGHLTSILKSHTSQELINFAQLGQDFYYLQFSNESAREVSLKWGQQYYWHSEKQIAEKGE

SEQ ID NO: 6149 - protein, 192 aa, Jonquetella anthropi E3_33 E1
MEHRDLLKESVNKMLDWIKSDGCSPGERAALRRMDSQRTGRVLPGAFWKLLVSQEIFPEGEGETRAWEAILQGMALSADVSSGEAPSFARALGTADAALVGTTSEDRLIRMLQAQGERFYDLLRGMVRFCASRGISFSWGDLARLCLAQNSEQRRKTCEHLAQDYYLARFRAQAVAEKQQSQTNHEEENIDE

SEQ ID NO: 6150 - protein, 212 aa, Bifidobacterium gallicum DSM 20093 = LMG 11596
MLQRSDKARGVQTYVNRLVRNMQQEYVGNGGASADVRAVLANLRKCADPAHTDWLAAGAVIFDAWPEDMLGDPEHDSRLVKAITTALGLYAVHQQSKDYGVAQLRKEEGEYYPISFGKACQFIAEGSDEDKGVVRRLNAAENAPTFEGTAWYLRALIMLMRSTEHPIALDYGRLARDLYLMQFPDSRGAVFQRWSMDYHYRQSQRNAESSNK

SEQ ID NO: 6151 - protein, 209 aa, Cutibacterium acnes J139
MPEPWNDVTKATLDVVNHLQRGYLMVPRDAWSVRTMAALRHADAAAPGTDPAVWEVTLGHLPDDLLGRNAAPATAAERAVHASVVLYAIHQQSRSEPMHMPGIGLGQAVHSLSTRRSSGSEWDPGTISRFQHLCRAQQWGIRIENLRGLIALMRSEGVPLDHGRLATDLWRIQTSASDHVLLDWGRQLHRIPPSNNPTPSTTTDQGEAR

SEQ ID NO: 6152 - protein, 211 aa, Pyramidobacter piscolens W5455
MPAEKNAFHVMSRYEKFFERTGELLMRMAPTPEEEQKKGYTLTRGERAELRRMNPTKDDTRPPVFWRLLCEYDILGDAGNSLDEGAEKAWGAVFQGMAMTAQNCRGARDDFGAALGSMEDAGDALTRRFDLLMRAEGDRFFDLLRYLLKLASSKGCTFSWTALACLCVASEENERSKVRSALTKSFYLALWKSRNTAGENGESIVKENESE

SEQ ID NO: 6153 - protein, 180 aa, Klebsiella variicola
MNVVSDEHKATLRQWHEELQEKRGLRASLRRSATLNDVCLSEGFHSLMVQTHSLWNTQGKEWRFTALALVAALAAQVKTIDDRQTFAAQLGQKTGDTPVMSRLRFARLSAVKTPDELLRQLRRAISLLHGSVNLLSLAEDIFRWCREQDDLLNHRRRQQRPIEFIRIRWALDYYQAGDAE

SEQ ID NO: 6154 - protein, 195 aa, Megasphaera genomosp. type_1 str. 28L
MADTKSKPTVFSVVKEIVTILENTIETSAGKAALAKLRHSTGQPLSRMVDVLPMIFEKMPEEFLGFRGEVTKEERAILITIQLYAWHQQGAHDRVNTNEKYKNMGAALRSMRRGEATVVVDRRFNALITSQDFEELIYHLRQMIRLLKSRTKEKINYPQLSEDLYWFLRGQKEKLRISWAQEYYKQKGDDTDENE

SEQ ID NO: 6155 - protein, 187 aa, Citrobacter youngae ATCC 29220
MSIVKDDHKVTLRRWHEELQETRGLRASLRRSKTVNEACLSEGFRSLLMQTHTLWKRENEEWRFTALAIAAALAAHVKSIDERQKFAAQLGQMTGSNPVMSELRFSRLSAVKTPDELLRQLLRAVRLLNGAVNLPSLAEDVFHWCRENDEQLNHLRRQQRPTEFIRIRWALEYYQAGEVDTDNNKDQ

SEQ ID NO: 6156 - protein, 111 aa, Schaalia odontolytica F0309; identical to SEQ ID NO: 6135

SEQ ID NO: 6157 - protein, 173 aa, Roseomonas cervicalis ATCC 49957
MSLSPDAAAAWWHDLQGGEGGRRGKDRAALARLRRCARVAEAMQEPAAFDLFHRCGGRSEEDLPKVALVAAVLSHARENSAPQWVARAIGPESPDKPESARMKPLRFRRLMEAETPDELLTGFRRLLALTGGKANIRDLAWALFFWSEKTRITWTYRYWDAEAPHATAKETAA

SEQ ID NO: 6158 - protein, 160 aa, Escherichia coli MS 196-1; identical to SEQ ID NO: 6112

SEQ ID NO: 6159 - protein, 160 aa, Escherichia coli MS 175-1; identical to SEQ ID NO: 6112

SEQ ID NO: 6160 - protein, 178 aa, Escherichia coli MS 198-1
MSIVKEEHKATLRKWHEELQEKRGNRASLRRSTTVNDVCLSEGFRSLLMQTHTLWKIEAQEWRFTALALVAAVSANVKAIDERQPFAAQLAAVMSEGRFTRLSAVKTPDDLLRQLRRAVKLLNGSVNLISLAEDIFRWCQESDDLLNHHRRQQRPTEFIRIRWALEYYQAGDADNEQN

SEQ ID NO: 6161 - protein, 178 aa, Escherichia coli MS 69-1
MSIVKEEHKATLRKWHEELQEKRGNRASLRRSTTVNDVCLSEGFRSLLMQTHTLWKIESQEWRFTALALVAAVAANVKAIDERQPFAAQLAAVMSEGRFTRLSAVKTPDELLRQLRRAVKLLNGSVNLISLADDIFRWCQESDDLLNHHRRQQRPTEFIRIRWALEYYQAGDADNEQN

SEQ ID NO: 6162 - protein, 178 aa, Escherichia coli MS 84-1
MSIVKEEHKATLRKWHEELQEKRGERASLRRSTTVNDVCLTDGFRLFLKNRQIKWQDEPEWRITALALIAAVSANVKAIDERQPFAAQLAAVMSKGRFTRLSAVKTPDELLRQLRRAVRLLNGSVNLDSLAEGVFRWCQESDDLLNHHRRQQRPTEFIRIRWALEYYQAGDADNEQNQ

SEQ ID NO: 6163 - protein, 178 aa, Escherichia coli MS 115-1; identical to SEQ ID NO: 6162

SEQ ID NO: 6164 - protein, 177 aa, Escherichia coli MS 182-1
MSIVKDEHKVALRKWHEELQDKRGERASLRRSTTVNDVCLTDGFRLFLKNRQIKWQDEPEWRITALALIAAVSANVKAIDERQPFAAQLAAVMKKGRFTRLLAVKTPDDLLRQLRRAVKLLNGSVNLDSLAEGVFRWCQESDDLLNHHRRQQRPTEFIRIRWALEYYQAGDADNEQN

SEQ ID NO: 6165 - protein, 200 aa, delta proteobacterium NaphS2
MSESRFLKYAETSAIKNWHHWLEDHRGDRARLRRAERPEDALLTDAFFTFLKRMPEAWQGDIPLYVSAAVAGLLSHVKEDRQVPGRIYGTNAENGVPTSASFAEQMATPVRGDNPPVSELRFQQLQKSKTTDEFYRRMIKVIRLLNGQVNIASMTNDIIHWHREFDHQIDRKPANRLAVRWATDYFTGLQTKTKIKGESL

SEQ ID NO: 6166 - protein, 160 aa, Escherichia coli MS 116-1; identical to SEQ ID NO: 6112

SEQ ID NO: 6167 - protein, 178 aa, Escherichia coli MS 21-1; identical to SEQ ID NO: 6161

SEQ ID NO: 6168 - protein, 202 aa, Lactobacillus delbrueckii subsp. bulgaricus PB2003/044-T3-4
MAFEIEKATERIIRQLYNNGDTDKASLSALRSAATIDGYRAQKVWPVFLSNLDEQWLSKNGKATREEAAIFAAVRMYALHQQASDSCVFGRRNYSDKKDEETNSRELFEALNWLKQGTDSHEALDRRVQALLGTNNYNAVIDQLVHLMQIIKSKKTGIQIDYARLAGDLYKFQFGYRQANEVRLRWGEQYYHAFKKSDTNQQ

SEQ ID NO: 6169 - protein, 179 aa, Peptoniphilus sp. oral taxon 836 str. F0141
MSSSQTRANLAGIRNSINKPLSNAEEVWPILFESLPEEFLSKDGSLTAEENAILLTLQLYAIHQQGSSISVLMDENEDNWKNLGYSLNSLRKGDDSLAIDRRFNTMITSSTFDELSHHLRQLIKLLKAKSDVKINYGKLAKDLYGFIRGNKENVRISWAQRYYSYNKKENKEGENTNEK

SEQ ID NO: 6170 - protein, 177 aa, Escherichia coli MS 119-7
MSIVKEEHKVALRKWHEELQDKRGERASLRRSTTVNDVCMTDGFRLFLKNRQIKWQDEPEWRITALALIAAVSANVKAIDERQPFAAQLAAVMSKGRFTRLLAVKTPDDLLRQLRRAVRLLNGSVNLDSLAEGVFRWCQESDDLLNHHRRQQRSTEFIRIRWALEYYQAGDADNEQN

SEQ ID NO: 6171 - protein, 178 aa, Escherichia coli MS 107-1; identical to SEQ ID NO: 6162

SEQ ID NO: 6172 - protein, 178 aa, Escherichia coli MS 124-1; identical to SEQ ID NO: 6162

SEQ ID NO: 6173 - protein, 177 aa, Escherichia coli MS 78-1; identical to SEQ ID NO: 6164

SEQ ID NO: 6174 - protein, 220 aa, Mobiluncus curtisii subsp. curtisii ATCC 35241
MSDDTPISKEPKNSDALRNAISLTCHRLQENFFMPYDSPQSHLARAQLAELRKSSSLNIMDNPLALGKVLFIMRGDFVEKLAGKTDQPSPSEQAAFAALTLFGLHMQSATKPMHTAEISFARACGRLYATGTSDSIKSRVDAMLLARDEKSRLLQIRSLVSLLRSKELPCDYGKLASDLRALMNPKRRPGVQLRWGRDFANGSFQTESISETKTSDNLER

SEQ ID NO: 6175 - protein, 199 aa, Peptoniphilus duerdenii ATCC BAA-1640
MQNPSKRQLVYSTTNKIIFSLEESKELSKTKATLSNLRNSVGRPSAENLEGIKLLYQFIPEEFYTKYSKLTYEENAILTTLQLYAIHQQSEIDSVNNTEKKDGWDNVGESIAEIRTEDNFLSLDRRFNAMITSQSFEELSNHLRQLIKILKGSKELIKINYPKLAQDLYDFARGYDERVRLNWSRAYYSKNISKGEENE

SEQ ID NO: 6176 - protein, 223 aa, Corynebacterium accolens ATCC 49726
MHDTSHPQAGTAAEYTGPRLRTSVARTAEALQNDYLHSPQHNKQARARAVLAQLRKYSAVRLEQHPVALEEVLLLLEPALSEQEMGKGAAPSASELAAFQALTMLGIHLQSASTEAHIKGQSFARACGRFYAHSQSQSTKPRFDAMLVSSDEASRLIHIRSLVTLLRGENLGFDYGAFAQDLRVLGSKNATQKAHTQRQGVLLKWARDFVLGSYASSQTEPTS

SEQ ID NO: 6177 - protein, 188 aa, Corynebacterium matruchotii ATCC 14266
MSELNIYHFVQHIIRQAKRKQESRDSQAIREIAALRSGMSITTEYRAYPYVLPDLGNASPRERMVALRCAAMIAEYADLGADSDDASPLRFGVWANHLARKIGDDDSVDGMIASRLEYLHTQDVEEAITTIRRILQYAQSNSFTQRVDFIQLFKTFWYWGNGYNNDSLNRRLQILRDFYGASNPVTTN

SEQ ID NO: 6178 - protein, 178 aa, Escherichia coli MS 145-7; identical to SEQ ID NO: 6162

SEQ ID NO: 6179 - protein, 195 aa, Lactobacillus iners LactinV 01V1-a
MEGSNVYNVTAKILRKINQTKDTSSTRALFANIRNSINKSSSNNLDALAFVFNNMPEEYIGFGKELSDYEQAILTAIQMYALHQQSNEKSVLKIEYNEGEKRQNLGDALSTLRGSDNKSIDRRFNAMILSSNYLQLQNHLRQFIKLLKAKSDAKVDYASVADDLFWFLKNQKDGVKIKWSRSYYKFRKVNDKGEN

SEQ ID NO: 6180 - protein, 204 aa, Faecalibacterium cf. prausnitzii KLE1255
MKTQDVKLYAAQQLHRLQALPDNQRRAELAKLRRGIGHAPGDLPELWGSFLLEMPESFQGRSAPSAAEWAVYLALTLYAMHQQGNDRLMNCPGNTLGRAVRQLAERNSAGQDWTEASVLRRFNALATAEEITEISHHLRGMIQLLSAAKDGGIPLDYPQLAADLYELQCTDPRYAQTPANVRLRWGQDLYRDPKPAPDEKEKEN

SEQ ID NO: 6181 - protein, 182 aa, Aminomonas paucivorans DSM 12260
MESSGRNASEKKEGKAGRLVERLLSWKEDLGALAALRRGWGKEPGTAPEMFPYVASFDDSRWEGEVVYIVAGLFGMWPQHDPSSGSFGASMRRLVEPEEDVQGTSVEKRFLSLLDADAGELYQALPRMVGLLKAKEVPLNYLLLTQHLFHWKDAGIHNVRRRWAVDFWRRPFTRSVETTKED

SEQ ID NO: 6182 - protein, 195 aa, Lactobacillus iners LEAF 2053A-b; identical to SEQ ID NO: 6179

SEQ ID NO: 6183 - protein, 195 aa, Lactobacillus iners LEAF 2052A-d
MEGSNVYNVTAKILRKIDQTKDTSSTRALFANIRNSINKSSSNNLDALAFVFNNMPEEYIGFGKELSYYEQAILTAIQMYALHQQSNEKSVLKIEYNEGEKRQNLGDALSTLRGSDNKSIDRRFNAMILSSNYLQLQNHLRQFIKLLKAKSDAKVDYASVADDLFWFLKNQKDGVKIKWSRSYYKFRKVNDKGEN

SEQ ID NO: 6184 - protein, 195 aa, Lactobacillus iners LEAF 3008A-a
MEDLNVYNVTAKILRKIDKTKDKSSTRALLANIRNSINKSSYNNLDALAFIFNNMPEKYIGSGKELNDYEQAILTAIQMYALHQQSNEKSVLKIEYIEYNNGENLGDALSTLRGLDNKSIDRRFNAMILSSNYLQLQNHLRQFIKLLKAKSDVKVDYAGVANDLFWFLKNQKDRVKIKWSRSYYKFRKANDKGEN

SEQ ID NO: 6185 - protein, 195 aa, Lactobacillus oris PB013-T2-3
MARIETVTSRIIHQIWGNGNPNKAVLAALRNTNDVLNKKATVVWPLLLDALAKNDLSKTGRPTSAERAVFAALHCYAVYQQGNQASCGYADKGHGGKPLFKALAELRKDPTTRAAIDRRVQNVLGNTNPGSVINAVGHLTSILKSRSSQEVINFAQLGQDFYYLQFSNESAREVSLKWGQQYYWQSGKQVAEKGE

SEQ ID NO: 6186 - protein, 209 aa, Cutibacterium acnes HL001PA1; identical to SEQ ID NO: 6151

SEQ ID NO: 6187 - protein, 209 aa, Cutibacterium acnes HL082PA2; identical to SEQ ID NO: 6151

SEQ ID NO: 6188 - protein, 209 aa, Cutibacterium acnes HL110PA3; identical to SEQ ID NO: 6151

SEQ ID NO: 6189 - protein, 209 aa, Cutibacterium acnes HL110PA4; identical to SEQ ID NO: 6151

SEQ ID NO: 6190 - protein, 209 aa, Cutibacterium acnes HL060PA1; identical to SEQ ID NO: 6151

SEQ ID NO: 6191 - protein, 178 aa, Escherichia coli MS 85-1; identical to SEQ ID NO: 6162

SEQ ID NO: 6192 - protein, 197 aa, Streptococcus oralis ATCC 49296
MLEQSKQTVGSVTKRIIRQLSYELESPLSKAALAKIRKTLGKPLSDATDIWPILFEHLPEEFVNSYQQPSYEELAIYTAIQFYALHQQGTSTSVMLDEPDTYQNIGSALSQLRKGDDTTAIDRRFNVMITSSTFEELIYHLRHMMMLLKTKSPATKVDYAKLAEDLYWFLKNVQENLRLNWARSYYKQIKGEKHNDN

SEQ ID NO: 6193 - protein, 192 aa, Lachnoanaerobaculum saburreum DSM 3986
MDSIRSVSGRILNELYVRQEDSTGKAVLSRLRNSIGRDYIDMADIMPFVFDKLPESFLGNSKRMTDEEICILTCLQLYAIHQQGDDSNVYERGENYGNIGTSLKVLRAGDDTTAVDRRFNAMITSTEFDELIVHLRHLIRLLKSKQKGTKVDYAGLSEDLYWIRKNKNKDNIILNWAREYYKVNYKGESNEK

SEQ ID NO: 6194 - protein, 206 aa, Lautropia mirabilis ATCC 51599
MSEKQRQWVRDWWRSLHRRDQDKDALIGELRGQGQADGARLRRCMTAEELLSNSATLLFARRLIVLGAGNKLFSDESRIYEQLAWVAGALAHVKEDLVDGKTLASRLGKGSDGERPAMSELRFRSLQAASIPEDFFLKIRRAIQLAGKKTDVAQLADDLFAWQLEQGNLASRAGSGVKFHWAYDYYLSAGQQADADEPESIKENLK

SEQ ID NO: 6195 - protein, 197 aa, Streptococcus sp. C150
MSHQTKQTVWTVTNKIIFKLSNQKEETYDKATLAKIRKTLGKPLSEATEMWPILFKNLPEEFLSFYQQPSYEELAIYTALQLYALHQQGVSTSVMLDESKPYENIGSALGKLRKEDDTTAIDRRFNTMITSSTFEELTYHLRHLISLLKVESPMIQVNYADLANDLYWFLNNGQENVRLNWARAYYKQIKGEKNNDN

SEQ ID NO: 6196 - protein, 179 aa, Escherichia coli MS 117-3
MSIVKEEHKATLRKWREELQAKRGNRASLRRSTTVNDVCLSEGFRSLLMQTHTLWKIEAQEWRFTALALVAAVSANVKAIDERQPFAAQLAAVMSKGRFTRLSAVKTPDELLRQLRRAVRLLNGSVNLDSLAEGVFRWCQESDDLLNHHRRQQRPTEFIRIRWALEYYQAGDADNEQNQ

SEQ ID NO: 6197 - protein, 192 aa, Anaerococcus prevotii ACS-065-V-Col13
MNKETNVYKTSKHILTYLENTKKESSTKAILAQLRNSINKDLGENIESLAFIFSMIPEDKLGTGKNLNYYEQTILTTLQLYAIYQQGVDRSVIYRNEDFPYKSLGQSLRSLRNPEDKSANKSVDLRFNSLISSPNYRMLEYRLRQIIKLLKAKSEEQVDFFSLSNDLYAYLLGDVNPIRIKWARDYYWNITR

SEQ ID NO: 6198 - protein, 209 aa, Cutibacterium acnes HL103PA1; identical to SEQ ID NO: 6151

SEQ ID NO: 6199 - protein, 210 aa, Atopobium vaginae DSM 15829
MQKGVLMNEATTGYSEVSNAVQKIVRQYLSNVDAASRRAILAKLRHSIGKPLSQSVDIWPLILTSVPDDFLSEYEGKNLKMQAVIYTLQIYALYEQGNMSAEDISTDNTVTDENALAQSFSYNMGSCLRILRLDEKQRDAMDRRFSNLITSDNIDHFYYNLRQLTGILKSKTKDSHQHINYPRLARDLYLFNFIPEKIRLSWAQEYYRFN

SEQ ID NO: 6200 - protein, 178 aa, Actinomyces sp. oral taxon 170 str. F0386
MAALRKGANRPPGELPEIWELTSVHVPDYAGDSPTWEETAVHTAMTLYAVHQQSRTEPMFVHGRGLGYAARSLIGPPDDENPSARARFNALVTSTTVTELRHHLRGFISMLRARSITLDHAMLADDILHFQQPGGARRVRLTWSREYQFLSAESPASSDDVTPASATNSTITAPTLEN

SEQ ID NO: 6201 - protein, 180 aa, Klebsiella sp. MS 92-3; identical to SEQ ID NO: 6147

SEQ ID NO: 6202 - protein, 195 aa, Lactobacillus iners SPIN 1401G
MEGSNVYNVTAKILRKIDQTKDTSSTRALFANIRNSINKSSSNNLDALAFVFNNMPEEYIGFGKELNDYEQAILTAIQMYALHQQSNEKSVLKIEYNECEKRQNLGDALSTLRGSDNKSIDRRFNAMILSSNYLQLQNHLRQFIKLLKAKSDAKVDYASVADDLFWFLKNQKDGVKIKWSRSYYKFRKVNDKGEN

SEQ ID NO: 6203 - protein, 183 aa, Parasutterella excrementihominis YIT 11859; identical to SEQ ID NO: 6134

SEQ ID NO: 6204 - protein, 177 aa, Escherichia coli D9
MSIVKEEHKATLRKWREELQEKRGERASLRRSTTVNDVCLTDGFRLFLKNRQIKWQDEPEWRITALALIAAVSANVKAIDERQPFAAQLAAVMSKGRFTRLSAVKTPDELLRQLRRAVRLLNGSVNLDSLAEGVFRWCQESDDLLNHHRRQQRPTEFIRIRWALEYYQAGDADNEQN

SEQ ID NO: 6205 - protein, 204 aa, Gardnerella vaginalis 315-A
MAENKSKSVEVSNAVSKIINQFLNSSDIASRRTMLAQLRHTIGKPLSQSIEIWPWILNNVPESFIDKYGEVNYQLRAVINTLQIYALYEQGVAEKSSYKDLNKSEDSENEKSYNNMGTALRTLRSDEGVRGAMDRRFSVMITANDYESFYYYLRQLVRLIKSRTKENQQSIDYSKLARDLYLLQFEDSEKVRLSWAQEYYRLSK

SEQ ID NO: 6206 - protein, 200 aa, Oribacterium sp. oral taxon 108 str. F0425
MDEERKSVDAVMRKIIGEIEPIKTLGSGKALLAGIRDSIGKELTNAPQVWPLLFENLPEEYLGDKARITAEENAIYLSLQIYALMQQGASKSERGEVKSTRNIGESLRILRGDESKAKAMDERFNTMVTAGSFEELAHYLRQMVKILKANIDTPSVDYPKLAKDLFWMQKGKQDNILMDWARAYYQTFQKSTVEKENTNE

SEQ ID NO: 6207 - protein, 208 aa, Propionibacterium namnetense SK182B-JCVI
MPEPWNDVTKATLDVVNHLQRGYLKAPRDAWSARTMAALRHVDAAAPGTEPQVWEVTLGHLPDDLLGRGAAPATAAERAVHAAVVLYAIHQQSRSEPMHMLGIGLGQAVRRLSTRRSSGPDWDPGTISRFQHLCRAQQWGIRIENLRGLIALMRSEGVPLDYGHLAADLWRIQTSAFDNVLLDWGRQLHRIPSDNSTPSTATDQGEAR

SEQ ID NO: 6208 - protein, 195 aa, Lactobacillus oris F0423; identical to SEQ ID NO: 6185

SEQ ID NO: 6209 - protein, 198 aa, Streptococcus ictaluri 707-05
MTKQKKVSVSEVTRKILIKLSKQKDTSSGKALLARLRQSIGKPISETVVIWSVLFKDLPEEFLGRNGQPSNEEQAILTTLQLYALHQQSQSHSVLINREDKYQNIGYSLKQLRQGEDTTAIDRRFNVMITASSFEELVYHLRHLISLLKTKSPETKVDYAKLSEDLYWFLRDYQERVRLSWAREYYKRNVKGEKDAAK

SEQ ID NO: 6210 - protein, 197 aa, Streptococcus sp. oral taxon 058 str. F0407
MLEQSKQTVGSVTKRIIRQLSYELESPSSKAALAKIRKTLGKPLSDATDIWPILFEHLPEEFVNSYQQPSYEELAIYTAIQFYALHQQGTSTGVMLDEPDTYQNIGSALSQLRKGDDTTAIDRRFNVMITSSTFEELIYHLRHMMMLLKTKSPATKVDYAKLAEDLYWFLKNVQENLRLNWARSYYKQIKGEKHNDN

SEQ ID NO: 6211 - protein, 192 aa, Jonquetella anthropi DSM 22815; identical to SEQ ID NO: 6149

SEQ ID NO: 6212 - protein, 192 aa, Lachnospiraceae bacterium oral taxon 082 str. F0431
MESVKSVCGRILKELYAMQEYSTGKAILSRLRNSIGRNYADMADIMPVIFEKLPESFLGNSKRMTDEEICILSCLQLYAIHQQGEDLCVNTAEDGYSNVGTSLKLLRVGDDTTAPDRRFNAMITSTDFGELTVHLRHLIRLLKSKQKGVRIDYGRLAEDLYLIRKNKNKENIILNWAREYYKFNSKGESNEQ

SEQ ID NO: 6213 - protein, 181 aa, Leptonema illini DSM 21528
MKAQPQSKGPVDYKAAWAAIEQWWLALQDLPGDRAELRRAHSPDEAALTPAYFALLKAIRPFGLSMTMQRTRMPIVAGVLAHVKPNRVTVPVARSMGPENKDSKARISDLRFRRLLKTEDDTELYVMMIRMVRLLDEKVNVQDLAKSLTFWNDQTRKEWAYLYYTGTTLDASSESQDSDSE

SEQ ID NO: 6214 - protein, 204 aa, Thiorhodovibrio sp. 970
MGESLKDQNPAKVVDEVLDWWRQLVAPPETGQPSRRGELAELRRAKNLEEVLFVPAYHRLFYRVSAQGWAHGPSVAAIAGLLAHVKGDTAMAGQIPSDATAQEEQRQSKAPDTVAALLAAPVKPGLGPRVSESRFQRLVAIRELPVLYPNLLRIIHLAGDRVPVRDLIQSVRYWNDRQRRDWTFRYYTALLGNEGKAPAQTQGA

SEQ ID NO: 6215 - protein, 152 aa, Methylomicrobium album BG8
MSVGENKGPDFMALYEHYQKLKPGPQAELKRVVQPDDLLEIPAFYRLLQDNKASKNMQRLVFCLPLIKHQNNGDSLGKALAKANINEKRLFMVIRSQDPNDLIQLRRLLKQAEPKLDWPSAAKTLYFWNDRAKRQLLEDFFFYQNSKTKESA

SEQ ID NO: 6216 - protein, 197 aa, Streptococcus oralis SK10
MLEQSKQTVGSVTKRIIRQLSYELESPLSKAALAKIRKTLGKPLSDATDIWPILFEHLPEEFVNSYQQPSYEELAIYTAIQFYALHQQGTSTSVMLDELDTYQNIGSALSQLRKGDDTTAIDRRFNVMITLSTFEELIYHLRHMMMLLKTKSPATKVDYAKLAEDLYWFLKNVQENLRLNWARSYYKQIKGEKHNDN

SEQ ID NO: 6217 - protein, 192 aa, Lachnoanaerobaculum saburreum F0468
MDSIRSVSGRILNELYIRQEDSTGKAVLSRLRNSIGRDYIDMADIMPFVFDKLPESFLGNSKRMTDEEICILTCLQLYAIHQQGDDSNVCERGEDYSNIGTSLKVLRAGDDTTAVDRRFNAMITSTEFDELIVHLRHLIRLLKSKQKGTKVDYAGLSEDLYWIRKNKNKDNIILNWAREYYKVNYKGESNEK

SEQ ID NO: 6218 - protein, 238 aa, Saccharomonospora glauca K62
MADDGENASRSEKDEIRRHAKRWVRHVRRDVLTTPARRAAVRAALGGEPGEARTFVALGEVSAFLPESSNPAVERAFLTVAAMMCAQPLRPREQDIAAGQANSTPTETKDPARAEQTDLVSGDSDSASTMSSPRSLGASCAEAVLKRLSRSGTMEARLHALCRANNVGVHRQLPRLVALLRSGLVEVDWAQLIEDLARWDRYSQRHISATWLRDYYRQLNDEPNDTTGKEKNEHAEVH

SEQ ID NO: 6219 - protein, 160 aa, Escherichia coli 1.2741
MADEIDAMALYRAWQQLDNGACAQIRRVSEPDDLRDIPAFYRLVQPFGWENLRHQQALLRMVFCLSAGKNVIRHQDKKPEQTIGISLGRALANSGRINERRIFQLIRADRTADMVQLRRLLAHAEPVLDWSLMARMLTWWGKRERQQLLEDFVLTTNKNA

SEQ ID NO: 6220 - protein, 177 aa, Escherichia coli 97.0246; identical to SEQ ID NO: 6164

SEQ ID NO: 6221 - protein, 178 aa, Escherichia coli 5.0588; identical to SEQ ID NO: 6162

SEQ ID NO: 6222 - protein, 178 aa, Escherichia coli 1.2264; identical to SEQ ID NO: 6162

SEQ ID NO: 6223 - protein, 179 aa, Escherichia coli 96.0497; identical to SEQ ID NO: 6196

SEQ ID NO: 6224 - protein, 177 aa, Escherichia coli 99.0741; identical to SEQ ID NO: 6164

SEQ ID NO: 6225 - protein, 177 aa, Escherichia coli 3.2608; identical to SEQ ID NO: 6164

SEQ ID NO: 6226 - protein, 177 aa, Escherichia coli 93.0624; identical to SEQ ID NO: 6164

SEQ ID NO: 6227 - protein, 179 aa, Escherichia coli 4.0522; identical to SEQ ID NO: 6196

SEQ ID NO: 6228 - protein, 179 aa, Escherichia coli JB1-95; identical to SEQ ID NO: 6196

SEQ ID NO: 6229 - protein, 178 aa, Escherichia coli 96.154
MSIVKDGHKATLRKWHEELQAKRGNRASLRRSTTVNDVCLSEGFRSLLMQTHTLWKIEAQEWRFTALALVAAVAANVKAIDERQPFAAQLAAVMSEGRFTCLSAVKTPDDLLRQLRRAVKLLNGSVNLISLADDIFRWCQESDDLLNHHRRQQRPTEFIRIRWALEYYQAGDADNEQN

SEQ ID NO: 6230 - protein, 178 aa, Escherichia coli 5.0959
MSIVKEEHKATLRKWHEELQEKRGERASLRRSTTVNDVCLTDGFRLFLKNRQIKWQDEPEWRITALALIAAVSANVKAIDERQPFAAQLAAVMSKGRFTRLSAVKTPDELLRQLRRAVRLLNASVNLDSLAEGVFRWCQESDDLLNHHRRQQRPTEFIRIRWALEYYQAGDADNEQNQ

SEQ ID NO: 6231 - protein, 178 aa, Escherichia coli 9.0111; identical to SEQ ID NO: 6162

SEQ ID NO: 6232 - protein, 177 aa, Escherichia coli 4.0967; identical to SEQ ID NO: 6164

SEQ ID NO: 6233 - protein, 178 aa, Escherichia coli 2.3916; identical to SEQ ID NO: 6162

SEQ ID NO: 6234 - protein, 178 aa, Escherichia coli 3.3884; identical to SEQ ID NO: 6229

SEQ ID NO: 6235 - protein, 160 aa, Escherichia coli B41; identical to SEQ ID NO: 6112

SEQ ID NO: 6236 - protein, 179 aa, Escherichia coli 900105 (10e); identical to SEQ ID NO: 6196

SEQ ID NO: 6237 - protein, 195 aa, Desulfobacter postgatei 2ac9
MTRMSQRPIQGFLKWAKVRIEAKDRGCLADLRRGFSPGTEHRCWPHIAIYCDLSKKRERIIWQTIAAGFATIEQTANSGNLGATMRRLAIDGASGSPEDALKSFDARFRRLLTCDSAVEVCERLASIIKAAKSKNIIPIDFEVLYEDLFYWGERVKLSWAASYWGGQKDEADETGQTITLQESLLSFNEHGVLTK

SEQ ID NO: 6238 - protein, 178 aa, Escherichia coli FRIK1996
MSIVKEEHKATLRKWHEELQEKRGERASLRRSTTVNDVCLTDGFRLFLKNRQIKWQDEPEWRITALALIAALSANVKAIDERLPFAAQLAAVMSKGRFTRLSAVKTPDELLRQLRRVVRLLNGSVNLDSLAEGVFRWCQESDDLLNHHRRHQRPTEFIRIRWALEYYQAGDVDNEQNQ

SEQ ID NO: 6239 - protein, 178 aa, Escherichia coli FDA517; identical to SEQ ID NO: 6238

SEQ ID NO: 6240 - protein, 178 aa, Escherichia coli FDA505; identical to SEQ ID NO: 6238

SEQ ID NO: 6241 - protein, 178 aa, Escherichia coli 93-001; identical to SEQ ID NO: 6238

SEQ ID NO: 6242 - protein, 178 aa, Escherichia coli FRIK1985; identical to SEQ ID NO: 6238

SEQ ID NO: 6243 - protein, 178 aa, Escherichia coli FRIK1990]; identical to SEQ ID NO: 6238

SEQ ID NO: 6244 - protein, 178 aa, Escherichia coli PA3; identical to SEQ ID NO: 6238

SEQ ID NO: 6245 - protein, 178 aa, Escherichia coli PA5; identical to SEQ ID NO: 6238

SEQ ID NO: 6246 - protein, 178 aa, Escherichia coli PA9; identical to SEQ ID NO: 6238

SEQ ID NO: 6247 - protein, 178 aa, Escherichia coli PA10; identical to SEQ ID NO: 6238

SEQ ID NO: 6248 - protein, 178 aa, Escherichia coli PA15; identical to SEQ ID NO: 6238

SEQ ID NO: 6249 - protein, 178 aa, Escherichia coli PA14; identical to SEQ ID NO: 6238

SEQ ID NO: 6250 - protein, 178 aa, Escherichia coli PA22; identical to SEQ ID NO: 6238

SEQ ID NO: 6251 - protein, 178 aa, Escherichia coli PA25; identical to SEQ ID NO: 6238

SEQ ID NO: 6252 - protein, 178 aa, Escherichia coli PA24; identical to SEQ ID NO: 6238

SEQ ID NO: 6253 - protein, 178 aa, Escherichia coli PA28; identical to SEQ ID NO: 6238

SEQ ID NO: 6254 - protein, 178 aa, Escherichia coli PA31; identical to SEQ ID NO: 6238

SEQ ID NO: 6255 - protein, 178 aa, Escherichia coli PA32; identical to SEQ ID NO: 6238

SEQ ID NO: 6256 - protein, 178 aa, Escherichia coli PA33; identical to SEQ ID NO: 6238

SEQ ID NO: 6257 - protein, 178 aa, Escherichia coli PA40; identical to SEQ ID NO: 6238

SEQ ID NO: 6258 - protein, 178 aa, Escherichia coli PA41; identical to SEQ ID NO: 6238

SEQ ID NO: 6259 - protein, 178 aa, Escherichia coli PA39; identical to SEQ ID NO: 6238

SEQ ID NO: 6260 - protein, 178 aa, Escherichia coli PA42; identical to SEQ ID NO: 6238

SEQ ID NO: 6261 - protein, 178 aa, Escherichia coli TW07945; identical to SEQ ID NO: 6238

SEQ ID NO: 6262 - protein, 178 aa, Escherichia coli TW10246; identical to SEQ ID NO: 6238

SEQ ID NO: 6263 - protein, 178 aa, Escherichia coli TW11039; identical to SEQ ID NO: 6238

SEQ ID NO: 6264 - protein, 178 aa, Escherichia coli TW09098; identical to SEQ ID NO: 6238

SEQ ID NO: 6265 - protein, 178 aa, Escherichia coli TW09109; identical to SEQ ID NO: 6238

SEQ ID NO: 6266 - protein, 178 aa, Escherichia coli TW10119; identical to SEQ ID NO: 6238

SEQ ID NO: 6267 - protein, 178 aa, Escherichia coli EC4203; identical to SEQ ID NO: 6238

SEQ ID NO: 6268 - protein, 178 aa, Escherichia coli TW09195; identical to SEQ ID NO: 6238

SEQ ID NO: 6269 - protein, 178 aa, Escherichia coli EC4196; identical to SEQ ID NO: 6238

SEQ ID NO: 6270 - protein, 178 aa, Escherichia coli O157:H7 str. TW14313; identical to SEQ ID NO: 6238

SEQ ID NO: 6271 - protein, 178 aa, Escherichia coli TW14301; identical to SEQ ID NO: 6238

SEQ ID NO: 6272 - protein, 178 aa, Escherichia coli EC4421; identical to SEQ ID NO: 6238

SEQ ID NO: 6273 - protein, 178 aa, Escherichia coli EC4422; identical to SEQ ID NO: 6238

SEQ ID NO: 6274 - protein, 178 aa, Escherichia coli EC4013; identical to SEQ ID NO: 6238

SEQ ID NO: 6275 - protein, 178 aa, Escherichia coli EC4402; identical to SEQ ID NO: 6238

SEQ ID NO: 6276 - protein, 178 aa, Escherichia coli EC4439; identical to SEQ ID NO: 6238

SEQ ID NO: 6277 - protein, 178 aa, Escherichia coli EC4436; identical to SEQ ID NO: 6238

SEQ ID NO: 6278 - protein, 178 aa, Escherichia coli EC4437; identical to SEQ ID NO: 6238

SEQ ID NO: 6279 - protein, 178 aa, Escherichia coli EC4448; identical to SEQ ID NO: 6238

SEQ ID NO: 6280 - protein, 178 aa, Escherichia coli EC1738; identical to SEQ ID NO: 6238

SEQ ID NO: 6281 - protein, 178 aa, Escherichia coli EC1734; identical to SEQ ID NO: 6238

SEQ ID NO: 6282 - protein, 178 aa, Escherichia coli EC1863; identical to SEQ ID NO: 6238

SEQ ID NO: 6283 - protein, 178 aa, Escherichia coli EC1845; identical to SEQ ID NO: 6238

SEQ ID NO: 6284 - protein, 204 aa, Frankia sp. QA3
MSEAAGTSPGTAPSPSTGTVARRHFWERDHPGGRPDGADLAALRRGVGRAPGEAPQMWHYYTTLSADGGISRRLWAEHVALTLYAIHQQSLSVPAHQAGTGFGTAALRLHDSDAFSPDAVDRRFNAVATATTLDEAAYHLRGLVRQFRQVAIAFDYTALWHDLITWQSPERIGEVRRRWGSQYFFRPRRGEAPGVAVNGEPGAS

SEQ ID NO: 6285 - protein, 200 aa, Oribacterium parvum ACB8
MDEERKSIDAVMRKIIAEIEPIKNLGSGKALLAGIRDSIGKELANAPQVWPLLFANLPEEYLGNKARVTAEENAIYLSLQIYALMQQGSSKLERGEEKSTRNIGESLRALRGDESKTKAMDERFNTMVTAGSFEELSHYLRQMIKILKANAANPSVNYPKLANDLFWMQKGKRDNILMDWARAYYQSFQKSTVEKENTNE

SEQ ID NO: 6286 - protein, 192 aa, Lachnoanaerobaculum sp. ICM7
MESVKSVCGRILKELYAIQEYSTGKAILSRLRNSIGRDYADMADIMPFVFDKLPESFLGNSKKMTDEEMCILSCLQLYAIHQQGEDLCVNTTEGEYSNVGTSLKSLRVGDDATAVDRRFNAMITSIDFDELIVHLRHLIRLLKSKQKGERIDYARLADDLYWIRKNKNKENIILNWAREYYKFNSKGESNEQ

SEQ ID NO: 6287 - protein, 178 aa, Escherichia coli PA7; identical to SEQ ID NO: 6238

SEQ ID NO: 6288 - protein, 178 aa, Escherichia coli FRIK920; identical to SEQ ID NO: 6238

SEQ ID NO: 6289 - protein, 178 aa, Escherichia coli PA34; identical to SEQ ID NO: 6238

SEQ ID NO: 6290 - protein, 178 aa, Escherichia coli FDA506; identical to SEQ ID NO: 6238

SEQ ID NO: 6291 - protein, 178 aa, Escherichia coli FDA507; identical to SEQ ID NO: 6238

SEQ ID NO: 6292 - protein, 178 aa, Escherichia coli FDA504; identical to SEQ ID NO: 6238

SEQ ID NO: 6293 - protein, 178 aa, Escherichia coli FRIK1999; identical to SEQ ID NO: 6238

SEQ ID NO: 6294 - protein, 178 aa, Escherichia coli FRIK1997; identical to SEQ ID NO: 6238

SEQ ID NO: 6295 - protein, 178 aa, Escherichia coli NE1487; identical to SEQ ID NO: 6238

SEQ ID NO: 6296 - protein, 178 aa, Escherichia coli NE037; identical to SEQ ID NO: 6238

SEQ ID NO: 6297 - protein, 178 aa, Escherichia coli FRIK2001; identical to SEQ ID NO: 6238

SEQ ID NO: 6298 - protein, 178 aa, Escherichia coli PA4; identical to SEQ ID NO: 6238

SEQ ID NO: 6299 - protein, 178 aa, Escherichia coli PA23; identical to SEQ ID NO: 6238

SEQ ID NO: 6300 - protein, 178 aa, Escherichia coli PA49; identical to SEQ ID NO: 6238

SEQ ID NO: 6301 - protein, 178 aa, Escherichia coli PA45; identical to SEQ ID NO: 6238

SEQ ID NO: 6302 - protein, 178 aa, Escherichia coli TT12B; identical to SEQ ID NO: 6238

SEQ ID NO: 6303 - protein, 178 aa, Escherichia coli MA6; identical to SEQ ID NO: 6238

SEQ ID NO: 6304 - protein, 178 aa, Escherichia coli CB7326
MSIVKEEHKATLRKWHEELQEKRGERASLRRSTTVNDVCLTDGFRLFLKNRQIKWQDEPEWRITALALIAALSANVKAIDERLPFAAQLAAVMSKGRFTRLSAVKTPDELLRQLRLVVRLLNGSVNLDSLAEGVFRWCQESDDLLNHHRRHQRPTEFIRIRWALEYYQAGDVDNEQNQ

SEQ ID NO: 6305 - protein, 178 aa, Escherichia coli EC96038; identical to SEQ ID NO: 6238

SEQ ID NO: 6306 - protein, 178 aa, Escherichia coli 3006; identical to SEQ ID NO: 6162

SEQ ID NO: 6307 - protein, 178 aa, Escherichia coli PA38; identical to SEQ ID NO: 6238

SEQ ID NO: 6308 - protein, 178 aa, Escherichia coli EC1735; identical to SEQ ID NO: 6238

SEQ ID NO: 6309 - protein, 178 aa, Escherichia coli EC1736; identical to SEQ ID NO: 6238

SEQ ID NO: 6310 - protein, 178 aa, Escherichia coli EC1737; identical to SEQ ID NO: 6238

SEQ ID NO: 6311 - protein, 178 aa, Escherichia coli EC1846; identical to SEQ ID NO: 6238

SEQ ID NO: 6312 - protein, 178 aa, Escherichia coli EC1847; identical to SEQ ID NO: 6238

SEQ ID NO: 6313 - protein, 178 aa, Escherichia coli EC1848; identical to SEQ ID NO: 6238

SEQ ID NO: 6314 - protein, 178 aa, Escherichia coli EC1849; identical to SEQ ID NO: 6238

SEQ ID NO: 6315 - protein, 178 aa, Escherichia coli EC1850; identical to SEQ ID NO: 6238

SEQ ID NO: 6316 - protein, 178 aa, Escherichia coli EC1856; identical to SEQ ID NO: 6238

SEQ ID NO: 6317 - protein, 178 aa, Escherichia coli EC1862; identical to SEQ ID NO: 6238

SEQ ID NO: 6318 - protein, 178 aa, Escherichia coli EC1864; identical to SEQ ID NO: 6238

SEQ ID NO: 6319 - protein, 179 aa, Escherichia coli EC1865; identical to SEQ ID NO: 6196

SEQ ID NO: 6320 - protein, 178 aa, Escherichia coli EC1868; identical to SEQ ID NO: 6238

SEQ ID NO: 6321 - protein, 178 aa, Escherichia coli EC1866; identical to SEQ ID NO: 6238

SEQ ID NO: 6322 - protein, 178 aa, Escherichia coli EC1869; identical to SEQ ID NO: 6238

SEQ ID NO: 6323 - protein, 178 aa, Escherichia coli EC1870; identical to SEQ ID NO: 6238

SEQ ID NO: 6324 - protein, 178 aa, Escherichia coli NE098; identical to SEQ ID NO: 6238

SEQ ID NO: 6325 - protein, 178 aa, Escherichia coli FRIK523; identical to SEQ ID NO: 6238

SEQ ID NO: 6326 - protein, 177 aa, Escherichia coli 0.1288; identical to SEQ ID NO: 6204

SEQ ID NO: 6327 - protein, 178 aa, Escherichia coli 0.1304; identical to SEQ ID NO: 6238

SEQ ID NO: 6328 - protein, 178 aa, Escherichia coli 3.4870; identical to SEQ ID NO: 6238

SEQ ID NO: 6329 - protein, 178 aa, Escherichia coli 5.2239; identical to SEQ ID NO: 6238

SEQ ID NO: 6330 - protein, 178 aa, Escherichia coli 6.0172; identical to SEQ ID NO: 6238

SEQ ID NO: 6331 - protein, 178 aa, Escherichia coli 8.0586; identical to SEQ ID NO: 6238

SEQ ID NO: 6332 - protein, 178 aa, Escherichia coli 10.0833; identical to SEQ ID NO: 6238

SEQ ID NO: 6333 - protein, 178 aa, Escherichia coli 8.2524; identical to SEQ ID NO: 6238

SEQ ID NO: 6334 - protein, 178 aa, Escherichia coli 10.0869; identical to SEQ ID NO: 6238

SEQ ID NO: 6335 - protein, 178 aa, Escherichia coli 88.0221; identical to SEQ ID NO: 6238

SEQ ID NO: 6336 - protein, 178 aa, Escherichia coli 8.0416; identical to SEQ ID NO: 6238

SEQ ID NO: 6337 - protein, 178 aa, Escherichia coli 10.0821; identical to SEQ ID NO: 6238

SEQ ID NO: 6338 - protein, 178 aa, Leptospira santarosai str. MOR084
MRFHENKDKYKEIIIDWWSDLKSQTGDRAALRRCSNGLDTLLIPYTHKLISKLAREEFRFFSDKIGPIAGLLSHVEEDNPSVPFARSMARKEGERSIINEIRFRKILQYSDILSEELFYQNMIRIVKNLRKKANLLDLSLSVYSWNQKTKKNWAYDYYGTPTSENNLDISENPQGENQ

SEQ ID NO: 6339 - protein, 178 aa, Leptospira sp. Fiocruz LV3954
MRFHENKDKYKEIIIDWWSDLKSQTGDRAALRRCSNGLDTLLIPYTHRLISKLAREEFRFFSDKIGPIAGLLSHVEEDNPSVPFARSMARKEGERSIINEIRFRKILQYSDILSEELFYQNMIRIVKNLRKKANLLDLSLSVYSWNQKTKKNWAYDYYGTPTSENNLDISENPQGENQ

SEQ ID NO: 6340 - protein, 178 aa, Leptospira borgpetersenii str. 200801926
MKFYENKEKYKETIINWWIDLKSRTGDRAALRRCSNGLDTLLIPYTHRLISQLSQEGFQFFSDKIGPIAGILSHIEEDNPSVSFARSMARKEGEKPVINKIRFRKILQYSDILSEELFYQNMVRIVKNLKKKANISDLSLSIYSWNQRTKKDWAYDYYGTPISENNLENSENPQGENQ

SEQ ID NO: 6341 - protein, 178 aa, Leptospira borgpetersenii str. UI 09149
MKFYENKEKYKETIINWWIDLKSRTGDRAALRRCSNGLDTLLIPYTHRLISQLFQEGFQFFPDKIGPIAGILSHIEEDNPSVSFARSMARKEGENPVINEIRFRKILQYSDILSEELFYQNMVRIVKNLKKKANISDLSLSIYSWNQRTKKDWAYDYYGTPISENNLENSENLQGENQ

SEQ ID NO: 6342 - protein, 178 aa, Leptospira borgpetersenii serovar Castellonis str. 200801910; identical to SEQ ID NO: 6341

SEQ ID NO: 6343 - protein, 178 aa, Leptospira santarosai str. CBC379; identical to SEQ ID NO: 6338

SEQ ID NO: 6344 - protein, 178 aa, Leptospira mayottensis 200901122
MRFYENKEKYKEIIINWWTDLRSQTGDRAALRRCSNGLDTLLIPYTHRLISKLFQEGFQFFPDKIGPIAGILSHIEEDNPSTPFARSMARKEGEKPVINEIRFRKILQYSDILSEELFYQNMIRIVKNLKKKANLSDLSLSIYSWNQKTRKDWAYDYYGTPTSENDLDNLENPQGENQ

SEQ ID NO: 6345 - protein, 178 aa, Leptospira santarosai str. JET
MRFHENKDKYKEIIIDWWSDLKSQTGDRAALRKCSNGLDTLLIPYTHRLISKLAREEFRFFPDKIGPIAGLLSHVEEDNPSVPFARSMARKEGERSIINEIRFRKILQYSDIISEELFYQNMIRIVKNLRKKANLLDLSLSIYSWNQKTKKNWAYDYYGTPTSENNLDISENPQGENQ

SEQ ID NO: 6346 - protein, 178 aa, Escherichia coli 88.1042; identical to SEQ ID NO: 6238

SEQ ID NO: 6347 - protein, 178 aa, Escherichia coli 89.0511; identical to SEQ ID NO: 6238

SEQ ID NO: 6348 - protein, 178 aa, Escherichia coli 88.1467; identical to SEQ ID NO: 6238

SEQ ID NO: 6349 - protein, 178 aa, Escherichia coli 90.0091; identical to SEQ ID NO: 6238

SEQ ID NO: 6350 - protein, 178 aa, Escherichia coli 90.2281; identical to SEQ ID NO: 6238

SEQ ID NO: 6351 - protein, 178 aa, Escherichia coli 90.0039; identical to SEQ ID NO: 6238

SEQ ID NO: 6352 - protein, 178 aa, Escherichia coli 93.0056; identical to SEQ ID NO: 6238

SEQ ID NO: 6353 - protein, 178 aa, Escherichia coli 93.0055; identical to SEQ ID NO: 6238

SEQ ID NO: 6354 - protein, 178 aa, Escherichia coli 94.0618; identical to SEQ ID NO: 6238

SEQ ID NO: 6355 - protein, 178 aa, Escherichia coli 95.0183; identical to SEQ ID NO: 6238

SEQ ID NO: 6356 - protein, 178 aa, Escherichia coli 95.0943; identical to SEQ ID NO: 6238

SEQ ID NO: 6357 - protein, 178 aa, Escherichia coli 95.1288; identical to SEQ ID NO: 6238

SEQ ID NO: 6358 - protein, 178 aa, Escherichia coli 96.0428; identical to SEQ ID NO: 6238

SEQ ID NO: 6359 - protein, 178 aa, Escherichia coli 96.0427; identical to SEQ ID NO: 6238

SEQ ID NO: 6360 - protein, 178 aa, Escherichia coli 96.0939; identical to SEQ ID NO: 6238

SEQ ID NO: 6361 - protein, 178 aa, Escherichia coli 96.0932; identical to SEQ ID NO: 6238

SEQ ID NO: 6362 - protein, 178 aa, Escherichia coli 96.0107; identical to SEQ ID NO: 6238

SEQ ID NO: 6363 - protein, 178 aa, Escherichia coli 97.0003; identical to SEQ ID NO: 6238

SEQ ID NO: 6364 - protein, 178 aa, Escherichia coli 97.1742; identical to SEQ ID NO: 6238

SEQ ID NO: 6365 - protein, 178 aa, Escherichia coli 97.0007; identical to SEQ ID NO: 6238

SEQ ID NO: 6366 - protein, 178 aa, Escherichia coli 99.0672; identical to SEQ ID NO: 6238

SEQ ID NO: 6367 - protein, 178 aa, Escherichia coli 99.0678; identical to SEQ ID NO: 6238

SEQ ID NO: 6368 - protein, 178 aa, Escherichia coli 99.0713; identical to SEQ ID NO: 6238

SEQ ID NO: 6369 - protein, 193 aa, Peptostreptococcus anaerobius VPI 4330 = DSM 2949
MKKNSIYSVTSSIIYKLNALSEISSGKSYLAKLRNSIGKDISSSSEVWSILFENLPEEFLGDENRITTEERVITLTLQLFALMNQGSNRISVNPDDENKYKNIGYSIRVLRDEHGESVDRRFNALLTSSDVDELSTHLRYLLNLLKAKTTGTYVNFPKLAEDMYWYSKGYGDSVKLSWAREYYRKKIEFDNEK

SEQ ID NO: 6370 - protein, 178 aa, Escherichia coli 96.0109; identical to SEQ ID NO: 6238

SEQ ID NO: 6371 - protein, 178 aa, Escherichia coli 97.0010; identical to SEQ ID NO: 6238

SEQ ID NO: 6372 - protein, 178 aa, Escherichia coli 99.0814; identical to SEQ ID NO: 6238

SEQ ID NO: 6373 - protein, 178 aa, Escherichia coli 09BKT078844; identical to SEQ ID NO: 6238

SEQ ID NO: 6374 - protein, 178 aa, Escherichia coli 99.0815; identical to SEQ ID NO: 6238

SEQ ID NO: 6375 - protein, 178 aa, Escherichia coli 99.0839; identical to SEQ ID NO: 6238

SEQ ID NO: 6376 - protein, 178 aa, Escherichia coli 99.0816; identical to SEQ ID NO: 6238

SEQ ID NO: 6377 - protein, 178 aa, Escherichia coli 99.0848; identical to SEQ ID NO: 6238

SEQ ID NO: 6378 - protein, 178 aa, Escherichia coli 99.1753; identical to SEQ ID NO: 6238

SEQ ID NO: 6379 - protein, 178 aa, Escherichia coli 99.1775; identical to SEQ ID NO: 6238

SEQ ID NO: 6380 - protein, 178 aa, Escherichia coli 99.1793; identical to SEQ ID NO: 6238

SEQ ID NO: 6381 - protein, 178 aa, Escherichia coli PA11; identical to SEQ ID NO: 6238

SEQ ID NO: 6382 - protein, 178 aa, Escherichia coli ATCC 700728; identical to SEQ ID NO: 6238

SEQ ID NO: 6383 - protein, 178 aa, Escherichia coli 99.1805; identical to SEQ ID NO: 6238

SEQ ID NO: 6384 - protein, 178 aa, Escherichia coli PA13; identical to SEQ ID NO: 6238

SEQ ID NO: 6385 - protein, 178 aa, Escherichia coli PA19; identical to SEQ ID NO: 6238

SEQ ID NO: 6386 - protein, 178 aa, Escherichia coli PA2; identical to SEQ ID NO: 6238

SEQ ID NO: 6387 - protein, 178 aa, Escherichia coli PA47; identical to SEQ ID NO: 6238

SEQ ID NO: 6388 - protein, 178 aa, Escherichia coli PA48; identical to SEQ ID NO: 6238

SEQ ID NO: 6389 - protein, 178 aa, Escherichia coli PA8; identical to SEQ ID NO: 6238

SEQ ID NO: 6390 - protein, 178 aa, Escherichia coli 7.1982; identical to SEQ ID NO: 6238

SEQ ID NO: 6391 - protein, 178 aa, Escherichia coli 99.1781; identical to SEQ ID NO: 6238

SEQ ID NO: 6392 - protein, 178 aa, Escherichia coli 99.1762; identical to SEQ ID NO: 6238

SEQ ID NO: 6393 - protein, 178 aa, Escherichia coli PA35; identical to SEQ ID NO: 6238

SEQ ID NO: 6394 - protein, 178 aa, Escherichia coli 3.4880; identical to SEQ ID NO: 6238

SEQ ID NO: 6395 - protein, 178 aa, Escherichia coli 95.0083; identical to SEQ ID NO: 6238

SEQ ID NO: 6396 - protein, 178 aa, Escherichia coli 99.0670; identical to SEQ ID NO: 6238

SEQ ID NO: 6397 - protein, 178 aa, Leptospira santarosai str. ST188
MRFHENKDKYKEIIIDWWSDLKSQTGDRAALRRCSNGLDTLLIPYTHRLISKLAREEFRFFSDKIGPIAGLLSHIEEDNPSVPFARSMARKEGERSIINEIRFRKILQYSDILSEELFYQNMIRIVKNLRKKANLLDLSLSVYSWNQKTKKNWAYDYYGTPTSENNLDISENPQGENQ

SEQ ID NO: 6398 - protein, 178 aa, Leptospira borgpetersenii str. 200701203; identical to SEQ ID NO: 6340

SEQ ID NO: 6399 - protein, 188 aa, Klebsiella pneumoniae JHCK1
MDQVPADVTAESAGNESPAKRFVGYVIERIAKDNGFAARLKRADNPATEYQSWEILAGFGIDLEKEWQRLPYCVIGAALAKAKPASNGTITLGAAIAGCYPEGNQSEQAKARLRRLLACTSTSEACRILRPLLALMASRSVTPDFAGLLNELQWFSGSSRERIRARWAQEFYRRAGEAAGSEARNSHD

SEQ ID NO: 6400 - protein, 181 aa, Leptospira noguchii str. Bonito
MKLFDPGSPSAEIILRWWADLQNNPGERATLRRCSDPSETVFYPASHRLLTELYKIQPDVYRPSRDKVCAIAGILSHVKTNHTIPFASQLSYKKSGSDQSLISDLRFRRILQYKSLSEEDLFFQKMIRVIRHLDGNANILDLFSSLYFWGDSVKKRWAYDYYGTGTSTKSENDITDQGKNQ

SEQ ID NO: 6401 - protein, 178 aa, Leptospira sp. Fiocruz LV4135; identical to SEQ ID NO: 6339

SEQ ID NO: 6402 - protein, 178 aa, Leptospira santarosai str. HAI1349; identical to SEQ ID NO: 6339

SEQ ID NO: 6403 - protein, 178 aa, Leptospira sp. P2653
MRFYENKEKFKEIIINWWTDLRSQTGDRAALRRCSNGLDTLSIPYTHRLISGLFQEGFQFFPDKIGPIAGILSHIEEDNSSVSFARSMARKEGERPVINEIRFRKILQYSDILSEELFYQNMIRIVKNLKKKANLSDLSLSIYSWNQKTKKDWAYDYYGTPTSENDLDNLENPQGENQ

SEQ ID NO: 6404 - protein, 178 aa, Leptospira borgpetersenii serovar Hardjo-bovis str. Sponselee
MKFYENKEKYKETIINWWIDLKSRTGDRAALRRCSNGLDTLLIPYTHRLISQLFQEGFRFFPDKIGPIAGILSHIEEDNPSVSFARSMARKEGENPVINEIRFRKILQYSDILSEELFYQNMVRIVKNLKKKANISDLSLSIYSWNQRTKKDWAYDYYGTPISENNLENSENPQGENQ

SEQ ID NO: 6405 - protein, 178 aa, Leptospira sp. serovar Kenya str. Sh9
MKFYENKEKYKETIINWWIDLKSRTGDRAALRRCSNGLDALLIPYTHRLISQLFQEGFQFFPDKIGPIAGILSHIEEDNPSVSFARSMARKEGEKPVINKIRFRKILQYSDILSEELFYQNMVRIVKNLKKKANISDLSLSIYSWNQRTKKDWAYDYYGTPISENNLENSENPQGENQ

SEQ ID NO: 6406 - protein, 181 aa, Leptospira noguchii str. 2007001578
MKLFDPGSPTAEIILRWWGDLQNNPGERATLSRCSNPSETVFYPASHRLLTELYKIQSNEYRPSRDKVCAIAGILSHVKTNHTIPFASQLSYKKSGSDQPLISDLRFRRILQYKSISEEDQFFQKMIRVIRHLDGNANILDLFSSLYFWGDSVKKRWAYDYYRTGTSTKSENKTTDQGTNQ

SEQ ID NO: 6407 - protein, 178 aa, Leptospira borgpetersenii str. Brem 307; identical to SEQ ID NO: 6341

SEQ ID NO: 6408 - protein, 178 aa, Leptospira borgpetersenii str. Brem 328; identical to SEQ ID NO: 6341

SEQ ID NO: 6409 - protein, 178 aa, Leptospira santarosai serovar Arenal str. MAVJ 401
MRFHENKDKYKEIIIDWWSDLKSQTGDRAALRRCSNGLDTLLIPYTHRLISKLAREEFRFFPDKIGPIAGLLSHVEEDNPSVPFARSMARKEGERSIINEIRFRKILQYSDILSEELFYQNMIRIVKNLRKKANLLDLSLSVYSWNQKTKKNWAYDYYGTPTSENNLDISENPQGENQ

SEQ ID NO: 6410 - protein, 178 aa, Leptospira borgpetersenii serovar Javanica str. MK146; identical to SEQ ID NO: 6341

SEQ ID NO: 6411 - protein, 178 aa, Leptospira borgpetersenii str. Noumea 25; identical to SEQ ID NO: 6341

SEQ ID NO: 6412 - protein, 178 aa, Leptospira santarosai str. CBC523
MRFHENKDKYKEIIIDWWSDLKSQTGDRAALRKCSNGLDTLLIPYTHRLISKLAREEFRFFPDKIGPIAGLLSHVEEDNPSVPFARSMARKEGERSIINEIRFRKILQYSDIISEELFYQNMIRIVKNLRKKANLLDLSLSVYSWNQKTKKNWAYDYYGTPTSENNLDISENPQGENQ

SEQ ID NO: 6413 - protein, 179 aa, Leptospira santarosai str. HAI134
MMRFHENKDKYKEIIIDWWSDLKSQTGDRAALRRCSNGLDTLLIPYTHRLISKLAREEFRFFSDKIGPIAGLLSHVEEDNPSVPFARSMARKEGERSIINEIRFRKILQYSDILLEELFYQNMIRIVKNLRKKANLLDLSLSVYSWNQKTKKNWAYDYYGTPTSENNLDISENPQGENQ

SEQ ID NO: 6414 - protein, 179 aa, Leptospira santarosai str. HAI821
MMRFHENKDKYKEIIIDWWSDLKSQTRDRAALRRCSNGLDTLLIPYTHRLISKLAREEFRFFSDKIGPIAGLLSHVEEDNPSVPFARSMARKEGERSIINEIRFRKILQYSDILSEELFYQNMIRIVKNLRKKANLLDLSLSVYSWNQKTKKNWAYDYYGTPTSENNLDISENPQGENQ

SEQ ID NO: 6415 - protein, 178 aa, Leptospira santarosai str. ZUN179; identical to SEQ ID NO: 6339

SEQ ID NO: 6416 - protein, 178 aa, Leptospira mayottensis 200901116; identical to SEQ ID NO: 6344

SEQ ID NO: 6417 - protein, 178 aa, Leptospira santarosai str. CBC1416
MRFHENKDKYKEIIIDWWSDLKSQTGDRAALRRCSNGLDTLLIPYTHRLISKFAREEFRFFPDKIGPIAGLLSHVEEDNPSVPFARSMARKEGERSIINEIRFRKILQYSDILSEELFYQNMIRIVKNLRKKANLLDLSLSVYSWNQKTKKNWAYDYYGTPTSENDLDISENPQGENQ

SEQ ID NO: 6418 - protein, 178 aa, Leptospira borgpetersenii serovar Pomona str. 200901868
MKFYENKEKYKETIINWWIDLKSRTGDRAALRRCSNGLDTLLIPYTHRLISQLFQEGFQFFPDKIGPIAGILSHIEEDNPSVSFARSMARKEGEKPVINEIRFRKILQYSDILSEELFYQNMVRIVKNLKKKANISDLSLSIYSWNQRTKKDWAYDYYGTPISENNLENSENPQGENQ

SEQ ID NO: 6419 - protein, 178 aa, Leptospira santarosai str. 200403458
MRFHENKDKYKEIIIDWWSDLKSQTGDRAALRRCSNGLDTLLIPYTHRLISKLAREEFRFFSDKIGPIAGLLSHVEEDNPSVPFARSMARKEGERSIINEIRFRKILQYSDILSEELFYQNMIRIVKNLRKKANLLDLSLSVYYWNQKTKKNWAYDYYGTPTSENNLDISENPQGENQ

SEQ ID NO: 6420 - protein, 178 aa, Leptospira santarosai str. AIM
MRFHENKDKYKEIIIDWWSDLKSQTGDRAALRKCSNGLDTLLIPYTHRLISKLAREEFRFFSDKIGPIAGLLSHVEEDNPSVPFARSMARKEGERSIINEIRFRKILQYSDIISEELFYQNMIRIVKNLRKKANLLDLSLSIYSWNQKTKKNWAYDYYGTPTSENNLDISENPQGENQ

SEQ ID NO: 6421 - protein, 181 aa, Leptospira noguchii str. 2001034031; identical to SEQ ID NO: 6406

SEQ ID NO: 6422 - protein, 178 aa, Leptospira santarosai str. 200702252; identical to SEQ ID NO: 6419

SEQ ID NO: 6423 - protein, 178 aa, Leptospira santarosai str. HAI1380; identical to SEQ ID NO: 6339

SEQ ID NO: 6424 - protein, 179 aa, Leptospira santarosai str. CBC1531; identical to SEQ ID NO: 6413

SEQ ID NO: 6425 - protein, 186 aa, Vibrio cholerae O1 str. 95412
MDNNPVVTRDSAVAQTSKTGRFITYVIERIQKDKGFAARLKRADNQTTEYQSWELLASFDVDLEKEWERLPYCIVGAALAKAKPKSNGHLTLGQAIAACYDDGNQSEQAKARLRRLLACSSSTEVCRILRPLLTLIESKGVALNYHQLLEQLLWYHGKAQDSIRARWAQDFYRRSASTQAHEVNYE

SEQ ID NO: 6426 - protein, 147 aa, Methylophaga lonarensis MPL
MSNEKAPDFLAIYEQYQALKPGSQAELRRAVKPADLLEVSAFYQLLKGHQADGRMQRLVYCLPVIKHQAEGYGLGQALAKANISEKRLFMVLRSETPNDLIQLRRLLKMAQPTLDWLKAAPTIYYWGESSKRKLLEDYFYYQNNSAA

SEQ ID NO: 6427 - protein, 186 aa, Salmonella enterica subsp. enterica serovar Dublin str. UC16
MSVVTKDDKATLRQWHDELQEKRGLRASLRRSKTVNDACLAEGLHSLLMQTHSLWKNKAPWNVTALAITAALAAHIKFIDEQKSFAAQLGQKKGGDTPVMSKLRFSHLLAVKTPDELLRQLRRAVKLLDGSVNLFSLADDIFCWCQEQNDLLNHHRRQQRPTEFLRIRWALEYYQAGDGDTDNEQD

SEQ ID NO: 6428 - protein, 178 aa, Escherichia coli MP021017.9; identical to SEQ ID NO: 6162

SEQ ID NO: 6429 - protein, 178 aa, Escherichia coli MP021017.6
MSIVKEEHKATLRKWHEELQEKRGERASLRRSTTVNDVCLTDGFRLFLKNRQIKWQDEPEWRITALALIAAVSANVKAIDERQPFAAQLAAVMSKGRFTRLSAVKTPDELLRQLRRAVRLLNGSVNLDSLAEGVFRWCQESDDLLNHPRRQQRPTEFIRIRWALEYYQAGDADNEQNQ

SEQ ID NO: 6430 - protein, 178 aa, Escherichia coli MP021017.5
MSIVKEEHKATLRKWHEELQEKRGERASLRRSTTVNDVCLTDGFRLFLKNRQIKWQDEPEGRITALALIAAVSANVKAIDERQPFAAQLAAVMSKGRFTRLSAVKTPDELLRQLRRAVRLLNGSVNLDSLAEGVFRWCQESDDLLNHHRRQQRPTEFIRIRWALEYYQAGDADNEQNQ

SEQ ID NO: 6431 - protein, 178 aa, Escherichia coli MP021017.4; identical to SEQ ID NO: 6162

SEQ ID NO: 6432 - protein, 178 aa, Escherichia coli MP021017.3; identical to SEQ ID NO: 6162

SEQ ID NO: 6433 - protein, 178 aa, Escherichia coli MP021017.2; identical to SEQ ID NO: 6162

SEQ ID NO: 6434 - protein, 178 aa, Escherichia coli MP021017.10; identical to SEQ ID NO: 6162

SEQ ID NO: 6435 - protein, 178 aa, Escherichia coli MP021017.11; identical to SEQ ID NO: 6162

SEQ ID NO: 6436 - protein, 178 aa, Escherichia coli BCE034_MS-14; identical to SEQ ID NO: 6162

SEQ ID NO: 6437 - protein, 178 aa, Escherichia coli MP021017.12; identical to SEQ ID NO: 6162

SEQ ID NO: 6438 - protein, 178 aa, Escherichia coli BCE002_MS12
MSIVKEEHKATLRKWHEELQEKRGERASLRRSTTVNDVCLTDGFRLFLKNRQIKWQDEPEWRITALALIAAVSANVKAIDERQPFAAQLAAVMSKGRFTRLSEVKTPDELLRQLRRAVRLLNGSVNLDSLAEGVFRWCQESDDLLNHHRRQQRPTEFIRIRWALEYYQAGDADNEQNQ

SEQ ID NO: 6439 - protein, 178 aa, Escherichia coli 2875000; identical to SEQ ID NO: 6162

SEQ ID NO: 6440 - protein, 160 aa, Escherichia coli BCE019_MS-13
MADEIDAMALYRAWQQLDNGACAQIRRVSEPDELRDIPAFYRLVQPFGWENPRHQQALLRMVFCLSAGKNVIRHQDKKPEQTTGISLGRALANSGRINERRIFQLIRADRTADMVQLRRLLAHAEPVLDWPLMARMLTWWGKRERQQLLEDFVLTTNKNA

SEQ ID NO: 6441 - protein, 178 aa, Escherichia coli 2872800; identical to SEQ ID NO: 6162

SEQ ID NO: 6442 - protein, 160 aa, Escherichia coli 2872000; identical to SEQ ID NO: 6440

SEQ ID NO: 6443 - protein, 160 aa, Escherichia coli 2871950
MADEIDAMALYRAWQQLDNGACAQIRRVSEPDELRDIPAFYRLGQPFGWENPRHQQALLRMVFCLSAGKNVIRHQDKKPEQTTGISLGRALANSGRINERRIFQLIRADRTADMVQLRRLLAHAEPVLDWPLMARMLTWWGKRERQQLLEDFVLTTNKNA

SEQ ID NO: 6444 - protein, 178 aa, Escherichia coli 2867750; identical to SEQ ID NO: 6162

SEQ ID NO: 6445 - protein, 178 aa, Escherichia coli 2866550; identical to SEQ ID NO: 6162

SEQ ID NO: 6446 - protein, 178 aa, Escherichia coli 2866450; identical to SEQ ID NO: 6162

SEQ ID NO: 6447 - protein, 178 aa, Escherichia coli 2866750; identical to SEQ ID NO: 6162

SEQ ID NO: 6448 - protein, 178 aa, Escherichia coli 2861200; identical to SEQ ID NO: 6162

SEQ ID NO: 6449 - protein, 177 aa, Escherichia coli 2865200; identical to SEQ ID NO: 6170

SEQ ID NO: 6450 - protein, 178 aa, Escherichia coli 2860050; identical to SEQ ID NO: 6162

SEQ ID NO: 6451 - protein, 178 aa, Escherichia coli 2853500; identical to SEQ ID NO: 6162

SEQ ID NO: 6452 - protein, 178 aa, Escherichia coli 2851500; identical to SEQ ID NO: 6162

SEQ ID NO: 6453 - protein, 178 aa, Escherichia coli 2850750; identical to SEQ ID NO: 6162

SEQ ID NO: 6454 - protein, 178 aa, Escherichia coli 2850400; identical to SEQ ID NO: 6162

SEQ ID NO: 6455 - protein, 178 aa, Escherichia coli 2848050; identical to SEQ ID NO: 6162

SEQ ID NO: 6456 - protein, 160 aa, Escherichia coli 2845350; identical to SEQ ID NO: 6440

SEQ ID NO: 6457 - protein, 177 aa, Escherichia coli 2788150; identical to SEQ ID NO: 6170

SEQ ID NO: 6458 - protein, 179 aa, Escherichia coli 2780750
MSIVKEEHKATLRKWHEELQAKRGNRASLRRSTTVNDVCLSEGFRSLLMQTHTLWKIEAQEWRFTALALVAAVSANVKAIDERQPFAAQLAAVMSEGRFTRLSAVKTPDDLLRQLRRAVKLLNGSVNLISLAEDIFRWCQESDDLLNHHRRQQRPTEFIRIRWALEYYQAGDADNEQNQ

SEQ ID NO: 6459 - protein, 178 aa, Escherichia coli 2770900; identical to SEQ ID NO: 6162

SEQ ID NO: 6460 - protein, 160 aa, Escherichia coli 2762100; identical to SEQ ID NO: 6440

SEQ ID NO: 6461 - protein, 178 aa, Escherichia coli 2756500; identical to SEQ ID NO: 6430

SEQ ID NO: 6462 - protein, 178 aa, Escherichia coli 2749250; identical to SEQ ID NO: 6162

SEQ ID NO: 6463 - protein, 178 aa, Escherichia coli 2747800; identical to SEQ ID NO: 6162

SEQ ID NO: 6464 - protein, 160 aa, Escherichia coli 2731150; identical to SEQ ID NO: 6440

SEQ ID NO: 6465 - protein, 178 aa, Escherichia coli 180600; identical to SEQ ID NO: 6162

SEQ ID NO: 6466 - protein, 178 aa, Escherichia coli ThroopD; identical to SEQ ID NO: 6162

SEQ ID NO: 6467 - protein, 178 aa, Escherichia coli P0304777.1; identical to SEQ ID NO: 6162

SEQ ID NO: 6468 - protein, 179 aa, Escherichia coli P0302308.1; identical to SEQ ID NO: 6196

SEQ ID NO: 6469 - protein, 178 aa, Escherichia coli P0302293.2; identical to SEQ ID NO: 6229

SEQ ID NO: 6470 - protein, 160 aa, Escherichia coli P0301867.1
MADEIDAMALYRAWQQLDNGACAQIRRVSEPDELRDIPAFYRLVQPFGWENPRHQQALLRMVFCLSAGKNVIRHQDKKPEQTTGISLGRALANSGRINERRIFQLIRADRTADMVQLRRLLTHAEPVLDWPLMARMLTWWGKRERQQLLEDFVLTTNKNA

SEQ ID NO: 6471 - protein, 160 aa, Escherichia coli MP021566.1; identical to SEQ ID NO: 6440

SEQ ID NO: 6472 - protein, 199 aa, Escherichia coli MP021561.2
MNSHTAALRRITQPAAQTELLEWFRSLSERYAENNAQRNNGRAWRAELKRMQIPYGVMMCEGYNALRQRMNAHMSLGPLEQMALALFVCVAVHVKSHKEKLSFAAQLGEKINGSTPCFSTLRFERLQKSVEPEDFCRQLIHAVKIRGMDGVNILSLADSIFLWMEEWQRRENDVPETTHPFERNKIRWANEYISNYHVK

SEQ ID NO: 6473 - protein, 178 aa, Escherichia coli MP021017.1; identical to SEQ ID NO: 6162

SEQ ID NO: 6474 - protein, 179 aa, Escherichia coli MP020980.2; identical to SEQ ID NO: 6458

SEQ ID NO: 6475 - protein, 178 aa, Escherichia coli Jurua 20/10; identical to SEQ ID NO: 6162

SEQ ID NO: 6476 - protein, 179 aa, Escherichia coli MP020940.1; identical to SEQ ID NO: 6196

SEQ ID NO: 6477 - protein, 178 aa, Escherichia coli Jurua 18/11; identical to SEQ ID NO: 6162

SEQ ID NO: 6478 - protein, 178 aa, Escherichia coli Envira 10/1; identical to SEQ ID NO: 6162

SEQ ID NO: 6479 - protein, 178 aa, Escherichia coli Envira 8/11; identical to SEQ ID NO: 6162

SEQ ID NO: 6480 - protein, 201 aa, Escherichia coli 2726800
MSIVKEEHKATLRKWREELQAKRGNRASLRRSTTVNDVCLSEGFRSLLMQTHTLWKIEAQEWRFTALALVAAVSANVKAIDERQPFAAQLAAVMSKGRFTRLSAVKTPDELLRQLRRAVRLLNGSVNLDSLAEGSSVGARRATTCSIITAASSGQPNLSVSAGRWNITRLATPITNKINKGLSHDNIYSASFVNRLPCCQP

SEQ ID NO: 6481 - protein, 160 aa, Escherichia coli 2719100; identical to SEQ ID NO: 6470

SEQ ID NO: 6482 - protein, 178 aa, Escherichia coli BCE001_MS16; identical to SEQ ID NO: 6162

SEQ ID NO: 6483 - protein, 178 aa, Escherichia coli 2720900; identical to SEQ ID NO: 6162

SEQ ID NO: 6484 - protein, 172 aa, Leptospira weilii serovar Ranarum str. ICFT
MSEEKFENEIKFIKVLQKLSEENTKAMAELRRSLSYDLTTYPKSYPYVEWAVENLGEWKRKAYYLVAGLFALHKIEDGSLSTKRNLGATIFQLYKENDESKSIEQRFINLLESDEEELAYRLRQMISLLKGKSINWTLLLYHVKYWNRTDKWVQQKWSRSFYKNFSMTKSES

SEQ ID NO: 6485 - protein, 179 aa, Escherichia coli 174900; identical to SEQ ID NO: 6196

SEQ ID NO: 6486 - protein, 178 aa, Escherichia coli 2735000; identical to SEQ ID NO: 6429

SEQ ID NO: 6487 - protein, 160 aa, Escherichia coli 2846750; identical to SEQ ID NO: 6440

SEQ ID NO: 6488 - protein, 178 aa, Escherichia coli 199900.1; identical to SEQ ID NO: 6429

SEQ ID NO: 6489 - protein, 178 aa, Escherichia coli p0305293.1; identical to SEQ ID NO: 6162

SEQ ID NO: 6490 - protein, 160 aa, Escherichia coli P0305260.1; identical to SEQ ID NO: 6440

SEQ ID NO: 6491 - protein, 179 aa, Escherichia coli P0304816.1; identical to SEQ ID NO: 6196

SEQ ID NO: 6492 - protein, 160 aa, Escherichia coli P0299438.2; identical to SEQ ID NO: 6440

SEQ ID NO: 6493 - protein, 178 aa, Escherichia coli P0299917.1; identical to SEQ ID NO: 6162

SEQ ID NO: 6494 - protein, 178 aa, Escherichia coli BCE008_MS-13; identical to SEQ ID NO: 6162

SEQ ID NO: 6495 - protein, 160 aa, Escherichia coli 201600.1; identical to SEQ ID NO: 6440

SEQ ID NO: 6496 - protein, 160 aa, Escherichia coli P0298942.1; identical to SEQ ID NO: 6440

SEQ ID NO: 6497 - protein, 160 aa, Escherichia coli BCE007_MS-11; identical to SEQ ID NO: 6440

SEQ ID NO: 6498 - protein, 160 aa, Escherichia coli P0301867.4; identical to SEQ ID NO: 6470

SEQ ID NO: 6499 - protein, 160 aa, Escherichia coli P0301867.2; identical to SEQ ID NO: 6470

SEQ ID NO: 6500 - protein, 178 aa, Escherichia coli 2729250; identical to SEQ ID NO: 6162

SEQ ID NO: 6501 - protein, 100 aa, Escherichia coli 178900
MVFCLSAGKNVIRHQDKKPEQTTGISLGRALANSGRINERRIFQLIRADRTADMVQLRRLLTHAEPVLDWPLMARMLTWWGKRERQQLLEDFVLTTNKNA

SEQ ID NO: 6502 - protein, 178 aa, Escherichia coli 179550; identical to SEQ ID NO: 6162

SEQ ID NO: 6503 - protein, 178 aa, Escherichia coli 180200; identical to SEQ ID NO: 6162

SEQ ID NO: 6504 - protein, 160 aa, Escherichia coli 2730450; identical to SEQ ID NO: 6440

SEQ ID NO: 6505 - protein, 160 aa, Escherichia coli 2741950; identical to SEQ ID NO: 6440

SEQ ID NO: 6506 - protein, 178 aa, Escherichia coli 2730350; identical to SEQ ID NO: 6162

SEQ ID NO: 6507 - protein, 178 aa, Escherichia coli 2860650; identical to SEQ ID NO: 6162

SEQ ID NO: 6508 - protein, 179 aa, Escherichia coli 2864350; identical to SEQ ID NO: 6458

SEQ ID NO: 6509 - protein, 160 aa, Escherichia coli 2862600; identical to SEQ ID NO: 6440

SEQ ID NO: 6510 - protein, 178 aa, Escherichia coli 2866350; identical to SEQ ID NO: 6162

SEQ ID NO: 6511 - protein, 178 aa, Escherichia coli BCE008_MS-01; identical to SEQ ID NO: 6162

SEQ ID NO: 6512 - protein, 160 aa, Escherichia coli BCE030_MS-09; identical to SEQ ID NO: 6443

SEQ ID NO: 6513 - protein, 160 aa, Escherichia coli BCE032_MS-12; identical to SEQ ID NO: 6440

SEQ ID NO: 6514 - protein, 178 aa, Escherichia coli MP021561.3; identical to SEQ ID NO: 6229

SEQ ID NO: 6515 - protein, 160 aa, Escherichia coli P0298942.10; identical to SEQ ID NO: 6440

SEQ ID NO: 6516 - protein, 160 aa, Escherichia coli P0298942.12; identical to SEQ ID NO: 6440

SEQ ID NO: 6517 - protein, 160 aa, Escherichia coli P0298942.11; identical to SEQ ID NO: 6440

SEQ ID NO: 6518 - protein, 160 aa, Escherichia coli P0298942.6; identical to SEQ ID NO: 6440

SEQ ID NO: 6519 - protein, 160 aa, Escherichia coli P0298942.15; identical to SEQ ID NO: 6443

SEQ ID NO: 6520 - protein, 160 aa, Escherichia coli P0298942.7; identical to SEQ ID NO: 6443

SEQ ID NO: 6521 - protein, 160 aa, Escherichia coli P0298942.2; identical to SEQ ID NO: 6440

SEQ ID NO: 6522 - protein, 160 aa, Escherichia coli P0299438.10; identical to SEQ ID NO: 6440

SEQ ID NO: 6523 - protein, 160 aa, Escherichia coli P0298942.9; identical to SEQ ID NO: 6440

SEQ ID NO: 6524 - protein, 160 aa, Escherichia coli P0298942.8
MADEIDAMALYRAWQQLDNGACAQIRRVSEPDELRDIPAFYRLVQPFGWENPRPQQALLRMVFCLSAGKNVIRHQDKKPEQTTGISLGRALANSGRINERRIFQLIRADRTADMVQLRRLLAHAEPVLDWPLMARMLTWWGKRERQQLLEDFVLTTNKNA

SEQ ID NO: 6525 - protein, 160 aa, Escherichia coli P0299438.4; identical to SEQ ID NO: 6440

SEQ ID NO: 6526 - protein, 160 aa, Escherichia coli P0299438.9; identical to SEQ ID NO: 6440

SEQ ID NO: 6527 - protein, 178 aa, Escherichia coli P02997067.6; identical to SEQ ID NO: 6162

SEQ ID NO: 6528 - protein, 178 aa, Escherichia coli P0299917.10; identical to SEQ ID NO: 6229

SEQ ID NO: 6529 - protein, 178 aa, Escherichia coli P0299917.2; identical to SEQ ID NO: 6229

SEQ ID NO: 6530 - protein, 178 aa, Escherichia coli P0299917.3; identical to SEQ ID NO: 6229

SEQ ID NO: 6531 - protein, 178 aa, Escherichia coli P0299917.4; identical to SEQ ID NO: 6229

SEQ ID NO: 6532 - protein, 178 aa, Escherichia coli P0299917.5; identical to SEQ ID NO: 6229

SEQ ID NO: 6533 - protein, 178 aa, Escherichia coli P0299917.8; identical to SEQ ID NO: 6229

SEQ ID NO: 6534 - protein, 178 aa, Escherichia coli P0299917.6; identical to SEQ ID NO: 6229

SEQ ID NO: 6535 - protein, 178 aa, Escherichia coli P0299917.7; identical to SEQ ID NO: 6229

SEQ ID NO: 6536 - protein, 178 aa, Escherichia coli P0299917.9; identical to SEQ ID NO: 6229

SEQ ID NO: 6537 - protein, 160 aa, Escherichia coli P0301867.11; identical to SEQ ID NO: 6470

SEQ ID NO: 6538 - protein, 160 aa, Escherichia coli P0301867.8
MADEIDAMALYRAWQQLDNGACAQIRRVSEPDELRDIPAFYRLGQPFGWENPRHQQALLRMVFCLSAGKNVIRHQDKKPEQTTGISLGRALANSGRINERRIFQLIRADRTADMVQLRRLLTHAEPVLDWPLMARMLTWWGKRERQQLLEDFVLTTNKNA

SEQ ID NO: 6539 - protein, 179 aa, Escherichia coli P0302308.10; identical to SEQ ID NO: 6196

SEQ ID NO: 6540 - protein, 179 aa, Escherichia coli P0302308.11; identical to SEQ ID NO: 6196

SEQ ID NO: 6541 - protein, 179 aa, Escherichia coli P0302308.3; identical to SEQ ID NO: 6196

SEQ ID NO: 6542 - protein, 179 aa, Escherichia coli P0302308.2; identical to SEQ ID NO: 6196

SEQ ID NO: 6543 - protein, 179 aa, Escherichia coli P0302308.5; identical to SEQ ID NO: 6196

SEQ ID NO: 6544 - protein, 179 aa, Escherichia coli P0302308.4; identical to SEQ ID NO: 6196

SEQ ID NO: 6545 - protein, 179 aa, Escherichia coli 179100; identical to SEQ ID NO: 6196

SEQ ID NO: 6546 - protein, 201 aa, Escherichia coli 2854350; identical to SEQ ID NO: 6480

SEQ ID NO: 6547 - protein, 160 aa, Escherichia coli 2733950; identical to SEQ ID NO: 6440

SEQ ID NO: 6548 - protein, 178 aa, Escherichia coli p0305293.13; identical to SEQ ID NO: 6162

SEQ ID NO: 6549 - protein, 179 aa, Escherichia coli MP020980.1; identical to SEQ ID NO: 6458

SEQ ID NO: 6550 - protein, 160 aa, Escherichia coli BCE006_MS-23; identical to SEQ ID NO: 6440

SEQ ID NO: 6551 - protein, 153 aa, Escherichia coli P0298942.3
MALYRAWQQLDNGACAQIRRVSEPDELRDIPAFYRLVQPFGWENPRHQQALLRMVFCLSAGKNVIRHQDKKPEQTTGISLGRALANSGRINERRIFQLIRADRTADMVQLRRLLAHAEPVLDWPLMARMLTWWGKRERQQLLEDFVLTTNKNA

SEQ ID NO: 6552 - protein, 160 aa, Escherichia coli P0298942.4; identical to SEQ ID NO: 6440

SEQ ID NO: 6553 - protein, 160 aa, Escherichia coli P0301867.13; identical to SEQ ID NO: 6470

SEQ ID NO: 6554 - protein, 160 aa, Escherichia coli P0301904.3; identical to SEQ ID NO: 6440

SEQ ID NO: 6555 - protein, 178 aa, Escherichia coli P0302293.7; identical to SEQ ID NO: 6229

SEQ ID NO: 6556 - protein, 160 aa, Escherichia coli P0305260.2; identical to SEQ ID NO: 6440

SEQ ID NO: 6557 - protein, 178 aa, Escherichia coli p0305293.14; identical to SEQ ID NO: 6162

SEQ ID NO: 6558 - protein, 178 aa, Escherichia coli P0302293.10; identical to SEQ ID NO: 6229

SEQ ID NO: 6559 - protein, 178 aa, Escherichia coli P0302293.3; identical to SEQ ID NO: 6229

SEQ ID NO: 6560 - protein, 178 aa, Escherichia coli P0302293.4; identical to SEQ ID NO: 6229

SEQ ID NO: 6561 - protein, 178 aa, Escherichia coli P0302293.6
MSIVKDGHKATLRKWHEELQAKRGNRASLRRSTTVNDVCLSEGFRSLLMQTHTLWKIEAQEWRFTALALVAAVAANVKAIDERQPFAAQLAAVMSEGRFTCLSAVKTPDDLLRQLRRAVKLLNGSVNLISLADDIFRWGQESDDLLNHHRRQQRPTEFIRIRWALEYYQAGDADNEQN

SEQ ID NO: 6562 - protein, 178 aa, Escherichia coli P0302293.8; identical to SEQ ID NO: 6229

SEQ ID NO: 6563 - protein, 178 aa, Escherichia coli P0304777.10; identical to SEQ ID NO: 6162

SEQ ID NO: 6564 - protein, 178 aa, Escherichia coli P0302293.9; identical to SEQ ID NO: 6229

SEQ ID NO: 6565 - protein, 178 aa, Escherichia coli P0304777.11; identical to SEQ ID NO: 6162

SEQ ID NO: 6566 - protein, 178 aa, Escherichia coli P0304777.12; identical to SEQ ID NO: 6162

SEQ ID NO: 6567 - protein, 178 aa, Escherichia coli P0304777.13; identical to SEQ ID NO: 6162

SEQ ID NO: 6568 - protein, 178 aa, Escherichia coli P0304777.14; identical to SEQ ID NO: 6162

SEQ ID NO: 6569 - protein, 178 aa, Escherichia coli P0304777.15; identical to SEQ ID NO: 6162

SEQ ID NO: 6570 - protein, 178 aa, Escherichia coli P0304777.2; identical to SEQ ID NO: 6162

SEQ ID NO: 6571 - protein, 178 aa, Escherichia coli P0304777.3; identical to SEQ ID NO: 6162

SEQ ID NO: 6572 - protein, 178 aa, Escherichia coli P0304777.4; identical to SEQ ID NO: 6162

SEQ ID NO: 6573 - protein, 178 aa, Escherichia coli P0304777.7; identical to SEQ ID NO: 6162

SEQ ID NO: 6574 - protein, 178 aa, Escherichia coli P0304777.5; identical to SEQ ID NO: 6162

SEQ ID NO: 6575 - protein, 178 aa, Escherichia coli P0304777.8; identical to SEQ ID NO: 6162

SEQ ID NO: 6576 - protein, 178 aa, Escherichia coli P0304777.9; identical to SEQ ID NO: 6162

SEQ ID NO: 6577 - protein, 179 aa, Escherichia coli P0304816.11; identical to SEQ ID NO: 6196

SEQ ID NO: 6578 - protein, 179 aa, Escherichia coli P0304816.10; identical to SEQ ID NO: 6196

SEQ ID NO: 6579 - protein, 179 aa, Escherichia coli P0304816.12; identical to SEQ ID NO: 6196

SEQ ID NO: 6580 - protein, 179 aa, Escherichia coli P0304816.14; identical to SEQ ID NO: 6196

SEQ ID NO: 6581 - protein, 179 aa, Escherichia coli P0304816.13; identical to SEQ ID NO: 6196

SEQ ID NO: 6582 - protein, 179 aa, Escherichia coli P0304816.15; identical to SEQ ID NO: 6196

SEQ ID NO: 6583 - protein, 179 aa, Escherichia coli P0304816.2; identical to SEQ ID NO: 6196

SEQ ID NO: 6584 - protein, 179 aa, Escherichia coli P0304816.6; identical to SEQ ID NO: 6196

SEQ ID NO: 6585 - protein, 179 aa, Escherichia coli P0304816.7; identical to SEQ ID NO: 6196

SEQ ID NO: 6586 - protein, 179 aa, Escherichia coli P0304816.8; identical to SEQ ID NO: 6196

SEQ ID NO: 6587 - protein, 179 aa, Escherichia coli P0304816.9; identical to SEQ ID NO: 6196

SEQ ID NO: 6588 - protein, 160 aa, Escherichia coli P0305260.10; identical to SEQ ID NO: 6443

SEQ ID NO: 6589 - protein, 160 aa, Escherichia coli P0305260.11; identical to SEQ ID NO: 6443

SEQ ID NO: 6590 - protein, 160 aa, Escherichia coli P0305260.12; identical to SEQ ID NO: 6443

SEQ ID NO: 6591 - protein, 160 aa, Escherichia coli P0305260.13; identical to SEQ ID NO: 6443

SEQ ID NO: 6592 - protein, 160 aa, Escherichia coli P0305260.15; identical to SEQ ID NO: 6440

SEQ ID NO: 6593 - protein, 160 aa, Escherichia coli P0305260.3; identical to SEQ ID NO: 6440

SEQ ID NO: 6594 - protein, 160 aa, Escherichia coli P0305260.4; identical to SEQ ID NO: 6440

SEQ ID NO: 6595 - protein, 160 aa, Escherichia coli P0305260.5; identical to SEQ ID NO: 6443

SEQ ID NO: 6596 - protein, 160 aa, Escherichia coli P0305260.6; identical to SEQ ID NO: 6443

SEQ ID NO: 6597 - protein, 160 aa, Escherichia coli P0305260.7; identical to SEQ ID NO: 6440

SEQ ID NO: 6598 - protein, 160 aa, Escherichia coli P0305260.8; identical to SEQ ID NO: 6443

SEQ ID NO: 6599 - protein, 178 aa, Escherichia coli p0305293.10; identical to SEQ ID NO: 6162

SEQ ID NO: 6600 - protein, 160 aa, Escherichia coli P0305260.9; identical to SEQ ID NO: 6440

SEQ ID NO: 6601 - protein, 178 aa, Escherichia coli p0305293.11; identical to SEQ ID NO: 6162

SEQ ID NO: 6602 - protein, 178 aa, Escherichia coli p0305293.12; identical to SEQ ID NO: 6162

SEQ ID NO: 6603 - protein, 178 aa, Escherichia coli p0305293.15; identical to SEQ ID NO: 6162

SEQ ID NO: 6604 - protein, 178 aa, Escherichia coli p0305293.2; identical to SEQ ID NO: 6162

SEQ ID NO: 6605 - protein, 178 aa, Escherichia coli p0305293.3; identical to SEQ ID NO: 6162

SEQ ID NO: 6606 - protein, 178 aa, Escherichia coli p0305293.4; identical to SEQ ID NO: 6162

SEQ ID NO: 6607 - protein, 178 aa, Escherichia coli p0305293.8; identical to SEQ ID NO: 6438

SEQ ID NO: 6608 - protein, 178 aa, Escherichia coli p0305293.9; identical to SEQ ID NO: 6162

SEQ ID NO: 6609 - protein, 178 aa, Escherichia coli 178200; identical to SEQ ID NO: 6162

SEQ ID NO: 6610 - protein, 160 aa, Escherichia coli P0298942.14; identical to SEQ ID NO: 6443

SEQ ID NO: 6611 - protein, 160 aa, Escherichia coli P0301867.3; identical to SEQ ID NO: 6470

SEQ ID NO: 6612 - protein, 160 aa, Escherichia coli P0301867.5; identical to SEQ ID NO: 6538

SEQ ID NO: 6613 - protein, 160 aa, Escherichia coli P0301867.7; identical to SEQ ID NO: 6538

SEQ ID NO: 6614 - protein, 179 aa, Escherichia coli P0302308.13
MSIVKEEHKATLRKWREELQAKRGNSASLRRSTTVNDVCLSEGFRSLLMQTHTLWKIEAQEWRFTALALVAAVSANVKAIDERQPFAAQLAAVMSKGRFTRLSAVKTPDELLRQLRRAVRLLNGSVNLDSLAEGVFRWCQESDDLLNHHRRQQRPTEFIRIRWALEYYQAGDADNEQNQ

SEQ ID NO: 6615 - protein, 179 aa, Escherichia coli P0302308.12; identical to SEQ ID NO: 6196

SEQ ID NO: 6616 - protein, 179 aa, Escherichia coli P0302308.14; identical to SEQ ID NO: 6196

SEQ ID NO: 6617 - protein, 179 aa, Escherichia coli P0304816.3; identical to SEQ ID NO: 6196

SEQ ID NO: 6618 - protein, 179 aa, Escherichia coli P0304816.4; identical to SEQ ID NO: 6196

SEQ ID NO: 6619 - protein, 179 aa, Escherichia coli P0304816.5; identical to SEQ ID NO: 6196

SEQ ID NO: 6620 - protein, 178 aa, Escherichia coli p0305293.5; identical to SEQ ID NO: 6162

SEQ ID NO: 6621 - protein, 178 aa, Escherichia coli p0305293.7; identical to SEQ ID NO: 6162

SEQ ID NO: 6622 - protein, 178 aa, Escherichia coli p0305293.6; identical to SEQ ID NO: 6162

SEQ ID NO: 6623 - protein, 178 aa, Leptospira borgpetersenii serovar Mini str. 201000851; identical to SEQ ID NO: 6340

SEQ ID NO: 6624 - protein, 188 aa, Klebsiella pneumoniae UHKPC81; identical to SEQ ID NO: 6399

SEQ ID NO: 6625 - protein, 188 aa, Klebsiella pneumoniae UHKPC57; identical to SEQ ID NO: 6399

SEQ ID NO: 6626 - protein, 181 aa, Leptospira noguchii str. 1993005606; identical to SEQ ID NO: 6406

SEQ ID NO: 6627 - protein, 178 aa, Leptospira santarosai serovar Shermani str. 1342KT
MRFHENKDKYKEIIIDWWSDLKSQTGDRAALRRCSNGLDTLSIPYTHRLISKLAREEFRFFPDKIGPIAGLLSHVEEDNPSVPFARSMARKEGERPIINEIRFRKILQYSDILSEELFYQNMIRIVKNLRKKANLLDLSLSVYSWNQKTKKNWAYDYYGTPTSENNLDISENPQGENQ

SEQ ID NO: 6628 - protein, 204 aa, Gardnerella vaginalis JCP8481B
MAENQSVLIEISGAVTKIIKQFFDGLDIASRRAMLAQLRHTIGKPLSQSVEIWPWILSNVPENFINKYGEVSYQLQAVINTLQIYSLYEQGGVEKLGDKNSNESEESESKKSYSNMGTTLRGLRSDEGVRGAMDRRFSVMITASDYESFYYYLRQLVRLLKGRTKDNRQAINYIQLARDLYLLQFEDSEKVRLSWAQEYYRFSK

SEQ ID NO: 6629 - protein, 204 aa, Gardnerella vaginalis JCP8481A; identical to SEQ ID NO: 6628

SEQ ID NO: 6630 - protein, 204 aa, Gardnerella vaginalis JCP8017A
MAENQSKSVEVSNAVRKIINQFLNGSDIASRRAMLAQLRNTIGKPLSQSVEIWPWILSNVPESFINKYGEVSYQMRSVINTLQIYALYEQGSVEKSSYKYLNKSEDSENEKSYNNMGTALRALRCDEGVRGAMDRRFSVMITASDYESFYYYLRQLVRLLKSRTKENQQAIDYSKLARDLYLLQFEDSEKVRLSWAQEYYRLSK

SEQ ID NO: 6631 - protein, 203 aa, Gardnerella vaginalis JCP7672
MAENKSKSVEVSSAVSKIINQFLNSSDIASRRAMLAQLRHTIGKPLSQSVEIWPWILNNVPESFIDKYGEVTYQLRAVINTLQIYALYEQGVVEKSSYKDLNKSEDLENEKSYNNMGTALRALRSDEGVRGAMDRRFSVMITASDYESFYYYLRQLVRLLKSRTKENQQAIDYSKLARDLYLLQFEDSEKVRLSWAQEYYRFS

SEQ ID NO: 6632 - protein, 204 aa, Gardnerella vaginalis JCP7659; identical to SEQ ID NO: 6630

SEQ ID NO: 6633 - protein, 212 aa, Gardnerella vaginalis JCP7275
MRKEAIMAENQSKSVEVSNAVSKIIKQFIEIADASSNRAMLAQLRHTIGKPLSQSVEIWPWILSNVPESFINKYGEVSYQMQAVINTLQIYALYEQGGVEKSSYKDLNKSEDSENEKSYNNMGTALRALRSDEGVRGAMDRRFSVMITASNYESFYYYLRQLIRLLKSRTKENQQAIDYSKLARDLYLLQFEDSEKIRLSWAQEYYRLSKQQ

SEQ ID NO: 6634 - protein, 204 aa, Gardnerella vaginalis JCP8070
MAENQSKSVEVSNAVRKIINQFIEIADTSSYRAMLAQLRHTIGKPLSQSVEIWPWILNNVPESFIDKYGEVSYQMRAVINTLQIYALYEQGGVEKSSYKDLNKSEDPENEKSYNNMGTALRALRSDEGVRGAMDRRFSVMITASDYESFYYYLRQLVRLLKSRMKENKQAIDYSKLARDLYLLQFEDSEKVRLSWAQEYYRFTK

SEQ ID NO: 6635 - protein, 206 aa, Gardnerella vaginalis JCP8066
MAESQSKSVEVSNAVSKIIKQFIEIADASSNRAMLAQLRHTIGKPLSQSVEIWPWILSNVPESFINKYGEVSYQLRAVINTLQIYALYEQGSVEKSSYKDLNKSEDSENEKSYNNMGTALRALRSDEGVRGAMDRRFSVMITASNYESFYYYLRQLIRLLKSRTKENKQAVDYSKLARDLYLLQFEDSEKIRLSWAQEYYRLSKQQ

SEQ ID NO: 6636 - protein, 204 aa, Gardnerella vaginalis JCP8017B; identical to SEQ ID NO: 6630

SEQ ID NO: 6637 - protein, 186 aa, Salmonella enterica subsp. enterica serovar Dublin str. DG22; identical to SEQ ID NO: 6427

SEQ ID NO: 6638 - protein, 184 aa, Salmonella enterica subsp. enterica serovar Enteritidis str. 2009K0958
MSVVTKDDKATLRQWHDELQEKRGLRASLRRSKTVNDACLAEGLHSLLMQTHSLWKNKAPWNVTALAITAALAAHIKFIDEQKSFAAQLGQKKGGDTPVMSKLRFSHLLAVKTPDELLRQLRRAVKLLDGSVNLFSLADDIFCWCQEQNDLLNHHRRQQRPTEFLRIRWALEYYQAGDTDNEQD

SEQ ID NO: 6639 - protein, 184 aa, Salmonella enterica subsp. enterica serovar Enteritidis str. 08-1080; identical to SEQ ID NO: 6638

SEQ ID NO: 6640 - protein, 184 aa, Salmonella enterica subsp. enterica serovar Enteritidis str. 2010K-0262; identical to SEQ ID NO: 6638

SEQ ID NO: 6641 - protein, 184 aa, Salmonella enterica subsp. enterica serovar Enteritidis str. 2009K1726; identical to SEQ ID NO: 6638

SEQ ID NO: 6642 - protein, 184 aa, Salmonella enterica subsp. enterica serovar Enteritidis str. 2009K1651; identical to SEQ ID NO: 6638

SEQ ID NO: 6643 - protein, 184 aa, Salmonella enterica subsp. enterica serovar Enteritidis str. 2010K-0267; identical to SEQ ID NO: 6638

SEQ ID NO: 6644 - protein, 184 aa, Salmonella enterica subsp. enterica serovar Enteritidis str. 2010K-0284; identical to SEQ ID NO: 6638

SEQ ID NO: 6645 - protein, 184 aa, Salmonella enterica subsp. enterica serovar Enteritidis str. 2010K-0271; identical to SEQ ID NO: 6638

SEQ ID NO: 6646 - protein, 184 aa, Salmonella enterica subsp. enterica serovar Enteritidis str. 2010K-0286; identical to SEQ ID NO: 6638

SEQ ID NO: 6647 - protein, 180 aa, Klebsiella pneumoniae DMC0799; identical to SEQ ID NO: 6147

SEQ ID NO: 6648 - protein, 188 aa, Klebsiella pneumoniae UHKPC179; identical to SEQ ID NO: 6399

SEQ ID NO: 6649 - protein, 178 aa, Leptospira alexanderi serovar Manhao 3 str. L 60
MRFYENKEKYNEIIINWWTDLKSRTGDRAALRRCSNGLDTLLIPYTHRLISKLFQEGFQFFPDKIGPIAGILSHIEEDSPSVPFARSMARKEGEKPVINEIRFRKILQYSDILSEELFYQNMIRIVKNLKKKANLSDLSLSIYSWNQKTKKDWAYDYYGTPTSENDLDNLENPQGENQ

SEQ ID NO: 6650 - protein, 178 aa, Escherichia coli B107; identical to SEQ ID NO: 6238

SEQ ID NO: 6651 - protein, 178 aa, Escherichia coli B102; identical to SEQ ID NO: 6238

SEQ ID NO: 6652 - protein, 178 aa, Escherichia coli 09BKT076207; identical to SEQ ID NO: 6238

SEQ ID NO: 6653 - protein, 178 aa, Escherichia coli B26-1; identical to SEQ ID NO: 6238

SEQ ID NO: 6654 - protein, 178 aa, Escherichia coli B26-2; identical to SEQ ID NO: 6238

SEQ ID NO: 6655 - protein, 178 aa, Escherichia coli B28-2; identical to SEQ ID NO: 6238

SEQ ID NO: 6656 - protein, 178 aa, Escherichia coli B28-1; identical to SEQ ID NO: 6238

SEQ ID NO: 6657 - protein, 178 aa, Escherichia coli B29-1; identical to SEQ ID NO: 6238

SEQ ID NO: 6658 - protein, 178 aa, Escherichia coli B29-2; identical to SEQ ID NO: 6238

SEQ ID NO: 6659 - protein, 178 aa, Escherichia coli B36-1; identical to SEQ ID NO: 6238

SEQ ID NO: 6660 - protein, 178 aa, Escherichia coli B36-2; identical to SEQ ID NO: 6238

SEQ ID NO: 6661 - protein, 178 aa, Escherichia coli B7-1; identical to SEQ ID NO: 6238

SEQ ID NO: 6662 - protein, 178 aa, Escherichia coli B7-2; identical to SEQ ID NO: 6238

SEQ ID NO: 6663 - protein, 178 aa, Escherichia coli B93; identical to SEQ ID NO: 6238

SEQ ID NO: 6664 - protein, 178 aa, Escherichia coli B94; identical to SEQ ID NO: 6238

SEQ ID NO: 6665 - protein, 178 aa, Escherichia coli B95; identical to SEQ ID NO: 6238

SEQ ID NO: 6666 - protein, 179 aa, Escherichia coli TW07509; identical to SEQ ID NO: 6196

SEQ ID NO: 6667 - protein, 178 aa, Escherichia coli 08BKT055439; identical to SEQ ID NO: 6238

SEQ ID NO: 6668 - protein, 178 aa, Escherichia coli Bd5610_99; identical to SEQ ID NO: 6238

SEQ ID NO: 6669 - protein, 178 aa, Escherichia coli T1840_97; identical to SEQ ID NO: 6238

SEQ ID NO: 6670 - protein, 178 aa, Escherichia coli T234_00; identical to SEQ ID NO: 6238

SEQ ID NO: 6671 - protein, 178 aa, Escherichia coli 14A; identical to SEQ ID NO: 6238

SEQ ID NO: 6672 - protein, 178 aa, Escherichia coli T924_01; identical to SEQ ID NO: 6238

SEQ ID NO: 6673 - protein, 178 aa, Escherichia coli 2886-75; identical to SEQ ID NO: 6238

SEQ ID NO: 6674 - protein, 178 aa, Escherichia coli B103; identical to SEQ ID NO: 6238

SEQ ID NO: 6675 - protein, 178 aa, Escherichia coli B104; identical to SEQ ID NO: 6238

SEQ ID NO: 6676 - protein, 178 aa, Escherichia coli B105; identical to SEQ ID NO: 6238

SEQ ID NO: 6677 - protein, 178 aa, Escherichia coli B108; identical to SEQ ID NO: 6238

SEQ ID NO: 6678 - protein, 178 aa, Escherichia coli B106; identical to SEQ ID NO: 6238

SEQ ID NO: 6679 - protein, 178 aa, Escherichia coli B109; identical to SEQ ID NO: 6238

SEQ ID NO: 6680 - protein, 178 aa, Escherichia coli B112; identical to SEQ ID NO: 6238

SEQ ID NO: 6681 - protein, 178 aa, Escherichia coli B113; identical to SEQ ID NO: 6238

SEQ ID NO: 6682 - protein, 178 aa, Escherichia coli B114; identical to SEQ ID NO: 6238

SEQ ID NO: 6683 - protein, 178 aa, Escherichia coli B15; identical to SEQ ID NO: 6238

SEQ ID NO: 6684 - protein, 178 aa, Escherichia coli B17; identical to SEQ ID NO: 6238

SEQ ID NO: 6685 - protein, 178 aa, Escherichia coli B40-2; identical to SEQ ID NO: 6238

SEQ ID NO: 6686 - protein, 178 aa, Escherichia coli B40-1; identical to SEQ ID NO: 6238

SEQ ID NO: 6687 - protein, 178 aa, Escherichia coli B49-2; identical to SEQ ID NO: 6238

SEQ ID NO: 6688 - protein, 178 aa, Escherichia coli B5-2; identical to SEQ ID NO: 6238

SEQ ID NO: 6689 - protein, 178 aa, Escherichia coli B83; identical to SEQ ID NO: 6238

SEQ ID NO: 6690 - protein, 178 aa, Escherichia coli B84; identical to SEQ ID NO: 6238

SEQ ID NO: 6691 - protein, 178 aa, Escherichia coli B85; identical to SEQ ID NO: 6238

SEQ ID NO: 6692 - protein, 178 aa, Escherichia coli B86; identical to SEQ ID NO: 6238

SEQ ID NO: 6693 - protein, 178 aa, Escherichia coli 08BKT77219; identical to SEQ ID NO: 6238

SEQ ID NO: 6694 - protein, 178 aa, Escherichia coli 09BKT024447; identical to SEQ ID NO: 6238

SEQ ID NO: 6695 - protein, 178 aa, Escherichia coli T1282_01; identical to SEQ ID NO: 6238

SEQ ID NO: 6696 - protein, 178 aa, Escherichia coli B89; identical to SEQ ID NO: 6238

SEQ ID NO: 6697 - protein, 178 aa, Escherichia coli B90; identical to SEQ ID NO: 6238

SEQ ID NO: 6698 - protein, 178 aa, Escherichia coli Tx1686; identical to SEQ ID NO: 6238

SEQ ID NO: 6699 - protein, 178 aa, Escherichia coli Tx3800; identical to SEQ ID NO: 6238

SEQ ID NO: 6700 - protein, 213 aa, Actinomyces graevenitzii F0530
MTSNVAAAQTPPAPSSKGLSSSAAVRGRVNGLIVHRLSTSSPSARALRAQLRGALSKEVGTVPAIWDLTLDDRSGYLGDAPTRGEKATHAALTLWALHQGSNTRPMHDTSEQPRRFASAIRLIAESQRGDKRAEETPIYRRFAAAVQAPTFEGLLVHLRSLVSQLESAEIPCDYGQLAADLFTWQDPRYRTSVMRDWGRQFARVKQTTDTDNK

SEQ ID NO: 6701 - protein, 223 aa, Actinomyces johnsonii F0510
MSQRPHRPRLEENAGRLVDQRIGGTKRQEGLQARYRRNEARARGELAALRKGANRPPGELPEIWALTSVHVPDYAGDAPTWEETAVHTAMTLYAVHQQSRTEPMFVPGRGLGHAARSLIGPPDDENPSARARFNALVTSTTVTELRHHLRGFISLLRARSISLDHAMLADDILHFQQPGGARKVRLTWSREYQFLSAESLASSDDATPASATNSTTTAPTPEN

SEQ ID NO: 6702 - protein, 223 aa, Actinomyces johnsonii F0542; identical to SEQ ID NO: 6701

SEQ ID NO: 6703 - protein, 155 aa, Actinomyces sp. oral taxon 172 str. F0311
MPELWDLTLDGRPGYLGDEPTRGEKAVHGALTLWALHQGSNTRPMHDTSDRPRSFASAIRVVAEGQSGDKRAEETPIYRRFSAAVQAPTFEGLLVHLRSLVSQLEAAEIPCDYAQLAADLYTWQDPRHRTSVMRNWGRQFARPAETIQTDSASDE

SEQ ID NO: 6704 - protein, 176 aa, Actinomyces sp. oral taxon 877 str. F0543
MAARAQLRHGAGKEVGAVPSIWAYTLESQRPELSDQRPSWGENAVHTALTLWARHQGSNAAPMHMVDAKETPRSFGSAVRALAEKGRGDKRPEETPVYRRLSSVVAAQTFGALSHHLRGIVDLLEAAEIPMDYGLLAADLFEWQSPRRRSAVTRRWGRQFARAPIPTESAEDEASE

SEQ ID NO: 6705 - protein, 198 aa, Streptococcus sobrinus W1703
MSEQRKARVAEVTRKILIKLSKQKDTSSGKALLARLRQSIGKPVSETVAVWPILFEDLPEEFLGHDGYTSAEEQAILTTLQLYALHQQSLSHSVFIGEENKYQNIGNSFRQLRQGEDTTAIDRRFNVMITASTFEELVYHLRHLITLLKSKSPETKVDYARLSEDLYWFLRDYQERVRLSWARDYYKRNFKGEKDNDK

SEQ ID NO: 6706 - protein, 199 aa, Peptostreptococcaceae bacterium oral taxon 113 str. W5053
METKNKDSVFSVTKKIMVKLDALSEYSSGKAALAKIRNSVGKPVNEVTEVWQLLFENLPEEFLGSRGTPSDEELSILTAIQLYALHKQGTSSKGNVEESEGFKNLGYSLGKLRIADGQTSIDRRFNSMITSTTFDELIHHLRHLIKILKAKVPDVSVDYAKLAEDLFGYLKGYEAEIRLKWAREYYRQNNKGEDNYEQE

SEQ ID NO: 6707 - protein, 196 aa, Ruminococcus callidus ATCC 27760
MKGDEIMSKIDDVRNYTYRQIQFLIRQKETSVGKAMLANLRRGIGKTPGELPELWGAFLNEMPSELYGNSGMPSEGEWAVYIALTLFALHQQGNAEPVHCEKVSLGTAAARLMNEKTEEERGRILRRFGPVVTAKSMQELSHHLRGLIQLCKAKGVRLDYVQLAGDIYRFQFLESRKEVQLSWGQDFYYVEKGEKQ

SEQ ID NO: 6708 - protein, 199 aa, Peptoniphilus sp. BV3AC2
MQNPSKRQLVYSTTNKIIFSLEESKELSKTKATLSNLRNSVGRPSAENLEGIKLLYQFIPEEFYTKYSKLTYEENAILTTLQLYAIHQQSEVYSVNNTEKKDGWDNVGESIAEIRTEDNFLSLDRRFNAMITSQSFEELSNHLRQLIKILKGSKDIVKINYPKLSKDLYDFARGYDERVRLNWSRAYYSKNISKGEENE

SEQ ID NO: 6709 - protein, 178 aa, Escherichia coli 113303; identical to SEQ ID NO: 6162

SEQ ID NO: 6710 - protein, 178 aa, Escherichia coli 113290
MSIVKEEHKATLRKWHEELQAKRGNRASLRRSTTVNDVCLSEGFRSLLMQTHTLWKIEAQEWRFTALALVAAVSANVKAIDERQPFAAQLAAVMSEGRFTRLSAVKTPDDLLRQLRRAVKLLNGSVNLISLAEDIFRWCQESDDLLNHHRRQQRPTEFIRIRWALEYYQAGDADNEQN

SEQ ID NO: 6711 - protein, 178 aa, Escherichia coli 907357; identical to SEQ ID NO: 6162

SEQ ID NO: 6712 - protein, 178 aa, Escherichia coli 110957; identical to SEQ ID NO: 6160

SEQ ID NO: 6713 - protein, 160 aa, Escherichia coli 909945-2; identical to SEQ ID NO: 6470

SEQ ID NO: 6714 - protein, 178 aa, Escherichia coli 907713; identical to SEQ ID NO: 6160

SEQ ID NO: 6715 - protein, 178 aa, Escherichia coli 113302; identical to SEQ ID NO: 6162

SEQ ID NO: 6716 - protein, 178 aa, Escherichia coli 907672
MSIVKEEHKATLRKWHEELQEKRGNRASLRRSTTVNDVCLSEGFRSLLMQTHTLWKIESQEWRFTALALVAAVAANVKAIDERQPFAAQLAAVMSEGRFTRLSAIKTPDDLLRQLRRAVKLLNGSVNLISLADDIFRWCQESDDLLNHHRRQQRPTEFIRIRWALEYYQAGDADNEQN

SEQ ID NO: 6717 - protein, 178 aa, Escherichia coli 907710; identical to SEQ ID NO: 6162

SEQ ID NO: 6718 - protein, 178 aa, Escherichia coli 907715; identical to SEQ ID NO: 6160

SEQ ID NO: 6719 - protein, 178 aa, Escherichia coli 907889; identical to SEQ ID NO: 6160

SEQ ID NO: 6720 - protein, 178 aa, Escherichia coli 908521; identical to SEQ ID NO: 6160

SEQ ID NO: 6721 - protein, 178 aa, Escherichia coli 908522; identical to SEQ ID NO: 6160

SEQ ID NO: 6722 - protein, 178 aa, Escherichia coli 908525; identical to SEQ ID NO: 6716

SEQ ID NO: 6723 - protein, 178 aa, Escherichia coli 908541; identical to SEQ ID NO: 6229

SEQ ID NO: 6724 - protein, 178 aa, Escherichia coli 908573; identical to SEQ ID NO: 6161

SEQ ID NO: 6725 - protein, 178 aa, Escherichia coli 908585; identical to SEQ ID NO: 6160

SEQ ID NO: 6726 - protein, 178 aa, Escherichia coli 908616; identical to SEQ ID NO: 6160

SEQ ID NO: 6727 - protein, 178 aa, Escherichia coli 908658; identical to SEQ ID NO: 6160

SEQ ID NO: 6728 - protein, 210 aa, Cutibacterium acnes HL042PA3
MMPEPWNDVTKATLDVVNHLQRGYLMVPRDAWSVRTMAALRHADAAAPGTDPAVWEVTLGHLPDDLLGRNAAPATAAERAVHASVVLYAIHQQSRSEPMHMPGIGLGQAVHSLSTRRSSGSEWDPGTISRFQHLCRAQQWGIRIENLRGLIALMRSEGVPLDHGRLATDLWRIQTSASDHVLLDWGRQLHRIPPSNNPTPSTTTDQGEAR

SEQ ID NO: 6729 - protein, 197 aa, Lactobacillus fermentum NB-22
MANEIAKVTAQIIYSLYNNGNLDKAVLASLRHAVTIKDHRAENVWPIMFSKMAASNISSDPQGRETRQETAIYTALRCFAIYQQGLTQLSYASSNQVSAEDKGQQLFVALADLRKSQDKQAALDRRIQNLLSSTNIDSVAKSITQLVRILKSTDRNLLLDFSQLAQDLFFFQMGYEYSRKVFLKWGRQYYWQSVSTN

SEQ ID NO: 6730 - protein, 206 aa, Frankia sp. CcI6
MTEVTAAPSASSTSSETTSPRETTSPRHFWERDHKGDRPDGADLAVLRRGVGREPGSVPEMWRYYSTLTVDGRRTWSLTAEHVALTLFAVHQQSLPTAAYQPGIGLGEAALRLRSSDKFSPEAVDRRFNAVATATTLDEAAYHLRGLVRQFRQVPVGLDYTQLWRDLIAWQTPERIGDVRRRWGAQYFYRPPKDKAATPAAASGTS

SEQ ID NO: 6731 - protein, 186 aa, Salmonella enterica subsp. enterica serovar Cubana str. 76814
MSIVQEDHKATLRKWHEDLQEKRGARASLRRSKTVNEACLSEGFHLLLMQTHSLWKNKAAWHVTALAITAVLAAHIKFIDERQSFATQLGQKKSGDNPVMSKLRFSRLSAVKTPDELLRQLRRAVQLLDGSVNLISLADDIFRWCQEQDDLLSHHRRQQRPTEFLRIRWALEYYQAGDGDIDNEQD

SEQ ID NO: 6732 - protein, 216 aa, Propionimicrobium sp. BV2F7
METQEKDKSETRESLHTFSPSNHSNLRNFVSSKAQQLQANYLKQNPKAKAKLAALRKSINKPVGSDPETWQIVFEDFPENLIGKSDEPNRWELAAHTALALFSLHMQSAKSARHVSRVGLGQAIRKLIDAGSRDDQDSPVMRRFHALGTASTFAEIAYHARGLIQLMRAKDIPLDYGMLAQDFADLLVTSRQNSVRLRWARQLYKVNRPEEKQEKE

SEQ ID NO: 6733 - protein, 197 aa, Streptococcus thermophilus TH985
MSQHTKQTVWTVTKKIIFKLSNQKEETYDKATLAKVRKTLGKPLSEATEIWSILFENLPEEFLSSYQQPSYEELAIYTVLQLYALHQQGVSTSVMLDDSKPYENIGSALGKLRKEDDTTSIDRRFNTMITSSTFEELTYHLRHLISLLKVESPVIQVNYSGLANDLYWFLNNSQENVRLNWARAYYKQIKGEKNNDN

SEQ ID NO: 6734 - protein, 209 aa, Lactobacillus otakiensis DSM 19908 = JCM 15040
METIKSKKDKVAQITRSIIHELYANGNPNKRVLSGIRRAPVVTDPGAQDVWPMMFGKLDKGMLSRTGKPTIFETAIYTTVYLYAIHQQSQDQFVFGRAGNDDTADGVTFWAALSNFRRDENAQKALDRRVQAVLKSTNITSVINGITHLVAILKAGSTHQKIDYARLASELYVFQIGFKQAREVQLAWGQQYYRFIKPVTTPKGENDHG

SEQ ID NO: 6735 - protein, 160 aa, Escherichia coli str. K-12 substr. MG1655; identical to SEQ ID NO: 6112

SEQ ID NO: 6736 - protein, 147 aa, Geobacter sulfurreducens PCA; identical to SEQ ID NO: 6113

SEQ ID NO: 6737 - protein, 160 aa, Escherichia coli K-12; identical to SEQ ID NO: 6112

SEQ ID NO: 6738 - protein, 197 aa, Streptococcus oralis; identical to SEQ ID NO: 6216

SEQ ID NO: 6739 - protein, 197 aa, Streptococcus; identical to SEQ ID NO: 6192

SEQ ID NO: 6740 - protein, 197 aa, Streptococcus; identical to SEQ ID NO: 6210

SEQ ID NO: 6741 - protein, 209 aa, Cutibacterium acnes; identical to SEQ ID NO: 6151

SEQ ID NO: 6742 - protein, 208 aa, Propionibacterium namnetense; identical to SEQ ID NO: 6207

SEQ ID NO: 6743 - protein, 197 aa, Streptococcus salivarius
MSHQTKQTVWTVTNKIIFKLSNQKEETYDKATLAKIRKTLGKPLSEATEMWPILFKNLPEEFLSSYQQPSYEELAIYTALQLYALHQQGVSTSVMLDESKPYENIGSALGKLRKEDDTTAIDRRFNIMITSSTFEELSYHLRHLISLLKVGSPVIQVNYADLANDLYWFLNNGQENVRLNWARAYYKQIKGEKNNDN

SEQ ID NO: 6744 - protein, 198 aa, Streptococcus ratti
MPEESNGTVYSVTKKIVTKLTNQLDTSAGKAMLARLRHSAGKPISEAKEVWPILFENLPETFLSQYDDASYEETAILTAIQLYALYQQGRAQSVFDEVAEKHQNIGYSLKNLRREEDTIAVDRRFNTMITATTFDELTHHLRHLVTLLKAKSPETKIDFARLSADLYWFLRDYPETVRLNWARQYYKHSSKEEEENDN

SEQ ID NO: 6745 - protein, 202 aa, Lactobacillus delbrueckii; identical to SEQ ID NO: 6168

SEQ ID NO: 6746 - protein, 205 aa, Lactobacillus delbrueckii
MIVMAFEIEKATERIIRQLYNNGDTDKASLSALRSAATIDGYRAQKVWPVFLSNLDEQWLSKNGKATREEAAIFAAVRMYALHQQASDSCVFGRRNYSDKKGEETNSRELFEALNWLKQGTDSHEALDRRVQALLGTNNYNAVIDQLVHLMQIIKSKKTGIKIDYARLAGNLYKFQFGYRQANEVRLRWGEQYYRAFKKLDTNQQ

SEQ ID NO: 6747 - protein, 195 aa, Lactobacillus oris; identical to SEQ ID NO: 6185

SEQ ID NO: 6748 - protein, 195 aa, Desulfobacter postgatei; identical to SEQ ID NO: 6237

SEQ ID NO: 6749 - protein, 203 aa, Gardnerella vaginalis
MAENQSKSIKVSSAVSKIINQCLNGADIASRRAMLAQLRHTIGKPLSQSVEIWPWILSNVPESFINKYGEVSYQLRAVINTLQIYALYEQGVAEKSSYKDLNKSEDSVNEKSYNNMGTALRSLRSDEGVRGAMDRRFSVMITASDYESFYYYLRQLVRLLKSRTKENQQAIDYSKLAHDLYLLQFEDSEKVRLSWAQEYYRFS

SEQ ID NO: 6750 - protein, 206 aa, Gardnerella vaginalis
MAENQSKSVEVSNAVSKIINQFLNGSNIASRRAMLAQLRHTIGKPLSQSVEIWPWILSNVPESFINKYGEVSYQLRSVINTLQIYALYEQGVVEKSSYKYLNKSEDSENEKSYNNMGTALRALRSDEGVRGAMDRRFSVMITASDYESFYYYLRQLVRLLKSRTKENQQSIDYSKLARDLYLLQFEDSEKVRLSWAQEYYRLSKQK

SEQ ID NO: 6751 - protein, 204 aa, Gardnerella vaginalis
MAENQSKSVEVSSVVSKIINQFLNGSDIASRRTMLAQLRHTIGKPLSQSIEIWPWILNNVPESFIDKYGEVNYQLRAVINTLQIYALYEQGVAEKSSYKDLNKSEDSENEKSYNNMGTALRTLRSDEGVRGAMDRRFSVMITANDYESFYYYLRQLVRLLKSRTKENQQSIDYSKLARDLYLLQFEDSEKVRLSWAQEYYRLSK

SEQ ID NO: 6752 - protein, 204 aa, Gardnerella vaginalis
MAENQSKSVEVSNAVRKIINQFLNGSDIASRRAMLAQLRHTIGKPLSQSVEIWPWILSNVPESFINKYGEVSYQMQAVINTLQIYALYEQGSGEKSSYKDLNKSEDSENEKSYNNMGTALRALRSDEGVRGAMDRRFSVMITASDYESFYYYLRQLVRLLKSRTKENQQAIDYSKLARDLYLLQFEDSEKVRLSWAQEYYRLSK

SEQ ID NO: 6753 - protein, 203 aa, Gardnerella vaginalis
MAENQSKSVEVSSVINKIINQFLNGSDIASRRAMLAQLRHTIGKPLSQSVEIWSWILSNVPESFINKYGEVSYQMRAVINTLQIYALCEQGVVEKSSYKDLNKSEDSEKEKSYNNMGTALRALRSDEGVREATDRRFNVMVTTSDYESFYYYLRQLVRLLKSRTKENQQAIDYSKLARDLYLLQFEDSEKVRLSWAQEYYRFS

SEQ ID NO: 6754 - protein, 204 aa, Gardnerella vaginalis; identical to SEQ ID NO: 6630

SEQ ID NO: 6755 - protein, 204 aa, Gardnerella vaginalis
MAENQNKSVEVSNAVRKIINQFIEIADTSSYRAMLAQLRHTIGKPLSQSVEIWPWILNNVPESFMDKYGEVSYQLRAVINTLQIYALYEQGVAEKSSYKDLNKSEDSVNEKSYNNMGTALRTLRSDEGVRGAMDRRFSVMITASDYESFYYYLRQLVRLLKSRTKEDKQAIDYSKLARDLYLLQFEDSEKVRLSWAQEYYRFTK

SEQ ID NO: 6756 - protein, 204 aa, Gardnerella vaginalis; identical to SEQ ID NO: 6205

SEQ ID NO: 6757 - protein, 193 aa, Peptostreptococcus anaerobius; identical to SEQ ID NO: 6369

SEQ ID NO: 6758 - protein, 209 aa, Cutibacterium avidum
MPEPWNDVSAATLGAVNHLQRGYLATPRDPWAVRTLAALRHADATRPGTDPNLWEVTLGHLPDDLVGHGASPATYAERAVHAAVVLYAIHQQSRPGPMHATGIGLGQAARMLSARRSTSTEWDPGTVSRFQHLCRAQQWAIRLENLRELVTLMRSEDVPLDYGRLAADLWRLQTSASDRVLLSWGRQLHHLPSDAPTTTTESTDQGESR

SEQ ID NO: 6759 - protein, 203 aa, Anaerococcus lactolyticus; identical to SEQ ID NO: 6142

SEQ ID NO: 6760 - protein, 192 aa, Anaerococcus prevotii; identical to SEQ ID NO: 6197

SEQ ID NO: 6761 - protein, 152 aa, Methylomicrobium album; identical to SEQ ID NO: 6215

SEQ ID NO: 6762 - protein, 188 aa, Corynebacterium matruchotii; identical to SEQ ID NO: 6177

SEQ ID NO: 6763 - protein, 155 aa, Desulfuromonas acetoxidans
MTKENDFMELYQAWKSLPNGSKAELRRCTKPDDLLEVPAFYRLFGGRGEKEWQKKAYQRLIFCLPCIEHTEQKISLGAALAGGRKGERPAVSESRMIQVIRNQTPNDMIQLRRILKQVEPKVHWPLMAKQLWYWDYNERSKRDLLEDFFINQSDK

SEQ ID NO: 6764 - protein, 210 aa, Atopobium vaginae; identical to SEQ ID NO: 6199

SEQ ID NO: 6765 - protein, 195 aa, Lactobacillus iners; identical to SEQ ID NO: 6179

SEQ ID NO: 6766 - protein, 195 aa, Lactobacillus iners; identical to SEQ ID NO: 6183

SEQ ID NO: 6767 - protein, 195 aa, Lactobacillus iners; identical to SEQ ID NO: 6184

SEQ ID NO: 6768 - protein, 195 aa, Lactobacillus iners; identical to SEQ ID NO: 6202

SEQ ID NO: 6769 - protein, 195 aa, Lactobacillus antri; identical to SEQ ID NO: 6148

SEQ ID NO: 6770 - protein, 198 aa, Streptococcus ictaluri; identical to SEQ ID NO: 6209

SEQ ID NO: 6771 - protein, 200 aa, Lactobacillus equicursoris; identical to SEQ ID NO: 6133

SEQ ID NO: 6772 - protein, 197 aa, Streptococcus sp. C150; identical to SEQ ID NO: 6195

SEQ ID NO: 6773 - protein, 183 aa, Parasutterella excrementihominis; identical to SEQ ID NO: 6134

SEQ ID NO: 6774 - protein, 195 aa, Lactobacillus iners
MEGSNVYNVTAKILRKIDQTKDTSSTRALFANIRNSINKSSSNNLDALAFVFNNMPEEYIGFGKELNDYEQAILTAIQMYALHQQSNEKSVLKIEYNECEKRQNLGDALSTLRGSDNKSIDRRFNAMILSSNFVQLQNHLRQFIKLLKAKSDAKVDYAGVADDLFWFLKNQKDGVKIKWSRSYYKFRKVNDKGEN

SEQ ID NO: 6775 - protein, 179 aa, Peptoniphilus sp. oral taxon 836; identical to SEQ ID NO: 6169

SEQ ID NO: 6776 - protein, 195 aa, Megasphaera genomosp. type_1; identical to SEQ ID NO: 6154

SEQ ID NO: 6777 - protein, 200 aa, Oribacterium sp. oral taxon 108; identical to SEQ ID NO: 6206

SEQ ID NO: 6778 - protein, 200 aa, Oribacterium parvum; identical to SEQ ID NO: 6285

SEQ ID NO: 6779 - protein, 190 aa, Lactobacillus pasteurii; identical to SEQ ID NO: 6132

SEQ ID NO: 6780 - protein, 147 aa, Methylophaga lonarensis; identical to SEQ ID NO: 6426

SEQ ID NO: 6781 - protein, 204 aa, Gardnerella vaginalis; identical to SEQ ID NO: 6118

SEQ ID NO: 6782 - protein, 204 aa, Fannyhessea vaginae
MNEATTGYSEVSNAVQKIVRQYLSNVDAASRRAILAKLRHSIGKPLSQSVDIWPLILTSVPDDFLSEYEGKNLKMQAVIYTLQIYALYEQGNMSAEDISTDNTVTDENALAQSFSYNMGSCLRILRLDEKQRDAMDRRFSNLITSDNIDHFYYNLRQLTGILKSKTKDSHQHINYPRLARDLYLFNFIPEKIRLSWAQEYYRFN

SEQ ID NO: 6783 - protein, 147 aa, Geobacter sulfurreducens; identical to SEQ ID NO: 6113

SEQ ID NO: 6784 - protein, 202 aa, Lactobacillus delbrueckii
MAFEIEKATERIIRQLYNNGDTDKASLSALRSAATIDGYRAQKVWPVFLSNLDEQWLSKNGKATREEAAIFAAVRMYALHQQASDSCVFGRRNYSDKKDEETNSRELFEALNCLKQGTDSHEALDRRVQALLGTNNYNAVIDQLVHLMQIIKSKKTGIKIDYARLAGDLYKFQFGYRQANEVRLRWGEQYYRAFKKLDTNQQ

SEQ ID NO: 6785 - protein, 205 aa, Lactobacillus delbrueckii
MIVMAFEIEKATERIIRQLYNNGDTDKASLSALRSAATIDGYRAQKVWPVFLSNLDEQWLSKNGKATREEAAIFVAVRMYARHQQASDSCVFGRRNYSDKKDEETNSRELFEALNWLKQGIDSHEALDRRVQALLGTNNYNAVIDQLVHLMQIIKSKKTGIKIDYARLAGDLYKFQFGYRQANEVRLRWGEQYYRAFKKLDTNQQ

SEQ ID NO: 6786 - protein, 204 aa, Gardnerella vaginalis; identical to SEQ ID NO: 6116

SEQ ID NO: 6787 - protein, 183 aa, Streptococcus mutans
MKLSNQIDTSPGKAVLAKIRHSIGKPINKATEIWSLLFENLPEEFLGKSGRASYEETVILITVQLYALYQQGLSHSVLVEDVEKYHNIGSSLRQLRKGDDTTAIDRRFNVMITSSTFEELTHHLRHLVKLLKSRSPETKIDFAKLSQNLYWFLRDSQETVRLDWAREYYKQDNKGEKDNDNIQ

SEQ ID NO: 6788 - protein, 205 aa, Lactobacillus delbrueckii
MIVMAFEIEKATERIIRQLYNNGDTDKASLSALRSAATIDGYRAQKVWPVFLSNLDEQWLSKNGKATREEAAIFAAVRMYALHQQASDSCVFGRRNYSDKKDEETNSRELFEALNWLKQGTDSHEALDRRVQALLGTNNYNAVIDQLVHLMQIIKSKKTGIQIDYARLAGDLYKFQFGYRQANEVRLRWGEQYYHAFKKSDTNQQ

SEQ ID NO: 6789 - protein, 197 aa, Streptococcus
MSQHTKQTVWTVTKKIIFKLSNQKEETYDKATLAKVRKTLGKPLSEATEMWPILFENLPEEFLSSYQQPSYEELAIYTALQLYALHQQGVSTSVMLDDSKPYENIGFALGKLRKEDNTTSIDRRFNTMITSSTFEELTYHLRHLISLLKVESPVIQVNYSALANDLYWFLNNSQENVRLNWARAYYKQIKGEKNNDN

SEQ ID NO: 6790 - protein, 198 aa, Streptococcus mutans
MSEESYVRMYFVTKQILIKLNKQQNTSAGKAMLARLRHSVGKPISEAKEVWPILFENVPENFLSQYDNASYEEIAILTAIQLYALYQQGMSHNVFDDSAKKFQNIGYSLKCIRTRVDTVAVDRRFNTMITATTFEELVHHLRQLITLLKSKTPETKIDFARLATDLYCFLRDYQETVRLKWARQYYKHSSEEEAENDN

SEQ ID NO: 6791 - protein, 204 aa, Gardnerella vaginalis; identical to SEQ ID NO: 6628

SEQ ID NO: 6792 - protein, 204 aa, Gardnerella vaginalis; identical to SEQ ID NO: 6634

SEQ ID NO: 6793 - protein, 198 aa, Streptococcus sobrinus
MPEQKKAKVASTTSKILIKLSKQKDMSSGKAMLARLRQSIGKPISETMAVWPVLFEDLPEEFLGRSGHTSNEERAILTTLQLYALHQQSLSHSVVAGEDNKYQNIGYSFRQLRQGEDTTAIDRRFNVMITASTFEELIYHLRHLTTLLKSKSPETKVDYAKLSEDLYWFLRDYQERVRLSWAREYYKRNFKGEKDNDN

SEQ ID NO: 6794 - protein, 209 aa, Lactobacillus otakiensis; identical to SEQ ID NO: 6734

SEQ ID NO: 6795 - protein, 152 aa, Methylomonas sp. MK1
MSEGQNQGPDFIGLYERYQKLKPGPQAELKRVVQPDDLLEIPAFYRLLIDANVSKGIQRLVYCLPLIKHAEGGDSLGRTLAKADVNEKRLFMVIRSQEPNDLIQLRRLLKQIEPKMDWLSAARIVYYWNDRAKRQLLEDFFFYQNTKTKESA

SEQ ID NO: 6796 - protein, 152 aa, Methylosarcina fibrata
MSEERNQGPDFVSLYERYQKLKPGSQAELKRVAQPDDLLEIPAFYRLLLDAKASKGMQRLVYCLPLIKHLDSGDSLGKSLAKADINEKRLFMVIRSQEPNDLIQLRRLLKQVEPKLDWLAAAKTLYYWNDRAKRQLLEDFFFYQNTKTKESA

SEQ ID NO: 6797 - protein, 203 aa, Gardnerella vaginalis; identical to SEQ ID NO: 6631

SEQ ID NO: 6798 - protein, 212 aa, Gardnerella vaginalis; identical to SEQ ID NO: 6633

SEQ ID NO: 6799 - protein, 206 aa, Gardnerella vaginalis; identical to SEQ ID NO: 6635

SEQ ID NO: 6800 - protein, 213 aa, Actinomyces graevenitzii; identical to SEQ ID NO: 6700

SEQ ID NO: 6801 - protein, 223 aa, Actinomyces johnsonii; identical to SEQ ID NO: 6701

SEQ ID NO: 6802 - protein, 155 aa, Actinomyces sp. oral taxon 172; identical to SEQ ID NO: 6703

SEQ ID NO: 6803 - protein, 176 aa, Actinomyces sp. oral taxon 877; identical to SEQ ID NO: 6704

SEQ ID NO: 6804 - protein, 198 aa, Streptococcus sobrinus; identical to SEQ ID NO: 6705

SEQ ID NO: 6805 - protein, 199 aa, Peptostreptococcaceae bacterium oral taxon 113; identical to SEQ ID NO: 6706

SEQ ID NO: 6806 - protein, 196 aa, Ruminococcus callidus; identical to SEQ ID NO: 6707

SEQ ID NO: 6807 - protein, 210 aa, Cutibacterium acnes; identical to SEQ ID NO: 6728

SEQ ID NO: 6808 - protein, 197 aa, Limosilactobacillus fermentum; identical to SEQ ID NO: 6729

SEQ ID NO: 6809 - protein, 225 aa, Shigella flexneri
MSGSAFAVTHHAFSSGAGRTSDGNGSHASTLKSPSYTKSVSWQHYPTVNDVCLTDGFRLFLKNRQIKWQDEPEWRITALALIAAVSANVKAIDERQPFAAQLAAVMKKGRFTRLLAVKTPDDLLRQLRRAVKLLNGSVNLDSLAEGGFRWCQESDDLLNHHRRQQRPTEFIRIRWALGAGRWALGAGRWNITRLATPITNKINKGLSHDNIYSASFVNRLPCCQS

SEQ ID NO: 6810 - protein, 204 aa, Gardnerella vaginalis 409-05; identical to SEQ ID NO: 6116

SEQ ID NO: 6811 - protein, 160 aa, Oceanithermus profundus DSM 14977; identical to SEQ ID NO: 6119

SEQ ID NO: 6812 - protein, 228 aa, Deinococcus proteolyticus MRP; identical to SEQ ID NO: 6120

SEQ ID NO: 6813 - protein, 168 aa, Marinithermus hydrothermalis DSM 14884; identical to SEQ ID NO: 6122

SEQ ID NO: 6814 - protein, 219 aa, Coriobacterium glomerans PW2; identical to SEQ ID NO: 6121

SEQ ID NO: 6815 - protein, 175 aa, Sphaerochaeta coccoides DSM 17374; identical to SEQ ID NO: 6124

SEQ ID NO: 6816 - protein, 170 aa, Thermus thermophilus JL-18; identical to SEQ ID NO: 6125

SEQ ID NO: 6817 - protein, 191 aa, Thiocystis violascens DSM 198; identical to SEQ ID NO: 6126

SEQ ID NO: 6818 - protein, 200 aa, Desulfomonile tiedjei DSM 6799; identical to SEQ ID NO: 6127

SEQ ID NO: 6819 - protein, 181 aa, Pelobacter carbinolicus DSM 2380; identical to SEQ ID NO: 6114

SEQ ID NO: 6820 - protein, 200 aa, Lactobacillus buchneri CD034; identical to SEQ ID NO: 6128

SEQ ID NO: 6821 - protein, 147 aa, Geobacter sulfurreducens KN400; identical to SEQ ID NO: 6113

SEQ ID NO: 6822 - protein, 166 aa, Thermus oshimai JL-2; identical to SEQ ID NO: 6129

SEQ ID NO: 6823 - protein, 216 aa, Mycobacterium smegmatis JS623; identical to SEQ ID NO: 6130

SEQ ID NO: 6824 - protein, 363 aa, Escherichia coli str. K-12 substr. MG1655
MSNFINIHVLISHSPSCLNRDDMNMQKDAIFGGKRRVRISSQSLKRAMRKSGYYAQNIGESSLRTIHLAQLRDVLRQKLGERFDQKIIDKTLALLSGKSVDEAEKISADAVTPWVVGEIAWFCEQVAKAEADNLDDKKLLKVLKEDIAAIRVNLQQGVDIALSGRMATSGMMTELGKVDGAMSIAHAITTHQVDSDIDWFTAVDDLQEQGSAHLGTQEFSSGVFYRYANINLAQLQENLGGASREQALEIATHVVHMLATEVPGAKQRTYAAFNPADMVMVNFSDMPLSMANAFEKAVKAKDGFLQPSIQAFNQYWDRVANGYGLNGAAAQFSLSDVDPITAQVKQMPTLEQLKSWVRNNGEA

SEQ ID NO: 6825 - protein, 383 aa, Desulfatibacillum aliphaticivorans
MEKNPYQNLRVEFHILQSFPVTCLNRDDVGAPKTAVVGGATRARVSSQCWKRNIRLTMKDLGVPIGSRTKLIHQMIEDACAELGADTDQAQACAAQVASVFIKEKKGKKDDGDDSEGNGSDKSDALIFLSREEVKKIALALRENNFSTEFQEEKVNKKGDAKVEKIKLEKKIQNLLGKPDFSRDGVDIALFGRMVAQAAALNVEGAASFSHAISTHKVTNEVEFFTALDDLQTEPGSAHMGALEFNSATYYRYVCLDMGQLWKNLAGQHLPQALEGFVKALYLALPSARQATQSGACWWEFAKVFVRKGQRLQAPFDTAVKPRNGGLLEPSKDALCAYLEKKEQQAGSLFRKIAEFTFGEDNGPSIDDLVLSIQDAIQEVGHE

SEQ ID NO: 6826 - protein, 362 aa, Gardnerella vaginalis 409-05
MNSRLFLDIQAIQSVPPCNINRDDAGSPKTAQYGGVTRARVSSQCWKHSMREYFKEHSGDSNVGMRSKNIVKYVADKIITLKPELSEQEALDLANKTLNNAGFKTKTDKGKIIPVVNVLFFLGENQANSLAQAAINNVTDKKQLEEILKDNPPIDIALFGRMLADNPSLNEDASSQVAHAISTHAVRAEFDYYTAVDDLSVDDNAGAGMLGTIEYNSSTLYRYANVAIHEFSHQLSDNKESTINALKLFIEAFANAMPTGKVNTFANQTLPQMLVVTLREDRPVNLVSAFEDPVKAKDGYVSKSIEKLSQEYEKVQKFVHKPLASFYVTMDSSNKEIKLGVEEQSMQQLLDDFSSKVSELLQ

SEQ ID NO: 6827 - protein, 362 aa, Gardnerella vaginalis ATCC 14019
MNAHLFLDIQAIQTVPPCNINRDDAGSPKTAQYGGVTRTRISSQCWKHSMREYFKEHSGDSNVGIRSKNIVKYVADKIITLKPELSEQEALDLADKTLNTAGVKTKTDKGETVPTAKALFFLGETQANSLAQAAINNVTDKKQLQEILRDNPPIDIALFGRMLADDPSLNEDASSQVAHAISTHAVRTEFDYYTAVDDLSADDNAGAGMLGTIEYNSSTLYRYANVAVHEFSHQLSDNKESTINALRLFIEAFANAMPTGKVNTFANQTLPQMLVVTLRDDRPVNLVSAFEDPVKSKDGYVSKSIEKLSQEYEKVQKFVHKPLASFYVTMDSSNEEIKLGVEEQSMQQLLDDFSSKVSEFLQ

SEQ ID NO: 6828 - protein, 381 aa, Oceanithermus profundus DSM 14977
MNVLEIHLIQTVPAANLNRDDAGFPKQVTFGGVPRIRLSSQSQKYAMRRRFREQFDRSKLGVRTRQLARALTEHLPDVELGVLEEALELVGFKLKKGVLDTLIFLSWGQVEELAELLRANWGTIEQTIMANREAQVKAEEGGKKAPAKKSLPKGLVDEVQRLLLKAKAGDIALFGRMMASLPEGNVNAAAHVAHAFSTHAAYPESDYFITSDDLAADGEATAGMIGERSYSAATLYRYAAVDYTELVRGLEGDQALAAEFLKAFVEAFVKELPGGMQSSHAAYTLPEAVLLVAHAGEPRSLAGAFDRPVTAGEGGYTLPSIRALLRRWQDLETMYGSRPASTARWVALPSLDVRLPDDAGIVASRSIEDAMQDVVNAVTRR

SEQ ID NO: 6829 - protein, 377 aa, Coriobacterium glomerans PW2
MFVDICVIQNVPSNNINRDDTGSPKTALYGGARRARVSSQAWKRAMRKMFPAYLPKGSLGVRTKYAVRLIKDRIVAACPDLESEGQELAEAALKALGLKLKKSRRAGSDSGEQETGYLLFLAPPEIDGLAQLMIDWHNTKRNINKLTKSMKKEAAAVFQDLRAIDIALFGRMLTEASKLNTDASAQVAHAISVDRVVQEYDYFAAVDDCASADNTGASMLETAGYNSSTLYRYATVNLDSLFEQLQDIEGTAKGTAVFVETFVRSMPTGKQNTFANRTLPSTVSVAFRSRQPINPVSAFEIPVSAKEDRSISQQAAELLEKRVAEIEGLFDEPADRAWCATIDLPATPNGALGERIDFKTLLGEVQREAERVLRTRS

SEQ ID NO: 6830 - protein, 357 aa, Sphaerochaeta coccoides DSM 17374
MNNTIFAGKKIEFHIIQSFPVTTLNRDDVGAPKTALVGGVTRARVSSQAWKRQVRLHLHDFGIKLAVRTKYISQKIQEACQSLGASEDHAHSVGEAIAEVLAKDTLYFFSDSEALELARYAQSLDFDPKKIIGENKKDLKKIFDAQKSGLIKGFKSQEVDGLDIALFGRMVALAPDLNVEAATSFAHAISTHKVANELDFFTAIDDLGSDTPASSHMGTLEFNSATYYRYVSLDLGQLEQNLGDTKHIPIAVSTFIKALYVAVPFARQSTLSGSSPWDYARVLVRNGQRIQAPFDKPVKPTEEGFSLPSINRLNEFLDRQEKLAGSLFGLQKAFRYGEDENYSIDDLITDLVTEISK

SEQ ID NO: 6831 - protein, 304 aa, Streptococcus salivarius 57.I
MREYFNTHGDQSNVGIRTKEIVRYVADKIVELDSSISIEDALEKADKVLIAAGIKKKGEVKALYFMGDSQAKKLAQAAYDNITDKKELQKLANADPAIDIALFGRMVAEDPTLNEDSSSQVAHAISTHPVQTEFDFFTAVDDLAPKDNAGAGMLGTVEFNSSTLYRYANVAIHELSKQLGNKESLDNSLSLFIEAFAKSLPTGKVNTFANQTLPQTLIVTVRSDRPVNLVSAFEEPVKSIEGYVTRSIDKLAKEFIKVEKFVDKPLMTFYVTLHESDSLKQIGEEKDSVSKLLEDFSEMIAQYI

SEQ ID NO: 6832 - protein, 427 aa, Thiocystis violascens DSM 198
MTTQPRFIQIHTLHTYPAALINRDDAGLAKRLPFGNAVRTRISSQCLKRHWRKTDDPFSLSMLHVPMAVRSRLFFEKIAEILVSASVSDQIANAIAFGLREAMTKKDLGKLIKEAKKPPKKNKKAQINEEDFEEPTEETSTERKQAFLLGYPEYEYLKKVCLEVSQLPDICEKNARLYLFEKIKAEQENLKQIALGCGLESALFGRMVTSDVLAGREAAIYVGHAFTVHAAQVESDYFTVVDDLTGDSGELGSAGIFDTELTSGLYYGYVVVDVRQLVENLEGIEAKDCFADTTPAEKRKLAGTVVEHLLHLIATVSPGAKRGSTAPFDWAKFMLVEAGDWQPRSLAGAFHNALPLSLPLSARDGRSIRERAVACLSDEIAKMDEAYGATLTRRVMALDPVEIPQGQRLNLNALATWAAEAITKGVC

SEQ ID NO: 6833 - protein, 359 aa, Lactobacillus buchneri subsp. silagei CD034
MTNQNLYVDINVLQTVPSSNINRDDTGAPKTAIYGGVSRARVSSQSWKHAIRESFKANDITTGIRTKEAVQLLADKLNEIDTSLDEDAALVKAADIFKAAGIKVSKDNETGALLLISPGQIEKLAQYATDHDELDKKEVKTLLKSDNSLDLALFGRMVADNPELNVEGSAQVAHAISTHEVVPEFDYYTALDDLQSDDTSGAAMLGTIEYNSSTLYRYANLNVNELAHNLGESSAVQGAADFIKSFLLSMPTGKQNTFANKTLPNYVMITVRTDTPVNLVTAFEDAVASKHGYVAESVKKLEDEYQSTLRFVDQPVSTIVLSDSKYHSKLDDQAANLSELLKRVTEVLTKAVQDEDTTN

SEQ ID NO: 6834 - protein, 376 aa, Mycobacterium sp. JS623
MFVDTHILQSVPPSNINRDDTGSPKTAIFGGAQRARVSSQAWKRATRSRFNATLDKSNIGCRTKRVVEKLSEQIHQLDGGLSTEDARRLASQTLTAAGITLTTPKPPKDAPKGFQPIELTSSLLFVSAGQYAKLAELAVAAHQASAKVARKVAKQAINSEHSFDVALFGRMVADDLNLNVDAAAQVAHAISVQAVEPEFDYFAAVDDMQERDQQAGAGMIGTIEFNSSTLYRYATVNVPGLRQNLGDSTAAARAVAAFVDSFILSMPTGKLSTFANRTVPEAILVSVRSDQPINLVGAFENPIQPRADGSVVAKAAAALADRHRAVADVYGPPVKTWVASLGDAAAPLEAVGDRVDMRTLTQQLEQSILEYLGAPA

SEQ ID NO: 6835 - protein, 363 aa, synthetic Escherichia coli C321.deltaA; identical to SEQ ID NO: 6824

SEQ ID NO: 6836 - protein, 358 aa, Lactobacillus equicursoris DSM 19284 = JCM 14600 = CIP 110162
MSKNLYLDINVLQTVPSSNINRDDTGAPKTAFYGGVMRARVSSQSWKRATRKAFAEDGAEIGTRTLKVPQLLAEKLMELDSSLSQEEADKMAAAALGTAGIKVKKDNVTGALLMVSKGQIEGLAKYVLAGEELDKKEAKKNLLQGNSLDLALFGRMVADNPELNVDASAQVAHAISTHEIIPEYDYFTALDDLQGKEQSGAALIQTTQYDSATLYRYANVNMGELAHNLDGKDAVEGAVTFVKDFALSMPTGKQNSFANKTVPSYLMVTVRDDTPVNLVSAFEQPATARDGKGYLENSVNKLEAEFVDTQAFVDAPLATLVAGKFDTKIGEKEDNLNDLLDKLRDVLKKAVEDEDLNN

SEQ ID NO: 6837 - protein, 352 aa, Faecalibacterium prausnitzii M21/2
MKKRLYVDFHILQTVPPSCINRDDTGSPKTAVYGGVTRARVSSQAWKHAMRAAFAENAQLDVGKRTKKAAELVKAQILALAPELDADKLAKKALENAGIKSDDKGTKALFFMSTAQAKALAELAVEGSADKKQYRDALKAAPSMDMALFGRMVADDPSLNYDAAAQVAHSISTHAVQNEYDYFTAVDDCQAEDNAGAGHLGTVEYNSSTLYRYATVNVMELAGQLGAAQAAETVRAFGEAFLFSMPTGKQNTFANRTLPDAVYVTLREDQPVNLCGAFERAVPRSAQGYAAPSKAALAQYAQQMYSSFAEAPAQSFTVGSGLEVLAPAQTAKAMLDALEKAVRDALAGNEVG

SEQ ID NO: 6838 - protein, 371 aa, Bifidobacterium catenulatum DSM 16992 = JCM 1194 = LMG 11043
MFVDIHCLQQVPPSNINRDDTGSPKTAYVGGALRARVSSQSWKRAMREMFSSKLDSSKLGKRTKSAVALISSVIAEKRPDLVEESKSLAEKVLAATGVKVKASDRAGADKGSSATEYLIFIANREVEQLADIAITAFDEGKDPSKMKKEVAAVFHGEQAIDIACFGRMLADAPDLNTDASAQVAHAFSIDQITPEYDYFTAVDDCASDDNAGAAMIDTIGFNSSTLYRYATVNVDALKDQLQDANAAVEGVAAFVDAFIKSMPSGKQNTFANHTLPEDIVIVLRDSQPISAADAFEDPIKRKDGISVSRQGIERLGDRLNEIRINYGEEPVKAWHVVSGGSVHSLDEWSEQVTLPELEQGLRETLSAAYSA

SEQ ID NO: 6839 - protein, 341 aa, Desulfovibrio piger ATCC 29098
MRHLELHILQSVPVACLNRDDFGSPKTALFGNVQRARVSSQCWKRAVRELMQEEVPALFGGQRTRLILDPLCRILHEQHGLAEEEARKKAEELGAAVSKLDTPPVRVKTLFFTSPLELEALAAAYVATGNAKKAVKELAKHPLKDAADIALFGRMVASDHSLTLEGAAMFSHALSTHKVSNEIDFFAAVDDLQPEDEAGAGMTGTLEFNSATYYRFAALNLDLLEQHLSALSAEERREVVCNFVTATLRAVPGARKNSMNAATLPSHVLAVVREKGHPVQLVNAFEKPVWTRGGLMEESVSQLEREYTHLKETWGLEATLECRMPELSLSVLLQEVEQHVR

SEQ ID NO: 6840 - protein, 380 aa, Corynebacterium accolens ATCC 49725
MALTIDIHALQTLPPSLINRDDTGAPKSAVYGGVPRQRVSSQAWKRAIRKYFESEIDPESVGDRSKRLPEKIARKVQEHEGWDAERAQKEVAELFKAAGIKTEVDAKRIKALKDSEETTEEELAAAQYPQTKYLLFLSPHQIERAAEAIIAADGEKIKKKDALEILDTQHSVDMALFGRMVADDAAYNVDAAVQVAHALGIHASAPEFDYFTAVDDLAEEGEETGAGMIGTVQMMSSTLYRYATVNLDGLTQNLDSAENAKQAAVNFVDAFIKSMPTGKINTFANQTMPELIYIAVRDTRPVSLVTAFEEPVEPTAGQSLRVAGAEALAKEETEFEENYGLQPKAAFVVGLSEARQAFAQIADEVTLPELSQRLSSALSE

SEQ ID NO: 6841 - protein, 377 aa, Corynebacterium glucuronolyticum ATCC 51867
MSITVDISALHTLPPSLINRDDTGAPKSAIFGGVPRQRVSSQAWKRAIRKYVAENLDPDSIGTRTRLVVDVILKEISSITGQDTDAEDVKVVEALFKAAKISLKDAPAKADEDDDAPTKNKTAGYLLFLSSHQIHNVAQAVVKSRETGEKIPAKIAKQLLNSEHSADVSMFGRMVADDSSYNVDAAVQVAHALGVHESSPEFDYFTAVDDYVESSDETGAGMIGTVQMMSSTLYRYATIDMDSLAENLGNKDAAKTCALYFVEAFIKSMPTGKINTFANQTLPELVYIAIRDTRPVSLVNAFETPVTATADHGRREAAAEAMSEQEREIEEQYGFKPKAAFVIGLGDLRKAFAELATETTLPELTTVLGEALDEASN

SEQ ID NO: 6842 - protein, 356 aa, Corynebacterium glucuronolyticum ATCC 51866
MSNQLTLHFLCSIPYSNLNRDDTGVPKRVMQGGALRALHSSQSIKRGSRVLYENASQDLSIRSGRLDEEVAEKAMEMNPDLDEKTALKQAAKLIGNLTKGEAKSGEGDAKRSTWLSSEEILTAATYVANSTDPREKFIDGNTTGSLAIAAFGRMFANATDLNTEAAVAVSPAITTHQATIETDYFSTADDINLRDHKANATYLDVSLYTSGTFYRTVTIDRNQLRTSWSGFESNSVRENLEAFVRSLVYGQPRGKKNSTAPFTMPSLILAEEQQYRVAYDFERPVEADKDGGGFMKSSIEKLAKQYTLARSFDPGNFGPVEALSGTYPDLDGHFGDLKKASLDSLIGDVVDWILDA

SEQ ID NO: 6843 - protein, 381 aa, Corynebacterium striatum ATCC 6940
MSLTVDVHVLQTIPPSLINRDDMGAPKSARYGGVQRQRVSSQAWKRAVRQDFAKRFPAEVMGKRTRLVGELICKRIFEITEEAGEKWETQRAIDGVKNLFTGAKLKLKDAKSKNDETEEDAKIAYPELGYLLFLGNHQIDRAARAIIDKDGEKFKKNEAQAILDTEHSIDIAMFGRMVADDAAFNVDASVQVAHALGIHETEPEFDYFTAVDDATADNEETGAGMIGTVQMMSSTLYRFASVDFESLASNLNDVKTAVDSAAAFVDSFVKSLPTGKQNTFAHNTLPEFVYVTISDDRSVSLVNAFEEPVEAGAAGRSKLGAEKLAQEAIETQRMYGLKPTAQFVAGIRGLDGYFTEFADSVTIPELEERVADVLNSLISEK

SEQ ID NO: 6844 - protein, 359 aa, Anaerococcus lactolyticus ATCC 51172
MQNKINNRLFLDIHAIQTVPPANINRDDTGSPKTAQYGGVTRARVSSQSWKRAIRKYFNENGDVENVGIRSLEIVRYVANKIVQKDGSISIEEAMEMADKTINNAKISTKDQKAKALFFMSDKQAEELAQASIDKVNDKKILQEILKNDTSIDVALFGRMVADDASLNEDASSQVAHAISTHAIQSEFDFFTAVDDLAPEDNAGAGMLGTVEYNSSTLYRYANIALHDFYRQLADKEETIKATKLFVKSFVESMPTGKINTFANQTLPQAIVVSLRSDRPLNMVSAFEEPIKSDNGYVDKSIEKLFSEYTKYDKILDKPIFTAYLILGNTEVNEIGKSEASLNDLLEDLGKEIEKNIEA

SEQ ID NO: 6845 - protein, 352 aa, Mobiluncus mulieris ATCC 35243
MSNILTIHILNSIPWSNLNRDDTGTPKRLIQGGVLRGQLSSQSIKRAARSAYENVSQDISVRSGNLAEMVTERALELNPKGNKKDFLKSAKKAIGALTKNDDSSKKRDSARSTWLSGEELEACAKAIAQGKNPEFMEAGKTGSLAIAAFGRMFASAPGMNTESAIAVSPAVSTHQAIIETDYYNTTDDAPLQHQGAGATFLGMALYTSGCFYRTVTIDKAQLRKSWTGFDSESAHENLAAMVDALIYALPRGKKNSTAPYVMPALLLAEEQAHRIAYDFEKPIQASNEGGFIGATVDELLKQYQSARRFDPDNFAGVNAISGTCEEKDIAGFNLKYSNKSDFINKIVDWIQA

SEQ ID NO: 6846 - protein, 387 aa, Bifidobacterium angulatum DSM 20098 = JCM 7096
MFMDIHCIQQVPPSNINRDDTGSPKTAYVGGALRSRVSSQAWKRAMRGVFDDMLDSDKLGKRTKGVVALIASSITAKRPDLAESAEELGQRVLALEGIGVKASNRAGSDKGTLVTDYLIFIANNEIDKLADWAIAASDKGRDFSKVGKKGLSKAEKTDLAKMKNEVSEIFHGPQAIDIALFGRMLANAPDLNTDASAQVAHAFSIDQITPEYDYFTAVDDCASEDNAGAAMLDTVGFNSSTLYRYAAVNIDALKEQLQDASAAVEGAVAFVEAFIKSMPSGKQNTFANHTLPEDVVVVLRDSQPISAADAFEEPVRRKEGVSVSRQGIERLGKRLNEIRVNYSEEPVKAWYIASGGEVDSLKEWSEQVSLPDLEHGLRETLNAVYSA

SEQ ID NO: 6847 - protein, 311 aa, Lactobacillus antri DSM 16041
MMFKEQSTDAEWLAGIRTMRGPLLLANELQKQDSNLSSDEAMAQAVDVFNKAKIKLDKKTNQTKALLMLSHGQIAKLAEYVRQNDELDSKAVKEALQGDHSLDMALFGRMVADDPSLNVDAACQVAHAISTHEIVPEYDYYTAVDDEKADDESGSAMIGTIEYDSATLYRYANVNVNELVQSLGDVDTAVKGLQLFVKDFVLSMPTGKQNSFANKTVPQYVLVTVREDTPVNLVSAFEEAVKSRHGYLQPSVAKLEKEYQDTQQFVQTPLASVVVTNKESKISTKAADVDDLVSKITEVIESRVSDENLND

SEQ ID NO: 6848 - protein, 358 aa, Lactobacillus helveticus DSM 20075 = CGMCC 1.1877
QTVPSSNINRDDTGSPKTAIYGGVTRSRVSSQSWKRAIRLGFQEDSRDAKWLKGFRTLKGVQLLIKKIQELDNTISDDDALEKAKAVFAAAGIKLKKDKDTGKYLTGALFLISNGQLEKIAKIALDSDGIDKETGKEIKKALMEEQSLDLALFGRMVADNPDLNVDASSQVAHAISTHEITPEFDFYTAVDDVKKEGSSGSAMLGTIEYNSSTLYRYANVNVLDLMHNLGNEDLTLEGIKLFIKEFIMTMPTGKENTFANKTLPQYVMVNVRDDTPVNLVSAFETPVESKGGYVQKSINRLKDEYNRTLKYVDKPAFDIELADSDKKIVDKQAKSVTDLIDQTAEFIKQELNNEDSND

SEQ ID NO: 6849 - protein, 400 aa, Jonquetella anthropi E3_33 E1
MNNFPRFVQISTLTTYSASLLNRDDSGLAKRIPFGDSVRTRISSQCLKRHWRNAGGPYGLDKAGDALSLSVRSRFSFPELIEKPLVAEGLEQKLVVSGSQKLQQLLYNGEEKGDTKKDKKKKIELDEDGYSAKRNELVVLGRPELEYLKQIIRDAISSSSNIKEIDNAVKDFYTKRKSNLLALRAGCGVDAAMFGRFVSGDVDAKVTAAVHVAHSFTIHGEQSETDYFTAVDDLVEQGTGHINAAELNTGIYYGYVVVDVPQLISNLCGCDSKNSADADRTLAAQVTSNLIHLMATVTPGAKLSGTAPYAASWLVLAEWSDSQPRTLADAFFEGLKLGSDGSARSLAVQMLAEYIRKYDAMYTPQLTRRCASIEPCQIPGAENGSLDELCEAVKLAIEGA

SEQ ID NO: 6850 - protein, 310 aa, Slackia exigua ATCC 700122
MPEVSEGDAIEKAKEVLVALGFKLKKEENEYLNEYLIFIGTLQIGKLAELAIQALRDGEKVDKKEAKKILDVKRSPALNAVDIAMFGRMVADAPDLNVDASVQVAHAISVSSAETEFDYFTALDDKAPEDNAGAAMIETTEFTSAMFYRYANVDVFHLCENLGSPDAATKGINAFLQSFVKSMPTGKQNSFANRTLPSAVVIQLRDSQPVSLVNSFERPVVALRDKSQLTNAAEALVAQEKALDEAFGVTPQHTFVVAASPDASVLKELADGDPMGLDDAVDQIVAFCSDYLSECGFRDEEREQNDSLTA

SEQ ID NO: 6851 - protein, 381 aa, Bifidobacterium gallicum DSM 20093 = LMG 11596
MTTIVEIYAIQNVPPSNINRDDTGNPKTAIYGGVLRARVSSQAWKRAMREAFPEMLDADQLGIRTKNALAQIEQSIVAKRPDIDVETVHKAATAALTATGAKVEKSKRKGSMEGADLTQYLIFIANREIDKLADLAIAWIDADEDLDKPSKEMKGQVSAVFHGPQAVDIALFGRMLADAPELNTDASAQVAHAISVDEVTPEYDYFTAIDDDAADDNAGAAMLDTVGFNSSTLYRYATVAVDSLYEQLQSADMTVKAVDAFVNAFLRSMPTGKQNTFANRTLPTAALVVVRNSQPINPVEAFERPVHAERDKSISRVAAERLGRKLQDIQDTYGETPIAAWNIVAGQPVELLDSLSEHVTLPVMVESLDTVLQQELAAKEQ

SEQ ID NO: 6852 - protein, 374 aa, Cutibacterium acnes J139
MSSYYVDIHVIQSVPPSNVNRDDTGSPKSALYGGVRRARVSSQAWKKAVRTSFKEFLPANQTGSRTLRVVELLMNRLTAAPYGLPEEDARQKALEVVKALGLKAEKPRKKDESGAEGIERTQYLVFYSNQQLDRLAQLAATTDGKITATDAKKAADSDHGIEVALFGRMVADSKDLNVDSAVQVAHALSTHAVEIESDYFTAVDDYKLDEDDAGAGMIGTVEFTSETLYRFATVAVSTLKDNLGDVDLTAQAASAFVRGFIMSMPTGKQNTFANNTIPDAVVVQVRKGRSASFIGAFEDPVTSDDGGFVAASCQAVAAYAHDCEEAFLGAPEASFVTRVGSRTEAIGTMGTQMPIDDLVSSVRDQVTSLLQDES

SEQ ID NO: 6853 - protein, 408 aa, Pyramidobacter piscolens W5455
MTMLPRFIQISTLTTYPASLLNRDDSGLSKRIPFGGVSRTRVSSQCLKRHWRMADGLWSLQNVDKDIATSIRSRRIFPEKIEKPLIEKEGLDAEKVVAASQALQSELYGAKGTEAAAKNKKTAKDDADALNPSIDAQLSAERSELVVLGHPEIQFLSKIVREMASADGSAADVGKKTGEWFKKHKKDFQALKCGAGLDAAMFGRFISGDTDARVSAAVHVAHAFTVHAEESETDYFTAVDDLNNSGSAHINAAELTSGIFYNYVVVDVPQLVSNIEGCPSKQWQTAQRDVAGRLVKHLLHLIATVTPGAKLGSTAPYARPWFVMAEAGESQPHTLADAFYLPVPLRGDMRAQALRQLEDYVGKSDEMYGSDERRWIASMYDVSIPRGENSSLDRMGESLERAVVSLEL

SEQ ID NO: 6854 - protein, 361 aa, Megasphaera genomosp. type_1 str. 28L
MKTNNLYLDIHAIQSVPPSNLNRDDTGSPKTAKYGGATRARVSSQCWKKAIREYFCKYVEKGDLGKRTQYIVKCVADKITEKFPECEKNATKFATAVLKNAGLKIDKDGKSNVLFFMGDKQVSELAELAIRGTKEQEKICKALNANMAIDIALFGRMVAREKTQKYDLSVDASCQVAHAISTHAVSGEYDYFTAIDDLSPEDNAGAGMIGTIEYNSSTLYRYANIAVHELCHQLGNKEAAISAVTLFIEAFIKSMPTGKANTFANQTLPQGIIVTLRSDRPVNLVSAFEEPVQAKGGYAKESMAKLAVEYKKAAKIVQPEIASFVLTLDEDSPLAAVGKQEKNLDALLHDVGGTIEQTLMV

SEQ ID NO: 6855 - protein, 350 aa, Escherichia coli MS 198-1
MTTFIQLHLLTAYPAANLNRDDTGAPKTVVLGGATRLRVSSQSLKRAWRTSALFEQALAGHIGIRSGRIAREAATILIEKGIEEKKAIEWAAKIADYLGKAKNDKKPKDPLTNAETEQLVHISPAEFDAVKALAHQLAEEKRAPKEEDLALLRKDRMAVDIAMFGRMLANKPEFNVEAACQVAHAFGVSETIVEDDFFTAVDDLRQASEDAGAGHLGETGFGSALFYTYICIDKDLLVENLGGDEALANQTLRAFTEAALKVSPTGKQNSFASRAYASWALAEKGTEQPRSLAAAFYEPINGTRQLDVAVQRITTLRENMNTVYEQKTECASFDVMNKQGSMKDVLDFIC

SEQ ID NO: 6856 - protein, 351 aa, Escherichia coli MS 69-1
MTTFIQLHLLTAYPAANLNRDDTGAPKTVVLGGATRLRVSSQSLKRAWRTSALFEQALAGHIGIRSGRIAREAATILIEKGIEEKKAIEWAAKIADYLGKAKNDKKPKDPLTNAETEQLVHISPAEFDAVKALAHQLAEEKRAPKEEDLALLRKDRMAVDIAMFGRMLANKPEFNVEAACQVAHAFGVSETIVEDDFFTAVDDLRQASEDAGAGHLGETGFGSALFYTYICIDKDLLVENLGGDEALANQTIRAFTEAALKVSPTGKQNSFASRAYASWALAEKGTEQPRSLAAAFYEPINGTRQLDVAVQRITTLRENMNTVYEQKTECTSFDVMNKQGSMKDVLDFICA

SEQ ID NO: 6857 - protein, 351 aa, Escherichia coli MS 84-1
MTTFIQLHLLTAYPAANLNRDDTGAPKTVVLGGATRLRVSSQSLKRAWRISALFEQALAGHIGIRSGRIAREAATILIEKGIEEKKAIEWAAKIADYLGKAKNDKKPKDPLTNAETEQLVHISPAEFDAVKALAHQLAEEKRAPKEEDLALLRKDRMAVDIAMFGRMLANKPEFNVEAACQVAHAFGVSETIVEDDFFTAVDDLRQASEDAGAGHLGETGFGSALFYTYICIDKDLLVENLGGDEALANQTIRAFTEAALKVSPTGKQNSFASRAYASWAMAEKGTEQPRSLAAAFYEPINGTRQLEVAVQRITTLRENMNTVYEQKTECASFDVMNKQGSMKDVLDFICA

SEQ ID NO: 6858 - protein, 351 aa, Escherichia coli MS 115-1
MTTFIQLHLLTAYPAANLNRDDTGAPKTVVLGGATRLRVSSQSLKRAWRTSALFEQALAGHIGIRSGRIAREAATILIEKGIEEKKAIEWAAKIADYLGKAKNDKKPKDPLTNAETEQLVHISPAEFDAVKALAHQLAEEKRAPKKEDLALLRKDRMAVDIAMFGRMLANKPEFNVEAACQVAHAFGVSETIVEDDFFTAVDDLRQASEDAGAGHLGETGFGSALFYTYICIDKDLLVENLGGDEALANQTIRAFTEAALKVSPTGKQNSFASRAYASWALAEKGTDQPRSLAAAFYEPINGTRQLDVAVQRITTLRENMNTVYEQKTECASFDVMNKQGSMKDVLDFICA

SEQ ID NO: 6859 - protein, 357 aa, Escherichia coli MS 182-1
MTTFIQLHLLTAYPAANLNRDDSGSPKTVILGGATRLRVSSQSLKRAWRTSELFEQALAGHIGVRSGRIAREAATILIEKGIEDKKAIEWAVEIADYLGKAKKDKKQKNDKKPKDPLTSAETEQLVHISPAEFDAVKALAHQLAEEKRAPKEKDLALLRKDRMAVDIAMFGRMLAKKPGFNVEAACQVAHAFGVSETIVENDFFTAVDDLRQASEDAGAGHVDETGFGSALFYTYICIDKDLLVENLGGDEALANQTIRAFTEAALKVSPTGKQNSFASRAYASWALAEKGTDQPRSLAAAFYEPINGTRQLDVAVQRITTLRENMNTVYEQKTECASFDVMNKQGSMKDVLDFICA

SEQ ID NO: 6860 - protein, 262 aa, delta proteobacterium NaphS2
MSRFIQLHLLTAYPPANLNRDDMGSPKTAKMGGYDRLRVSSQCLKRTWRTSDIFEQALANHMGTRTKEMGRKIYGSLRDKGIEHKNAIEWAKPIAGVFGKLKEFSKKEKDALKKLSDADREKKELLELEIEQLAFFDVDEQRNMESLLTEIAARKDGPKDDELDFLRKKVQAVDIALFGRMLASKPAYNVEAACQVAHAISVHPIVIEDDYFTAVDDLNDGQDDMGAGHIGETRFAAGLFYSYACINRELLIENLDGDDGLA

SEQ ID NO: 6861 - protein, 351 aa, Escherichia coli MS 21-1
MTTFIQLHLLTAYPAANLNRDDTGAPKTVVLGGATRLRVSSQSLKRAWRTSALFEQALAGHIGIRSGRIAREAATIMIEKGIEEKKAIEWAADIADYLGKAKKDKKPKDPLTNAETEQLVHISPAEFDAVKALAHQLAEEKRAPKEDDLALLRKDRMAVGIAMFGRMLANKPEFNVEAACQVAHAFGVSETIVEDDFFTAVDDLRQASEDAGAGHLGETGFGSALFYTYICIDKDLLVENLGGDEALANQTLRAFTEAAFKVSPTGKQNSFASRAYASWALAEKGTEQPRSLAAAFYEPINGTRQLDVAVQRITTLRENMNTVYEQKTECASFDVMNKQGSMKDVLDFICA

SEQ ID NO: 6862 - protein, 358 aa, Lactobacillus delbrueckii subsp. bulgaricus PB2003/044-T3-4
MTKNLYVDINVLQTVPSSNINRDDTGAPKTAFYGGVTRARVSSQSWKRAVRKAFAEDGANIGTRTKRVPQMLAAKLQDLDASLDEDAAMSKAIDALKEGGIKTNKDNETGALLMVSPGQVAKLASYVLENETLDKKEVKKILMEGNSLDLALFGRMVADNPELNVDASAQVAHAISTHEIIPEYDYFTALDDLQEKEKSGAALIQTTQYDSATLYRYANINMAELSYNLGDEDAIEGALTFVKDFALSMPTGKQNSFANKTLPNYLMVTVRDDTPVNLVSAFESPVVAKAGEGYVENSVKKLENEYKDALQFVDQPLATVAVGKYETTVGEQAGNLQDLLDKLQDVLKKAVENEDFNN

SEQ ID NO: 6863 - protein, 362 aa, Peptoniphilus sp. oral taxon 836 str. F0141
MKNRLFLDINVIQILPPSNINRDDTGSPKTAQYGGVRRARVSSQSWKKAMRDYFKENSQKSNIGVRTLKIVDFVAEKIVKLDPGKSYDEAMKLAEKVINDAGVKTAKSQAKALFFMGNSQAEKLAKAALNDISDKKELTGILKSNPAIDIALFGRMVADDPSLNEDASCQVAHAISTHAVETEFDFFTAVDDLSKEDSQGAGMLGTVEYNSSTIYRYANVAIHEFLKQIGDKEQTVQSLKLLIEAFVNSLPTGKVNTFANTTLPEFVMISIRDDRPVNLVSAFENPVKAYKDEGYAKQSIVKLLKEYEKAEKFVDKAKYTSVLSLNAISNLDTDIVNEENLKKLLDDFANKLKGLLDDNQGE

SEQ ID NO: 6864 - protein, 195 aa, Escherichia coli MS 119-7
MAVDIAMFGRMLAKKPGFNVEAACQVAHAFGVSETIVENDFFTAVDDLRLASEDSGAGHVDETGFGSALFYTYICIDKDLLVKNLGGDEALANQTLRAFTEAALKVSPTGKQNSFASRAYASWALAEKGTEQPRSLAAAFYEPINGTGQLDVAVQRITTLRENMNTVYEQKTEYASFDVMNKQGSMKDVLDFICA

SEQ ID NO: 6865 - protein, 351 aa, Escherichia coli MS 107-1
MTTFIQLHLLTAYPAANLNRDDTGAPKTVVLGGATRLRVSSQSLKRAWRTSALFEQALAGHIGIRSGRIAREAATILIEKGIEDKKAIEWSAKIADYLGKAKNDKKPKDPLTNAETEQLVHISPAEFDAVKALAHQLAEEKRAPKEEDLALLRKDRMAVDIAMFGRMLANKPEFNVEAACQVAHAFGVSETIVEDDFFTAVDDLRQASEDAGAGHLGETGFGSALFYTYICIDKDLLVENLGGDEALANQTIRAFTEAALKVSPTGKQNSFASRAYASWALAEKGTDQPRSLAAAFYEPINGTRQLEVAVQRITTLRENMNTVYEQKTDYASFDVMNKQGSMKDVLDFICA

SEQ ID NO: 6866 - protein, 164 aa, Escherichia coli MS 124-1
MTTFIQLHLLTAYPAANLNRDDTGAPKTVVLGGATRLRVSSQSLKRAWRISALFEQALAGHIGIRSGRIAREAATILIEKGIEEKKAIEWAAKIADYLGKAKNDKKPKDPLTNAETEQLVHISPAEFDAVKALAHQLAEEKRAPKEEDLALLRKDRMAVDIAIG

SEQ ID NO: 6867 - protein, 170 aa, Escherichia coli MS 124-1
FPHAFGVSETIVEDDFFTAVDDLRQASEDAGAGHLGETGFGSALFYTYICIDKDLLVENLGGDEALANQTIRAFTEAALKVSPTGKQNSFASRAYASWAMAEKGTEQPRSLAAAFYEPINGTRQLEVAVQRITTLRENMNTVYEQKTECASFDVMNKQGSMKDVLDFICA

SEQ ID NO: 6868 - protein, 357 aa, Escherichia coli MS 78-1; identical to SEQ ID NO: 6859

SEQ ID NO: 6869 - protein, 359 aa, Peptoniphilus duerdenii ATCC BAA-1640
MNKRIFMDIHAVQTLPPSNINRDDTGSPKTAQYGGARRARVSSQSWKKAIREYFNKNTAQTNVGIRSLNVVEYVAEKINNIDSSITMEEAIKMADEIFNLGGIKTKDNKVRALFFLGEIQAVKLAEAAIEGVKDKKTIQEIFNSNPAIDIALFGRMVADDPYLNEDASCQVAHSISTHEIQTEFDFYTAVDDLSPQDNAGAGMLGTIEFNSSTMYRYANVAVHDFLNQVGDKESTINALKAFVEAFSNSLPTGMLNSFANQTLPQFIMVSIRSDRPVSLVSAFEEPVRSKEGYVEESIKKLTKEYKEVEKFVEEPLFTIVLSTRAIELSDEFEKAESMKDILSKLGEKLAEVIDESQGE

SEQ ID NO: 6870 - protein, 380 aa, Corynebacterium accolens ATCC 49726]
MALTIDIHALQTLPPSLINRDDTGAPKSAVYGGVPRQRVSSQAWKRAIRKYFESEIDAESVGDRSKRLPEKIARKVQEHEGWDAERAQKEVAELFKAAGIKTEVDAKRIKALKDSEETTEEELAAAQYPQTKYLLFLSPHQIERAAEAIIAADGEKIKKKDALEILDTQHSVDMALFGRMVADDAAYNVDAAVQVAHALGIHASAPEFDYFTAVDDLAEEGEETGAGMIGTVQMMSSTLYRYATVNLDGLTQNLDSAENAKQAAVNFVDAFIKSMPTGKINTFANQTMPELIYIAVRDTRPVSLVTAFEEPVEPTAGQSLRVAGAEALAKEEAEFEENYGLQPKAAFVVGLSEARQAFAQIADEVTLPELSQRLSSALSE

SEQ ID NO: 6871 - protein, 355 aa, Corynebacterium matruchotii ATCC 14266
MSHHLTLHIIASVPYSNLNRDDTGTPKHVRRGGYLAALLSSQSIKKGIRTKYEANSLVTSVRSGQLDADVVDRALAINPDADEKALRKKAKTLLGKLTKAKESDPEKGKESDRSIWLSSEELETAAAQILEDADGDFLQDYKTGSLAIASFGRMFAAAPQKGTEAALSVSPAVTTHAVAIATDYFSTIDDIKEANRDTGATYLGVAQYTTGVFYRTVTIDKQQLRRSWTGFDSPDSDESLRLLVDAIIYGLPRGKQHSTAPFVQPALVLAEEQRYRSAYDFEAPVQPDRKEGGYLKPTLEELDRQYTAARAFDRGNFDGVEFVAGTAAEVQNLFKDAEHGSKDELIDAVVAWIKQ

SEQ ID NO: 6872 - protein, 254 aa, Escherichia coli MS 145-7
MGKLKTTKKPKDPLTNAETEQLVHISPAEFDAVKALAHQLAEEKRAPKEEDLALLRKDRMAVDIAMFGRMLANKPEFNVEAACQVAHAFGVSETIVEDDFFTAVDDLRQASEDAGAGHLGETGFGSALFYTYICIDKDLLVENLGGDEALANQTIRAFTEAALKVSPTGKQNSFASRAYASWALAEKGTDQPRSLAAAFYEPINGTRQLEVAVQRITTLRENMNTVYEQKTDYASFDVMNKQGSMKDVLDFICA

SEQ ID NO: 6873 - protein, 352 aa, Faecalibacterium cf. prausnitzii KLE1255
MNKRLYVDFHILQTVPPSCINRDDTGSPKTAVYGGVLRARVSSQAWKHAMRAAFAENAQLDVGKRTKKAAELVKAQILALAPELDTDKLAKKALENAGIKSDDKGTKALFFMSTAQAKALAELAVEGSADKKQYRDALKAAPSMDMALFGRMVADDPSLNYDAAAQVAHSISTHAVQNEYDYFTAVDDCQAEDNAGAGHLGTVEYNSSTLYRYATVNVMELAGQLGAAQAAETVRAFGEAFLFSMPTGKQNTFANRTLPDAVYVTLREDQPVNLCGAFERAVPRSAQGYAAPSKAALAQYAQQMYSSFAEAPAQSFTVGSGLEELAPAQTAKAMLDALEKAVRDALAGNEVG

SEQ ID NO: 6874 - protein, 360 aa, Lactobacillus iners LEAF 3008A-a
MTNSSDQRLFLDIHAIQTVPPSNINRDDTGSPKTAQYGGVTRARVSSQSWKRAIRKYFYDKGHIQNSGIRSCDIVNYIAKIIVEKDKSISNKNAIKLVEKALKVVAAKLSTKDQKLKALFFISNNQADKFAQACLDKKSDKTELQEILKTDTSIDIALFGRMLAGDHSLNEDASSQVAHAISTHAIESEFDFYSAVDDLAPDDNAGVVLLDTLEYDSSTLYRYANIALHDFYRQLGDKEEVIDAVKLFVEAFVKSMPTGKINSFANQTLPQAVVVSLRSDRPINLVSAFEEPVKSENGYVDKSIQKLFAEYVKYEKILDKPIFTDYLLLDDTLEVKSIGKSTQNLDELLSDLEESINVNL

SEQ ID NO: 6875 - protein, 363 aa, Lactobacillus oris PB013-T2-3
MNKPNLYVDINVLQSVPSSNINRDDTGAPKTAYYGGVVRSRVSSQSWKRAVRMLFKDQSADAEWLAGIRTMRGPLLLANELQKQDSNLSSDEAMEQAVAVFNKAKIKLDKKTNQTKALLMLSHGQIEKLAEYVLQNSELDSKAVKEVLQGNHSLDMALFGRMVADDPSLNVDAACQVAHAISTHEIVPEYDYYTAVDDEKADDESGSAMIGTIEYDSATLYRYANVNVNELVHNLGDVDTAVKGLQLFVKDFVLSMPTGKQNSFANKTVPQYVLVTVREDTPVNLVSAFEEPVQSRHGYLQPSVKQLEKEYQDTQQFVQTPLASVVVTNKESKINTKATDVDDLVSKVTEVIETRVSDENLND

SEQ ID NO: 6876 - protein, 374 aa, Cutibacterium acnes HL001PA1
MSSYYVDIHVIQSVPPSNVNRDDTGSPKSALYGGVRRARVSSQAWKKAVRTSFKEFLPANQTGSRTLRVVELLMNRLTAAPYGLPEEDARQKALEVVKALGLKAEKPRKKDESGAEGIERTQYLVFYSNQQLDRLAQLTATTDGKITATDAKKAADSDHGIEVALFGRMVADSKDLNVDSAVQVAHALSTHAVEIESDYFTAVDDYKLDEDDAGAGMIGTVEFTSETLYRFATVAVSTLKDNLGDVDLTAQAASAFVRGFIMSMPTGKQNTFANNTIPDAVVVQVRKGRSASFIGAFEDPVTSDDGGFVAASCQAVAAYAHDCEEAFLGAPEASFVTRVGSRTEAIGTMGTQMPIDDLVSSVRDQVTSLLQDES

SEQ ID NO: 6877 - protein, 374 aa, Cutibacterium acnes HL082PA2; identical to SEQ ID NO: 6852

SEQ ID NO: 6878 - protein, 374 aa, Cutibacterium acnes HL110PA3; identical to SEQ ID NO: 6852

SEQ ID NO: 6879 - protein, 374 aa, Cutibacterium acnes HL110PA4; identical to SEQ ID NO: 6852

SEQ ID NO: 6880 - protein, 374 aa, Cutibacterium acnes HL060PA1; identical to SEQ ID NO: 6852

SEQ ID NO: 6881 - protein, 351 aa, Escherichia coli MS 85-1; identical to SEQ ID NO: 6857

SEQ ID NO: 6882 - protein, 357 aa, Streptococcus oralis ATCC 49296
MTTNQRLFLDIHAIQTLPPSNMNRDDTGSPKTAQYGGVKRSRVSSQAWKRAIRDYFNTYGEQSNVGVRTKDIVRYVAGKIVELDNSISFEDALTKADTVLIATGIKKKGKVKALYFMGDRQAEKLAQAAYENLTDKKELQKLANSNPAIDVAMFGRMVAEDPVLNEDASSQVAHAISTHAVQTEFDFFTAIDDLAPEDNAGAGMLGTIEFNSSTLYRYANVAIHELSKQLEDEKSLKNSLNLFIEAFANSLPTGKVNTFANQTLPQALIVSLRDDRPVNLVSAFEEPVKSTDGYVAKSIEKLSKEYTRVEKFVNKPLLTFYVTLDENESLKQIGEEKYSVSELLKDFSETLEQFLKK

SEQ ID NO: 6883 - protein, 368 aa, Lachnoanaerobaculum saburreum DSM 3986
MKSRLFLDMHIIQTLPPSNINRDDTGSPKTSMYGGVRRARVSSQSWKAAMRNYFKESGEVADVGVRTKDIVSYVAKKIRDINNTILEKEALDRAAQAIELVGIKLKDNKDKSGKEAKALFFLGDRQATDIAKMAAEADEDGKGKLMLDKKDLQRVLKDNVAIDIALFGRMVADDPSLNEDASSQVAHAISTHAVQTEFDYFTAADDLSPEDNAGAGMIGNVEYNSSTLYRYANIALHEFLHQLKDKESMINAVKLFVEAFAKSLPTGKVNTFANQTLPGILVVNLREDRPVSLVSAFETPVKSEDGYIAGSIKKLSDEMDNVQKFVEKPVKTLYLAINNVNISDGEGTDSLNELLTKLGEEINRYQFN

SEQ ID NO: 6884 - protein, 355 aa, Streptococcus sp. C150
MTTKQRLFLDIHAIQTLPPSNMNRDDTGSPKTAQYGGVRRSRVSSQSWKKAMREYFNTHGTQSNVGIRTKEIVRYVANKIVELDSSISIDNALEKADKVLIAAGIKKKGEVKALYFMGDSQAKKLAQAAYDNITDKKELQKLANADPSIDIALFGRMVAEDPNLNEDSSSQVAHAISTHAVQTEFDFFTAVDDLATEDNAGAGMLGTVEFNSSTLYRYANVAIHELSKQLGNEELLENSLSLFIEAFVKSLPTGKVNTFANQTLPQTLIVTVRSDRPVNLVSAFEEPVKSIKGYVTKSIDKLAKEFVKVEKFVDKPLMTFYVTLYESENLKQIGEEKDSVSKLLEDFSETIAQYI

SEQ ID NO: 6885 - protein, 352 aa, Salmonella enterica subsp. enterica serovar Montevideo str. CASC_09SCPH15965
MTTFIQLHLLTAYPAANLNRDDTGAPKTVVLGGATRLRISSQSLKRAWRTSELFEQALAGNIGIRSGRIAREAAQILVESGIDAKKAVEYVKNIANYFGKVKAEKKPKDELTNAETGQLVHISPAEFEAVKALAHRLAEEKRAPKEEELALLRKDRMAVDIAMFGRMLAKKTDFNVEAACQVAHAFGVSETIVEDDFFTAVDDLRQASAEDAGAGHLGETGFGSALFYTYICINKDLLVKNLNDNEELANKTLRAFTEAALKVSPTGKQNSFASRAYASWALAEKGTDQPRSLAAAFYEPINGTDQLNVAVKRITSLHKNMNKVYGQRTDTASFDVMNQQGSMKDVLDFICA

SEQ ID NO: 6886 - protein, 351 aa, Escherichia coli MS 117-3; identical to SEQ ID NO: 6865

SEQ ID NO: 6887 - protein, 355 aa, Anaerococcus prevotii ACS-065-V-Col13
MTKDRLFLDIHLIQTLPPSNVNRDDTGSPKTAQYGGVTRARVSSQAWKRAVRKYFKDEYDLENQGIRSRDIVNFLAEKIVDLDSDKSHEEASKLAEETLNKAKISTKDQKVKALFFISNKQATDLAQAALDAIKDKKILQGILKDNPSIDISLFGRMVADDPTLNEDASCQFAHAISTHAIEREFDYFTAVDDLAREDNAGAGMLGTIEYNSSTVYRYANIALHEFKNQLDNVEACAYASRLFVEAFIKSMPTGKINSFANQTLPKAILLTLRKDRPLNLVTAFENPIKSKEGYEKKSTERLFDENTKYEKLLGDAAYKSCIVAYDMDIDNIDTRKESIKDLLYDLEEKIKANLS

SEQ ID NO: 6888 - protein, 374 aa, Cutibacterium acnes HL103PA1; identical to SEQ ID NO: 6852

SEQ ID NO: 6889 - protein, 356 aa, Atopobium vaginae DSM 15829
MNNRLYIDIHALQTLPPCNINRDDTGSPKTAQYGGSTRARVSSQCWKRAMRIYFKEHSAEENVGVRTLYLVDYIAKKIVALDPSISDENSLKLGEKALNNAGVKTTKDRKVKALFFIGEKQANALAQAAIDGVDDKKALQALLHKYLPIDIALFGRMLADDPSLNEDASAQVAHAISTHAIQHEFDYFTAIDDLSPKDNAGAGMLGTVEYNSSELYRYASIALHEFLSQLDNDKDALAASVKLFVKGFVESMPTGKANTFANQTLPHLLLITLRDDRPVNLVSAFEEPVKSTDGYASQSTTKLAQEMAKTEKIVHKPLVSFYVSLATPEHMQELGEEKPSMQALLDDLATKITEIL

SEQ ID NO: 6890 - protein, 351 aa, Escherichia coli D9
MTTFIQLHLLTAYPAANLNRDDTGAPKTLVLGGATRLRVSSQSLKRAWRTSALFEQALAGHIGIRSGRIAREAATILIEKGIEEKKAIEWAAKIADYLGKAKNDKKSKDPLTNAETEQLVHISPAEFDAVKALAHQLAEEKRAPKEEDLALLRKDRMAVDIAMFGRMLANKPEFNVEAACQVAHAFGVSETIVEDDFFTAVDDLRQASEDAGAGHLGETGFGSALFYTYICIDKDLLVENLGGDEALANQTIRAFTEAALKVSPTGKQNSFASRAYASWALAEKGTEQPRSLAAAFYEPINGTGQLEVAVQRITTLRENMNTVYEQKTECASFDVMNKQGSMKDVLDFICA

SEQ ID NO: 6891 - protein, 362 aa, Gardnerella vaginalis 315-A; identical to SEQ ID NO: 6827

SEQ ID NO: 6892 - protein, 359 aa, Oribacterium sp. oral taxon 108 str. F0425
MSKEKLFLDIHVIQTLPPSNINRDDTGSPKTAVYGGVRRARVSSQSWKKAMRDYFKENGNFSNVGVRSLDVVSFLAEKIRELKPEISLEDAIQRSVKVFNEAGIKTTKNNRVKALFFLGKEQAENLAKKAVEKKYNKEELRKVFKEKAAIDIALFGRMLANDKELSENASSQIAHAISTHGVQTEFDYFTALDDLSKDAKPGAAMIDTIEYNSSTLYRYGNVALHEFFHQLNENKSQTIEATKLFVEAFLNSLPTGKMNSFANQTVPSSVVISLRKDRPVSFVSAFETAVKTKLSQEGYVDESIEAMFKEYKNVQRFVEKPEISFYLNLSEGHSLEGAKEELSLSNLLNDLGAELKNRL

SEQ ID NO: 6893 - protein, 363 aa, Lactobacillus oris F0423; identical to SEQ ID NO: 6875

SEQ ID NO: 6894 - protein, 298 aa, Lactobacillus curvatus CRL 705
MTFSSRTKESVQLLANELRKQDGSLDEEAALTKANEAFKSAGIKVDKNNETGALLLISNGQIKKLAQYILNNDELDKKEIKKVLKGDQSLDLALFGRMVADNPELNVDAASQVAHAISTHEVIPEYDYFTALDDEQGEDTSGAAMLGTIEFNSATLYRYANVNVNELVHNLNKEDAIAGISAFIKDFALSMPTGKQNTFANKTLPNYVMVTIRQDTPVNLVSAFEKPVVSNDGYVEKSVERLENEYKQTLDFVDQPLLTVALSKYSTEASKTATNLSDLLEQVTTELTKVVEDENTND

SEQ ID NO: 6895 - protein, 357 aa, Streptococcus sp. oral taxon 058 str. F0407
MTTNQRLFLDIHAIQTLPPSNMNRDDTGSPKTAQYGGVKRSRVSSQAWKRAIRDYFNTYGEQSNVGVRTKDIVRYVAGKIVELDNSISFEDALTKADTVLIATGIKKKGEVKALYFMGDRQAEKLAQAAYENLTDKKELQKLANSNPAIDVAMFGRMVAEDPTLNEDASSQVAHAISTHAVQTEFDFFTAIDDLAPEDNAGAGMLGTIEFNSSTLYRYANVAIHELSKQLEDEKSLKNSLNLFIEAFANSLPTGKVNTFANQTLPQALIVSLRDDRPVNLVSAFEEPVKSTDGYVAKSIEKLSKEYTRVEKFVNKPLLTFYVTLDENESLKQIGEEKYSVSELLKDFSETLGQVLKK

SEQ ID NO: 6896 - protein, 400 aa, Jonquetella anthropi DSM 22815
MNNFPRFVQISTLTTYSASLLNRDDSGLAKRIPFGDSVRTRISSQCLKRHWRNAGGPYGLDKAGDALSLSVRSRFSFPELIEKPLVAEGLEQKLVVSGSQKLQQLLYNGEEKGDTKKDKKKKIELDEDGYSAKRNELVVLGRPELEYLKQIIRDAISSSSNIKEIDNAVKDFYTKRKSNLLALRAGCGVDAAMFGRFVSGDVDAKVTAAVHVAHSFTIHGEQSETDYFTAVDDLVEQGTGHINAAELNTGIYYGYVVVDVPQLISNLCGCDPKNSADADRTLAAQVTSNLIHLMATVTPGAKLSGTAPYAASWLVLAEWGNSQPRTLADAFFEGLKLGSDGSARSLAVQLLAEYIQKYDAMYTPQLIRRCASIEPCQIPGAENGSLDELCEAVKLAIEGV

SEQ ID NO: 6897 - protein, 371 aa, Lachnospiraceae bacterium oral taxon 082 str. F0431
MSSRLFLDMHIIQTLPPSNINRDDTGSPKTALYGGVRRARVSSQSWKAAMRNYFKESGEVANVGVRTKDIVSYVAKKIIEIDSTILEKEALDKAAQVIELAGIGLKEKKDKSGKEAKALFFIGDSQATDLAKMAVDAEEGNKGKLLLDEKGVKNVLKDKVPIDIALFGRMVASDKTSSGLNEDASSQVAHAISTHAVQTEFDYFTATDDLLPEDESGAGMIGNVEYNSSTLYRYANVALHEFLHQLKDKGSMINATKLFLEAFAKSLPTGKINTFANQTLPSILVINLREDRPVSLVSAFESPVKSEEGYVAGSIKRMSDEMEKIQKFVQKPIKTLYLAIDNVDIKNGEEVESFEELLEKLGAEIENYQFS

SEQ ID NO: 6898 - protein, 390 aa, Saccharomonospora glauca K62
MSTPKYIDIHVIQTLPFSNVNRDDTGSPKTVEFGGVERTRVSSQSWKRVVRQHVEEAVGGETVRTRRVVVGVAERLIKQGWEKPEAEAAGVQIALSAGKKISLKQEKDESDEVVLTTNVLLLLPESGIDELAALADEHREMILAEAKKAKKLTGMKPKLPSERINEILSRRSATINLFGRMVAELPGANVDGAVQVAHAFTTHGTAVEYDFFTAVDDIEQKLDLPGSGYMDTALFSAGTFYRYANVNLTDLLRNLDRDTDLARVLVKTFLDGFITTVPSGKQNATAAVTLPDLVYVTVRDDRPVSLANAFEAPVGGGDGFVRKSAHRLDSHAGAIAELLGESHVLFSAHTTTPGAMPKNTEGWSHLGVNARSFEKLIDDAVDVALPGGRS

SEQ ID NO: 6899 - protein, 374 aa, Desulfobacter postgatei 2ac9
MNLIELHILQSFPVSCLNRDDVGAPKTAYFGGCQRARVSSQAWKRPIRAMAKESSPGLFAGQRTRFVVRSLEQIYLKKDLEPQKAKTLAILTADSMGKLDDPEKGNVKTLLYFSPQELESVTSEVLDKDYAPLLQAVIDDNRTKKDKSNAEKNLKVITDKASKQLKAKVKDNADIAVFGRMVADDHSLMVEGAGLFSHALSTHSVANEIDFFSAVDDNNTADDEGAGHLGTIEFNSACYYRYVGLNIDMLKDEHHLDHYEDDEFNQVVKTFLKAAILAVPSARKNSMFAFNPPAYVLGLKRNGQPLSLVNAFEKPVRKSRDGYIEESIDRMNSHWENLAETYCLRKQEDVKVVIPEKNIDDFIMVLMNKVSSNG

SEQ ID NO: 6900 - protein, 380 aa, Frankia sp. QA3
MRCYIDVHILQSVPPSNINRDDAGTPKQAVYGGVKRARVSSQAWKRATRTAFAEHVDHDRLGTRTRRISALLADRLAARGGLDGESATRIATSLLSSLKIKPGKKAAETAYLLFFGRPQLERLVDLVADDIPRLVKLDDEELADAVKGLPVLTTLGSGHPIDVALFGRMVADLATLNVDAATQVAHALSTHAVDVEFDYYTAVDDENARGETGAGMIGTVEFQSATLYRFATVGLHQLAENLAGDVEATVEALRMFLTAFTTSMPTGHQNSFAHRTVPNLLTVAVRADQPVNLVSAFEQPVPAGRHGILAGSVARFGEEMRTATSLWGLRPDLVASTYRAPDNAATAQTLTEVLGAARPFDEVISTVVDAARQRLASATR

SEQ ID NO: 6901 - protein, 405 aa, Streptomyces ipomoeae 91-03
MAAYAPARYVDFHALHPLPASVLNRGEDDPPKTLQLGGAVRAMVSSQSWKRAIRLRLEDDLDEHAARTRMLPLRVADALREAGWPADLAAFAGAQIVRSATREGLKTEEKQGGITSVTLYLPRTVLDDLTDLCAEHRQQLEEALAKEKAQKAQEAEAEAKGTRRKAKKEKTEAVLPTPTVAALIRRRTATINLFGRMLAEVPGAQVDGAVQMAHSFSVHQSSQQPDYFTAVEDWSLPHEAGSAHLQTGFFTTGLLYRYATVNLTELTRNLGGDHDQALHLLELFTETFIDVMPGAKKTATAPHTYPHLVHYAVRDRRPVSFAAAFEQPVKSAPGGGYTVPAVKALSQHAGALNRLLGPRRLIGSGYATAHDAPVDHLGTAHASFDDLTDALTQTAAQPSPTQAAA

SEQ ID NO: 6902 - protein, 358 aa, Peptostreptococcus anaerobius VPI 4330 = DSM 2949
MRNEQRLFIDIHVVQTLPPSNINRDDTGAPKTAQFGGVKRARVSSQSWKRAIRMYFQNNGDRVDFGVRTHSIVDYVAKKIIEKDSSISYEESMKKSEKVINDVITKTTKDMKLKALFFLGDFQANMLADAIIKGVNDKKQLKEILKNNPSIDIALFGRMVADDPSLNEDASSQVAHAISTHAIQNEFDFYTAVDDLHSDDNAGAGMLGNIEFNSSTLYRYANIAVHELSKQLDNKEAVINTVKLFIEAFSNSLPTGKVNTFANQTIPNAIIVTVRDDRPINMVGAFEEPIRSNGGFASKSIEKLAEEMKKSEKFVKKPIKSLYVSMEQISSMNDVSEEAGCLHDLLEEIANELDKKLI

SEQ ID NO: 6903 - protein, 344 aa, Klebsiella pneumoniae JHCK1
MTTPFRNTRIEFHILQSFPVTCLNRDDVGAPKSAIVGGVSRARVSSQCWKRQVRLALPDFGIRLGVRSKKTASLLANACRALGASEEQATGCGEAMAAFFSDDTLLFLSEAEAAAFAAYAQGKDFDAASLKDKELVKVAKKVVNNTLDALDIALFGRMVAKAADMNVEAAASFAHAISTHKVSNEIEFFTAVDDCKTEDESGSAHMGSLEFNSATYYRYVSLDLGQLAQTLGEDADMKTAVAAFVKALYVAVPSARQTTQSGACPWEYARVLLRKGQGLQASFEQPVKSQGEGFLSPSKAALKNWLHTKEKLSGSLFGKQGDYEWGEDLDYSIDRLIADLQSHL

SEQ ID NO: 6904 - protein, 366 aa, Salmonella enterica subsp. enterica serovar Dublin str. UC16
MAIPITNKINRDIFMTTFIQLHLLTAYPAANLNRDDTGAPKTVVLGGATRLRISSQSLKRAWRTSELFEQALAGHIGIRTGRIAREAAQILVDSGIDAKKAVEYVEKIANCFGKVKAEKKPKDELTNAETEQLVHISPAEFEGVKALAHRLAEEKRAPKEEELALLRKDRMAVDIAMFGRMLANKPDFNVEAACQVAHAFGVSETIVEDDFFTAVDDLRQASAEDAGAGHLGETGFGSALFYTYICIDKDLLVKNLNGNEELANKTLRAFTEAALKVSPTGKQNSFASRAYASWALAEKGTDQPRSLAAAFYEPINGTDQLNVAVKRITALRENMNAVYAQETAFKDFNVMNQQGSMKDVLDFICA

SEQ ID NO: 6905 - protein, 362 aa, Gardnerella vaginalis JCP8481B
MNTRLFLDIQAIQTVPPCNMNRDDAGSPKTAQYGGVTRTRVSSQCWKHSMREYFKEHSGDSNVGVRSKNIVKYVADKIITLKPELSEQEALDLANKTLNNAGVKTKTDKDEIVPTAKALFFLGEIQANALAQAAINDVTDKKQLQEILKDNPAIDIALFGRMLADDPSLNEDASSQVAHAISTHAVRAEFDYYTAVDDLSPDDNAGAGMLGTIEYTSSTLYRYANVAVHELVHQLDDNKESTINALKLFIEAFTNAMPTGKVNTFANQTLPQMLVVTLRDDRPVNLVSAFENPVKAKDGYVSKSIEKLSQEYEKVQKFVHKPLASFYVTMNSSDEELKLGVAEASMQQLLDDFSAKVTELLQ

SEQ ID NO: 6906 - protein, 362 aa, Gardnerella vaginalis JCP8481A; identical to SEQ ID NO: 6905

SEQ ID NO: 6907 - protein, 362 aa, Gardnerella vaginalis JCP8017A
MNAHLFLDIQAIQAVPPCNINRDDAGSPKTAQYGGVTRARVSSQCWKHSMREYFKEHSGDSNVGIRSKNIVKYVADKIVALKPELSEQEALDLANKTLNNAGVKTKKDNDEIVPTAKALFFLGETQANSLAQAAINNVTDKKQLQEILKDNPPIDIALFGRMLADDPSLNEDASSQVAHAISTHAVRAEFDYYTAVDDLSTEDNAGAGMLGTIEFNSSTLYRYANVAVHEFSHQLSDNKESTINALRLFIEAFANAMPTGKANTFANQTLPQMLVVTLRDDRPVNLVSAFEDPVKAKDGYVSKSIEKLSQEYEKVQKFVNKPLASFYVTMDSSNENLKLGVEEQSMQQLLDDFSSKVSEFLQ

SEQ ID NO: 6908 - protein, 362 aa, Gardnerella vaginalis JCP7672
MNAHLFLDIQAIQSVPPCNINRDDAGSPKTAQYGGVTRTRVSSQCWKHSMREYFKEHSGESNVGIRSKNIVKYVADKIVALKPELSEQEALDLADKTLNTAGVKTKTDKGETVPTAKALFFLGETQANSLAQAAINNVTDKKQLQEILKDNPPIDIALFGRMLADDPSLNEDASSQVAHAISTHAVRAEFDYYTAVDDLSTEDNAGAGMLGTIEYSSSTLYRYANVAIHEFNHQLSDNKESTINALRLFIEAFANAMPTGKVNTFANQTLPQMLVVTLRDDRPVNLVSAFEDPVKSKDGYVSKSIEKLSQEYEKVQKFVHKPLASFYVTMDSSNEEIKLGVEEQSMQQLLDDFSSKVSEFLQ

SEQ ID NO: 6909 - protein, 362 aa, Gardnerella vaginalis JCP7659; identical to SEQ ID NO: 6907

SEQ ID NO: 6910 - protein, 362 aa, Gardnerella vaginalis JCP7275
MNAHLFLDIQAIQTVPPCNINRDDAGSPKTAQYGGVTRARVSSQCWKHSMREYFKEHSGDSNVGIRSKNIVKYVADKIIALKPELSEQEALDLAKKTLNNAGIKTKTDKGKITPVVNVLFFLGENQANSLAQAAVNNIKDKKQLEEILKDNPPIDIALFGRMLADNRSLNEDASSQVAHAISTHAIRTEFDYYTAVDDLSADDNAGAGMLGTIEYNSSTLYRYANVAVHEFSHQLSDNKESTINALKLFIEAFANAMPTGKANTFANQTLPQMLVVTLRDDRPVNLVSAFEDPVKSSDGYVSKSIEKLSQEYEKVQKFVHKPLASFYVTMDSLNEEIKLGVEEQNMQQLLDDFSSKVSEFLQ

SEQ ID NO: 6911 - protein, 362 aa, Gardnerella vaginalis JCP8070
MNSRLFLDIQAIQSVPPCNINRDDAGSPKTAQYGGVTRARVSSQCWKHSMREYFKEHSGDSNVGMRSKNIVKYVADKIITLKPELSEQEALDLANKTLNNAGIKTKTDKGKITPVVNVLFFLGENQANSLAQAAVNNIKDKKQLEEILKDNPPIDIALFGRMLADNRSLNEDASSQVAHAISTHAVRAEFDYYTAVDDLSADDNAGAGMLGTIEYNSSTLYRYANVAVHEFSHQLSDNKESTINALKLFIEAFANAMPTGKANTFANQTLPQMLVVTLRDDRPVNLVSAFEDPVKSKDGYVSKSIEKLSQEYEKVQKFVHKPLASFYVTMDSSNEEIKLGVEEQSMQQLLDDFSSKVSELLQ

SEQ ID NO: 6912 - protein, 362 aa, Gardnerella vaginalis JCP8066
MNAHLFLDIQAIQTVPPCNINRDDAGSPKTAQYGGVTRARVSSQCWKHSMREYFKEHSGDSNVGIRSKNIVEYVADKIIALKQELSEQEALDLAKKTLNNAGIKTKTDKGKITPVVNVLFFLGENQANSLAQAAVNNIKDKKQLEEILKDNPPIDIALFGRMLADNQSLNEDASSQVAHAISTHAVRAEFDYYTAVDDLSADDNAGAGMLGTIEYNSSTLYRYANVAVHEFSHQLSDNKESTINALKLFIEAFANAMPTGKANTFANQTLPQMIVVTLRDDRPVNLVSAFEDPVKSKDGYVSKSIEKLSQEYEKVQKFVHKPLASFYVTMDSSNEEIKLGVEEQSMQQLLDDFSSKVSELLQ

SEQ ID NO: 6913 - protein, 362 aa, Gardnerella vaginalis JCP8017B; identical to SEQ ID NO: 6907

SEQ ID NO: 6914 - protein, 366 aa, Salmonella enterica subsp. enterica serovar Dublin str. DG22; identical to SEQ ID NO: 6904

SEQ ID NO: 6915 - protein, 325 aa, Actinobaculum sp. oral taxon 183 str. F0552
MDASELGTRTKRVVEVLAKEIARQAEDLSDQAQSLAEQVFQAAKIKLVDSRAKNGEESLKSQESGYLIFLSHRQIAMLAELAIASDRSGKALDKKAVKAIFKSGNSIDVALFGRMVADDADLNVDAACQVAHAISTHAAENEFDFYTAVDDEKARSEEKEDAGAGMMGTVEFSSATIYRYATINIGMLLENLGNNEATLRALTAFIKSFIRSMPTGKQNTFANRTLPDTVVIHIREDQPVSFVGAFEKPIAQDLTEGYVTRSVRQLADHERKLEETYGFKPLHGFAVSMESPEAVESLGERISFADLDGRVREVVARRLPGAESE

SEQ ID NO: 6916 - protein, 384 aa, Actinomyces sp. oral taxon 877 str. F0543
MSRFIDIHVLQTLPPSNPNRDDTGAPKTATFGGVRRMRISSQAIKRATREDFEKHAPEGNRGIRTKLVVELVRAAIVERAPQLAQSAAELAEMGLVEIGFKLTEPRRKKNEETTDQKLKEAGFLVFLSAKQIEHLAEALVSVADAEDRKKAFKALKPKTLVDTDHSISIALFGRMVAEPNSLNVDAACQVAHALGVGEVESEYDYYTAVDDEKKRDDEADEGAGMIGTIEFASATVYRYATINVDLLEENLGSVDAADDAIRLFIDSFVRAMPTGKVTTFANRTLPDAVVVQVRDDQPINLVGAFEEPVPAKAEGDGTKKGFAGPAVERLVAFEKDMRALTGMTPKASLVAWTTHKAEPIAELGQQVRLIDLGGAAVDALRGQQ

SEQ ID NO: 6917 - protein, 359 aa, Streptococcus sobrinus W1703
MTNNQHLFLDIHAIQTLPPSNINRDDTGSPKTAQYGGVRRARVSSQSWKRAIREYFSDNGQQSNVGVRTKDIVRYVADKIIGLDQSISLEDALQKADKVLNGAGVKTKDFKAKALFFLSDVQAKKLAQAAINDVSDKKELHEVLTSSPAIDIALFGRMVADDPSLNEDASSQVAHAISTHAVQTEFDFYTAVDDLAPEDNAGAGMLGTIEFNSSTLYRYANVAVHELLKQLGDKESLVNSLSLFIEAFAKSLPTGKATSFANQTLPQALVVTLRNDRPISLVSAFEKPVKSSEGYVTKSIEKLSDEFVKVEKFVNKPVLTFYVSLEDVEKLKNVGGIEKNSLSELLSDFSEELSNFIQE

SEQ ID NO: 6918 - protein, 359 aa, Peptostreptococcaceae bacterium oral taxon 113 str. W5053
MNKNRLFLDIHAIQTLPPSNINRDDTGSPKTAMYGGVRRARVSSQSWKRAMREYFNNNGEDGNIGVRTLEIVRYVGDKIKNLDSSVSDEEAMEMANEVFKKAGITTTKDFKAKALFFLGEIQANLLAKAAIDKINDKKKLQQIINDNPAIDIALFGRMVADDPSLNEDASSQVAHAISTHAVQTEFDFFTAVDDLSPEDNAGAGMLGTIEFNSSTLYRYANIAVHELNKQLKDKEATIHAVKLFVEAFSNSLPTGKVNTFANQTIPQAVIVTLRNDRPLSLATAFEEPIKSSDGHVDKSIQKLSQEFKRVEKFVNKPLWTLYVTFDEVEALKEIGEGQDSLRNLLNTLSEELSNAIQGE

SEQ ID NO: 6919 - protein, 358 aa, Ruminococcus callidus ATCC 27760
MSIYVDFHVLQTVPPSCVNRDDTGSPKTAVYGGSVRARVSSQAWKHAMRKEFRGMFAEDDLGNRTKNVVQLVAQEMQSIDASLDEKKCLKKAADALDAAGISLKAKKKEEIKKADALFFMSNRQAKEIARLACGDTADKNDFKKALKEYPSVDIALFGRMAASDPTLNYDAASQVAHAISTHAVQNEYDYFTAVDDISEDDNAGAGHLGTVEFNSSTLYRYANVNVSELRKTLDDAADVAVVVRKFAEAFIRSMPTGKENTFANRTFPDAVYVTIRMDQPVNLCGAFEKPVRASEDGYATESEKRLAAYAKKIYSRYAAEPKAAFCIGDALSDIAQQLSLPELLDTLESNLREQVSEA

SEQ ID NO: 6920 - protein, 351 aa, Escherichia coli 113303
MTTFIQLHLLTAYPAANLNRDDTGAPKTVVLGGATRLRVSSQSLKRAWRTSALFEQALAGHIGIRSGRIAREAATILIEKGIEEKKAIEWAAKIADYLGKAKNDKKPKDPLTNAETEQLVHISPAEFDAVKALAHQLAEEKRAPKEEDLALLRKDRMAVDIAMFGRMLANKPEFNVEAACQVAHAFGVSETIVEDDFFTAVDDLRQASEDAGAGHLGETGFGSALFYTYICIDKDLLVENLGGDEALANQTIRAFTEAALKVSPTGKQNSFASRAYASWAMAEKGTEQPRSLAAAFYEPINGTRQLEVAVQRITTLRENMNTVYEQKTECASFDVMNKQGSMKDVLDFICA

SEQ ID NO: 6921 - protein, 351 aa, Escherichia coli 113290
MTTFIQLHLLTAYPAANLNRDDTGAPKTVVLGGATRLRVSSQSLKRAWRTSALFEQALAGHIGIRSGRIAREAATILIEKGIEEKKAIEWAAKIADYLGKAKNDKKPKDPLTNAETEQLVHISPAEFDAVKALAHQLAEEKRAPIEEDLALLRKDRIAVDIAMFGRMLANKPEFNVEAACQVAHAFGVSETIVEDDFFTAVDDLRQASEDAGAGHLGETGFGSALFYTYICIDKDLLVENLGGDEALANQTIRAFTEAALKVSPTGKQNSFASRAYASWALAEKGTEQPRSLAAAFYEPINGTRQLDVAVQRITTLRENMNTVYEQKTECVSFDVMNKQGSMKDVLDFICA

SEQ ID NO: 6922 - protein, 351 aa, Escherichia coli 907357
MTTFIQLHLLTAYPAANLNRDDTGAPKTVVLGGATRLRVSSQSLKRAWRTSALFEQALAGHIGIRSGRIAREAATILIEKGIEEKKVIEWAAKIADYLGKAKNDKKPKDPLTNAETEQLVHISPAEFDAVKALAHQLAEEKRAPKEEDLALLRKDRMAVDIAMFGRMLANKPEFNVEAACQVAHAFGVSETIVEDDFFTAVDDLRQASEDAGAGHLGETGFGSALFYTYICIDKDLLVENLGGDEALANQTIRAFTEAALKVSPTGKQNSFASRAYASWALAEKGTDQPRSLAAAFYEPINGTRQLDVAVQRITTLRENMNTVYEQKTECASFDVMNKQGSMKDVLDFIYA

SEQ ID NO: 6923 - protein, 351 aa, Escherichia coli 110957
MTTFIQLHLLTAYPAANLNRDDTGAPKTVVLGGATRLRVSSQSLKRAWRTSALFEQALAGHIGIRSGRIAREAATILIEKGIEEKKAIEWAAKIADYLGKAKNDKKPKDPLTNAETEQLVHISPAEFDAVKALAHQLAEEKRAPKEEDLALLRKDRMAVDIAMFGRMLANKPEFNVEAACQVAHAFGVSETIVEDDFFTAVDDLRQASEDAGAGHLGETGFGSALFYTYICIDKDLLVENLGGDEALANQTLRAFTEAALKVSPTGKQNSFASRAYASWALAEKGTEQPRSLAAAFYEPINGTRQLDVAVQRITTLRENMNTVYEQKTECVSFDVMNKQGSMKDVLDFICA

SEQ ID NO: 6924 - protein, 341 aa, Escherichia coli 909945-2
MNMQKDAIFGGKRRVRISSQSLKRAMRKSDYYAQNIGESSLRTIHLAQLRDVLRQKLGERFEQKIIDKTLALLSGKSVDEAEKISADAVTPWVVGEIAWFCEQVAKAEADNLDDKKLLKVLKEDIAAIRVNLQQGVDIALSGRMATSGMMSELGKVDGAMSIAHAITTHQVDSDIDWFTAVDDLQEQGSAHLGTQEFSSGVFYRYANINLAQLQENLGGASREQALEIATHVVHMLATEVPGAKQRTYAAFNPADMVMVNFSDMPLSMANAFEKAVKAKDGFLQPSLQAFNQYWDRVANGYGLNGAAAQFSLSDVDPITGQVQQMPTLEQLKSWVRNNGEA

SEQ ID NO: 6925 - protein, 351 aa, Escherichia coli 907713
MTTFIQLHLLTAYPAANLNRDDTGAPKTVVLGGATRLRVSSQSLKRAWRTSALFEQALAGHIGIRSGRIAREAATILIEKGIEEKKAIEWAAKIADYLGKAKNDKKPKDPLTNAETEQLVHISPAEFDAVKALAHQLAEEKRAPKEEDLALLRKDRMAVDIAMFGRMLANKPEFNVEAACQVAHAFGVSETIVEDDFFTAVDDLRQASEDAGAGHLGETGFGSALFYTYICIDKDLLVENLGGDEALANQTLRAFTEAALKVSPTGKQNSFASRAYASWALAEKGTEQPRSLAAAFYEPINGTRQLDVAVQRITTLRENMNTVYEQKTECASFDVMNKQGSMKDVLDFICA

SEQ ID NO: 6926 - protein, 351 aa, Escherichia coli 113302
MTTFIQLHLLTAYPAANLNRDDTGAPKTVVLGGATRLRVSSQSLKRAWRTSALFEQALAGHIGIRSGRIAREAATILIEKGIEEKKVIEWAAKIADYLGKAKNDKKPKDPLTNAETEQLVHISPAEFDAVKALAHQLAEEKRAPKEEDLALLRKDRMAVDIAMFGRMLANKPEFNVEAACQVAHAFGVSETIVEDDFFTAVDDLRQASEDAGAGHLGETGFGSALFYTYICIDKDLLVENLGGDEALANQTIRAFTEAALKVSPTGKQNSFASRAYASWALAEKGTDQPRSLAAAFYEPINGTRQLDVAVQRITTLRENMNTVYEQKTECASFDVMNKQGSMKDVLDFICA

SEQ ID NO: 6927 - protein, 351 aa, Escherichia coli 907672
MTTFIQLHLLTAYPAANLNRDDTGAPKTVVLGGATRLRVSSQSLKRAWRTSALFEQALAGHIGIRSGRIAREAATIMIEKGIEEKKAIEWAADIADYLGKAKKDKKPKDPLTNAETEQLVHISPAEFDAVKALAHQLAEEKRAPKEDDLALLRKDRMAVDIAMFGRMLANKPEFNVEAACQVAHAFGVSETIVEDDFFTAVDDLRQASEDAGAGHLGETGFGSALFYTYICIDKDLLVENLGGDEALANQTLRAFTEAAFKVSPTGKQNSFASRAYASWALAEKGTEQPRSLAAAFYEPINGTRQLDVAVQRITTLRENMNTVYEQKTECASFDVMNKQGSMKDVLDFICA

SEQ ID NO: 6928 - protein, 351 aa, Escherichia coli 907710; identical to SEQ ID NO: 6926

SEQ ID NO: 6929 - protein, 351 aa, Escherichia coli 907715; identical to SEQ ID NO: 6925

SEQ ID NO: 6930 - protein, 351 aa, Escherichia coli 907889; identical to SEQ ID NO: 6923

SEQ ID NO: 6931 - protein, 351 aa, Escherichia coli 908521; identical to SEQ ID NO: 6925

SEQ ID NO: 6932 - protein, 350 aa, Escherichia coli 908522; identical to SEQ ID NO: 6855

SEQ ID NO: 6933 - protein, 351 aa, Escherichia coli 908525; identical to SEQ ID NO: 6927

SEQ ID NO: 6934 - protein, 294 aa, Escherichia coli 908555
MAGHIGIRSGRIAREAATILIEKGIEEKKAIEWAAKIADYLGKAKNDKKPKDPLTNAETEQLVHISPAEFDAVKALAHQLAEEKRAPKEEDLALLRKDRMAVDIAMFGRMLANKPEFNVEAACQVAHAFGVSETIVEDDFFTAVDDLRQASEDAGAGHLGETGFGSALFYTYICIDKDLLVENLGGDEALANQTIRAFTEAALKVSPTGKQNSFASRAYASWAMAEKGTEQPRSLAAAFYEPINGTRQLEVAVQRITTLRENMNTVYEQKTECASFDVMNKQGSMKDVLDFICA

SEQ ID NO: 6935 - protein, 351 aa, Escherichia coli 908541
MTTFIQLHLLTAYPAANLNRDDTGAPKTVVLGGATRLRVSSQSLKRAWRTSALFEQALAGHIGIRSGRIAREAATILIEKGIEDKKAIEWAAKIADYLGKAKNDKKPKDPLTNAETEQLVHISPAEFDAVKALAHQLAEEKRAPKEEDLSLLRKDRMAVDIAMFGRMLANKPEFNVEAACQVAHAFGVSETIVEDDFFTAVDDLRQASEDAGAGHLGETGFGSALFYTYICIDKDLLVENLGGDEALANQTIRAFTEAALKVSPTGKQNSFASRAYASWALAEKGTDQPRSLAAAFYEPINGTRQLDVAVQRITTLRENMNTVYEQKTECASFDVMNKQGSMKDVLDFICA

SEQ ID NO: 6936 - protein, 351 aa, Escherichia coli 908573; identical to SEQ ID NO: 6856

SEQ ID NO: 6937 - protein, 351 aa, Escherichia coli 908585; identical to SEQ ID NO: 6925

SEQ ID NO: 6938 - protein, 351 aa, Escherichia coli 908616; identical to SEQ ID NO: 6925

SEQ ID NO: 6939 - protein, 351 aa, Escherichia coli 908658; identical to SEQ ID NO: 6923

SEQ ID NO: 6940 - protein, 374 aa, Cutibacterium acnes HL042PA3; identical to SEQ ID NO: 6852

SEQ ID NO: 6941 - protein, 366 aa, Salmonella enterica subsp. enterica serovar Cubana str. 76814
MAISITNRINRDIFMTTFIQLHLLTAYPASNLNRDDTGAPKTVVLGGATRLRISSQSLKRAWRTSELFEQALAGNIGIRSGRIAREAAQILVESGIEPKKAVEYVKNIANCFGKVKEDKKPKEDLTNAETEQLVHISPAEFEAVKALARRLAEEKRPATEEEAELLRHDRMAVDIAMFGRMLAKKTDFNVEAACQVAHAFGVSETIIEDDFFTAVDDLRQASAEDAGAGHLGETGFGSALFYTYICIDKDLLVKNLNGNEELANKTLRAFTEAALKVSPTGKQNSFASRAYASWALAEKGTDQPRSLAAAFYEPINGTDQLNVAVKRITALRENMNAVYVQETAFKDFNVMNQQGSMKDVLDFICA

SEQ ID NO: 6942 - protein, 363 aa, Escherichia coli LAU-EC8
MSNFINIHVLISHSPSCLNRDDMNMQKDAIFGGKRRVRISSQSLKRAMRKSDYYAQNIGESSLRTIHLAQLRDVLRQKLGERFDQKIIDKTLALLSGKLVDEAEKISADAVTPWVVGEIAWFCEQVAKAEADNLDDKKLLKVLKEDIAAIRVNLQQGVDIALSGRMATSGMMSELGKVDGAMSIAHAITTHQVDSDIDWFTAVDDLQEQGSAHLGTQEFSSGVFYRYANINLAQLQENLGGASREQALEIATHVVHMLATEVPGAKQRTYAAFNPADMVMVNFSDMPLSMANAFEKAVKAKDGFLQPSIQAFNQYWDRVANGYGLNGAAAQFSLSDVDPITAQVKQMPTLEQLKSWVRNNGEA

SEQ ID NO: 6943 - protein, 363 aa, Escherichia coli LAU-EC9; identical to SEQ ID NO: 6942

SEQ ID NO: 6944 - protein, 363 aa, Escherichia coli O6:H16:CFA/II str. B2C
MSNFINIHVLISHSPSCLNRDDMIMQKDAIFGGKRRVRISSQSLKRAMRKSDYYAQNIGESSLRTIHLAQLRDVLRQKLSERFDQKIIDKTLALLSGKSVDEAEKISADAVTPWVVGEIAWFCEQVAKAEADNLDDKKLLKVLKEDIAAIRVNLQQGVDIALSGRMATSGMMSELGKVDGAMSIAHAITTHQVDSDIDWFTAVDDLQEQGSAHLGTQEFSSGVFYRYANINLAQLQENLGGASREQALEIATHVVHMLATEVPGAKQRTYAAFNPADMVMVNFSDMPLSMANAFEKAVKANDGFLQPSLQAFNQYWDRVANGYGLNGAAAQFSLSDVDPITGQVQQMPTLEQLKSWVRNNGEA

SEQ ID NO: 6945 - protein, 355 aa, Streptococcus thermophilus TH985
MTTEQRLFLDIHAIQTLPPSNMNRDDTGSPKTAQYGGVRRSRVSSQAWKKAMREYFNTHGDQSNVGIRTKEIVRYVADKIVELDSSISIEDALEKADKVLIAAGIKKKGEVKALYFMGDSQAKKLAQAAYDNITHKKELQKLANEDPAIDIALFGRMVAEDPTLNEDSSSQVAHAISTHPVQTEFDFFTAVDDLAPEDNAGAGMLGTVEFNSSTLYRYANVAIHELSKQLGNKESLENSLSLFIEAFAKSLPTGKVNTFANQTLPQTLIVTVRSDRPVNLVSAFEEPVKSIEGYVTKSIDKLAKEFIKVEKFVDKPLMTFYVTLHESDSLKQIGEEKDSVSKLLEDFSEMIAQYI

SEQ ID NO: 6946 - protein, 152 aa, Lactobacillus otakiensis DSM 19908 = JCM 15040
MANKNLYLDLNVIQTVPSSNINRDDTGAPKTAIYGGVTRARVSSQAWKQAIRHSFKESGVKRGSRTREAAKLLTEKIMELDASLDQDAANEKSHQIFIAAGITFDKKEKNKTRALLFVSPGQIEKLAQFAVSHDDLDVSKKIRQCQKRLKKN

SEQ ID NO: 6947 - protein, 234 aa, Lactobacillus otakiensis DSM 19908 = JCM 15040
MPEKVKKELKRDVKKAINNENTLDLALFGRMVADNPELNVEGTAQVAHAISTHEIVPEFDYYTALDDLKGDDTNGAGFIGTSEFNSSTLYRYANINVRELAGNLGDDNAITGAADFIKSFILSMPTGKENSYANKTLPNYVLITVRTDTPVNLVSAFEEPVQSKDGYLKNSVKKLEDEYQSTLRFVLDQPIETIALSESKTESEIENQATNLPDLIDQVTEVLEKAVQDENTND

SEQ ID NO: 6948 - protein, 363 aa, Escherichia coli str. K-12 substr. MG1655; identical to SEQ ID NO: 6824

SEQ ID NO: 6949 - protein, 363 aa, Escherichia coli K-12; identical to SEQ ID NO: 6824

SEQ ID NO: 6950 - protein, 363 aa, Escherichia coli; identical to SEQ ID NO: 6944

SEQ ID NO: 6951 - protein, 355 aa, Escherichia coli
MSNFINIHVLISHSPSCLNRDDMNMQKDAIFGGKRRVRISSQSLKRAMRKSDYYAQNIGESSLRTIHLAQLRDVLRQKLGERFDQKIIDKTLALLSGKLVDEAEKISADAVTPWVVGEIAWFCEQVAKAEADNLDDKKLLKVLKEDIAAIRVNLQQGVDIALSGRMATSGMMSELGKVDGAMSIAHAITTHQVDSDIDWFTAVDDLQEQGSAHLGTQEFSSGVFYRYANINLAQLQENLGGASREQALEIATHVVHMLATEVPGAKQRTYAAFNPADMVMVNFSDMPLSMANAFEKAVKAKDGFLQPSIQAFNQYWDRVANGYGLNGAAAQFSLSDVDPITAQVKQMPTLEQLKS

SEQ ID NO: 6952 - protein, 363 aa, Escherichia fergusonii
MSNFINIHVLISHSPSCLNRDDMNMQKDAIFGGKRRVRISSQSLKRAMRKSDYYAQNIGESSLRTIHLAQLRDVLRQKLGERFEQKIIDKTLALLSGKSVDEAEKISADAVTPWVVGEIAWFCEQVAKAEADNLDDKKLLKILKEDIAAIRVNLQQGVDIALSGRMATSGMMSELGKVDGAMSIAHAITTHQVDSDIDWFTAVDDLQEQGSAHLGTQEFSSGVFYRYANINLAQLQENLGGASREQALEIATNVVHMLATEVPGAKQRTYAAFNPADMVMVNFSDMPLSMANAFEKAVKAKDGFLQPSIQAFNQYWDRVANGYGLNGAAAQFSLSDVDPITAQVKQMPTLEQLKSWVRNNGEA

SEQ ID NO: 6953 - protein, 363 aa, Escherichia
MSNFINIHVLISHSPSCLNRDDMNMQKDAIFGGKRRVRISSQSLKRAMRKSDYYAQNIGESSLRTIHLAQLRDVLRQKLGERFEQKIIDKTLALLSGKSVDEAEKISADAVTPWVVGEIAWFCEQVAKAEADNLDDKKLLKILKEDIAAIRVNLQQGVDIALSGRMATSGMMSELGKVDGAMSIAHAITTHQVDSDIDWFTAVDDLQEQGSAHLGTQEFSSGVFYRYANINLAQLQENLGGASWEQALEIATHVVHMLATEVPGAKQRTYAAFNPAEMVMVNFSDMPLSMANAFEKAVKAKDGFLQPSIQAFNQYWDRVANGYGLNGAAAQFSLSDMDPITAQVKQMPTLEQLKSWVRNNGEA

SEQ ID NO: 6954 - protein, 363 aa, Enterobacteriaceae
MSNFINIHVLISHSPSCLNRDDMNMQKDAIFGGKRRVRISSQSLKRAMRKSDYYAQNIGESSLRTIHLAQLRDVLRQKLGERFEQKIIDKTLALLSGKSVDEAEKISADAVTPWVVGEIAWFCEQVAKAEADNLDDKKLLKVLKEDIAAIRVNLQQGVDIALSGRMATSGMMSELGKVDGAMSIAHAITTHQVDSDIDWFTAVDDLQEQGSAHLGTQEFSSGVFYRYANINLAQLQENLGGASREQALEIATHVVHMLATEVPGAKQRTYAAFNPADMVMVNFSDMPLSMANAFEKAVKAKDGFLQPSLQAFNQYWDRVANGYGLNGAAAQFSLSDVDPITGQVQQMPTLEQLKSWVRNNGEA

SEQ ID NO: 6955 - protein, 363 aa, Escherichia coli
MSNFINIHVLISHSPSCLNRDDMNMQKDAIFGGKRRVRISSQSLKRAMRKSDYYAQNIGESSLRTIHLAQLRDVLRQKLGERFEQKIIDKTLALLSGKSVDEAEKISADAVTPWVVGEIAWFCEQVAKAEADNLDDKKLLKVLKEDIAAIRVNLQQGVDIALSGRMATSGMMSELGKVDGAMSIAHAITTHQVDSDIDWFTAVDDLQEQGSAHLGTQEFSSGVFYRYANINLAQLQENLGGASRKQALEIATHVVHMLATEVPGAKQRTYAAFNPADMVMVNFSDMPLSMANAFEKAVKAKDGFLQPSLQAFNQYWDRVANGYGLNGAAAQFSLSDVDPITGQVQQMPTLEQLKSWVRNNGEA

SEQ ID NO: 6956 - protein, 363 aa, Enterobacteriaceae
MSNFINIHVLISHSPSCLNRDDMNMQKDAIFGGKRRVRISSQSLKRAMRKSDYYAQNIGESSLRTIHLAQLRDVLRQKLSERFDQKIIDKTLALLSGKSVDEAEKISADAVTPWVVGEIAWFCEQVAKAEADNLDDKKLLKVLKEDIAAIRVNLQQGVDIALSGRMATSGMMSELGKVDGAMSIAHAITTHQVDSDIDWFTAVDDLQEQGSAHLGTQEFSSGVFYRYANINLAQLQENLGGASREQALEIATHVVHMLATEVPGAKQRTYAAFNPADMVMVNFSDMPLSMANAFEKAVKANDGFLQPSLQAFNQYWDRVANGYGLNGAAAQFSLSDVDPITGQVQQMPTLEQLKSWVRNNGEA

SEQ ID NO: 6957 - protein, 363 aa, Escherichia
MSNFINIHVLISHSPSCLNRDDMNMQKDAIFGGKRRVRISSQSLKRAMRKSDYYAQNIGESSLRTIHLAQLRDVLRQKLSERFDQKIIDKTLALLSGKSVDEAEKISADAVTPWVVGEIAWFCEQVAKAEADNLDDKKLLKVLKEDIAAIRVNLQQGVDIALSGRMATSGMMSELGKVDGAMSIAHAITTHQVDSDIDWFTAVDDLQEQGSAHLGTQEFSSGVFYRYANINLAQLQENLGGASREQALEIATHVVHMLATEVPGAKQRTYAAFNPADMVMVNFSDMPLSMANAFEKAVKENDGFLQPSLQAFNQYWDRVANGYGLNGAAAQFSLSDVDPITGQVQQMPTLEQLKSWVRNNGEA

SEQ ID NO: 6958 - protein, 363 aa, Escherichia coli
MSNFINIHVLISHSPSCLNRDDMNMQKDAIFGGKRRVRISSQSLKRAMRKSDYYAQNIGESSLRTIHLAQLRDVLRQKLSERFDQKIIDKTLALLSGKSVDEAEKISADAVTPWVVGEIAWFCEQVAKAEADNLDDKKRLKVLKEDIAAIRVNLQQGVDIALSGRMATSGMMSELGKVDGAMSIAHAITTHQVDSDIDWFTAVDDLQEQGSAHLGTQEFSSGVFYRYANINLAQLQENLGGASREQALEIATHVVHMLATEVPGAKQRTYAAFNPADMVMVNFSDMPLSMANAFEKAVKANDGFLQPSLQAFNQYWDRVANGYGLNGAAAQFSLSDVDPITGQVQQMPTLEQLKSWVRNNGEA

SEQ ID NO: 6959 - protein, 363 aa, Enterobacteriaceae; identical to SEQ ID NO: 6824

SEQ ID NO: 6960 - protein, 363 aa, Enterobacteriaceae
MSNFINIHVLISHSPSCLNRDDMNMQKDAIFGGKRRVRISSQSLKRAMRKSGYYAQNIGESSLRTIHLAQLRDVLRQKLGERFDQKIIDKTLALLSGKSVDEAEKISADAVTPWVVGEIAWFCEQVAKAEADNLDDKKLLKVLKEDIAAIRVNLQQGVDIALSGRMATSGMMTELGKVDGAMSIAHAITTHQVDSDIDWFTAVDDLQEQGSAHLGTQEFSSGVFYRYANINLAQLQENLGGASREQALEIATHVVHMLATEVPGAKQRTYAAFNPADMVMVNFSDMPLSMANAFEKAVKAKDGFLQPSIQAFNQYWDRVANGYGLNGAAAQFSLSDVDSITAQVKQMPTLEQLKSWVRNNGEA

SEQ ID NO: 6961 - protein, 357 aa, Streptococcus
MTTNQRLFLDIHAIQTLPPSNMNRDDTGSPKTAQYGGVKRSRVSSQAWKRAIRDYFNTNGEQSNVGVRTKDIVRYVAGKIVELDNSISFEDALTKADTVLIATGIKKKGKVKALYFMGDRQAEKLAQAAYENLTDKKELQKLASSNPAIDVAMFGRMVAEDPVLNEDASSQVAHAISTHAVQTEFDFFTAIDDLAPEDNAGAGMLGTIEFNSSTLYRYANVAIHELSKQLEDEKSLKNSLNLFIEAFANSLPTGKVNTFANQTLPQALIVSLRDDRPVNLVSAFEEPVKSTDGYVAKSIEKLSKEYTRVEKFVNKPLLTFYVTLDENESLKQIGEEKYSVSELLKDLSEILGQFLKK

SEQ ID NO: 6962 - protein, 357 aa, Streptococcus; identical to SEQ ID NO: 6895

SEQ ID NO: 6963 - protein, 357 aa, Streptococcus; identical to SEQ ID NO: 6882

SEQ ID NO: 6964 - protein, 406 aa, Streptococcus mutans
MTTNQEKLFLDIHVIQTLPPSNINRDDTGGPKTAQYGGVRRARVSSQSWKRAMREYLVNSLKLENTSARTVKIVEYIAKQIQLIDQSIEIDTAKKLVKEMLERVVKKKSGKDEKIFVIDNEYKLSALFFISKFQSIKLAELALNPEFVEICNKFDALSGKVKEDKEYKKSKEYKEIDAAYKIQMKKIKEILNELLSIDIAFFGRMLASDPSLNEDASSQVAHAISTHAIQTEFDFFTAIDDLAPEDNAGAGMLGTVEFNSSTLYRYANIAIHELESQLDDGESAVNALKLFVEAFAKSLPTGKVNTFANQTLPQALVVTVRNDRPVNLVSAFEEPVKSSNGYVTKSIEKLSKEFVKVEKMVKKPVLSFYVSLEEVEALTKVGIEKNSITELVEDFSQELSELIQNR

SEQ ID NO: 6965 - protein, 365 aa, Atlantibacter hermannii
MNNFINFHVLISHSPSCLNRDDMNMQKDAVFGGKRRVRISSQSLKRAMRKSDYYARHIGASSLRTIHLEELRDVLRQKLSPRFELPIIDKTLSLLSGKTIDDAEKINGDAVTPWVLGEVEWFCEQVMKAEAEQLDDKKLLKMLKDDIAAMRTNLQQGVDVALSGRMATSGLMSELGKVDGAMSIAHAITTHTVDSDIDWFTAVDDLQDLGSAHLGTQEFSSGVFYRYASLNIAQLQENLGGVSREQVLEIAAHLAHMLATEVPGAKQHTFAAFNPADMVMINFSDFPLSLANAFESPIKAKDGYLLPSINAFNEYWQRIAKGYGLTGPAAQFMLAEASMAGGNVVSVETLEQLKKWICHDGEASR

SEQ ID NO: 6966 - protein, 374 aa, Cutibacterium acnes; identical to SEQ ID NO: 6852

SEQ ID NO: 6967 - protein, 374 aa, Cutibacterium acnes; identical to SEQ ID NO: 6876

SEQ ID NO: 6968 - protein, 357 aa, Streptococcus ratti
MTTSQSKLFLDIHVIQTLPPSNINRDDTGSPKTAQYGGVRRARVSSQSWKRVMREYFNTNGKQSNVGIRTKEIVQYIADKMMELDSAISNDDALKKADNILNKGGIKTKDFKSKALFFLSDTQAKQLAQAAIDSVNDKKELQKMITSSPAIDIALFGRMVADDPSLNEDASSQVAHAISTHAVQTEFDFFTAVDDLAPEDNAGAGMLGTVEFNSSTLYRYANVAIHDLALQLDDTESVVNAVKLFVEAFANSLPTGKVNTFANQTLPQTLVVTVRTDRPVNLVSAFEKPVKSSEGYVKESIEKLANEFTKVEKMVKKSDLTFYVSLEEVAELSTIGVEKNSLPELLEDLSKELVNLM

SEQ ID NO: 6969 - protein, 362 aa, Gardnerella vaginalis
MNAHLFLDIQAIQTVPPCNINRDDAGSPKTAQYGGVTRTRISSQCWKHSMREYFKEHSGDSNVGIRSKNIVKYVADKIITLKPELSEQEALDLADKTLNTAGVKTKTDKGETVPTAKALFFLGETQANSLAQAAINNVTDKKQLQEILRDNPPIDIALFGRMLADDPSLNEDASSQVAHAISTHAVRAEFDYYTAVDDLSTEDNAGAGMLGTIEYNSSTLYRYANVAVHEFSHQLSDNKESTINALRLFIEAFANAMPTGKANTFANQTLPQMLVVTLRDDRPVNLVSAFEDPVKSKDGYVSKSIDKLSQEYEKVQKFVHKPLASFYVTMDSSNENLKLGVEEQSMQQLLDDFSSKVSEFLQ

SEQ ID NO: 6970 - protein, 362 aa, Gardnerella vaginalis
MNSRLFLDIQAIQSVPPCNINRDDAGSPKTAQYGGVTRARVSSQCWKHSMRKYFKEHSGDSNVGIRSKNIVKYVADKVIALKPELSEQEALDLANKTLNNAGIKTKTDKGKITPVVNVLFFLGENQANSLAQAAVNNIKDKKQLEEILKDNPPIDIALFGRMLADNQSLNEDASSQVAHAISTHAIRTEFDYYTAVDDLSTEDNSGAGMLGTIEYNSSTLYRYANVAIHEFSHQLSDNKESTINALKLFIEAFANAMPTGKANTFANQTLPQMLVVTLRDDRPVNLVSAFEDPVKAKDGYVSKSIEKLSKEYEKVQKFVNKPLASFYVTMDSSNEEIKLGVEEQSMQQLLDDFSSKVSELLQ

SEQ ID NO: 6971 - protein, 362 aa, Gardnerella vaginalis
MNAHLFLDIQAIQTVPPCNINRDDAGSPKTAQYGGVTRTRISSQCWKHSMREYFKEHSGDSNVGIRSKNIVKYVADKIITLKPELSEQEALDLADKTLNTAGVKTKTDKGETVPTSKALFFLGETQANSLAQAAINNVTDKKQLQEILRDNPPIDIALFGRMLADDPSLNEDASSQVAHAISTHAVRTEFDYYTAVDDLSADDNAGAGMLGTIEYNSSTLYRYANVAVHEFSHQLSDNKESTINALRLFIEAFANAMPTGKANTFANQTLPQMLVVTLRDDRPVNLVSAFEDPVKSKDGYVSKSIDKLSQEYEKVQKFVHKPLASFYVTMDSSNENLKLGVEEQSMQQLLDDFSSKVPEFLQ

SEQ ID NO: 6972 - protein, 362 aa, Gardnerella vaginalis
MNAHLFLDIQAIQAVPPCNINRDDAGSPKTAQYGGVTRARVSSQCWKHSMREYFKEHSGDSNVGIRSKNIVKYVADKIVALKPELSEQEALDLANKTLNNAGVKTKKDNDEIVPTAKALFFLGETQANSLAQAAINDVTNKKQLQEILKDNPPIDIALFGRMLADDPSLNEDASSQVAHAISTHAVRAEFDYYTAVDDLSTEDNAGAGMLGTIEYSSSTLYRYANVAIHEFSHQLSDNKESTINALRLFIEAFANAMPTGKVNTFANQTLPQMLVVTLRDDRPVNLVSAFEDPVKSKDGYVSKSIEKLSQEYEKVQKFVHKPLASFYVTMDSSNEEIKLGVEEQSMQQLLDDFSSKVSEFLQ

SEQ ID NO: 6973 - protein, 362 aa, Gardnerella vaginalis
MNAHLFLDIQAIQTVPPCNINRDDAGSPKTAQYGGVTRTRISSQCWKHSMREYFKEHGGDSNVGIRSKNIVKYVADKIITLKPELSEQEALDLADKTLNGAGVKTKTDKGETVPTAKALFFLGETQANSLAQAAINNVTDKKQLQEILKDNPPIDIALFGRMLADDPSLNEDASSQVAHAISTHAVRAEFDYYTAVDDLSAEDNAGAGMLGTIEYNSSTLYRYANVAVHEFSHQLRDNKESTINALRLFIEAFSNAMPTGKVNTFANQTLPQILVVTLRDDRPVNLVSAFEDPVKSKDGYVSKSIEKLSQEYEKVQKFVHKPLASFYVTMDSSNEEIKLGVEEQSMQQLLDDFSSKVSEFLQ

SEQ ID NO: 6974 - protein, 362 aa, Gardnerella vaginalis; identical to SEQ ID NO: 6907

SEQ ID NO: 6975 - protein, 362 aa, Gardnerella vaginalis
MNSRLFLDIQAIQSVPPCNINRDDAGSPKTAQYGGVTRARVSSQCWKHSMREYFKEHSGDSNVGMRSKNIVKYVADKIITLKPELSEQEALDLANKTLNNAGFKTKTDKGKIIPVVNVLFFLGENQANSLAQAAINNVTDKKQLEEILKDNPPIDIALFGRMLADNPSLNEDASSQVAHAISTHAVRAEFDYYTAVDDLSVDDNAGAGMLGTIEYNSSTLYRYANVAIHEFSHQLSDNKESTINALKLFIEAFANAMPTGKVNTFANQTLPQMLVVTLRDDRPVNLVSAFEDPVKAKDGYVSKSIEKLSQEYEKVQKFVHKPLASFYVTMDSSNKEIKLGVEEQSMQQLLDDFSSKVSELLQ

SEQ ID NO: 6976 - protein, 362 aa, Gardnerella vaginalis; identical to SEQ ID NO: 6827

SEQ ID NO: 6977 - protein, 364 aa, Erwinia amylovora
MNNFINCHVLISHSPSCLNRDDMNMQKDAVFGGKRRVRISSQSLKRAIRKSAYYQQHLGESSMRTIHLADLRNVVHARLADKYAAGDIDKALSLLSGKAIDGAEKIDGGAVSPWVMDEIDWFCQQVAQPEYADFDEKKWAKLLKEQINALRGTLNNAVDVALSGRMATSGLMSEVGNVDGAMSLAHAITTHAVEADIDWFTAVDDLKETTGAAHLGTQEFSSGVFYRYASLNLSQLQQNLGGASREQALTIAAHLVHMLATEIPGAKQHSFAAFNPADLVMVNFSDFPLSLANAFEQPVVAKRDGFLQPSVAALNDYWARVAAGYGIDGPTAQFNLAEGEMPAGVQRMAGLAALKTWVSSNGEG

SEQ ID NO: 6978 - protein, 358 aa, Peptostreptococcus anaerobius; identical to SEQ ID NO: 6902

SEQ ID NO: 6979 - protein, 374 aa, Cutibacterium avidum
MSSYYVDIHVLQSVPPSNVNRDDTGSPKSALYGGVRRARVSSQAWKKAVRTSFKDFLPASQTGARTLRAVELLMNRLTADPYRLAQEDARQKALAVVKALGLKADKPRVKEGSGPEGVERTQYLVFYSNQQLDRLAQLAATSEGKISSSDAKKAADSDHGVEVALFGRMVADSKCLNVDSAVQVAHALSTHAVEIESDYFTAVDDYKLDEDDAGAGMIGTVEFTSETLYRFATVAVSTLEDNLGDVDLTADAAAAFVRGFVVSMPTGKQNTFANNTLPDAVVVQIRKGRSASFVGAFEDAITSTTGGFVEASCKALASYAHDCEEAFLGAPVASFVTRVGTRTEAVSDMGTAMPIDELVSSVRDQVATVLRAQS

SEQ ID NO: 6980 - protein, 359 aa, Anaerococcus lactolyticus; identical to SEQ ID NO: 6844

SEQ ID NO: 6981 - protein, 355 aa, Anaerococcus prevotii; identical to SEQ ID NO: 6887

SEQ ID NO: 6982 - protein, 316 aa, Shigella boydii
MRKSDYYAQNIGESSLRTIHLAQLRDVLRQKLGERFEQKIIDKTLALLSGKSVDEAEKISADAVTPWVVGEIAWFCEQVAKAEADNLDDRKLLKVLKEDIAAIRVNLQQGVDIALSGRMATSGMMSELGKVDGAMSIAHAITTHQVDSDIDWFTAVDDLQEQGSAHLGTQEFSSGVFYRYANINLAQLQENLGGASREQALEIATHVVHMLATEVPGAKQRTYAAFNPADMVMVNFSDMPLSMANAFEKAVKANDGFLQPSLQAFNQYWDRVANGYGLNGAAAQFSLSDVDPITGQVQQMPTLEQLKSWVRNNGEA

SEQ ID NO: 6983 - protein, 352 aa, Faecalibacterium prausnitzii; identical to SEQ ID NO: 6837

SEQ ID NO: 6984 - protein, 352 aa, Faecalibacterium; identical to SEQ ID NO: 6873

SEQ ID NO: 6985 - protein, 364 aa, Desulfuromonas acetoxidans
MKNYVNFHILISHSPSCLNRDDMNMQKSAIFGGVRRVRVSSQSLKRAMRKSDYYADNLGEGSIRTKHLSQLRDRFIAELEGRFPVEIIEKTMKLLIEKDVAVDGIVEGDAVAPWALEEFSWFCEQVKKAQNEGVDDKALIKQLKDSVESMRKTLVGGLDIALSGRMATSGLLSELGQVDGALAMAHALTTHAVDSDIDWFTAVDDLQEQGSGHLDTQEFSSGVFYRYASLNLGQLQENLGNASREKALEIASHLLYMMATVVPSAKQQSFAAHNVADLALVSFSDLPISLANAFEKPIMQHNGSGFREPSMTALQDYWQRVHIGYGLDEQCAQFSLAKSEIPEGIAVKTNLEELKTWVRNNGEG

SEQ ID NO: 6986 - protein, 356 aa, Fannyhessea vaginae; identical to SEQ ID NO: 6889

SEQ ID NO: 6987 - protein, 262 aa, delta proteobacterium NaphS2; identical to SEQ ID NO: 6860

SEQ ID NO: 6988 - protein, 374 aa, Kineosphaera limosa
MTNSPSLFIDVHVLQTVPPSNLNRDDTGTPKSAWYGGVQRARVSSQAWKKATRADFKAHLDAADLAHRTKWVIDQLTERLQRLDPSLADDAAYARAQAVLKAVGFQKFEKPRTGERKDQELLTEYLAFFSTRQLDRLAELAAATDKPSKKDAQTAADTDHGIEIALFGRMVANAPDINVDAACQVAHAISTHAATVEHDYYTAVDDFAPDDNTGAGMLGTIEYTSATLYRYATIAMDRLTENLGTSESAVAAARAFIDAFVRSMPTGKQNTFGNRTPVDAVVVQVRRGQPINLVGAFEDAIVADSGYVEPSARALAEYAEQVWAAYDRPLASFVVRVSPKASALDGLGEPTTLQELGAGVANAVHVESGSAGDA

SEQ ID NO: 6989 - protein, 360 aa, Lactobacillus iners; identical to SEQ ID NO: 6874

SEQ ID NO: 6990 - protein, 368 aa, Lachnoanaerobaculum sp. OBRC5-5
MNSRLFLDMHIIQTLPPSNINRDDTGSPKTALYGGVRRARVSSQSWKAAMRNYFKESGEVANVGVRTKDIVSYVAGKIREINSTILEKEAMDRAAEAIEKAGIKLKDNKDKSAKEAKALFFLGENQAKDIAKIAAEAEEDAKGKLVLDKDLLQKVLNDNVAIDIALFGRMVADDPSLNEDASSQVAHAISTHGVQTEFDYFTAADDLSPEDNAGAGMIGNVEYNSSTLYRYANVALHEFLHQLKDRGSMINATKLFVEAFAKSLPTGKVNTFANQTLPSILVINLREDRPVSLVSAFESPVKSEEGYVAGSIKRMSDEMEKIQKFVQKPVKTLYLAIDNVDITDGEEVDSLDELLEKLGVEIENYQFS

SEQ ID NO: 6991 - protein, 366 aa, Streptococcus ictaluri
MLKEKKTLPNNQHLFLDIHAIQTLSPSNINRDDTGSPKTAQYGGVRRARVSSQSWKRAMRRYFSGNKQQSDVGVRTKDIVKYVADKIIELDKSISAEDALNKADKVLNGAGVKTKDFKAKALFFLSSVQARNLAQAAIDNVTDKKVLHDILNSNVAIDIALFGRMVADDPSLNEDASSQVAHALSTHAVQTEFDFYTAVDDLAPEDNAGAGMLGTIEFNSSTLYRYANVAVHELLEQLKDRENLVNTLNLFIEAFAKSLPTGKVTSFANQTLPQALVVTLRNDRAISLVSAFEKPIKSSEGYVRKSIEKLSSEFIKVEKFVNEPVLTFYVALEDVEALKSTGGIEKNSISELLNDFYQELSHLIQE

SEQ ID NO: 6992 - protein, 355 aa, Streptococcus sp. C150; identical to SEQ ID NO: 6884

SEQ ID NO: 6993 - protein, 368 aa, Lachnoanaerobaculum saburreum; identical to SEQ ID NO: 6883

SEQ ID NO: 6994 - protein, 359 aa, Peptoniphilus duerdenii; identical to SEQ ID NO: 6869

SEQ ID NO: 6995 - protein, 405 aa, Streptomyces ipomoeae; identical to SEQ ID NO: 6901

SEQ ID NO: 6996 - protein, 362 aa, Peptoniphilus sp. oral taxon 836; identical to SEQ ID NO: 6863

SEQ ID NO: 6997 - protein, 361 aa, Megasphaera genomosp. type_1; identical to SEQ ID NO: 6854

SEQ ID NO: 6998 - protein, 359 aa, Oribacterium sp. oral taxon 108; identical to SEQ ID NO: 6892

SEQ ID NO: 6999 - protein, 359 aa, Stomatobaculum longum
MDKNRLFVDLHVIQTVPPSCINRDDTGSPKTAIYGGTTRARVSSQAWKHAMREYFKEVMTEEELSKRSKRVVGLLAEEIQKLNSGLNGEKLAIDALTKAGLKVKIDEKKGKKAELDALFFISSAQIQALAQLAVDGCEEKESFKKALKDIPGFEIALFGRMVAADPSLNYDAASQVAHSISTHAVHSEYDYFTAVDDLAPEDNAGAGHLGTVEFNSSTLYRYATVNVSELKKWVKNPEQIVRVFAEAFIYAMPTGKQNTFANRTVPDAVYITIREDQPVNFSGAFEEAVMSRNGYSKASIERIQEYAEKSYRNFVEIPTYALGTGEGIERLCVTKSVKENLETLENCVRELLDKAGEAE

SEQ ID NO: 7000 - protein, 359 aa, Oribacterium parvum
MSKEKLFLDIHVIQTLPPSNINRDDTGSPKTAVYGGVRRARVSSQSWKKAMRDYFKENGNLSNVGVRSLDVVSFLAEKIRELKPELSMEDAVNKSVKTFNAAGISTTKDNRVKALFFLGKEQADNLAKEAVKDNLDKKVLQEILNSNIAIDIALFGRMVADDASLNEDASAQIAHAISTHGVQSEFDFYTALDDLSKEDQSGAGMLGTIEYNSSTLYRYGNVALHEFYHQLNENKSQTIEATKLFVEAFLNSLPTGKMNSFANQTVPSSVVISLRKDRPVSFVSAFETAIKTKLSQEGYVNESIEAMFKEHKNVQRFVEKPEISFYLNLSEGHSLEGAKEELSLSDLLHDLGEELDNRL

SEQ ID NO: 7001 - protein, 368 aa, Lachnoanaerobaculum sp. ICM7
MNSRLFLDMHIIQTLPPSNINRDDTGSPKTALYGGVRRARVSSQSWKAAMRNYFKECGEVANVGVRTKDIVSYVAVKIREINSTVLEKEAMDRAAEAIEKAGIKLKDNKDKSAKEAKALFFLGENQAKDIARIAAEAEVDAKGKLVLDKESLQKVLNDNVAIDIALFGRMVADDPSLNEDASSQVAHAISTHGVQTEFDYFTAADDLSPEDNAGAGMIGNVEYNSSTLYRYANVALHEFLHQLKDKGSMINATKLFVEAFVKSLPTGKINTFANQTLPSILVINLREDRPVSLVSAFESPVKSEEGYVVGSIKRMTDEMKKIQKFVQKPVKTLYLSIDNVDITDGEEVDSLDELLEKLGVEIENYQFS

SEQ ID NO: 7002 - protein, 371 aa, Lachnospiraceae bacterium oral taxon 082; identical to SEQ ID NO: 6897

SEQ ID NO: 7003 - protein, 364 aa, Finegoldia magna
MKNKLYLDIHALQVLPPSNVNRDEFGNPKSALYGGVNRSRVSSQSWKRAIREYFYENSEIQNLGVRTLKLPDYIADKMLEIDSSIPREEAIKKAGKVLKSAGISTKLKDVDDEGEKTLVLESLFFISDKQALELAQAAVKGDVPKPDIIDSIKNNMSIDIALFGRMVASSKNLNVEASCQVAHAISTHEVNSEVDYFTAVDEYTKDPGAAMIGNSNFNASTLYRYSNIAIHDLFEQIHDKETLINSIKLFIKAFCLSMPSGKINSYANQTLPSFLSIDIRSDRPMNLVSAFEEPVVSNSGYTKKSIEKLSDEHKKLNKFYDKPLLSSFISFDDIECLNEFGNEADNLNNLAENVANFLKDNLGD

SEQ ID NO: 7004 - protein, 364 aa, Erwinia pyrifoliae
MNNFINCHVLISHSPSCLNRDDMNMQKDAVFGGKRRVRISSQSLKRAMRKSAYYQQHLGDSSMRTIHLADLRHVVHARLADKHTADIIDKALSLLSGKTIDGAEKIDGGAVSPWVMDEIDWFCQQLTLPEYADFDEKKWTKLLKEQINALRATLNNAVDVALSGRMATSGLMSEVGNVDGAMSVAHAITTHAVEADIDWFTAVDDLKETTGAAHLGTQEFSSGVFYRYASLNLSQLQQNLGGATREQALTIAAHLVHMLATEIPGAKQHSFAAFNPADLVMVNFSDFPLSLANAFEQPVVAKKDGFLQPSVAALNDYWARVAAGYGIDGPTAQFSLAESAMPVGVQRMAGLAALKTWVSSHGEG

SEQ ID NO: 7005 - protein, 362 aa, Gardnerella vaginalis; identical to SEQ ID NO: 6826

SEQ ID NO: 7006 - protein, 359 aa, Streptococcus mutans
MTISNNQDRLFLDIYAIQTLPPSNINRDDTGSPKTTQYGGVRRARVSSQSWKKAMRDYFYEHAEEEQLGKRTRKVVNYVAEKIIHQKIDLNEKESSKLATDILKLAGVPTDGKVLFFIGNTEAEKLATAAVKGVKDKEEARKIMQSNLALDVALFGRMVANDKETEADASSQFAHPISTHAVQTEFDFYTAVDDLASDDDAKAGMLGTVEFNSSTLYRYANVAIHEFLVQRGNREDLVDSLQLFIKAFAESMPRGKINSFANQTIPQTLIITVRSDRPVNLVSAFEEPVKSSNGYVTKSIEKLSKEFVKVEKMVKKPVLSFYVSLEEVEALTKVGIEKNSITELVEDFSQELSELIQNR

SEQ ID NO: 7007 - protein, 353 aa, Clostridium sp. SY8519
MAENRFYLDMHVIQTLPPSNVNRDDTGSPKTAVYGGVRRARVSSQAWKRAMRKYFLNESEEDLGVRSLDVVKYVSDRIRAADPSVNEENAMDMSEKLFNVAGIKTKDQKTKALFFLGKKQAEELAAAAIQGETDKKTVQEIFRSNPAVDIALFGRMVADDPSLNEDASAQVAHAISTHGVQTEFDFYTAVDDLAPEDNAGAGMLGTIEYNSSTLYRYANIAMHELSKQLADKEQTIHAAKLFVEAFANSMPTGKANTFANQTLPQLLMINIRQDRPVNLVSAFENPISSKNGIVVPSINRLFDEVKKTEKFVSVPVKSFYVVDEDVNKPEWAVEEDTLSDLLNDFAEAAGMLL

SEQ ID NO: 7008 - protein, 355 aa, Streptococcus
MTTEQRLFLDIHAIQTLPPSNMNRDDTGSPKTAQYGGVRRSRVSSQSWKKAMREYFNTHGDQSNVGIRTKEIVRYVADKIVELDSSISIEDALEKADKVLIAAGIKKKGEVKALYFMGDSQAKKLAQAAYDNITDKKELQKLANADPAIDIALFGRMVAEDPTLNEDSSSQVAHAISTHPVQTEFDFFTAVDDLAPKDNAGAGMLGTVEFNSSTLYRYANVAIHELSKQLGNKESLDNSLSLFIEAFAKSLPTGKVNTFANQTLPQTLIVTVRSDRPVNLVSAFEEPVKSIEGYVTRSIDKLAKEFIKVEKFVDKPLMTFYVTLHESDSLKQIGEEKDSVSKLLEDFSEMIAQYI

SEQ ID NO: 7009 - protein, 364 aa, Erwinia sp. Ejp617
MNNFINCHVLISHSPSCLNRDDMNMQKDAVFGGKRRVRISSQSLKRAMRKSAYYQQHLGDSSMRTIHLADLRHVVHARLADKHAAEIIDKALSLLSGKTIDGAEKIDGGAVSPWVMDEIDWFCQQVALPEYADFDEKKWTKLLKEQINALRATLNNAVDVALSGRMATSGLMSEVGNVDGAMSVAHAITTHAVEADIDWFTAVDDLKETTGAAHLGTQEFSSGVFYRYASLNLSQLQQNLGGATREQALTIAAHLVHMLATEIPGAKQHSFAAFNPADLVMVNFSDFPLSLANAFEQPVVAKKDGFLQPSVAALNDYWARVAAGYGIDGPTAQFSLAESAMPVGVQRMAGLAALKTWVSSHGEG

SEQ ID NO: 7010 - protein, 304 aa, Streptococcus salivarius; identical to SEQ ID NO: 6831

SEQ ID NO: 7011 - protein, 362 aa, Gardnerella vaginalis; identical to SEQ ID NO: 6905

SEQ ID NO: 7012 - protein, 362 aa, Gardnerella vaginalis; identical to SEQ ID NO: 6911

SEQ ID NO: 7013 - protein, 152 aa, Lactobacillus otakiensis; identical to SEQ ID NO: 6946

SEQ ID NO: 7014 - protein, 234 aa, Lactobacillus otakiensis; identical to SEQ ID NO: 6947

SEQ ID NO: 7015 - protein, 362 aa, Gardnerella vaginalis; identical to SEQ ID NO: 6908

SEQ ID NO: 7016 - protein, 362 aa, Gardnerella vaginalis; identical to SEQ ID NO: 6910

SEQ ID NO: 7017 - protein, 362 aa, Gardnerella vaginalis; identical to SEQ ID NO: 6912

SEQ ID NO: 7018 - protein, 325 aa, Actinobaculum sp. oral taxon 183; identical to SEQ ID NO: 6915

SEQ ID NO: 7019 - protein, 384 aa, Actinomyces sp. oral taxon 877; identical to SEQ ID NO: 6916

SEQ ID NO: 7020 - protein, 359 aa, Streptococcus sobrinus; identical to SEQ ID NO: 6917

SEQ ID NO: 7021 - protein, 359 aa, Peptostreptococcaceae bacterium oral taxon 113; identical to SEQ ID NO: 6918

SEQ ID NO: 7022 - protein, 358 aa, Ruminococcus callidus; identical to SEQ ID NO: 6919

SEQ ID NO: 7023 - protein, 366 aa, Salmonella enterica; identical to SEQ ID NO: 6941

SEQ ID NO: 7024 - protein, 248 aa, Escherichia coli
VGEIAWFCEQVAKAEADNLDDKKLLKVLKEDIAAIRVNLQQGVDIALSGRMATSGMMSELGKVDGAMSIAHAITTHQVDSDIDWFTAVDDLQEQGSAHLGTQEFSSGVFYRYANINLAQLQENLGGASREQALEIATHVVHMLATEVPGAKQRTYAAFNPADMVMVNFSDMPLSMANAFEKAVKAKDGFLQPSLQAFNQYWDRVANGYGLNGAAAQFSLSDVDPITGQVQQMPTLEQLKSWVRNNGEA

SEQ ID NO: 7025 - protein, 362 aa, Gardnerella vaginalis 409-05; identical to SEQ ID NO: 6826

SEQ ID NO: 7026 - protein, 381 aa, Oceanithermus profundus DSM 14977; identical to SEQ ID NO: 6828

SEQ ID NO: 7027 - protein, 377 aa, Coriobacterium glomerans PW2; identical to SEQ ID NO: 6829

SEQ ID NO: 7028 - protein, 357 aa, Sphaerochaeta coccoides DSM 17374; identical to SEQ ID NO: 6830

SEQ ID NO: 7029 - protein, 304 aa, Streptococcus salivarius 57.I; identical to SEQ ID NO: 6831

SEQ ID NO: 7030 - protein, 427 aa, Thiocystis violascens DSM 198; identical to SEQ ID NO: 6832

SEQ ID NO: 7031 - protein, 359 aa, Lactobacillus buchneri CD034; identical to SEQ ID NO: 6833

SEQ ID NO: 7032 - protein, 376 aa, Mycobacterium smegmatis JS623; identical to SEQ ID NO: 6834

SEQ ID NO: 7033 - protein, 224 aa, Escherichia coli str. K-12 substr. MG1655
MRSYLILRLAGPMQAWGQPTFEGTRPTGRFPTRSGLLGLLGACLGIQRDDTSSLQALSESVQFAVRCDELILDDRRVSVTGLRDYHTVLGAREDYRGLKSHETIQTWREYLCDASFTVALWLTPHATMVISELEKAVLKPRYTPYLGRRSCPLTHPLFLGTCQASDPQKALLNYEPVGGDIYSEESVTGHHLKFTARDEPMITLPRQFASREWYVIKGGMDVSQ

SEQ ID NO: 7034 - protein, 226 aa, Geobacter sulfurreducens PCA
MRDYLILKLQGPMQSWGEHTFEGKRPSGNFPTRSALLGLLGACLGIRRNEAGRLQQLADSVAFAVRKEERFRIRHDGRKTSLPIIKATDYHTVRDAREDYFGLKSHETIQTWREYLFDATYTVAVWNTDVATISLVELEQAVKSPHFTPYLGRRSCPLSRPLFEMSFSAANACDALRMIPSDGGVIYSEEPGETRTIRLRDVPLVRQPRQFASRNVHVYGGVDVSE

SEQ ID NO: 7035 - protein, 244 aa, Pelobacter carbinolicus DSM 2380
MKHLVFRLYGPLAAWGEIAVGESRHSAVYPSKSALLGLLAAALGIRRDEEEQQAALAAGYLFAVKVLRTGSLLRDYHTTQVPDSAGKVVYRTRREELIRGKARLGTILSSREYRCDSMALVAVRANANAPFTLETIREKLLKPAFLLYLGRKSCPLAAPLDPVVSDWDSFGQALDEAELKALMVEPDDEQRWIPVEYQTRYYWEGEDSSLKAQQVLTRHDQPFSRRRWQFSQRAENLCIGKGEG

SEQ ID NO: 7036 - protein, 238 aa, Corynebacterium aurimucosum ATCC 700975
MTSSLLLLLKAPLQSWGNESRYATRTTSQIPSKSGVLGMLAAAEGRRRTDGIEDLARLTFAVRVDQSGSLLRDYQTAQDWQRNPNASAKLVTRYFLSDAAFVAAIEAEDRGLLEGLAEALNKPAFPIFLGRRSCPAPPNLVQGIDDIPAVESLQAHSTWHATKEYMKTCGEKVALPIYRDAKPGELGESLQDVPVSFDPRHRKYSWRTVVQRESAMVDNPLDASQLRPDPFMEAVMNA

SEQ ID NO: 7037 - protein, 291 aa, Gardnerella vaginalis 409-05
MKSLLLKFSGPLQSWGTDSHFETRHTDYYPSKSAVIGMIAAAFGYRRSTDCDENIAKLNDLDFAVRIDQQGNLLRDYHIAAKYKANGDFEKNYVTNRYYLEDAIFLVAIGSNNEQLIYDISNALRSPYFQSSLGRRSLPPTADFILGVEDCGVIQALLTHEWLANKWSKKRFNTSKLSEASESSNESCNEVFISLYADSVLVDKAASELVKDDNTTYKIQESVRRLRKDYVNSFSNKERKFGFRYESKMEIPIEKISHNNLDSEDISSDSKHLKSVGEFIAEHDAFSGLES

SEQ ID NO: 7038 - protein, 234 aa, Mobiluncus curtisii ATCC 43063
MSYSLLLLLKGPLQSWGDESRYTTRATGSTPSKSGVIGLLAAAQGRHRTDPLEDLVRLDYAVRVDQSGALLRDYQTSQPWQKDPNASAKLVSRYFLSDAAFVAAIGAENRSILEGLQGNLYQPAYPLFLGRRSCPAPANLDLGIVEGNVVTALMEHEEWHATLSHKKERGEEVLLPIYRDGKPGEAGTPRQDVPISFSQEHRRYGWRTVVYAGAKQIKNEYGTSLDPFFEAVIS

SEQ ID NO: 7039 - protein, 226 aa, Geobacter sulfurreducens KN400; identical to SEQ ID NO: 7034

SEQ ID NO: 7040 - protein, 291 aa, Gardnerella vaginalis ATCC 14019
MKSLLLKFSGPLQSWGTDSHFETRHTDYYPSKSAVVGMIAAAFGYRRSADCDEAIAKLNDLDFAVRIDQQGNLLRDYHIAAKYKSNGDFEKNYVTNRYYLEDAIFLVAIGSDNEQLIYSINDALRSPYFQSSLGRRSLPPTADFILGVEDCGVIQALLTHEWLANKWSKKRFNTFRLSDSSESADESCNEVFISLYADSDLVDKAAAELVKDDTSTYKIQGSVRRLRKDFVNSFSNKERKFGFRYESKVEIPIKRILHNNSDSEGISSDSKHVKSTGDFIAEHDAFSGLES

SEQ ID NO: 7041 - protein, 219 aa, Oceanithermus profundus DSM 14977
MATLLVQLYGPMQSWRTGPRLERRPTQPLPTKSGVIGLLAGALGRPRGSDIADLTALRMGVRVDRPGVLEVDYQTVKNVVQAKGRGLKDAQTWRTYLADAAFLVGLEGERAPLKELAQALQAPHFVPYLGQKGFYPAAPLYRGLRLELGLEGALESEPLIVPARESRSVDVYVDDPEGELLVHDAPERALAEFGTPRTIGVRAVRRYQIVARPTQEETA

SEQ ID NO: 7042 - protein, 234 aa, Deinococcus proteolyticus MRP
MAILLLRLVAPMQAWGSRSRFDDRDTEAEPTKSGVLGLCAAALGIDRADPIDDLTRLRFGVRVDREGGAGRDYHTAQLKPGDPKTKTDVTTRFYLSDAAFWAGLEGEDRAFLQRLYAALHNPHWPLSLGRKAFQASLPIFAGPPQDTPLWEALQQAPSLRREPSEQAYRFVLDREAVPAERRAKASPSRRQDVPDGPFAHRHYLSREVLTLTGPLEVAPDPLVHRHWQAPEEVS

SEQ ID NO: 7043 - protein, 234 aa, Coriobacterium glomerans PW2
MAVLLLRLSGPLQSWGDSSRFTRRATRREPTKSGVIGLLASALGRTREESLNDLAKLEFGVRIDQQGNMLRDFQTERSLDGKTTMPLSNRYYLADAIFLAALHGKLDVLHKLDEAIQNPRWPLYLGRRSCPPDPPISLGVHEEYKDVRQALQQMNWIASSRCKRRLAQHRQLEIACDAREGEPYSRQADLPLSFSKSGRTYEDRRVYRAWIDNPDWGQEDIAKIASNHDPLCAC

SEQ ID NO: 7044 - protein, 221 aa, Marinithermus hydrothermalis DSM 14884
MPTLLLRLQGPMQSWGTRSRFDHRDTWPYPTKSGVLGLLAAALGRDRKEDISDLAALRMGVRVDQKGVLKVDYQTARNVLAADGRALRDVQSWRYYLSGAAFLAGVEGTEELLQQIHQALRNPRFPLYLGRKSYLPSPPPYLPDGLRPEELEEALRGYPYLLKEKPREDLLLALEAPPEQGRLVYDQPLAPFAQRRFGARYVREIVLPKEEVRLVDQQAGT

SEQ ID NO: 7045 - protein, 241 aa, Salmonella enterica subsp. enterica serovar Typhi
MKEYLVFQLYAPLASWGEEASGEIRHSATVPTRSALLGLLAAALGIRRDEEARLNNFNRHYHLAVHALASQDRWLRDYHTVSAPRENKKYRYYTRRDELTLASDEVGTLISQREYRCDGYWHVAISATPDAPYSLSELREALLTPHFPLYLGRKSCPLALPLAARLMTGTLKEVFTHAVEEISAAELSGFTLREGICYWDDPDEESLVWQQKQHSNNQPVSRQRWQFGGYTRFNGPLQERT

SEQ ID NO: 7046 - protein, 232 aa, Sphaerochaeta coccoides DSM 17374
MKYLALWLEAPLQSWGSNSKFGRRDTEIFPTKSGIYGLILSAMGKQGPQDDFLARLSSLRQYIIAYSYNTHTKPDILMDFHMVGSGYDASAPWERLLIPKKADGTPAVGGGSKITYRYYLQDVSFGVIQEMHEDFENDVSHALQFPVYDLFLGRKNCVPTEFIYRGCFNSFDEAKEVLDSLKNDKGLKKIYTVEEVNEASPESLIISDVPLQFGDSKMYKERIVLISHDDEY

SEQ ID NO: 7047 - protein, 224 aa, Thermus thermophilus JL-18
MPTLLLRLQGPLQSWGTRSRFDHRDTWPYPTKSGVVGLLAAALGRDRREDVSDLAALRMGVRVDRKGVLKVDYQTAQNVLAADLKAKRDVQSWRYFLSDAAFLVGLEGERALLEALHRALKNPRFPLYLGRKSYVPSPPPYLPDGLVEAPLAEALEGYPYLLGGKPPEDLLLALEAEEGRLVYDQPAGPFSERRFAARFVREEVLPKEKVPEGPPAWEVTRVAH

SEQ ID NO: 7048 - protein, 268 aa, Thiocystis violascens DSM 198
MREYLVFQLYGPLSAWGDIAVGETRPADLAPSKSAVLGLIAAALGLRRPDTTADESQRRQWEAEHLALAEGYGMAAKITLPGLPLTDYHTAQVPSSGSGRNRKVFATRRDELTWMPRHELNTILSRRDYRQDAYAGIALWAREGAPYPLQTLHDRLLAPEFVLYLGRKSCPLALPLNPGIRTADGIEAALDGYGLAQAVKGVIDDRDLSAIKRHLDESKPILCWDSDAETSLEKELTVSRRDLPTSRRRWQFAVREECRAHHTTGAAT

SEQ ID NO: 7049 - protein, 238 aa, Thiocystis violascens DSM 198
MSRHLLLRLEAPLMAFGGETIDNLGIIRDFPALSMVTGLLANALGWRREDTAQHDRLQERLVMGARLERPGVRLQDNQNARLSKDDKGWTTWGKPEERAGGAGTYESPHRRFRDYHADLTMLVALRLEPAEEPPTLDDLATALDHPARPLFIGRKPCLPSHRLFAGWHDGESVLQALRMAPWSHSSPDGARLQWPEGEGTLPGDRVLDLCDERNWTSGVHGGWRPIREGRIRIEGTPA

SEQ ID NO: 7050 - protein, 239 aa, Desulfomonile tiedjei DSM 6799
MRDYAVMQLYGPMASWGDIAVGELRGTWTRPSRSALIGLLSAALGVTRKDHSTLERMVGSYRFAVRVDRQGTLIQDFHTWQRPEPKRGVKYETRKEELEAEDIATGISRRDYCCDARYEVCMWTEGDAPPFSLQEIKEAIAHPRFVLYLGRKSCPLGLPIAVKIIQADSVCEAFERADRQQPKDFLAAIRRQPPLFFSDDCLHIGQIESRDTFTRRDVPLNRTAWQFTERQECFGGSPE

SEQ ID NO: 7051 - protein, 250 aa, Lactobacillus buchneri subsp. silagei CD034
MKTLLIRLTSPLQSYGNEATFSRRTSGDYPSKSAVIGMIAAAFGYHRDDSRITHLNNLSFAVRVDQPGTTLTDFQTVEWKKNTRKITYRNYLQDAVFVVGVGSNNDQQIDNIKEALRRPQFQLFLGRRSNVPAGVLKMTVVPNADPVKALQRLEWQASRWHQRRYLRREQKQYAENVELIADANLLPEQRSAMVKDRVVSFDQRHRQHGYRAFATKTLNRVKLNDSYIQRPDTDVAHNQVETSHDAFDAV

SEQ ID NO: 7052 - protein, 228 aa, Thermus oshimai JL-2
MPTLLLQLRGPMQSWGVRSRFEYRDTWPYPTKSGVVGLLAAALGRDRKEDISDLAALRLGVRVDRKGVLKVDYQTAQGVLAADLRGMRNVQSWRYYLSDAAFLVGVEGEEDLLKELHRALKNPYFPLYLGRKGYVPSPPPYLPDGLRQEGLEEALKAYPCLVPKKPEGGFLLALEAQTGRLVYDQPVGPFSERRFAARYVEERLLPKEEVPEGPPTWEVADVDQQAGA

SEQ ID NO: 7053 - protein, 227 aa, Mycobacterium sp. JS623
MTTLLIRLAGPMQAWGASSRFSRRDTRQEPTKSGVLGLIAAAQGMRRTDGLEHLAALPFGVRVDQAGVLIRDYQTAMTPDGTKPSDRYYLGDAVFVAGIEGDPTVIKEIVAALRNPAFPLYLGRRSCPPSQPLPIAVTEDRLLAALRECPWQAATWYRKKQPKTVQLRMAIDGCSFDEGELVRDVPVSFNPELRQYEWRTVVEEYVETPNPEGAADRHDPMAALEGA

SEQ ID NO: 7054 - protein, 240 aa, Corynebacterium urealyticum DSM 7111
MVHSLLLLLKGPMQSWGDESRFSVRATATTPTKSGIVGLIAAAQGRRRTDGVEDLAKLRIAVRVDQSGSLLRDYQTAQPWLKNPGANASLVTRYFLSDAAFVAAVESEDRELLDQMAEALRRPAYPLYMGRRSCPVHPGLVIGVVDGDAESALRAHDTWHATAVHRKESPKKVSLAIYRDANPGEGGSVPRQDVPVSFSPEHRKYGWREVIRAEDVEIDNPDGDEKSATGDVFFETVMRA

SEQ ID NO: 7055 - protein, 224 aa, synthetic Escherichia coli C321.deltaA; identical to SEQ ID NO: 7033

SEQ ID NO: 7056 - protein, 240 aa, Corynebacterium urealyticum DSM 7109
MAHSLLLLLKGPMQSWGDESRFSVRATATTPTKSGIVGLIAAAQGRRRTDGVEDLAKLRMAVRVDQSGSLLRDYQTAQPWLKNPGANASLVTRYFLSDAAFVAAVESEDRELLDQMAEALRRPAYPLYMGRRSCPVHPGLVIGVVDGDAESALRAHDTWHATAVHRKESPKKVSLAIYRDANPGEGGSVPRQDVPVSFSPEHRKYGWREVIRAEDVEIDNPDGDEKSATGDVFFETVMRA

SEQ ID NO: 7057 - protein, 236 aa, Lactobacillus pasteurii DSM 23907 = CRBIP 24.76
MKTITIRLAGPLQSYGINSTFLVRTTSMFPSKSAVLGMIAAAFGYRRDDRRIEQFNDLLFATRADQVGAVMTDYQVVEYKPGKNKLTYRDYLQDSVFMVAVGGDEQLIDQISYALKHPAFQLALGRRSNCPAGVLKIEEFLNQTPLEVLKTLPWQASTWYQKKCKRQSEILTEIYADQILDDKNKSIDTFMQRDLVGSFSEKHRFHNNRLVASLSVNLKNPCFEEKTPEHDIFSAI

SEQ ID NO: 7058 - protein, 232 aa, Lactobacillus equicursoris DSM 19284 = JCM 14600 = CIP 110162
MKTLTIKLTAPLQSYGNEANFERRTSWPVPSKSAVIGMIGAALGMRRDNPEITKLNDLAFAVRTDQRGKVLTDFHTVEWKTDTRKLTYRDYYQDAVYVVAIGGDDEEIDRIADALKHPKFQLYLGRRSCPPAGILKTNVFEDANPVEALKQLPWQASSWYQKKLRKENYKTEIVADANLIDNPNVTWTEKDRVESFNPRYRHFGFRVLAKTRVELENPSYHASMEHDAFGAV

SEQ ID NO: 7059 - protein, 241 aa, Lactobacillus helveticus CIRM-BIA 101
MKTATIRLTAPLQSYGNQASFNQRTSDNYPSKSAVIGIIAAALGYRRDDARILQLNNLLFAVRIEQSGNMMTEFQTVEYQKSSTKTARKLTYREFIQDAVFMVAIGSDNDHEIEKIVSALKHPKFQLYLGRRSNPPAGPLMIETYDEENPLQVLEKLSWQAEPWYQKRLRAPKFLTRIIADAELNPENNITMIKDKVGSFNQKNRYYQYRPVIIKKKIELDNLEYKSSTDLKTDLDYWSFV

SEQ ID NO: 7060 - protein, 242 aa, Schaalia odontolytica ATCC 17982
MSAVLVLRLAGPMQSWGADSRFTRRSTEAFPTKSALVGLLGAAQGRRRSDPIEDLAELSVAVRVDQPGQLLHDFHTAHRGDTSMPLSHRFYRADAAFGAFIEGPDDMIDALAQAIVRPVFPLYLGRRSCPPTLPLRLAVREGSAWDAVRETPWMASTYYQKKQRHDHFVRMRVVADLGIIPPEVEKVAQQTLQDMPISFDSENRKYTLRTVEETYIDLENPQYVETKLQAHPGLVHDPMEVL

SEQ ID NO: 7061 - protein, 220 aa, Faecalibacterium prausnitzii M21/2
MATLLLRLAAPLQAWGADSKFETRKTGREPTKSGVIGLLAAALGLRRDESEALTRLTGLRFGVRVEREGQLLVDYHTAKTQDEKTSYVTYRHYLQDAVFLAGIESTDTALLQQLQQALLHPAFPLYLGRRCCPPTLPLCLGVCPGSLQEVLQAEPPLCPGRQSRILLDADPLEPGTAPQRDVPVSFDPHHRQYGYRSVRELWQKMPDSPEATEHDPFREL

SEQ ID NO: 7062 - protein, 225 aa, Desulfovibrio piger ATCC 29098
MCAETVCLAIRLEGPLQAWGSASQYNRRLTDLLPSRSAVTGMLCAALGLGRGSTEETDFLREMTGVRMLAVVVPRRMGGTALPVRRLEDYHTVQDTAKADGGLKDCHITRRQYLLDAAFRVFLSGSRALLEKAGAALQDPVWGLWLGRKSCIPTAPVFAGIFADEQAAIAACVPEGLDGCLRSRDALSFAEGTDSVADMPLSFASSARAFALRRVRLDHGDEDAS

SEQ ID NO: 7063 - protein, 201 aa, Actinomyces urogenitalis DSM 15434
MLAAAVGRRRTDPIEDLLSLRFGVRKDQPGTVLRDFHTARTLDGKQSMPLSERYYLADAVYLAAIEGEKTLLEGLDVAVRHPVFPLYLGRRSCPPSQPLSLGIRHASLLQALTDEPWQAADWFRLRQDNSFRAEIVIDAASLAPDERGSGYTTLDSPVSFDPRRRDYQAREVERLFVPVGDSDRPDSHDPMSDIEEAGRCS

SEQ ID NO: 7064 - protein, 235 aa, Corynebacterium glucuronolyticum ATCC 51867
MTHSLLLLLKGPMQSWGDSSRYKSRETAAVPTKSGIVGLIAAAQGRRRSDPLEDLAQLRLAVRVDQPGTLLRDYQTAQQWQVKEGASAQLVTRYYLSDAAFVAAVESEDRELLEAMAESLRRPRFPLFLGRRSCPAPPNLVLGIRDTDVVQALVDEPWHASPHHRKARSSTVYLPIHRDAKPGEAGMSKCDVPISFSQEHRQYGWRTVVVEERKASFENDSAQSKDRFFDTVISS

SEQ ID NO: 7065 - protein, 242 aa, Corynebacterium glucuronolyticum ATCC 51866
MPSSTFIRLSGPIQSWAGQSVSGNFIRTNPIPTLTGLRGLLAGALGARRDEIPEWISKVRFSVREDQTGSFVDDFQTIGSREEEWDFRRRIAILQGMKARSIKQLSFKPAVGANAVVRRTYLSEAEFIVRVTDERHTEEIDHAFSSPVFATYLGRKAFPAAFPFYLGTGNEDVLHQIPVVKTTPRYNEGTKATEKCTVRVYELDPPLPPQTTQVPAVASRQEWLESVNSLSLHRRSTITPKA

SEQ ID NO: 7066 - protein, 232 aa, Corynebacterium striatum ATCC 6940
MTSTLLLLLKGPMQSWGDDSRYKQRKTGQVPTKSGVIGMLAAALGRRRVDPIEDLAGLSFGVRVDQPGTLLKDFQTALPEGASNAQLVTRYFLSDAVFVAAVESEERALLENIESALRRPRFPLFLGRRSCPAPADLVLGIRDSDLITALQGEEWHASKSHRQARARNVVLPIHRDAREGERGIACRDVPISFAQEHRQYAWREVVQDATGAPFENPLATKSDPFFEAVIRA

SEQ ID NO: 7067 - protein, 244 aa, Anaerococcus lactolyticus ATCC 51172
MIIVKTILLKLTGPMQSWGTSSRFETRTSDYYPSKSGVIGIIAASFGYERDEDEKIQKLNDLDFAVRVDQEGVLKKDYHIARKVKPNGELERTYVTNRYYMEDAVFVVAISHEDDKWMEEILQGLKYPYFQPFMGRRSCPLPARFILGTNEEGPIEALENLDWQAADWFKKKNKNYRADIYADKDLLPENSHTIRNDRVVSFSQKERKFGPRFEARSSLVMAKSDKDPFDVFESLEGQLCIYQE

SEQ ID NO: 7068 - protein, 245 aa, Mobiluncus mulieris ATCC 35243
MTSVYIRLAGPLQSWAGAKVSGNISHTQDYPTRGSLEGLVAACLGCPRGKYPLWFQDLQFAVRVDSPGRICDDYQTIGVRDEDMQVATRLLTLLTGKRATNRGLAFIPDAQGKTTIVRRTLLADAEFIVQIQCEGHLEQLDQAISDPTFVSYLGRKAFAPGFPFYLGIGEDSAIDTLPVFDKGRLESSYYQEKPEPTAESEIKSRTLYRLSSIHTTQETIHPPLEYCRKKWLETISEQLRRRATV

SEQ ID NO: 7069 - protein, 211 aa, Bifidobacterium angulatum DSM 20098 = JCM 7096
MLASAQGRSREDSIEDLLGISFGVRTEQHGRVIRDLQTEKSMTRKRNSNKFDKEMPLTYRYYLSDARFLVALGADRAVLETLEQAIRSPKWPLYLGRRSCPPDYPLSLGIRDEYEDVRKALESEPWHAADWYKRRYGHQKLEIVCDALEGDDTEAWSDLPLSFSSSGRRYADRAVRRYHISNPDEPKDGDDDNSRPPSFESTGEDDPMNFA

SEQ ID NO: 7070 - protein, 238 aa, Corynebacterium tuberculostearicum SK141
MTYSLLLLLKGPMQSWGTESRYATRATSTLPSKSGVLGMLAAAEGRRRTDGVEDLAGLKFAVRVDQSGSLLRDYQTAQNWQNDPKGQAKLITRYFLTDAAFVAAIESEDQDLLEGFAESLKRPVYPIFLGRRSCPAPPNIVLGVVNGSAVEALQNHSTWHATKDYMRTCGQEVELPIYRDSLAGEVGTACQDVPVSFAPEHRKYSWRTVVQKEFATVENPIEPENRRPDPFLEAVMNV

SEQ ID NO: 7071 - protein, 235 aa, Corynebacterium jeikeium ATCC 43734
MPSTLLLRLSGPMQSWGVSSRFKQRATEQVPTKSGVLGLLAAAQGRRRTDDLQDLAALTFAVRVDQPGSLLRDYQTAQPWQKRPKDNANLVTRYYLEDAVFVAAVESDNDSFIDELASAVQRPRFPLFLGRRSCPAPPNLYLGTFRGSAVDALRATDWQATRAHRKTRAPKLSLPIFRDATQGETGIARRDVPISFSQEHREYGWRDVVQDKTGVPVENDLGSTNDPFMEAVMQA

SEQ ID NO: 7072 - protein, 248 aa, Klebsiella pneumoniae subsp. rhinoscleromatis ATCC 13884
MSQYLVFQLHGPMASWGVDAPGEVRHSHELPSRSALLGLLAAALGIRREEEQRLNAFNQHYSFLLCASSEPRWARDYHTVQMPKEVRKARYFSRREELQDPELLSALISRRDYYTDAWWMIAVAVTPDAPYSLEQLHEALRYPVFPLYLGRKSHPLALPLMPLLLEGHAAEVLRQAYRQYQEKFNLLRLSLRQLQDQCWWEGEHAGLVANKILRRRDCPLNRQHWLFGERSMNQGTWLSKEETCTSQE

SEQ ID NO: 7073 - protein, 236 aa, Lactobacillus antri DSM 16041
MKTLTIKLAGPLQSYGNEATFSRRTSYHCPSKSAVIGLIAAALGYRRNDSRIKQLNELKMAVRIDQPGRTLTDFQTIEYNQKNGKRSLSYRDYLQDAVFVVAIAGEDQQIELVETALHHPKFQLFLGRRANVPAGLLLTRVFDEENPVTVLRQYEWQAAEWYQRQQRQPKYMAEVIADADLAQANLTTFAKDNVGSFSQDHRWHSYRAIISMNVELENKQCHGQDTSHDVMANLEE

SEQ ID NO: 7074 - protein, 241 aa, Lactobacillus helveticus DSM 20075 = CGMCC 1.1877; identical to SEQ ID NO: 7059

SEQ ID NO: 7075 - protein, 243 aa, Jonquetella anthropi E3_33 E1
MDFLVLRFRGPMMSFGDVAVDEQRPIDRFPGVSMVTGLVANALGWDWSETEKLQALQDRLVLAVREDRAGERLREYQTVALPGKSGLFVTHSIPCSRNLDKPMTVQKYLSYWANSLITCFIALTGLGTPTLDEIACALKKPARPLFLGRKTCLPTEPVFRGEIFGAESPEEAVLRSCQLDKRPLKFVESPHSCVVEWPYDGRTVVSQSEIFERRDLKQWKNNIHGGSRLVVRRMVSADRFKRR

SEQ ID NO: 7076 - protein, 267 aa, Slackia exigua ATCC 700122
MSKMTVLLLKLAAPLQSWGASSRFTERTTRHEPSKSGVIGLLAAALGRRREDSVDDLAALRFAVRIDQPGSFMRDFQTEHTRKWDSDTRRFVFNESLSLSKRDYLSDAVFVAALEGDEDLLAECAEALHHPAFPLFLGRRSCPPSTQVYLGLVDGPMMEALADIPWQATERHWNYAYRFRGDKPKETVELKVVYEATEEQAACTLSETVRDVPLSFSQLKREYGWRTETTIRMAVKNSFWSSDDGRPASTSIASEHDPFAILEEGSE

SEQ ID NO: 7077 - protein, 250 aa, Bifidobacterium gallicum DSM 20093 = LMG 11596
MSVLILRLAGPMQSWGDSSRFNRRETRTEPTKSAVIGLLASAQGRRREDSIEDLLGLRFGVRSDQPGRIMRDFQTEKSIARKKSGEFSLTMPLTHRYYLADAKFLVAIEGERSLLESLDAALRNPQWPLFLGRRSCPPASPVSLGVKDYANVEEALDKEPWIASPWYRKKVHDSKRLQVVVDAVENGETTGQQSDMPLSFSQKHRRYAQRPVRRYFVDCPTQDSATEPSARQTDNRPPEFTGAADPMSLM

SEQ ID NO: 7078 - protein, 235 aa, Cutibacterium acnes J139
MTVLLLRLAGPLQSWGDSSRFTTRATRREPTKSGVIGLLAAAQGRRRTDSLEDLLTLRFGVRTDQPGSIVRDFQTAMDWAHPKKDGRVKAMPLSNRYYLADAVFVAAVEGDPSLLQALDEAIRDPEFPLYLGRRSCPTEGQVSLGVRESELVKTLENEPWHAKLWHQRRLGRSVRLPIAYDAGPGQIGDTVRDIPLSFNPERREYGWRDVTTTTIVVDNPNGSDEPDWFAGLEGA

SEQ ID NO: 7079 - protein, 269 aa, Pyramidobacter piscolens W5455
MDALILRLRGPLMAFGDVAVDEIRPTDLLPGLSEMTGLIANALGWTFQDVEKLQRLQERLRLASREDRTGVPLRDYQTARLSSEDSLWRTDGIVAERGGGSKGEFTVQRYRHYRADAAVTVLIALDPADEAPALEEIRDALRHPARPLFIGRIGCPPSQPICFEPEGREIIHTDSLKDAIMHITPRAPLGAQTKREPASRNKVLVEWPLTPAEALSVHGDDSVHVIERCDCRNWVANTHGGRRYVWRDTTAQHSAIPVDGGKEGTSVEP

SEQ ID NO: 7080 - protein, 248 aa, Klebsiella variicola
MSQYLVFQLHGPMASWGVDAPGEVRHSHELPSRSALLGLLAAALGIRREEEQRLNAFNQHYSFLLCASSEPRWARDYHTVQMPKEVRKACYFSRREELQDPELLSALISRRDYYTDAWWMVAVAVTPDAPYTLEQLHEALRYPVFPLYLGRKSHPLALPLMPLLLEGHAAEVLRQAYRQYQAKFSLLRLSLRQLQDQCWWEGEHAGLAANKILRRRDCPLNRQQCLFGERTVNQGAWLSKEETCTSQE

SEQ ID NO: 7081 - protein, 250 aa, Megasphaera genomosp. type_1 str. 28L
MKTILLKLAGPLQSWGTRANFEIRHTDYYPSKSAVLGLLLGAMGIRREDTSETIDVFNALDFAIRVEQPGELLKDYHIARSYESNGSLLQTYVTERYYLEDAVFLAALGSENGAVIAEIEHALKYPHFQPFMGRRSCPVPADFFLGVFEEGVIEILKTYPWQAASWFKKKQRHDPKYHTFVYADSHLLKQAVRKRRKDKVASFSQKNRQFQYRFESELSVMLENPLYQGSTKDEHDALAAIGGEYVSIQS

SEQ ID NO: 7082 - protein, 248 aa, Citrobacter youngae ATCC 29220
MSQYLIFQLHGPMASWGVDAPGEVRHSHELPSRSALLGLLAAALGIRRDEDARLNDFNQHYAFLLCASKEPRWARDYHTVQMPKEVRKARYFSRREELQDPELLSALISRRDYYTDAWWMMGVSATPDAPYSLEQLRDALQHPVFPLYLGRKSHPLGLPLAPLLLEGRAADALREAYRQYQRNFTDMKLSLARLQNECWWEGEHDGLTANKILRRRDNPLNRQRWLFGERTVNQGPWLTKEEVCTSQE

SEQ ID NO: 7083 - protein, 242 aa, Schaalia odontolytica F0309
MSAVLVLRLAGPMQSWGADSRFTRRSTEAFPTKSALVGLLGAAQGRRRSDPIEDLAELSLAVRVDQPGQLLHDFHTAHRGDTSMPLSHRFYRADAAFGAFIEGPDDMIDALAQAIVRPVFPLYLGRRSCPPTLPLRLAVREGNAWDAVRETPWMASTYYQKKQRHDHFVRMRVVADLGIIPPEVEKVAQQTLQDMPISFDSENRKYTLRTVEETYIDLENPQYVETKLQAHPGLVHDPMEVL

SEQ ID NO: 7084 - protein, 249 aa, Roseomonas cervicalis ATCC 49957
MSPPFLTFALVAPMASFGAPAVGERRESWSRPGRSAILGLVGACLGLEREDDAAQATLAAEYGLALLCVSAGTPFADYHTAQVPSSSRKIRHATRAAELAAPELNTILSRRDYRTGTWHLAALWARGPAPRWPLAEIAAAMQSPAFTTYLGRKSCPLGLPLAPHLDMHSADAPAALQARHTGGPEAAFAASLARMQDRPLLVAMDEDRAAMGTTLRPDRSETRRDQPRRRSAWQFDLRREVVLRLEEGA

SEQ ID NO: 7085 - protein, 224 aa, Escherichia coli MS 196-1; identical to SEQ ID NO: 7033

SEQ ID NO: 7086 - protein, 224 aa, Escherichia coli MS 175-1; identical to SEQ ID NO: 7033

SEQ ID NO: 7087 - protein, 248 aa, Escherichia coli MS 198-1
MSQYLIFQLHGPMASWGVDAPGEVRHTHELPSRSALLGLLAAGVGIRRDDTERLNVFNRHYSLVVCASRNPRWARDYHTIQMPKEVRKARYFSRREELSDPDLLSAIISRRDYYTDAWWMVAVATTADAPYSLEQLQGGLRHPVFPLYLGRKSHPLALPLAPLLLEGNASDVLRNAYHQYQEHFHDLKIALPKLQDECWWEGEHDGLVASKILRRRDVPLNRQQWLFGERTVNQGPWLSKEEPCTSQE

SEQ ID NO: 7088 - protein, 248 aa, Escherichia coli MS 69-1
MSQYLIFQLHGPMASWGVDAPGEVRHTHELPSRSALLGLLAAGVGIRRDDTERLNAFNRHYSLVVCASRNPRWARDYHTVQMPKEVRKARYFSRREELSDPDLLSAIISRRDYYTDAWWMVAVATTADAPYSLEQLQEGLRHPVFPLYLGRKSHPLALPLAPLLLEGNASDVLRNAYQQYQDRFHELKVSLPKLQDECWWEGEHDGLVASKILRRRDVPLNRQQWLFGERTVNQGPWLSKEKPCTSQE

SEQ ID NO: 7089 - protein, 248 aa, Escherichia coli MS 84-1
MSQYLIFQLHGPMASWGVDAPGEVRHTHELPSRSALLGLLAAGVGIRRDDTERLNAFNRHYSLVVCASRNPRWARDYHTIQMPKEVRKARYFSRREELSDPDLLSAIISRRDYYTDAWWMVAVATTADAPYSLEQLQDGLRHPVFPLYLGRKSHPLALPLAPLLLEGNACDALCNAYQQYQDHFHKLKVSLPKLQDECWWEGEHDGLVASKILRRRDVPLNRQQWLFGERTINQGPWLSKEEPCTSQE

SEQ ID NO: 7090 - protein, 248 aa, Escherichia coli MS 115-1
MSQYLIFQLHGPMASWGVDAPGEVRHTHELPSRSALLGLLAAGVGIRRDDTERLNAFNRHYSLVVCASRNPRWARDYHTVQMPKEVRKARYFSRREELSDPDLLSAIISRRDYYTDAWWMVAVVPTPEAPYSLEQLQDGLRHPVFPLYLGRKSHPLALPLAPLLLEGNACDALCNAYQQYQDHFHKLKVSLPKLQDECWWEGKHDGLVASKILRRRDVPLNRQQWLFGERTVNQGPWLSKEEPCTSQE

SEQ ID NO: 7091 - protein, 248 aa, Escherichia coli MS 182-1
MSQYLIFQLHGPMASWGVDAPGEVRHTHELPSRSALLGLLAAGVGIRRDDTERLNAFNRHYSLVVCASRNPRWARDYHTVQMPKEVRKARYFSRREELSDPELLSAIISRRDYYTDAWWMVAVATTADAPYSLEQLQDGLRHPVFPLYLGRKSHPLALPLAPLLLEGNACDALCNAYQQYQDHFHKLKVSLPKLQDECWWEGKHDGLVASKILRRRDVPLNRQQWLFGERTVNQGPWLSKEEPCTSQE

SEQ ID NO: 7092 - protein, 283 aa, delta proteobacterium NaphS2
MDHWISCWNLSVVRGGNMQYLLFRLYGPMASWGEIAVGESRHTARYPGKSAIIGLLSAALGIKRNNEEEQLLMQEGYAIAVQVFSHGTLLRDYHTAQAPRSVRNTSYRSRREELVSGKAYLGTILSSREYRTDALALVSVRELPDAPHTLQTIKSHLKKPKFHLYLGRKSCPLAAPLYPQIIEAGDYHEAFKAYEHKPMMPTGMASDGAVSHRDRYWLQVPDERYYYWQGEPSDFSVTLDLIRVQTRTRHDQPLSRDRWQFSPRQEHYFYDAGGEVCISPESE

SEQ ID NO: 7093 - protein, 226 aa, Escherichia coli MS 116-1
MNMRSYLILRLAGPMQAWGQPTFEGTRPTGRFPTRSGLLGLLGACLGIQRDDTSSLQALSESVQFAVRCDELILDDRRVSVTGLRDYHTVLGAREDYRGLKSHETIQTWREYLCDASFTVALWLTPHATMVISELEKAVLKPRYTPYLGRRSCPLTHPLFLGTCQASDPQKALLNYEPVGGDIYSEESVTGHHLKFTARDEPMITLPRQFASREWYVIKGGMDVSQ

SEQ ID NO: 7094 - protein, 248 aa, Escherichia coli MS 21-1
MSQYLIFQLHGPMASWGVDAPGEVRHTHELPSRSALLGLLAAGVGIRRDDTECLNAFNRHYSLVVCASRNPRWARDYHTVQMPKEVRKARYFSRREELSDPDLLSAIISRRDYYTDAWWMVAVATTADAPYSLEQLQEGLRHPAFPLYLGRKSHPLALPLEPLLLEGNASDALRNAYQQYQDRFHELKVSLPKLQDECWWEGEHDGLVSSKILRRRDVPLNRQQWLFGERTVNQGPWLSKEEPCTSQE

SEQ ID NO: 7095 - protein, 233 aa, Lactobacillus delbrueckii subsp. bulgaricus PB2003/044-T3-4
MKTLTIKLTAPLQAYGNEASFERRTSWPAPSKSAVVGMIAAALGMRREDERIKSLNDLAYAVRVDQIGKTMTEFQTVEWKPGTRKLTYRDHYQDAVYVAAVGSEDEELIGKIEYALKHPRFQLYLGRRACPPAGVLRIESFADTDPVNVLKNMPWQAEKWYQNKHKRKAEFMAEIIADANLLPDATFTQTVKDRVESFDPQDRCFGFRLTAKERINLKNPCYEQKSQDVMDYL

SEQ ID NO: 7096 - protein, 235 aa, Peptoniphilus sp. oral taxon 836 str. F0141
MRTILLKLAGPLQSWGTNSHFETRHTDLYPSKSGILGIVAGSLGLKRDDNTNIKKLNELLFATRIDQEGMILRDFQISAKYKANGTFERNYVSNRYYLSDAIFIVSLSHEDKEYIQKIYQALKKPYFQQFMGRRSLPVNYDFIISVEDDEPIKLLKEIPWQANKYYQSRHSNELTIYADKKLIDNKTEILRKDNVLSFSQKNREFEYRTEGLLKVKVERNDIRKTAHDAWDAIGD

SEQ ID NO: 7097 - protein, 248 aa, Escherichia coli MS 119-7
MSQYLIFQLHGPMASWGVDAPGEVRHTHELPSRSALLGLLAAGVGIRRDDTERLNAFNRHYSLVVCASRNPRWARDYHTIQMPKEVRKARYFSRREELSDPDLLSAIISRRDYYTDAWWMVAVATTADAPYSLEQLQGGLRHPVFPLYLGRKSHPLALPLAPLLLEGNASDVLRNAYQQYQDHFHDLKVSLPKLQDECWWEGEHDGLVVSKILRRRDVPLNRQQWLFGERTVNQGPWLSKEEPCTSQE

SEQ ID NO: 7098 - protein, 248 aa, Escherichia coli MS 107-1
MSQYLIFQLHGPMASWGVDAPGEVRHTHELPSRSALLGLLAAGVGIRRDDTERLNAFNRHYSLVVCASRNPRWARDYHTVQMPKEVRKARYFSRREELSDPELLSAIISRRDYYTDAWWMVAVATTPDAPYSLEQLQDGLRHPVFPLYLGRKSHPLALPLAPLLLEGNASDVLRNAYQQYQDRFRELKVSLPKLQDECWWEGEHDGLVASKILRRRDVPLNRQQWLFGERTINQGPWLSKEEPCTSQE

SEQ ID NO: 7099 - protein, 248 aa, Escherichia coli MS 124-1; identical to SEQ ID NO: 7089

SEQ ID NO: 7100 - protein, 248 aa, Escherichia coli MS 78-1; identical to SEQ ID NO: 7091

SEQ ID NO: 7101 - protein, 234 aa, Mobiluncus curtisii subsp. curtisii ATCC 35241
MSYSLLLLLKGPLQSWGDESRYTTRATGSTPSKSGVIGLLAAAQGRHRTDPLEDLVRLDYAVRVDQSGALLRDYQTSQPWQKDPDASAKLVSRYFLSDAAFVAAIGAENRSILEGLQGNLYQPAYPLFLGRRSCPAPANLDLGIVEGNVVTALMEHEEWHATLSHKKERGEEVLLPIYRDGKPGEVGTPRQDVPISFSQEHRRYGWRTVVYAGAKEIKNEYGTSLDPFFEAVIS

SEQ ID NO: 7102 - protein, 232 aa, Peptoniphilus duerdenii ATCC BAA-1640
MNRLKTLLLKFAGPLQSWGTDSKFETRYTDFYPSKSAVIGMIAASFGYRRHEDEKIKKLNDLDFAVRVDQRGNLLRDYQIATAYKPDGRFERNYVTNRYYLEDAIFVVAIGGEDNFIDQIEHSLKNPYFQTFFGKRSNPINPDFILDKTDLGVIESLENLSWQAGNWYKRDFKDKSKVDLEVYIDGDLLEESVSKFRKDRVESFSQKNRRFGYRGEKRYVVTLSEEHDAFNF

SEQ ID NO: 7103 - protein, 223 aa, Corynebacterium matruchotii ATCC 14266
MTEALYIRLAGPLQSWAGPAITGNFVRTEPRPTRSGLVGLLAGACGYGRGEYPEWLTQLHFQIREDNRGTLVDDFHTINPRDTEEEFRSRLLLAMGQRPTKKLLNSTPDGQGLTAITERTYIADGEFIVQIKAGSREHQELLAEKLQQPHFVTYLGRKAFAPSFPFYLGAGPDDTLARIPTVGGEEPKKILRFYALDDYGYTTTTVPVVKDRNQWLTEVSEIF

SEQ ID NO: 7104 - protein, 248 aa, Escherichia coli MS 145-7
MSQYLIFQLHGPMASWGVDAPGEVRHTHELPSRSALLGLLAAGVGIRRDDTERLNAFNRHYSLVVCASRNPRWARDYHTVQMPKEVRKARYFSRREELSDPELLSAIISRRDYYTDAWWMVAVATTPDAPYSLEQLQDGLRHPVFPLYLGRKSHPLALPLAPLLLEGNACDALCNAYQQYQDHFHKLKVSLPKLQDECWWEGKHDGLVASKILRRRDVPLNRQQWLFGERTVNQGPWLSKEEPCTSQE

SEQ ID NO: 7105 - protein, 220 aa, Faecalibacterium cf. prausnitzii KLE1255
MATLLLRLAAPLQAWGADSKFETRKTGREPTKSGVIGLLAAALGLRRDEREALLRLTGLRFGIRVEREGQLLVDYHTAKTQDEKTSYVTYRHYLQDAVFLAGIESEDAALLQQLQQALLHPVFPLYLGRRCCPPTLPLCLGVRPGSLQEVLQAEPPLCPGRQSRILLDADPLEPGTAPQRDVPVSFDPHHRQYGYRSVRELWQKVPDSPETTEHDPFREL

SEQ ID NO: 7106 - protein, 236 aa, Aminomonas paucivorans DSM 12260
MPSLLLRLGAPMQSWGVHSAFGIRDTGREPSKSGVVGLLAAALGRDRHDPLDDLASLVLGVRVDREGSLMRDFQTAGGGQFCGSPYGVRKANGKAGDTVVSPRWYLADALFLVALGGEDPAFLKSLEEALLRPRYPLYLGRRSYPPTFPLVLGVVSEAAEEALRSYPVLPGSDGGGRMLRLVLESSPEEGGTPRMDVPLSFDPLERRYGVRYVRTELVEVVPSDRRREEMPCTSPG

SEQ ID NO: 7107 - protein, 245 aa, Lactobacillus iners LEAF 2053A-b
MKTILLKLKGPMQSWGTSSHFETRTTDYYPSKSAVIGIIAASLGYKRDNDEKIQKLNELNFAIRIDQPGVLSKDYHIATKYKVNIDKKYKISVAFDRNYVTNRYYMEDAIFVVAISHADDQWIDSIYHALQNPYFTPFMGRRSCPLPADFIITVTNKDALDALKNLEWQAAKWYKRKHRNYCADIYADKDLNLQGIATTRNDRVVSFSQKERKFGPRFETRTSKYFTNCREDSSNSNSLDFYESI

SEQ ID NO: 7108 - protein, 245 aa, Lactobacillus iners LEAF 2052A-d
MKTILLKLKGPMQSWGTSSHFETRTTDYYPSKSAVIGIIAASFGYKRDNDEKIQKLNELNFAIRIDQPGVLAKDYHIATKYKVNIDKKYKISVAFDRNYVTNRYYMEDAIFVVAISHADDQWIDSIYHALQNPYFTPFMGRRSCPLPADFIITVTNKDALDALQNLEWQAAKWYKRKHQNYCADIYADKDLNLQGIATTRNDRVVSFSQKERKFGPRFETRTSKDFTNGRNDASNSNSLDFYESI

SEQ ID NO: 7109 - protein, 241 aa, Lactobacillus iners LEAF 3008A-a
MKTILLKLKGPMQSWGTSSHFETRTTDYYPSKSAVIGIIAASLGYKRDNDEKIQKLNELNFAIRIDQPGVLAKDYHSAMSCRFPRVSDVKDNKKYVTNRYYMEDAIFVVAISHADDQWIDSIYHALQNPYFTPFMGRRSCPLPADFIITVTNKDALDALQNLEWQAAKWYKRKHRNYCADIYADKDLILQGIATTRNDRVVSFAQKERKFGPRFETRTSKDFTNGRDDASNSNSLDFYESI

SEQ ID NO: 7110 - protein, 235 aa, Cutibacterium acnes HL001PA1; identical to SEQ ID NO: 7078

SEQ ID NO: 7111 - protein, 235 aa, Cutibacterium acnes HL082PA2; identical to SEQ ID NO: 7078

SEQ ID NO: 7112 - protein, 235 aa, Cutibacterium acnes HL110PA3; identical to SEQ ID NO: 7078

SEQ ID NO: 7113 - protein, 235 aa, Cutibacterium acnes HL110PA4; identical to SEQ ID NO: 7078

SEQ ID NO: 7114 - protein, 235 aa, Cutibacterium acnes HL060PA1; identical to SEQ ID NO: 7078

SEQ ID NO: 7115 - protein, 248 aa, Escherichia coli MS 85-1; identical to SEQ ID NO: 7089

SEQ ID NO: 7116 - protein, 242 aa, Streptococcus oralis ATCC 49296
MNGMKTILLKFAGPLQSWGTSSHFETRHTDFYPSKSSVIGLIASSLGYRRDDDEKIVRLNELDFAVRVDQQGNLLRDFHIAQKYTEKGKFERNYVTNRYYLEDAVFVVALSHNNEQFLEMILQALRNPYFQPFMGRRALPLTADFILGETEIGAVESLRTLEWQASPWFMKRKFMDAVTLEIYSDRHLTDRGIYQLRQDVVKSFSQKGRRFGYRYETRELVQVRNSFRDKNTAHDVFKSIGD

SEQ ID NO: 7117 - protein, 241 aa, Lachnoanaerobaculum saburreum DSM 3986
MKTILLKFAGPMQSWGTDSHFETRHTDLYPSKSAVIGLIGAALGIRRDDKSISELDVLKFAVRVDREGSLLKDYHIARKYKPTGELERNYVTERYYLEDAVFVVAISHEDDNFIEKIYEALKRPYFQMFLGRRSVPVSADFILGIFDAGIKDTLEKCEWQAADYYKKRYRDKFKKSLDVYGDKGIFDNVYREILRQDRVISFSKSNRQFSFRYEEHTKVAVENNMFEVKDTDHNIFDLVGE

SEQ ID NO: 7118 - protein, 254 aa, Lautropia mirabilis ATCC 51599
MAEYLMMRLYGPMASWGEIAVGKTRRSSVQPSRSALLGLLGAALGVDRNDESKQQSLSGAYRFGVKLEAAGTPLRDFHTTEICRPSRKITFRSRRQELMSDKDDPILSSRDYRCDSLAIVAVERVDQSGEELKRLAEALRRPVYPLYLGRKSCPLALPVDPKVVQANGLLNAFQSVQFPSLAEMSRRHEFDKPWPSKGDQWMFRLGQVRYYWEEGMEPGMAASFEAMRTDQPVSRSRWQFERRKEWVALEERQG

SEQ ID NO: 7119 - protein, 241 aa, Streptococcus sp. C150
MKTILLKFAGPLQSWGTSSHFETRHTDFYPSKSAVIGLLAASLGYRRDEDEKIQKLNELDFAVRVDQQGNLLRDFHIAQKYTEKGKFDRNYVTNRYYLEDAVFVVALSHTDDSFIDIIKVALKNPYFQPFMGRRALPIISDFILGETDVNPLESLKSLKWQASLWFMKKSHDKDAISLEVYLDNQLVNKDVYQLRQDYVRSFSQKGRRFGFRYEVRELISVQNPHFSNRNTEHNIFESIGD

SEQ ID NO: 7120 - protein, 248 aa, Escherichia coli MS 117-3
MSQYLIFQLHGPMASWGVDAPGEVRHTHELPSRSALLGLLAAGVGIQRDDTERLNAFNRHYSLVVCASRNPRWARDYHTVQMPKEVRKARYFSRREELSDPDLLSAIISRRDYYTDAWWMVAVATTADAPYSLEQLQDGLRHPVFPLYLGRKSHPLALPLAPLLLEGNASDALRNAYQRYQDRFHELKVSLPKLQDECWWEGEHDGLVASKILRRRDDPLNRQQWLFGERTVNQGPWLSKEEPCTSQE

SEQ ID NO: 7121 - protein, 227 aa, Anaerococcus prevotii ACS-065-V-Col13
MKTILLKLSGPMQAWGTGSKFETRYTDHYPSKSAIIGMLAASLGYRRDDERISKLNEIDFAVRVDQRPNLIRDYHIASKYKKNGTFERNYVTNRYYLEDGVFVVAVGSNDELIEKLYRALENPYFQPYMGRRSCPPPADFLIGVRGLGPIDALKELDWQASSYFKKRYPSYVAELYADSNLLAGKEKIRNDRVVSFSYEGRKFMPRFESESSISFGYETSHDPFKAL

SEQ ID NO: 7122 - protein, 235 aa, Cutibacterium acnes HL103PA1; identical to SEQ ID NO: 7078

SEQ ID NO: 7123 - protein, 281 aa, Atopobium vaginae DSM 15829
MKSLLLKFAGPLQSWGTSSHFETRHTDYYPSKSAVIGMIAAAFGYKRNEPHDADLKQLNELAFAVRIDQQGNLLKDYHIASKCKPTGEFDRNYVTNRYCLEDAVFLVALGSEDSFLLEKIEQALAAPYFQLCLGRRSFPLSYDFIIGMQEEDPFALLRAYPWMAQKWQQKKIQSLNSTSDDLFIPIYADADLLAPYQSSIERPSVRKLRHDIAFSFSNKNRRFGYRYEARFDLPLKAICPMCDKTHDKKSASVNESAFDKDYVSMEHDAFSMLEVNNDVSQ

SEQ ID NO: 7124 - protein, 238 aa, Actinomyces sp. oral taxon 170 str. F0386
MTVLLLRLAGPLQAWGVKSRFTVRSTELAPTRSGIIGMLSAAIGRRRTDPIEDLLSLRFGVRKDQPGRVIRDFHTARSLDGKDSMPLSNRYYLADAVFLAGIEGDRPLLEGIDEALHHPAFPLYLGRRSCPPTPPVSLGLRDAALLDVLRTEPWLASPWFQKRHRSRVFDAELLLDQEAVPVGERGSARGSRDVPVSFDPRRRDYDFRQVERLMVQVGVPKADAHDPMLVLEEANQCS

SEQ ID NO: 7125 - protein, 248 aa, Klebsiella sp. MS 92-3
MSQYLVFQLHGPMASWGVDAPGEVRHSHELPSRSALLGLLAAALGIRREEEQRLNAFNQHYSFLLCASSEPRWARDYHTVQMPKEVRKARYFSRREELQDPELLSALISRRDYYTDAWWMIAVAVTPDAPYSLEQLHEALRYPVFPLYLGRKSHPLALPLMPLLLEGHAAEVLRQAYRQYQERFNLLRLSLRQLQDQCWWEGEHAGLVANKILRRRDCPLNRQHWLFGERSMNQGTWLSKEETCTSQE

SEQ ID NO: 7126 - protein, 245 aa, Lactobacillus iners SPIN 1401G; identical to SEQ ID NO: 7108

SEQ ID NO: 7127 - protein, 249 aa, Parasutterella excrementihominis YIT 11859
MDQFLIFQLFGPMASWGECAPGGVRQTLGIPTKSALLGILEGAVGITRDREKMHGAFAANYEFVICGSENPVWAQDFHTVQVPKENKKILYLTRKEELSNPEQLETILSTRDYLSDSWWLVAVKAKPQAPYSLEELKEYMERPTFTPYLGRKSNPSGLPFCPQIMSGDLKGVLGSCSKKFKEKLNSVGLNLPELQTDGYWERECQDLKPKFIIRRRDVPLSRTKWLFEERTINYGEVLNREDSQCTTPE

SEQ ID NO: 7128 - protein, 248 aa, Escherichia coli D9
MSQYLIFQLHGPMASWGVDAPGEVRHTHELPSRSALLGLLAAGVGIRRDDTERLNAFNRHYSLVVCASRNPRWARDYHTVQMPKEVRKARYFSRREELSDPDLLSAIISRRDYYTDAWWMVAVATTADAPYSLEQLQDGLRHPVFPLYLGRKSHPLALPLAPLLLEGNACDALCNAYQQYQDHFHKLKVSLPKLQDECWWEGKHDGLVASKILRRRDVPLNRQQWLFGERTVNQGPWLSKEEPCTSQE

SEQ ID NO: 7129 - protein, 291 aa, Gardnerella vaginalis 315-A
MKSLLLKFSGPLQSWGTDSHFETRHTDYYPSKSAVVGMIAAAFGYRRSADCDEAIAKLNDLDFAVRIDQQGNLLRDYHIAAKYKSNGDFEKNYVTNRYYLEDAIFLVAIGSDNEQLIYSINDALRSPYFQSSLGRRSLPPTADFILGVEDCGVIQALLTHEWLANKWSKKRFNTFRLSDSSESADESCNEVFISLYADSDLVDKAAAELVKDDTSTYKIQGSVCRLRKDFVNSFSNKERKFGFRYESKVEIPIKRILHNNSDSEGISSDSKHVKSTGDFIAEHDAFSGLES

SEQ ID NO: 7130 - protein, 187 aa, Oribacterium sp. oral taxon 108 str. F0425
MKTILLKFTGPLQSYGTSSHFETRYTDYYPSKSAVIGLLAACLGYRRDEAENLRELSKLKFAVRIDQDGTLLRDYHIARSYNEKGVESKTYVTNRYYLEDALFVVALSGMDELIDTLIEAIKTPYFQPFMGRRSLPVPVDFFLGVSTEDILDSLRNLPWQAAPWYKKRKKNKVLERRYLWKSMRMRR

SEQ ID NO: 7131 - protein, 236 aa, Lactobacillus oris F0423
MKTLTIKLTGPLQSYGNEATFSRRTSYHYPSKSAVIGLIAAALGYRRGDLRIKRLNELKMAVRIDQPGRTLTDFQTIEYNQKNGKRSLSYRDYLQDAVFVVAVAGEDQQIKLIETALHHPKFQLFLGRRANVPAGLLVTQVFDEENPAVVLRQYEWQAAKWYQRQQRQPKYIAEIIADADLAKANLTTFVKDNVGSFSQDHRWHSYRTIISMDVELENRQYHGQDTSHDIMANLEG

SEQ ID NO: 7132 - protein, 242 aa, Streptococcus sp. oral taxon 058 str. F0407
MNGMKTILLKFAGPLQSWGTSSHFETRHTDFYPSKSSVIGLIASSLGYRRDDDEKIIRLNELDFAVRVDQQGNLLRDFHIAQKYTEKGKFERNYVTNRYYLEDAVFVVALSHNNEQFLEMILQALRNPYFQPFMGRRSLPLTADFILGETDIGAVESLRTLEWQASPWFMKRKLMDAVTLEIYSDRHLTDRGIYQLRQDVVKSFSQKGRRFGYRYETRELVQVRNSFRDKNTAHDVFKSIGD

SEQ ID NO: 7133 - protein, 243 aa, Jonquetella anthropi DSM 22815
MDFLVLRFRGPMMSFGDVAVDEQRPIDRFPGVSMVTGLVANALGWDWSETEKLQALQDRLVLAVREDLAGERLREYQTVALPGKGGLFVTHSIPCSRNLDKPMTVQKYLSYWANSLITCFISLTGLGTPTLDEVACALKKPARPLFLGRKTCLPTEPVFRGEIFGAESPEEAVLRSCQLDKRPLKFVESPHSCVVEWPYDGRTVVSQSEIFERRDLKQWKNNIHGGSRLVVRRMVSADRFKRR

SEQ ID NO: 7134 - protein, 240 aa, Lachnospiraceae bacterium oral taxon 082 str. F0431
MKTILLKFAGPMQSWGTDSHFETRHTDLYPSKSAVIGMIGAALGIRRGDKSIDDFDSLRFAVRVDQEGSLLKDYHIARKYKTSGDIEGTYVTERYYIEDAVFVVAISHEDDNLIEKIYEALKRPYFQMFLGRRSIPVLADFILGNFDCDIRTALEKCEWQAKDYYKKRYNTSQKSLDVYCDKGVFDNADREILRQDKVISFSNKNRQFSFRYEDHAKTYVKNSMFEAEDTNHNIFDLVGE

SEQ ID NO: 7135 - protein, 240 aa, Leptonema illini DSM 21528
MQSYLVFHMHGALFAAGDTAVGEYRPSHVHPTKSGVLGLVAGAMGIRREEQDRIAKLAEAVRFSVLVLAAGNLLRDYHTVQVPSARKGKRLFTRREELLQPDLNTILSTRDYRQDALFRVALNSDDEELLKQIGESLQRPVFAPYLGRKSCPPALPFHPELVHAGSVMEAMKKVELPMSDLLKPLIPEDTVYFQLFTEDRPASGTRAEFQRRDRLIHRGNWQFGERSEFLIEMEAADVFQ

SEQ ID NO: 7136 - protein, 254 aa, Thiorhodovibrio sp. 970
MNRFLLFRLHGALAAWGDIAVGEQRPSTPHPSKSIVLGLVAAALGLKREDDDAHAALRDGYGFAVRVDSAGTPLRDYHTTQYPKTTSRLHHLRTRRDELADSGNRATVLSTRDYRSDSLYVVGLYQRGLDNVPEPDTLADALRRPKFTLYLGRRSCPAALPLAPRVIEAADFKAALADYDEAARHDGQQAFLEDARVARLSSGCEYYWEDGLPVGLESLQSTPRHDQPQSRARRQFAARTEHYANQGGKEAWAT

SEQ ID NO: 7137 - protein, 217 aa, Methylomicrobium album BG8
MRDYLILKLQGPMQAWGRESFEGLRPSELFPGRSALLGLLGACLGIDRTDRQRLQDLAASVSFAVRVDRQGQKMTDYHTVKDAREDYRGLKSHDTIQTWREYWQDACYTVAIWANVDAPLNLAAIEQAIKQPIYTPVLGRRSCPLARPLFETKIAAESALTALAQTGANQGTLYSEENSPGAIPLKKRDVPIIHQPRQFASRTVFMTAVQGALHVSE

SEQ ID NO: 7138 - protein, 255 aa, Saccharomonospora glauca K62
MSGLLLRLAGPLQSWGERSTFDVRDTAGFPTRSGLLGLLACVMGRRRGDSLEDLAALTFTIRVDRPGTRIIDYQTAGGALPPSMKVPTADGKGRPAGKGTVQTWREYLADAVFVVAVQGPSEVLDQVRHALRYPHWQPYLGRRSCPPDQPLLLDVPVEDPVAELCTRVPLARRVGKDEETVPVDFIFPVERRDGVRSEIHDVPAAFTSVDRAYSPRPVWRSTLTLPAELGVSTLREYPEQLRKYLNGEGVACHSG

SEQ ID NO: 7139 - protein, 216 aa, Desulfobacter postgatei 2ac9
MDETQSYLGLYLDAPMQSWGYQSKFDRRTSFAFPTKSGIIGMICAAMGIDRSNPDILQDLSNLKMTMLTFQSNGRLTDFHTVGGGWDKKSNPAHIVKTAQGSVGNTVITRREYLLQSRFGVLIMGELLFLEKIAGALYDPKWGIWLGRKSCIPATPICQGIFSDSQTAIGHLENIAGNPVLRTMEEAGTFAEGSDTLNDVPVHFGKRRYAPRRIKI

SEQ ID NO: 7140 - protein, 275 aa, Frankia sp. QA3
MTAPPAGHCLALRLAAPMQSWGTRSMFNRRDTQAEPTKSGIVGLLAAAQGRRRTDPIEDLLKLALGVRTDQPGTLLRDYHTVSDYRGRPLPSSAVSAKGAQKPTSPAKHTHLTERFYLQDAVFVAAVAAPDPVLATLAEALRNPAYPLALGRRACPPTQPLLLVADSGDDLWPGDVVDVLGRVPWQAGPQHRGALIRSRRPRPAAVDLPVTVDDPAGPDVRHDLPTGFDPHDRGFTSRRIRQTWVHLPPPYDLDDADLAVDAAAPPHDPFALLGW

SEQ ID NO: 7141 - protein, 242 aa, Lactobacillus saerimneri 30a
MKTLTVKLAAPLQSYGNQANYERRTTGRYPSKSAVIGMIAAALGYHRDDPRIVELNSLQFAVRVDQATSVLSDFHIVEYDTKKHKRKLTYRDYMQDAVYIVAVGSDDCKMIDRIEYALHHPYFQLYLGRRSNPPAGPLVTKIFTDSNPVEVLQKLDWQAADWFKQKYALRGRQDVMLELVADANLLPEHKDYTVHDRVRSFAVTDRCYGYRLAATTQVTLPIAKKKINTEHDIMGILESEGD

SEQ ID NO: 7142 - protein, 238 aa, Klebsiella pneumoniae JHCK1
MRQTTQYMLLWLEGPLQSWGGDSKFGVRDTLNFPTRSGILGLICCARGAAGPEVEWLAEMNNLPMEVRAYARTDKEGQPLLREPTLCDFQMVGSGYDDSDPWQSLLIPKTSDGKKAVGGGTKMTYRHYLQDAVFAVVMGLGSQQAESLPEALQNPVWDLYLGRKSCVPSELIYQGIYDSAEAAWQQARTLAESKRRTLSYRVIEGEGDGDVITLNDVPVQFGRHKRYRDRQVTVLECG

SEQ ID NO: 7143 - protein, 248 aa, Salmonella enterica subsp. enterica serovar Dublin str. UC16
MSQYLVFQLHGPMASWGVDAPGEVRHSHDLPSRSALLGLLAAALGIRRDEEERLNAFNRHYQFLLCASGNPRWARDYHTVQMPKEVRKARYFSRREELQDPELLSALISRRDYYTDAWWMIAVSATPDAPYSLAQLQASLQHPVFPLYLGRKSHPLALPLAPQLLDGRAPDVLREAYRWYQDQFNTLKLTLPRLQNECWWEGEHDGLTANKILRRRDMPLSRQQWLFGERSVNQGPWLRKEDACISQE

SEQ ID NO: 7144 - protein, 294 aa, Gardnerella vaginalis JCP8481B
MKSLLLKFSGPLQSWGTDSHFETRHTDYYPSKSAVIGMIAAAFGYRRSTDCDEEITKLNDLDFAVRVDQQGNLLRDYHIAAKYKSNGDFERNYVTNRYYLEDAIFLVALGSDNEELIDNIGDALRSPYFQSSLGRRSLPPTADLILGVEDCGVIQALLTHEWLANEWGRRRVKVSVLSRGLESTEESSKTLNSGFVPLYADADLIDKAAEELKKEDIDTYRIQSSVRKLRKDYVNSFSNKERKFGFRYESKIEIPIERIRRNMPNLQNVRSDNSYLKVHRTFNVEHDAFSGLEA

SEQ ID NO: 7145 - protein, 294 aa, Gardnerella vaginalis JCP8481A; identical to SEQ ID NO: 7144

SEQ ID NO: 7146 - protein, 291 aa, Gardnerella vaginalis JCP8017A
MKSLLLKFSGPLQSWGTDSHFETRHTDYYPSKSAVVGMIAAAFGYRRSTDCDEEIAKLNDLDFAVRIDQQGNLLRDYHIAAKYKPNGDFEKNYVTNRYYLEDAIFLVAIGSDNEQLIYSINDALRSPYFQSSLGRRSLPPTADFILGVEDCGVIQALLTYEWLANKWSKKRFNTSRLSEASESSIESCNEVFISLYADSDLVDKAAAELVKDDTSTYKIQESVRRLRKDFVNSFSNKERKFGFRYESKMGIPIKRILHNNSDSEGISSDSKHVKSTGDFIAEHDAFSGLES

SEQ ID NO: 7147 - protein, 291 aa, Gardnerella vaginalis JCP7672
MKSLLLKFSGPLQSWGTDSHFETRHTDYYPSKSAVVGMIAAAFGYRRSADCDEEIAKLNDLDFAVRIDQQGNLLRDYHIAAKYKPNGDFEKNYVTNRYYLEDAIFLVAIGSDNEQLIYSINDALRSPYFQSSLGRRSLPPTADFILGVEDCGVIQALLTHEWLANKWSKKRFNTFRLSDSSESSNESFNEVFISLYADSDLVDKAAAELVKDDTSTYKIQGLVRRLRKDFVNSFSNKERKFGFRYESKMEIPIKRILHNHSDSEGISSDSKHVKSTGDFIAEHDAFSGLES

SEQ ID NO: 7148 - protein, 291 aa, Gardnerella vaginalis JCP7659; identical to SEQ ID NO: 7146

SEQ ID NO: 7149 - protein, 291 aa, Gardnerella vaginalis JCP7275
MKSLLLKFSGPLQSWGTDSHFETRHTDYYPSKSAVIGMIAAAFGYRRSADCDEEIAKLNDLDFAVRIDQQGNLLRDYHIAAKYKPNGDFEKNYVTNRYYLEDAIFLVAIGSDNEQLIYSINDALRSPYFQSSLGRRSLPPTADFILGVEDCGVIQALLTHEWLANKWSEKRFNTSRLSETAESSNESYNEVFISLYADSDLVDKAAAELVKDGTSTYKIQGSVRRLRKDFVNSFSNKERKFGFRYESKMEIPIKRILHDNSDSEGISSDSKHVKSIGAFIAVHDAFSGLES

SEQ ID NO: 7150 - protein, 291 aa, Gardnerella vaginalis JCP8070
MKSLLLKFSGPLQSWGTDSHFETRHTDYYPSKSAVVGMIAAAFGYRRSADCDEEIAKLNDLDFAVRIDQQGNLLRDYHIAAKYKPNGDFEKNYVTNRYYLEDAIFLVAIGSNNEQLIYDISNALRSPYFQSSLGRKSLPPTADFILGVEDCGVIQALLTHEWLANKWSKKRFNTSRLSEASESSIESCNEVFISLYADSDLVDKAAAELVKDDTSTYKIQESVRKLRKDFVNSFSNKERKFGFRYESKMEIPIKRILRNNSDSEGISSDSKRVKSTGDFIAEHDAFSGLES

SEQ ID NO: 7151 - protein, 291 aa, Gardnerella vaginalis JCP8066
MKSLLLKFAGPLQSWGTDSHFETRHTDYYPSKSAVIGMIAAAFGYRRSTDCDENIAKLNDLDFAVRIDQQGNLLRDYHIAAKYKPNGDFEKNYVTNRYYLEDAIFLVAIGSDNEKLICSISDALRSPYFQSSLGRRSLPPTADFILGVEDCGVIHALLTHEWLVNKLSKKRFNTSRQSEASKSSIESCNEVFISLYADSDLVDKAALELVKDDINTYKIQESVRRLRKDFVNSFSNKERKFGFRYESKMEIPIKRILHNNLDSEGIPSDSKHVKSTGDFIAEHDAFSGLES

SEQ ID NO: 7152 - protein, 291 aa, Gardnerella vaginalis JCP8017B; identical to SEQ ID NO: 7146

SEQ ID NO: 7153 - protein, 248 aa, Salmonella enterica subsp. enterica serovar Dublin str. DG22; identical to SEQ ID NO: 7143

SEQ ID NO: 7154 - protein, 248 aa, Salmonella enterica subsp. enterica serovar Enteritidis str. 2009K0958
MSQYLVFQLHGPMASWGVDAPGEVRHSHELPLRSALLGLLAAALGIRRDEEERLNTFNRHYQFLLCASGNPRWARDYHTVQMPKEVRKARYFSRREELQDPELLSALISRRDYYTDAWWMIAVSATPDAPYTLAQLQAALQHPVFPLYLGRKSHPLALPLAPQLLEGNAADVLREAYRWYQDQFNALKLTLPGLQNECWWEGEHDGLTANKILRRRDMPLSRQQWLFGERSVNQGPWLRKEDACISQE

SEQ ID NO: 7155 - protein, 248 aa, Salmonella enterica subsp. enterica serovar Enteritidis str. 08-1080; identical to SEQ ID NO: 7154

SEQ ID NO: 7156 - protein, 248 aa, Salmonella enterica subsp. enterica serovar Enteritidis str. 2010K-0262; identical to SEQ ID NO: 7154

SEQ ID NO: 7157 - protein, 248 aa, Salmonella enterica subsp. enterica serovar Enteritidis str. 2009K1726
MSQYLVFQLHGPMASWGVDAPGEVRHSHELPSRSALLGLLAAALGIRRDEEERLNTFNRHYQFLLCASGNPRWARDYHTVQMPKEVRKARYFSRREELQDPELLSALISRRDYYTDAWWMIAVSATPDAPYTLAQLQAALQHPVFPLYLGRKSHPLALPLAPQLLEGNAADVLREAYRWYQDQFNALKLTLPGLQNECWWEGEHDGLTANKILRRRDMPLSRQQWLFGERSVNQGPWLRKEDACISQE

SEQ ID NO: 7158 - protein, 248 aa, Salmonella enterica subsp. enterica serovar Enteritidis str. 2009K1651; identical to SEQ ID NO: 7154

SEQ ID NO: 7159 - protein, 248 aa, Salmonella enterica subsp. enterica serovar Enteritidis str. 2010K-0267; identical to SEQ ID NO: 7157

SEQ ID NO: 7160 - protein, 248 aa, Salmonella enterica subsp. enterica serovar Enteritidis str. 2010K-0284; identical to SEQ ID NO: 7157

SEQ ID NO: 7161 - protein, 248 aa, Salmonella enterica subsp. enterica serovar Enteritidis str. 2010K-0271; identical to SEQ ID NO: 7157

SEQ ID NO: 7162 - protein, 248 aa, Salmonella enterica subsp. enterica serovar Enteritidis str. 2010K-0286; identical to SEQ ID NO: 7157

SEQ ID NO: 7163 - protein, 241 aa, Actinomyces graevenitzii F0530
MSKVLVLRLAGPMQSWGSSSRFTRRSTEAFPTKSALVGLLAAAQGRRRVDPIEDLAQLRVAVRVDQPGQLLRDFHTAHRGEVSMPLSDRFYWADAAFGAFIEGPDELIESLAQAIVRPVFPLYLGRRACPPTMPLRLAVHDGAAWDALQATPWLAAKFYQRRRKEARVSLRVVADQGIIPAEVGAACGRTLQDVPISFDSQHRRYSLRTVEETRIEVENPEFVPVKPKPMPGLTHDPMEVL

SEQ ID NO: 7164 - protein, 238 aa, Actinomyces johnsonii F0510
MTVLLLRLAGPLQAWGVKSRFTVRSTELEPTKSGIIGMLAAAVGRRRTDPIEDLLSLRFGVRKDQPGRVIRDFHTARTLDGKDSMPLSNRYYLADAVFLAGIEGDRPLLEGIDEALHHPAFPLYLGRRSCPPTPPVSLGLREAALLDALRAEPWLASPWFQKRHRSHVFDAELLVDQEAVPVGERGTACGSRDVPASFDPRRRDYDFRQVERLMTRVSTRKTDTHDPMLVLEEANQCF

SEQ ID NO: 7165 - protein, 234 aa, Actinobaculum sp. oral taxon 183 str. F0552
MTVLLLRLAGPLQAWGVKSKFSIRATELAPTKSGILGMLAAAVGRRRTDPVEDLLTLRFGVRKDQPGTVIRDFHTAHTLDGKKSMPLSDRYYLSDAVFLAGIAGERSMLETLDRAVRYPAFPLYLGRRSCPPALPVSLGLREAPLLEALKEEPWLASERFQRRNGWDFHAEILIDKEAVRDGEHSDDVRGSRDVPLSFDPRHREYSFRDIERHRICLGGMRGVDHHDPMAELED

SEQ ID NO: 7166 - protein, 238 aa, Actinomyces johnsonii F0542
MTVLLLRLAGPLQAWGVKSRFTVRSTELEPTRSGIIGMLAAAVGRRRTDPIEDLLSLRFGVRKDQPGRVIRDFHTARTLDGKDSMPLSNRYYLTDAVFLAGIEGDRPLLEGIDEALHHPAFPLYLGRRSCPPTPPVSLGLREAALLDALRAEPWLASPWFQKRHRSHVFDAELLVDQEAVPVGERGAAHGSRDVPASFDPRRRDYDFRQVERLMTRVSTRKTDTHDPMLVLEEANQCF

SEQ ID NO: 7167 - protein, 242 aa, Actinomyces sp. oral taxon 172 str. F0311
MSSVLVLRLAGPMQSWGSSSRFTRRSTEAFPTKSALVGLLAAAQGRRRSDPIEDLAELRFAVRVDQPGQLLRDFHTAHRGDTSMPLSDRFYWADATFGAFVEGPDDVIEGLSQAILRPVFPLYLGRRSCPPTMPLRLAVRRGEAWEAVRETPWMASAYYQKKQRYEQYVSVRVVADQGIIPSDVGVSFEHTIQDVPISFDSERRTYTLRTVEEARVDLENPQYVEARPNAGPGLVHDPMEVL

SEQ ID NO: 7168 - protein, 242 aa, Actinomyces sp. oral taxon 877 str. F0543
MSEVLVLRLAGPLQSWGSSSRFTRRSTEAFPTKSGIVGLLAAAQGRRRTDPIEDLAQLRMAVRIDQPGELLRDFHTAHRGKTAMPLSDRFYWSDAVFAAFVEGPDGLIDALANAIRRPAFPLYLGRRACPPALPLFLAVESDPIWEVVRSTGWLASGFHRKRQRDKREVQVRVVADAGIIPGADESTPGRTLQDVPVSFDSERRLYTFRQVEEASVPLQNPEYDESAPRKALTGGHDPMEVL

SEQ ID NO: 7169 - protein, 244 aa, Streptococcus sobrinus W1703
MNKMKTILLKLAGPLQSWGTSSHFETRHTDFYPSKSAIIGLIAASLGYRRDEEQRLQRLNELDFAVRIDQQGNILRDYHIAQKYKSKGEFERTYVTNRYYLEDAIFIVAISHEDDELMSAIEKGLKNPYFQTFMGRRSLPLNADFIVETTSDSALESLKRLKWQAAEWFMSKHSHETSITLEIYADSFLSDKESNRLRQDRVISFSQKARKFGFRYEVRDLVDVSNPMAKKGETQHDIFSSIGD

SEQ ID NO: 7170 - protein, 241 aa, Peptostreptococcaceae bacterium oral taxon 113 str. W5053
MNKVKTILLKFAGPLQSWGTDSHFETRHTDFYPSKSGVIGLITAGLGYGRDEDEKIQKLNDVNFAVRVDQQGFLMKDYHIAQKYKNNGEFERNYVTNRYYLEDAVFVIAISHKSDELMDKIEGGLRYPYYQPFMGRRSLPLCADFIIDTTSKGAVESLKDCPWQAATWYMRRHKKQNKINLEVYADSDLIDGSRRSLRKDRVISFSQKERKYGFRYENMLNMEVINKLASDRTEHDVMANI

SEQ ID NO: 7171 - protein, 213 aa, Ruminococcus callidus ATCC 27760
MAVLLLRLAAPLQAWGSNSKFIIRNTEREPTKSGVVGMLAAALGIQRNDDPKKPEPLTALRFGVRAEKEGRLLKDFHMVHYPKATPDVTERHYLSDAVFLVALESEDTAFLQKIAEALQHPVYPLYLGRKSCPPTLPIVWGVREKSLEAVLKEEPPLCNEKAGTFRIAYEVPFGGIPVQDVPQSFSQLHRQHGWRMKCEEIITGKEHDPFSEL

SEQ ID NO: 7172 - protein, 248 aa, Escherichia coli 113303; identical to SEQ ID NO: 7089

SEQ ID NO: 7173 - protein, 248 aa, Escherichia coli 113290
MSQYLIFQLHGPMASWGVDAPGEVRHTHELPSRSALLGLLAAGVGIRRDDTERLNAFNRHYSLVVCASRNPRWARDYHTVQMPKEVRKSRYFSRREELSDPDLLSAIISRRDYYTDAWWMVAVATTPDAPYSLEQLQEGLRHPVFPLYLGRKSHPLALPLAPLLIEGNASDALCNAYQQYQDSFRELKVSLPKLQDECWWEGKHDGLVASKILRRRDVPLNRQQWLFGERTVNQGPWLSKEEPCTSQE

SEQ ID NO: 7174 - protein, 248 aa, Escherichia coli 907357
MSQYLIFQLHGPMASWGGDAPGEVRHTHELPSRSALLGLLAAGVGIRRDDTERLNAFNRHYSLVVCASRNPRWARDYHTVQMPKEVRKARYFSRREELSDPELLSAIISRRDYYTDAWWMVAVATTTDAPYSLEQLQDGLRHPVFPLYLGRKSHPLALPLAPLLLEGNACDALCNAYQQYQDHFHKLKVSLPKLQDECWWEGKHDGLVASKILRRRDVPLNRQQWLFGERTVNQGPWLSKEEPCTSQE

SEQ ID NO: 7175 - protein, 248 aa, Escherichia coli 110957
MSQYLIFQLHGPMASWGVDAPGEVRHTHELPSRSALLGLLAAGVGIRRDDTERLNAFNRHYSLVVCASRNPRWARDYHTVQMPKEVRKARYFSRREELSAPDLLSAIISRRDYYTDAWWMVAVATTPDASYRLEQLQDGLRHPVFPLYLGRKSHPLALPLAPLLLEGNASDVLRNAYQQYQDSFRELKVSLPKLQDECWWEGEHDGLVASKILRRRDVPLNRQQWLFGERTINQGPWLSKEEPCTSQE

SEQ ID NO: 7176 - protein, 224 aa, Escherichia coli 909945-2
MKSYLILRLAGPMQAWGQPTFEGTRPTGRFPTRSGLLGLLGACLGIQRDDTSSLQALSESVQFAVRCDELILDDRRVSVTGLRDYHTVLGAREDYRGLKSHETIQTWREYLCDASFTVALWLTPQATMVMSELEKAVLKPRYTPYLGRRSCPLTQPLFLGTCQASDPQKVLLNYEPVGGDIYSEESVDGHHLKFTVRDEPMITLPRQFASREWYVIKGGMDVSQ

SEQ ID NO: 7177 - protein, 248 aa, Escherichia coli 907713; identical to SEQ ID NO: 7087

SEQ ID NO: 7178 - protein, 248 aa, Escherichia coli 113302
MSQYLIFQLHGPMASWGVDAPGEVRHTHEPPSRSALLGLLAAGVGIRRDDTERLNAFNRHYSLVVCASRNPRWARDYHTVQMPKEVRKARYFSRREELSDPELLSAIISRRDYYTDAWWMVAVATTTDAPYSLEQLQDGLRHPVFPLYLGRKSHPLALPLAPLLLEGNACDALCNAYQQYQDHFHKLKVSLPKLQDECWWEGKHDGLVASKILRRRDVPLNRQQWLFGERTVNQGPWLSKEEPCTSQE

SEQ ID NO: 7179 - protein, 248 aa, Escherichia coli 907672
MSQYLIFQLHGPMASWGVDAPGEVRHSHELPSRSALLGLLAAGVGIRRDDTECLNAFNRHYSLVVCASRNPRWARDYHTVQMPKEVRKARYFSRREELSDPDLLSAIISRRDYYTDAWWMVAVATTADAPYSLEQLQEGLRHPVFPLYLGRKSHPLALPLAPLLLEGNASDALRNAYQQYQDRFHELKVSLPKLQDECWWEGEHDGLVSSKILRRRDVPLNRQQWLFGERTVNQGPWLSKEEPCTSQE

SEQ ID NO: 7180 - protein, 248 aa, Escherichia coli 907710
MSQYLIFQLHGPMASWGVDAPGEVRHTHELPSRSALLGLLAAGVGIRRDDTERLNAFNRHYSLVVCASRNPRWARDYHTVQMPKEVRKARYFSRREELSDPELLSAIISRRDYYTDAWWMVAVATTTDAPYSLEQLQDGLRHPVFPLYLGRKSHPLALPLAPLLLEGNACDALCNAYQQYQDHFHKLKVSLPKLQDECWWEGKHDGLVASKILRRRDVPLNRQQWLFGERTVNQGPWLSKEEPCTSQE

SEQ ID NO: 7181 - protein, 248 aa, Escherichia coli 907715; identical to SEQ ID NO: 7087

SEQ ID NO: 7182 - protein, 248 aa, Escherichia coli 907889
MSQYLIFQLHGPMASWGVDAPGEVRHTHELPSRSALLGLLAAGVGIRRDDTERLNAFNRHYSLVVCASRNPRWARDYHTVQMPKEVRKARYFSRREELSAPDLLSAIISRRDYYTDAWWMVAVATTPDAPYRLEQLQDGLRHPVFPLYLGRKSHPLALPLAPLLLEGNASDVLRNAYQQYQDSFRELKVSLPKLQDECWWEGEHDGLVASKILRRRDVPLNRQQWLFGERTINQGPWLSKEEPCTSQE

SEQ ID NO: 7183 - protein, 248 aa, Escherichia coli 908521; identical to SEQ ID NO: 7087

SEQ ID NO: 7184 - protein, 248 aa, Escherichia coli 908522; identical to SEQ ID NO: 7087

SEQ ID NO: 7185 - protein, 248 aa, Escherichia coli 908525; identical to SEQ ID NO: 7179

SEQ ID NO: 7186 - protein, 248 aa, Escherichia coli 908555; identical to SEQ ID NO: 7089

SEQ ID NO: 7187 - protein, 248 aa, Escherichia coli 908541; identical to SEQ ID NO: 7097

SEQ ID NO: 7188 - protein, 248 aa, Escherichia coli 908573; identical to SEQ ID NO: 7088

SEQ ID NO: 7189 - protein, 248 aa, Escherichia coli 908585; identical to SEQ ID NO: 7087

SEQ ID NO: 7190 - protein, 248 aa, Escherichia coli 908616; identical to SEQ ID NO: 7087

SEQ ID NO: 7191 - protein, 248 aa, Escherichia coli 908658; identical to SEQ ID NO: 7175

SEQ ID NO: 7192 - protein, 235 aa, Cutibacterium acnes HL042PA3; identical to SEQ ID NO: 7078

SEQ ID NO: 7193 - protein, 276 aa, Frankia sp. CcI6
MSQDPPRHCLVLRLAGPLQSWGSRSMFNRRDTLTEPTKSGIIGLLAAAQGRRRTDPIEDLLSLTLGIRTDQPGTLLRDYHTVSDYRGRPLPSAAVSAKGLQKPTSPAKHTHVTERFYLQDAVFVAALAAPEPVLTTLADALRTPAFPLALGRRACPPTHPLLLVPDSEPDAALWSGSALEVLRQVPWQARPDHRDALARRRPPRLRRIDLPVTVDDPDGDDVRIDLPTTFDPHQRGFTSRRVHQSWVHLPPPYELTDADNVEGTTPHHDPFAILGW

SEQ ID NO: 7194 - protein, 248 aa, Salmonella enterica subsp. enterica serovar Cubana str. 76814
MSQYLVFQLHGPMASWGVDAPGEVRHSHELPSRSALLGLLAAALGIRRDEEERLNAFNRHYQFLLCASGNPRWARDYHTVQMPKEVRKARYFSRREELQDPELLSALISRRDYYTDAWWMIAVSATPDAPYTLAQLQASLQHPVFPLYLGRKSHPLALPLAPQLLEGSAADVLREAYRWYQDQFNALKLPLPRLQNECWWEGEHDGLTASKILRRRDMPLSRQQWLFGERSVNQGPWLRKEDACISQE

SEQ ID NO: 7195 - protein, 248 aa, Salmonella enterica subsp. enterica serovar Gallinarum/pullorum str. FCAV198; identical to SEQ ID NO: 7157

SEQ ID NO: 7196 - protein, 227 aa, Lactobacillus otakiensis DSM 19908 = JCM 15040
MQSYGNEASFNRRTSWDYPSKSAVIGMIAAAMGYQRNDKRIVQLNKLNFAVRVDQPGQIMTDFQIVEWDQKAGKRQLSYREYLQDAVFIVALGSEDDQLIDNIEFALKRPYFPLFLGRRANVPAGVLNLKSFPDEGPIDVLKHLQWQASTWYQKRLRRKSEVPVDIVADADLLHNVRTLLVKDRVKSFDQRNRQYGFRKTGDKTIVLTNPHAQKANPETGHDIFGAV

SEQ ID NO: 7197 - protein, 224 aa, Escherichia coli str. K-12 substr. MG1655; identical to SEQ ID NO: 7033

SEQ ID NO: 7198 - protein, 226 aa, Geobacter sulfurreducens PCA; identical to SEQ ID NO: 7034

SEQ ID NO: 7199 - protein, 224 aa, Escherichia coli K-12; identical to SEQ ID NO: 7033

SEQ ID NO: 7200 - protein, 291 aa, Gardnerella vaginalis
MKSLLLKFSGPLQSWGTDSHFETRHTDYYPSKSAVVGMIAAAFGYRRSADCDEEIAKLNDLDFAVRIDQQGNLLRDYHIAAKYKPNGDFEKNYVTNRYYLEDAIFLVAIGSDNEQLIQSINDALHSPYFQSSLGRRSLPPTADFILGVEDCGVIQALLTHEWLANKWSKKRFNTSRLSEASESSNESHNEIFISLYADSDLVDKAAAELVKDDTSTYKIQESVRRLRKDFVNSFSNKERKFGFRYESKMEIPIKRILHNNSDSEGISSDSKHVKSTRDFIAEHDAFSGLES

SEQ ID NO: 7201 - protein, 291 aa, Gardnerella vaginalis
MKSLLLKFAGPLQSWGTDSHFETRHTDYYPSKSAVIGMISAAFGYRRTTDCDEEIAKLNDLDFAVRIDQQGNLLRDYHIAAKYKPNGDFEKNYVTNRYYLEDAIFLVAIGSNNEQLIYSINDALRSPYFQSSLGRRSLPPTADFILGVEDCGVIQALLTHEWLANKWSKKRFNTSKLSEASESSNESCNEVFISLYADSVLVDKAASELVKDDNTTYKIQESVRRLRKDFVNSFSNKERKFGFRYESKMEIPIKRILHNNSDLEGISSDSKHVKSTGDFIAEHDAFSGLEA

SEQ ID NO: 7202 - protein, 291 aa, Gardnerella vaginalis
MKSLLLKFSGPLQSWGTDSHFETRHTDYYPSKSAVVGMIAAAFGYRRSADCDEEIAKLNDLDFAVRIDQQGNLLRDYHIAAKYKSNGDFEKNYVTNRYYLEDAIFLVAIGSDNEQLIYSINDALRSPYFQSSLGRRSLPPTADFILGVEDCGVIQALLTHEWLANKWSKKRFNTFRLSDSSESADESCNEVFISLYADFDLVDKAAAELVKDDTSTYKIQGSVRRLRKDFVNSFSNKERKFGFRYESKVEIPIKRILHNNSDSEGISSDSKHVKSTGDFIAEHDAFSGLES

SEQ ID NO: 7203 - protein, 291 aa, Gardnerella vaginalis
MKSLLLKFSGPLQSWGTDSHFETRHTDYYPSKSAVVGMIAAAFGYRRSADCDEEIAKLNDLDFAVRIDQQGNLLRDYHIAAKYKSNGDFEKNYVTNRYYLEDAIFLVAIGSDNEQLIYSINDALRSPYFQSSLGRRSLPPTADFILGVEDCGVIQALLTHEWLANKWSKKRFNTFRLSDSSESADESCNEVFISLYADSDLVDKAAAELVKDDTSTYKIQGSVRRLRKDFVNSFSNKERKFGFRYESKVEIPIKRILHNNSDSEGISSDSKHVKSTGDFIAEHDAFSGLES

SEQ ID NO: 7204 - protein, 291 aa, Gardnerella vaginalis
MKSLLLKFSGPLQSWGTDSHFETRHTDYYPSKSAVVGMIAAAFGYRRSADCDEEIAKLNDLDFAVRIDQQGNLLRDYHIAAKYKTNGDFEKNYVTNRYYLEDAIFLVAIGSDNEQLIYSINDALRSPYFQSSLGRRSLPPTADFILGVEDCGVIQALLTYEWLANKLSEKRFNTSRLSETAESSNESCNEVFIPLYADSDLVDKAAAELVKDDTSIYKIQESVRRLRKDFVNSFSNKERKFGFRYESKMEIPIKRILHVNSDSEGISSDSKHVKSTVDFIAEHDAFSGLES

SEQ ID NO: 7205 - protein, 291 aa, Gardnerella vaginalis
MKSLLLKFAGPLQSWGTDSHFETRHTDYYPSKSAVIGMIAASFGYRRSADCDENIAKLNDLDFAVRIDQQGNLLKDYHIAAKYKLNGDFEKNYVTNRYYLEDAIFLVAIGSNNEQLIYSINDALRSPYFQSSLGRRSLPPTADFILGVEDCGVIQALLTHEWLAKKWYKKRFNACNLSEISESSNKSRNEVFVSLYADSDLVDKAAKELVKDNTRTYKIQESVRRLRKDFVNSFSNKERKFGFRYESKMEISIKRILHDNSDSEGIASDSKHVKSTGDFIAEHDAFSGLEA

SEQ ID NO: 7206 - protein, 291 aa, Gardnerella vaginalis
MKSLLLKFSGPLQSWGTDSHFETRHTDYYPSKSAVIGMIAAAFGYRRSTDCDENIAKLNDLDFAVRIDQQGNLLRDYHIAAKYKANGDFEKNYVTNRYYLEDAIFLVAIGSNNEQLIYDISNALRSPYFQSSLGRRSLPPTADFILGVEDCGVIQALLTHEWLANKWSKKRFNTSKLSEASESSNESCNEVFISLYADSDLVDKAASELVKDDNTTYKIQESVRRLRKDFVNSFSNKERKFGFRYESKMEIPIKRILHNNSDLEGISSDSKHVKSTGEFIAEHDAFSGLES

SEQ ID NO: 7207 - protein, 291 aa, Gardnerella vaginalis; identical to SEQ ID NO: 7129

SEQ ID NO: 7208 - protein, 223 aa, Corynebacterium matruchotii; identical to SEQ ID NO: 7103

SEQ ID NO: 7209 - protein, 281 aa, Fannyhessea vaginae; identical to SEQ ID NO: 7123

SEQ ID NO: 7210 - protein, 249 aa, Parasutterella excrementihominis; identical to SEQ ID NO: 7127

SEQ ID NO: 7211 - protein, 187 aa, Oribacterium sp. oral taxon 108; identical to SEQ ID NO: 7130

SEQ ID NO: 7212 - protein, 242 aa, Lactobacillus saerimneri; identical to SEQ ID NO: 7141

SEQ ID NO: 7213 - protein, 291 aa, Gardnerella vaginalis; identical to SEQ ID NO: 7040

SEQ ID NO: 7214 - protein, 291 aa, Gardnerella vaginalis; identical to SEQ ID NO: 7037

SEQ ID NO: 7215 - protein, 294 aa, Gardnerella vaginalis; identical to SEQ ID NO: 7144

SEQ ID NO: 7216 - protein, 291 aa, Gardnerella vaginalis; identical to SEQ ID NO: 7150

SEQ ID NO: 7217 - protein, 291 aa, Gardnerella vaginalis; identical to SEQ ID NO: 7146

SEQ ID NO: 7218 - protein, 227 aa, Lactobacillus otakiensis; identical to SEQ ID NO: 7196

SEQ ID NO: 7219 - protein, 291 aa, Gardnerella vaginalis; identical to SEQ ID NO: 7147

SEQ ID NO: 7220 - protein, 291 aa, Gardnerella vaginalis; identical to SEQ ID NO: 7149

SEQ ID NO: 7221 - protein, 291 aa, Gardnerella vaginalis; identical to SEQ ID NO: 7151

SEQ ID NO: 7222 - protein, 234 aa, Actinobaculum sp. oral taxon 183; identical to SEQ ID NO: 7165

SEQ ID NO: 7223 - protein, 241 aa, Actinomyces graevenitzii; identical to SEQ ID NO: 7163

SEQ ID NO: 7224 - protein, 238 aa, Actinomyces johnsonii; identical to SEQ ID NO: 7164

SEQ ID NO: 7225 - protein, 238 aa, Actinomyces johnsonii; identical to SEQ ID NO: 7166

SEQ ID NO: 7226 - protein, 242 aa, Actinomyces sp. oral taxon 172; identical to SEQ ID NO: 7167

SEQ ID NO: 7227 - protein, 242 aa, Actinomyces sp. oral taxon 877; identical to SEQ ID NO: 7168

SEQ ID NO: 7228 - protein, 244 aa, Streptococcus sobrinus; identical to SEQ ID NO: 7169

SEQ ID NO: 7229 - protein, 241 aa, Peptostreptococcaceae bacterium oral taxon 113; identical to SEQ ID NO: 7170

SEQ ID NO: 7230 - protein, 213 aa, Ruminococcus callidus; identical to SEQ ID NO: 7171

SEQ ID NO: 7231 - protein, 248 aa, Escherichia coli; identical to SEQ ID NO: 7178

SEQ ID NO: 7232 - protein, 248 aa, Escherichia coli; identical to SEQ ID NO: 7174

SEQ ID NO: 7233 - protein, 240 aa, Corynebacterium urealyticum DSM 7109; identical to SEQ ID NO: 7056

SEQ ID NO: 7234 - protein, 238 aa, Corynebacterium aurimucosum ATCC 700975; identical to SEQ ID NO: 7036

SEQ ID NO: 7235 - protein, 291 aa, Gardnerella vaginalis 409-05; identical to SEQ ID NO: 7037

SEQ ID NO: 7236 - protein, 234 aa, Mobiluncus curtisii ATCC 43063; identical to SEQ ID NO: 7038

SEQ ID NO: 7237 - protein, 219 aa, Oceanithermus profundus DSM 14977; identical to SEQ ID NO: 7041

SEQ ID NO: 7238 - protein, 234 aa, Deinococcus proteolyticus MRP; identical to SEQ ID NO: 7042

SEQ ID NO: 7239 - protein, 221 aa, Marinithermus hydrothermalis DSM 14884; identical to SEQ ID NO: 7044

SEQ ID NO: 7240 - protein, 234 aa, Coriobacterium glomerans PW2; identical to SEQ ID NO: 7043

SEQ ID NO: 7241 - protein, 232 aa, Sphaerochaeta coccoides DSM 17374; identical to SEQ ID NO: 7046

SEQ ID NO: 7242 - protein, 224 aa, Thermus thermophilus JL-18; identical to SEQ ID NO: 7047

SEQ ID NO: 7243 - protein, 268 aa, Thiocystis violascens DSM 198; identical to SEQ ID NO: 7048

SEQ ID NO: 7244 - protein, 238 aa, Thiocystis violascens DSM 198; identical to SEQ ID NO: 7049

SEQ ID NO: 7245 - protein, 239 aa, Desulfomonile tiedjei DSM 6799; identical to SEQ ID NO: 7050

SEQ ID NO: 7246 - protein, 244 aa, Pelobacter carbinolicus DSM 2380; identical to SEQ ID NO: 7035

SEQ ID NO: 7247 - protein, 250 aa, Lactobacillus buchneri CD034; identical to SEQ ID NO: 7051

SEQ ID NO: 7248 - protein, 226 aa, Geobacter sulfurreducens KN400; identical to SEQ ID NO: 7034

SEQ ID NO: 7249 - protein, 228 aa, Thermus oshimai JL-2; identical to SEQ ID NO: 7052

SEQ ID NO: 7250 - protein, 227 aa, Mycobacterium smegmatis JS623; identical to SEQ ID NO: 7053

SEQ ID NO: 7251 - protein, 240 aa, Corynebacterium urealyticum DSM 7111; identical to SEQ ID NO: 7054

SEQ ID NO: 7252 - protein, 199 aa, Escherichia coli str. K-12 substr. MG1655
MYLSKVIIARAWSRDLYQLHQGLWHLFPNRPDAARDFLFHVEKRNTPEGCHVLLQSAQMPVSTAVATVIKTKQVEFQLQVGVPLYFRLRANPIKTILDNQKRLDSKGNIKRCRVPLIKEAEQIAWLQRKLGNAARVEDVHPISERPQYFSGDGKSGKIQTVCFEGVLTINDAPALIDLVQQGIGPAKSMGCGLLSLAPL

SEQ ID NO: 7253 - protein, 202 aa, Geobacter sulfurreducens PCA
MYLSKVLINGTACRNPYEIHRVLWKLFPEDADAERDFLFRVERSGQQSVEVLLQSRREPTMAASREVLLMGSKPYLLSLQQDQQLRFMLVANPIKTINDESARLNSANEIKKCRVPLIREEDLRAWLKRKLEGVAVIEAVEVEKRPAMNFRKAREKRVGKVQAVSFHGVLSVTDPVGLISLINTGIGPAKAFGCGLLSLART

SEQ ID NO: 7254 - protein, 199 aa, Desulfatibacillum aliphaticivorans
MIATMYTLDRKDCKALGLKDVYGVHKAVYNLFPENNGQGRDFLFADKGGDWNGRKILILSHREPIQPRHGAIDCREVPAAFLDWDYYGFEVVLNPVRRDNASRKLIPVRGRENLHEWFLKKAPGLGFEVEPHSLQVSRMGVEAYAKDGTMRTHNTATFIGKLRVIDPNAFKKSFAQGIGRAKAFGFGLLQLVPLTSDIQ

SEQ ID NO: 7255 - protein, 215 aa, Gardnerella vaginalis 409-05
MSYLSRVEIDYKKPSSLRDLKSVGAFHNWVEQSFPDEWENHERSRKLWRVDVLHGKHYLLIVSDSKPDLQRLEMYGVSGTASSKTYDKFLGSLMNGMRMQFRVTLNPVVSISDNAETHTARGRVVPHVTYDQQMNFLLNRAQKLGFSLNENEFAIVERGYSLFTKSEKPIRLSKAVYQGILTISDADIMRKTLLEGIGKKKAYGFGMMTVIPLDN

SEQ ID NO: 7256 - protein, 220 aa, Mobiluncus curtisii ATCC 43063
MATFTKILLNPARRQGRKLLTNPQAVHAAVCACFPPDMNQNQGRVLWRLDQRSHENILYIVGPEKPTAVHIVEQAGWDTRPAQSAEYDRLLGQLKKGQQWNFELVANPTKSLRRGGEQRGRVVALLSAPDQLAWLHSKAESMGVSFGTLEESTAQVGERESISFKRNFSAESSPKVHLVKVRYRGYLEVIDAEKLRQTLVGGVGRAKGYGCGLLTLARIQ

SEQ ID NO: 7257 - protein, 202 aa, Geobacter sulfurreducens KN400; identical to SEQ ID NO: 7253

SEQ ID NO: 7258 - protein, 215 aa, Gardnerella vaginalis ATCC 14019
MSYLSRVEIDYKKPSSLRDLKSVGAFHNWVEQSFPDEWENHERSRKLWRVDVLHGKHYLLIVSDSEPDLQRLEMYGVAGTASSKNYDKFLGSLMNGMRMQFRVTLNPVVSISDTAETRTTRGRVVPHVTYDQQMNFLLNRAQKLGFSLNENEFAIVERGYSLFTKSEKPIRLSKAVYQGILTISDAKIMRKTLLEGIGKKKAYGFGMMTVIPLDN

SEQ ID NO: 7259 - protein, 204 aa, Oceanithermus profundus DSM 14977
MSAVYLTKLTLNPYAKEVRRALEDRYALHRIAYSLKGEGREGRLLWRLEPPNGRAGAVILVQTPYTPDLSYVLERGLGHAETRRIELRLTPGSFAFRLEANAVRRHEQRARPLLDPEEQVRWLGERLAPMKLLEVVPVRTVPLEIKKPGGHKYTLHAVLFEGRLEVGRDAVAEAQRMMLEGIGRGRSMGLGMLSLKRARSAGGT

SEQ ID NO: 7260 - protein, 215 aa, Deinococcus proteolyticus MRP
MYLSRLFLNDHSKQAAADLRSAYGLHQTLRWAFPNAGEENGPLPEGERLLWRDDGPHGILVQSVTRPSWDAVSARHPDYFHDVQVKPFDLTGLQAGQHLAFKLKANVTVNRWRDGQDRDAEKRTKREALRGAKEQVEWLERQGERGGFSVVGADIAQSGNVRLYKARGSTPMTLFAVTFEGVLRIEDPALLAQTVRGGIGRAKALGFGLLSLARV

SEQ ID NO: 7261 - protein, 229 aa, Coriobacterium glomerans PW2
MYISKVPLNMARPDTIRFISSPYKVHAAVEQSFSPLAKRAGDDCRILWRLDSMPKAIKTLWLYVVSPDKPDFTHVVEQAGWTDSKRWQTKSYLPLLDSLEQGQVWSFRIKANPVRKVFKDQGQSPREGIVGTVQGHVTAEQQKRWMLSRTAAHGFSVRQSQNGEPALIVSQSTKESFSRGQSTVTLATAFFDGLLEITDVVEFRKVLCSGIGRAKSFGCGLLTIVKPAV

SEQ ID NO: 7262 - protein, 206 aa, Marinithermus hydrothermalis DSM 14884
MWISKLVLNPRSKAVRRDLANPYEMHRTLSRAVAEALGTQKERLLWRLEPTRATEPPVVLVQTLTEPNWGALETDYYAEVFPPKPFNPHLRPGQTLRFRLRANPAKRVARTGKRIALKNPEEKLAWLARRLEEGGFRLLGGENGYRARILQDVFLEARKKEALLQVQAVLFEGILEVLDPEKARATLERGVGPGKALGLGLLSLAP

SEQ ID NO: 7263 - protein, 234 aa, Salmonella enterica subsp. enterica serovar Typhi
MYLSRIQLRFNNLRPEMLAKWNSARPYASHQWLWQLFPEQELRQFLFREEAHGGFFMLSAIPPLLQHSLFLIETKLFNPQLTNGLELDFQLRANPVITRNGKRSDVMMNAKHQAKANGVEKERWWELQQQAAQAWLEQQGQQHGFRLIAPEPDDFAMWAGDEYSELQAHCGCVQAYQQHRFVRKDQETPITFSSVDFSGALCITDAALFKQALFSGLGKSKALGCGMLMVKRKR

SEQ ID NO: 7264 - protein, 198 aa, Sphaerochaeta coccoides DSM 17374
MIASTIFLDKKDIIALKLYDAYASHKFVYSLFPGNCRSFLFLEKTLSYQGRKMYLVLSEDSPAVPMKGEITSRHIPSGYFDFPAYTFEVKVNPVTKQVGKSNPIAVTGLEAIRTWFLNHQKTWGFSARQETMEISDMGVQAFLKNGQTITHNQATVRGIMDITDHVLFHKAFKNGLGRGKAFGFGLLQIKPLTQKESK

SEQ ID NO: 7265 - protein, 211 aa, Thermus thermophilus JL-18
MWLTKLVLNPASKAARRDLANPYEMHRTLSKAVSRALEGGEERLLWRLEPTRGLEPPVVLVQTLTEPDWSVLEGGYAQVFPPKPFHPAFRPGQRLRFRLRANPAKRLAATGKRVALKTPAEKVAWLERRLEEGGFRLLEGERGPWVQILQDTFLEVRRKKDGEEAGKLLQVQAVLFEGRLEVVDPERALATLKRGVGPGKALGLGLLSVAP

SEQ ID NO: 7266 - protein, 255 aa, Thiocystis violascens DSM 198
MNGASYRLSRMTPRPGLDFSDLVALGGLDPYGQHQLVWKFFDLPREPTPTQVPFLFRAEVRDGLPLLYVLSSDEPRDTSGKWRIESKDYRPALTLGDRLAFKLRANPTVARPGDVVLGRDGAPKLRTSGLKTGQPRHRIKRHDVVMDAKQRMDWKALPPDERPSLAHLAYEACAGWLREREERLGCQFNPARLRVDGYRTHRMHRKRGIALSTVDFEGELQVTDLERFTPILFNGIGPAKAFGCGLLLVRRMTDH

SEQ ID NO: 7267 - protein, 238 aa, Thiocystis violascens DSM 198
MSLYLLHCSPDPEALAIWATRHRLLSPDGDDGYALHALLTAAFGEQSPKPFRYLGARQGLLAYSDQPPALLHDNAALATPDVARALGLNSLAVRAFPTTWANGQMLSFEVRVRPIVRPPRGPERDLFQYTAEQSESPEKLKREVVYVDWLRQKFAEQDAAELSQVSMDAFRLSRVIRRTGTNDQGQRQALAPSGPDAVFKGQLRVGESDAFARLLKRGIGRHRAFGFGMLLLKPAHSC

SEQ ID NO: 7268 - protein, 228 aa, Desulfomonile tiedjei DSM 6799
MYFSRIRLDGERASAAELTKMIGQDGYGDHQIIWQLFKCADKSERDFLFRKESQQSLPVFFTVSRTPPARDHGIFRLKTKSYDPKVRPGDRFAFSLRANPVVTRWIGDNEKHHARHDVVMDAKRKLKADSVPESEWPTTPEIAQSAGFEWLAAKAEHAGFGVDRRLVSVEGYRQHQLRKGKNHLIRLSTMDFTGILTVTHPDLFVTALFGGIGPAKGFGCGLLLIRRV

SEQ ID NO: 7269 - protein, 222 aa, Lactobacillus buchneri subsp. silagei CD034
MYLSRVEIDLNNRQKIKELTHLGAYHNWVEQSFPDEIAEHTRLRHLWRIDRLAGKSYLLVLSQEAPDLELLGAYGVENTAMTKPYDPFLDRIKEGEIMQFRLTANPVRAISQPGRKQPRMVPHITVEQQRKWLTDRAEGLGFEIVKTVSADSMDSEGTENFDIVSRDWPILRRGHRTLRLSRVTYEGLLRVNDLDQFKQTLMNGVGREKAFGMGLMTVIPRG

SEQ ID NO: 7270 - protein, 205 aa, Thermus oshimai JL-2
MWISKLVLNPRSRAARRDLANPYEMHRTLSRAVSEALKEGRERLLWRQEPSRTTELPVVLVQTLTEPDWSVLEEDYAEIFPPKAFEPTFQPGQVFRFRLKANPSKRLAATGKRIALKTWLEKVGWLERRLQEGGFRLLEREEGPAVRILQDTFWEVRRKEGRVQVQVVLFEGRLEVQDPEKAKATLARGIGPGKALGLGLLSLAR

SEQ ID NO: 7271 - protein, 245 aa, Mycobacterium sp. JS623
MFLTKMPIHTRKRGAVKLLSSPQAMHAAVQSAFPPRALEDAGGRTLWRIDRATNAETTLYLVSPVAPDLTHLVEQAGWQTGDSWRTRDYRNLLNRLAVGQVWAFRLTANPTFNGYKTGANWADTKPLAHVTAKQQEHWLLSRAERAGFRVPDQSHDVTSIRVTNRSTLRFTKGGHRVVIGTATFDGVLEVRDIDALSHTLTDGIGRAKAYGCGLLTLAPLTVVNEAKSTNTWFRGEQVCSPRLRG

SEQ ID NO: 7272 - protein, 199 aa, synthetic Escherichia coli C321.deltaA; identical to SEQ ID NO: 7252

SEQ ID NO: 7273 - protein, 205 aa, Lactobacillus pasteurii DSM 23907 = CRBIP 24.76
MYLSRVQIDDHNQFVMRELNHLGAYHNWVEQSFPDEIANSVRLRHLWRIDTLNHKKYLLLLSQNRPDLDKLEQLGVAGTAQTKSYDEFLEKIEQGKKYRFRLTGNPTHKDSKTGRIMPHITVGAQRKWFERKAELSGFKILNFDVVSRNWLRLKKKKSRLELSSVTFEGILEVEDLEQFKQALVKGIGREKAYGMGLLTVIPIEK

SEQ ID NO: 7274 - protein, 206 aa, Lactobacillus equicursoris DSM 19284 = JCM 14600 = CIP 110162
MYLSRVEIDTKNRQKIRDLSHLGAYHGWIEQSFPDEIAQGERKRHLWRIDQLQGRTYLLLLSPDKPDLEKLEKYGRPGTAMSKDYEPFLNRLAKNQVLRFRLTANPAFRGGKSSKHPGKIIPYFAVDKQLGWLENKAENGGFKLLSADVVGHDRPSLRKQSRVSLNRTVYEGVLQITDLSKFRNVLTEGLGREKAFGMGLMTVIPM

SEQ ID NO: 7275 - protein, 210 aa, Lactobacillus ruminis CAG:367
MLYLSRVEIDSTNRRKLKNLTHLGAYHDWVEKCFPEEIKNHERQRHLWRIDDFKGKSYLLLLSSDRPDEEELLRYGVDGTVMVRNYDEFMDKLNVGQIMMFKLTANPTHCKDGKVYPHVTVEQQSKWLLDRAKGLGFDILESDGIPSFSVINREWQVLKRKGGRSVKLSKVTYQGYLKIVDLDLFRSALLKGVGREKAFGMGLMTVIPKG

SEQ ID NO: 7276 - protein, 217 aa, Lactobacillus helveticus CIRM-BIA 101
MYLSRVEIDTNDRQKISDLTHLGSYHNWVEQSFPDEVKQGTRLRHLWRIDEFSNKKYLLLVSKNKPKLNNLERYGVPYTAATKDYDRFLNQLVEGKKYRFRLTANPTYRITDSKSGKSRVVPHITILQQTNWLLERTKKHGFEIVRDSEEVYKLNISERDWPRLRRKGNHLIKLSRVTFDGILQITDLSKFKLALINGIGREKAYGMGLLTVIPLEK

SEQ ID NO: 7277 - protein, 249 aa, Schaalia odontolytica ATCC 17982
MYLTRIYLNPHRRGAKQLMRSRQTLHAAVLNCFPPSVLDDPGAPRVLWRLDRPPAVRGAAPRQGSPSCSLYISSPVAPDPSHIVEEAGYATEGGVVIRDMSSFLEGLWAGQRWGFRLCVNPTFREGSQVNARGRKKVLAHVTQDQQTQWVLERAEKCGFRVLTSAELGGELPVLEDSDGQRVDGANLLINGVERSIAEFKRGERRVTLGVATFEGVLEVTDPDAMRRVLTHGIGRGKAYGCGLMTLARP

SEQ ID NO: 7278 - protein, 195 aa, Faecalibacterium prausnitzii M21/2
MAALAAPQKLHGAVESAFAGERRRRLWRLDRLGERLYLLLLSEDAPELSGVVEQFGTGAAAETRSYDPLLQRVEPGSCWQFRLTANPTKSCKDTQNPAARGTVAAHCTTQYQKQWLLERAAKRGFALREEGFTVTRVQWQHFAKHGTRPVTLLAVTYEGVLQVTDAEQFRALLCQGMGRGKAYGLGLMTVMRAGN

SEQ ID NO: 7279 - protein, 233 aa, Bifidobacterium catenulatum DSM 16992 = JCM 1194 = LMG 11043
MFISRIPLNKARYGARQLIGSPYKLHAAVECAFPPNAVRNNDEGRILWRLDTSVNDNAVWLYVVSPEKPDFMHIVEQAGWPTHVEWETKNYEPLLERIAKGQQWHFKLRANPARKAKEDKGRRHRSDGIVGKVQGHITVDQQLQWLIDRSASHGFTILNDQNDQPDVVVKERHKENFKRADATVTLVTAVFEGRLEVTDAELFRKALCQGIGRAKGFGCGLLTIAPDLNNKDE

SEQ ID NO: 7280 - protein, 206 aa, Desulfovibrio piger ATCC 29098
MSWLVRMLLDRQALARCRFRDSYAWHQALWECFPAMPDAGRDFLTRTDWLPQGCRIYLLCRREPVRPDWCPPGSWAVKNIAPAFLQHGTYAFDLLANPTRKVAAFDAGGQRTRNGKRLALLDETSRQAWMEAKAGQHGFCLDGPLALDDAGASIFWRRACAGTHIGVRFRGRLQVTDRERFIHAFYHGIGSAKAFGFGMLLLQPLS

SEQ ID NO: 7281 - protein, 161 aa, Corynebacterium accolens ATCC 49725
MEQAGWDTRPGQSVEYDRLLNSLTKGQRWIFELVANPTYSQANGGKRGKVKAHVSVEHQLEWLYRRAENAGFELAPRAGDDVSDDERSRWSVEEETAIIERKTLDFRKGNGNRRVRIATARYRGTLEVKDPEALRHTLTHGIGRARGYGCGLMTLARPMGS

SEQ ID NO: 7282 - protein, 220 aa, Corynebacterium glucuronolyticum ATCC 51867
MTTFTRVFVNPQKRHGRKVLTNPEAMHAEVRGLFPPDLPSDNGRVLWRLDQHDNEHILYIVGPERPDTAELADRLGWSTRPAQTADYDKLLSSLAKGQQWCFELLANPSISLKTGGKRGKSVPLARIDQQIDWLLQRSEKNGFKVLPQGDSAEPDLRIANRKVMRFSKNPRDHKRTVALTTVRFEGTLEVTDAEALRATLTQGIGKGRAYGLGLMTLARR

SEQ ID NO: 7283 - protein, 225 aa, Corynebacterium glucuronolyticum ATCC 51866
MTNHAFLSKVPLHSLLMESPGTTYHRIASPTFRHRAVMGLFEDVDSVKPREKLNVLFRLETPTTETPYLLIQSAVSPSDEALMNISGLQCKEIELKAPTSGTPVAFRIAVNAIRRTTITIDPHKRRTLVKPVELDGTDSPNPTISEWIAAKLEPALTELSVTNHLREVITDPRTKKKPRTMTVQVDTIDGVARVADPVSLEKILSDGIGREKAYGCGLLTIRPLR

SEQ ID NO: 7284 - protein, 185 aa, Corynebacterium striatum ATCC 6940
MLTTTLSLNRTTRIAFDSQAVHRTLLHATDGKPVLWASPDTKHLVVRHETPVDWIKAIRGVTQAVTLPTQIPAASARINYALIGNPILSQYQGPNKRGKKTPAPPEKWNEWLQRRVGNALNLHSIDGTRLPPAKGKKPDMQTIHHRILFTGRATVKDQDALQTLMESGIGSGKAYGCGLLIVEEL

SEQ ID NO: 7285 - protein, 219 aa, Corynebacterium striatum ATCC 6940
MSTLTKLYLNPLKRGAAKLLANPQAMHAAVRGAFPPDIDESQSRVLWRVDHREHEHVLYIVGPEKPDAQHIVEQAGWGTRPAQSADYSRFLEQIVNGQKWAFELVGNPVESITIPGKSRGKVVPHVTAAQQCEWLLKKSMAAGFSIAVDENEEPMLSVVERNNLRFSKRDGAKRVSLRTARFRGQLVVTNAKALNKSLQQGIGRARAYGCGLLTLAPAE

SEQ ID NO: 7286 - protein, 215 aa, Anaerococcus lactolyticus ATCC 51172
MYLSRVEIDINNRRKMKDLTHLGCYHGWVEHSFPQENDIRTRKLWRIDNIGDKYYLIILSEYIPDKEKLEKYGVESTTEVKDYDEFLASLKEGIRAKFRIKLNTVIAKIDKENSTKRGRIMPVPNEKLNGFLVDKAQRNGFEVKTDEFGISKIDKEYFMNFDKEDKKKSRKNIVSATYEGMLTITDLEKFKVALVNGIGKKKAYGCGFLTIIPEK

SEQ ID NO: 7287 - protein, 212 aa, Mobiluncus mulieris ATCC 35243
MLVKPEFRAKLTCVFKTPDFRHRAVMDLFPEFEGEQNPRAAASILFRLETLPGLAPRFVVQSDISPAVDKLPKGVEPLGYTFPELGEGTPVSFRLAVNPVIRHSQGKDGQPARTTTVAPFGKEPAESAASLETWLSQKLSPGLAEVNIINAQREIIGDGYPNQDISKIKRIVIDLVDGVACVGDAKTLNKMLRSGVGRAKSYGCGLLSVKQL

SEQ ID NO: 7288 - protein, 233 aa, Bifidobacterium angulatum DSM 20098 = JCM 7096
MFISRIPLNKVRYGARQLIGSPYKLHAAVECSFPPDAVRKNDEGRILWRLDALTNDKGVWLYVVSPEKPDFTHIVEQAGWPMHEEWETKNYAPLLERIAKGQQWHFRLRANPARKASEDKGRRHRAEGIVGKIQGHVTVDQQMQWLIDRSASHGFKILDNEAGQSDVVVKERHKEQFKRGDATVTLVTAVFEGHLEVTDADLFRETLCQGIGRAKGFGCGLLTVAPDVKNKVE

SEQ ID NO: 7289 - protein, 232 aa, Corynebacterium tuberculostearicum SK141
MSTLTKILINPRRRQGRKLLTNPQAMHAAVAASFPPDLDQSSGRILWRLDESAHHHALYVVGPEKPTASVIAEQAGWDTRPAQSVEYDRFLGSLTQGQRWHFELLANPTYSQSNGQKRGKVKAHVSVEHQLGWLYQRSERAGFKLAPRAQDEVSDAERDRWCVHEQTNIVERKSLDFRKGDSRRRVHIATARYRGTLEVSDPDALRATLVNGIGRARGYGCGLLTLARPTGA

SEQ ID NO: 7290 - protein, 199 aa, Corynebacterium jeikeium ATCC 43734
MHAAVLSCFPKEVGDKERILWRHDGKTRGADEHFVYIVGPDSCDPTKIAEQTGSEHDPQKASYNRLLEALADGQQWHYEVVLNPVAAKKAPGSPRGTRGKLTALVGEAAQLEWFNTKAKSCGFTPLETLIVERKTLRFSKLAKNPKGRQVVIGTVRYRGTLQIDDVETFKKSLVEGIGRGKAYGCGLLTLAKPTPSKTS

SEQ ID NO: 7291 - protein, 188 aa, Klebsiella pneumoniae subsp. rhinoscleromatis ATCC 13884
MHQWLWQLFPGGQQRQFLYRREALQGAFRFFVLSPQLPAESEIFEIQSRSFNPELRAGQRLCFSLRANPTICKAGKRHDLLMDAKRQVKEQVEPRDIWAHQEQAALAWLTQQGEQSGFSLAETVVDAYRQQQIRREKSRQTIQFSSVDYTGMLVVNDPALFLQRLASGYGKSRAFGCGMMMIKPGDGE

SEQ ID NO: 7292 - protein, 209 aa, Lactobacillus antri DSM 16041
MYISRVEIDDQNRRKIKDLSHLGAYHNWVENCFPSEIAQHERRRHLWRIDQLHGKRYLLIVSADKPAATGMLKYGVTGTAMIKDYQHFLEQIKVGELMRFRLVANPTYRTDGKVYPHITVEQQENWLRQKAAANGFEFMTNADGSDTFDLVSRDWPNLYHQRRVRISRVAFEGTLRVTDLDKFRHALTHGIGREKAYGMGMLTVIPVRK

SEQ ID NO: 7293 - protein, 217 aa, Lactobacillus helveticus DSM 20075 = CGMCC 1.1877; identical to SEQ ID NO: 7276

SEQ ID NO: 7294 - protein, 255 aa, Slackia exigua ATCC 700122
MTYLTRFPINKTRRDARRLLASPYQMHAAIAGSFPVIHCLDSGKKRVLWRVDASEDGSARLYIVSPDKPSLVGLDEQIGWPDLPQQWETRSYDTFLSRIEIGQEYAFRLFANPVLSRSTRGGRTVPRNEKGKPKRIGHLTVLQQAAWLIGKDAYLGSGLEVPELFAHQEWNRAQRNGFEVLTNLDGTARLIVSHSGKQKLRSGRESCPITLSTAQFDGFLRVSDPDLLRSALVNGIGHAKGFGCGLLTLAPMVVR

SEQ ID NO: 7295 - protein, 236 aa, Bifidobacterium gallicum DSM 20093 = LMG 11596
MARIGARQLAASPYKLHAAVEASFPPHAPRATDEGRILWRLDHNRQDHSVWLYVVSPSQPDLLHIVEQAGWPGYAEWETKDYTPFLDRLAQGQQWHYRVCANPVRNAATDLNLHNSLATFDKMKGSRQAYVTVRQQIDWFERRAAANGFSLPERDPVSGFDEQVKDPLLLSSVRVIDRQRHKFRDRKNQVTLSTAVFEGTLQVEDPQSLRHALCFGIGKAKGFGCGLMTLAPIMTP

SEQ ID NO: 7296 - protein, 221 aa, Cutibacterium acnes J139
MFLTQFDINVARRDAMRLLASPERLHAAVLGAFPPGQSVSNGARTLWRLDRGPARHDARLMIVSPLRPDLTALNEQAGWSNGASSRSANYDPFLQALRSGSTWRFRCTINPTTAVRKSAGSRGQRVAEVTAEQQLTWFIGRVERHGYTVPVNDQGAPSAQVTRREILRFRRQRSTVTLAVTQVDGVIQIQDADAARLALVQGIGPAKSYGCGLMTLAPTVR

SEQ ID NO: 7297 - protein, 216 aa, Klebsiella variicola
MYLSRITLHTAQLSPLRLLHLVDRGEYVMHQWLWQLFPDGQQRQFLYRREALQGAFRFFVLSPQLPAESEIFEIQSRSFNPELRAGQRLCFSLRANPTICKAGKRHDLLMDAKRQVKEQVEPRDIWAYQQQAALAWLTRQGEQSGFSLAETVVDAYRQQQIRREKSRQTIQFSSVDYTGMLVVNDPALFLQRLASGYGKSRAFGCGMMMIKPGDGE

SEQ ID NO: 7298 - protein, 217 aa, Megasphaera genomosp. type_1 str. 28L
MYLSRVKVDDENFRKVRALNSLDAFHDWVERCFPEEFEAQKRKRKLWRLDTLQGDRYLLIVSETMPDIAGMEVYGVPGSGAIKEYDAFLQRLKENQRMRFRVTLNPVTAKADRTEGKRGRIFPHVTVAQQMKFLYDRAVKNGFSLVPDEFTIVERGYGILQKNRNIEHRRPIRLSKAVYEGLLTITDAVRFRQVLVAGFGKKKAYGFGMMTVIPVQS

SEQ ID NO: 7299 - protein, 188 aa, Citrobacter youngae ATCC 29220
MHQWLWELFPGGKERQFLYRREELQGAFRFFVLSQERPADSVIFDVLCRPFSPALVAGQTLRFTLRANPTVCKAGKRHDLLMEAKRQLNAQQGSRDVWSYQQQAAIEWLSHQGEQHGFSLREVNVDAYRQQQIRREKSRQMIQFSSVDYSGLLVVSDPTTFLQRMALGYGKSRAFGCGMMMIKPGDSE

SEQ ID NO: 7300 - protein, 249 aa, Schaalia odontolytica F0309
MYLTRIYLNPHRRGAKQLMRSRQTLHAAVLNCFPPSVLDDPGAPRVLWRLDRPPAVRGAAPRQGSPSCSLYISSPVAPDPSHIVEEAGYATEGGVVIRDMSSFLEGLWAGQRWGFRLCVNPTFREGSQVNARGRKKVLAHVTQDQQTQWVLERAEKCGFRVLTSAELGGELPVLEDSDGQRVDGANLLINGVERSIAEFKRGERRVTLGVATFEGVLEVTDPDALRRVLTHGIGRGKAYGCGLMTLARP

SEQ ID NO: 7301 - protein, 236 aa, Roseomonas cervicalis ATCC 49957
MTTLFLSRARLRQDASVAALARLLLPEAKGERVAAGHRLVWSLFAGDPAQKRDFLWREEGDGRFMLLSPSRPLDPHPLMEVESQPYTPNLAAGDRLHFVLRANPVISRSEAPGQRGKRHDVVMDALYATPRGARAEARFAALQQAGSAWLIKQGQAHGFELAAEPVVDGYERLRLPRPNPEPGKDKPPPPPAIFGVMDFAGTLRVTDPACFLAAQAKGFGRARGFGFGLMLIRRAV

SEQ ID NO: 7302 - protein, 199 aa, Escherichia coli MS 196-1; identical to SEQ ID NO: 7252

SEQ ID NO: 7303 - protein, 199 aa, Escherichia coli MS 175-1; identical to SEQ ID NO: 7252

SEQ ID NO: 7304 - protein, 216 aa, Escherichia coli MS 198-1
MYLSRITLHTGQLSPAQLLHLVDRGEYVMHQWLWDLFPGGKERQFLYRREELQGAFRFFVLSQERPAESETFTIECRSFVPELRTGQQLCFNLRANPTICKAGKRHDLLMEAKRQVRGQAEGSDVWLHQQQAALDWLAAQGERSGFTLLDTSVDAYRQQQLWRGKSRQLIQFSSVDYTGMLTVTDPGLFLQRLSQGYGKSRAFGCGLMLIKPGAEA

SEQ ID NO: 7305 - protein, 216 aa, Escherichia coli MS 69-1
MYLSRITLHTGQLSPAQLLHLVDRGEYVMHQWLWDLFPGGKERQFLYRREELQGAFRFFVLSQERPAESDIFTIECRPFAPELRTGQSLCFNLQANPTICKAGKRHDLLMEAKRQVRGQVEGSDVWLHQQQAALDWLAAQGERSGFTLLDTSVDAYRQQQLRRENSRQLIQFSSVDYTGMLTVTDPRLFLQRLSQGYGKSRAFGCGLMLIKPGAEA

SEQ ID NO: 7306 - protein, 216 aa, Escherichia coli MS 84-1
MYLSRITLHTGQLSPAQLLHLVDRGEYVMHQWLWDLFPGGKERQFLYRREELQGAFRFFVLSQERPAESDTFTIECRSFAPELRTGQQLCFNLRANPTICKSGKRHDLLMEAKRQVRGQAEGSDVWLHQQQAALDWLAAQGERSGFTLLDTSVDAYRQQQLRRENSRQLIQFSSVDYTGMLTVTDPGLFLQRLSQGYGKSRAFGCGLMLIKPGAEA

SEQ ID NO: 7307 - protein, 163 aa, Escherichia coli MS 115-1
GGGRFFVLSQERPAESDIFTIECRPFAPELRTGQSLCFNLRANPTICKAGKRHDLLMEAKRQVRGQVEGSDVWLHQQQAALDWLAAQGERSGFTLLDTSVDAYRQQQLRRENSRQLIQFSSVDYTGMLTVTAPGLFLQRLSQGYGKSRAFGCGLMLIKPGAEA

SEQ ID NO: 7308 - protein, 216 aa, Escherichia coli MS 182-1
MYLSRITLHTGQLSPAQLLHLVDRGEYVMHQWLWDLFPGGKERQFLYRREELQGAFRFFVLSQERPAESDTFTIECRSFAPELCTGQQLCFNLRANPTICKAGKRHDLLMEAKRQVRGQAEGSDVWLHQQQAALDWLAAQGERSGFTLLDTSVDAYRQQQLRRENSRQLIQFSSVDYTGMLTVTDPGLFVQRLSQGYGKSRAFGCGLMLIKPGAEA

SEQ ID NO: 7309 - protein, 298 aa, delta proteobacterium NaphS2
MAVLLSESSYNSHRLLWDLFTEQSRRCFVYREEIAREQLGTNRGVRGEPIYYMVSSVRPSTDKPLFYVETKEYRPGLKEGDQLGFNLRANPVITQKVERDNPKKYLEARRHRKVKNQEKLTKKRVRHDVVMNCQKEFLTTLCHEFNLQSHLPAHPQKRELKKVLLTFGNSLLDDRLTAILKDSYVYGERLDQSPILRDKLEWAIKAMTDEALQEWMIKQGERHGFKVARDDNQQLKLQNSGYLWHSIKAGKGKNSGFSSVDFTGNLIITNVETFRKALFEGIGPAKSFGCGLMLVRRL

SEQ ID NO: 7310 - protein, 199 aa, Escherichia coli MS 116-1; identical to SEQ ID NO: 7252

SEQ ID NO: 7311 - protein, 216 aa, Escherichia coli MS 21-1
MYLSRITLHTGQLSPAQLLHLVDRGEYVMHQWLWDLFPGGKERQFLYRREELQGAFRFFVLSQERPAESETFTIECRSFAPELHTGQSLCFNLRANPTVCKAGKRHDLLMEAKRQVRGQAEGRNVWLHQQQAALDWLAAQGERSGFTLLDTSVDAYRQQQLRRENSRQLIQFSSVDYTGMLTVTDPGLFLQRLSQGYGKSRAFGCGLMLIKPGAEA

SEQ ID NO: 7312 - protein, 207 aa, Lactobacillus delbrueckii subsp. bulgaricus PB2003/044-T3-4
MYLSRVEIDTDNRQKIKDLSHLGAYHNWVERSFPAEIAEGERQRHLWRLDTLNGRNYLLLLSPEKPDLHELERYGKPGTAISKDYEPFLSRLSEGQLLQFKLTANPVRRGGKSSSHPGSLIPCFAVDEQMKWLQGKAEKKGFELVAAEVVGHDRPLLRKKTHVALNRTVFEGRLKISNLDQFKVMLTSGIGREKAFGMGLMTVIPVD

SEQ ID NO: 7313 - protein, 211 aa, Peptoniphilus sp. oral taxon 836 str. F0141
MYISRVEIDLNNRQKIRDLTHLGAYHNWVEQSFPDENSKKIRSRKLWRIDYLFGKSYLLIVSNSKPDLKALEKYGVEKTGQTKDYDKFLDSLQEGQTMRFRVCLNPVVAKSEDKNSKRGRLYPCYKIEDQTSFLKSRSLKNGFEINNEDFSITERSHKLLKKKGMKNIRLNQVTYEGKLKIIDIDKFKKILTQGMGREKAYGFGMMTVIEE

SEQ ID NO: 7314 - protein, 216 aa, Escherichia coli MS 119-7
MYLSRITLHTAQLLPAQLLHLVDRGEYVMHQWLWDLFPGGKERQFLYRREELQGAFRFFVLSQERPAESETFTIECRSFAPELRTGQSLCFNLRANPTICKAGKRHDLLMEAKRQVRGQAEGRDVWLHQQQAALNWLAAQGERSGFTLLDTSVDAYRQQQLRRENSRQLIQFSSVDYTGMLTVTDPGLFLQRLSQGYGKSRAFGCGLMLIKPGAEA

SEQ ID NO: 7315 - protein, 216 aa, Escherichia coli MS 107-1
MYLSRITLHTGQLSPAQLLHLVDRGEYVMHQWLWDLFPGGKERQFLYRREELQGAFRFFVLSQERPAESETFTIECRSFTPELSTGQQLCFNLRANPTICKAGKRHDLLMEAKRQVRGQAEGSDVWLHQQQAALDWLAAQGERSGFTLLDTSVDAYRQQQLRRENSWQLIQFSSVDYTGMLTVTDPGLFLQRLSQGYGKSRAFGCGLMLIKPGAEA

SEQ ID NO: 7316 - protein, 216 aa, Escherichia coli MS 124-1; identical to SEQ ID NO: 7306

SEQ ID NO: 7317 - protein, 216 aa, Escherichia coli MS 78-1; identical to SEQ ID NO: 7308

SEQ ID NO: 7318 - protein, 220 aa, Mobiluncus curtisii subsp. curtisii ATCC 35241; identical to SEQ ID NO: 7256

SEQ ID NO: 7319 - protein, 212 aa, Peptoniphilus duerdenii ATCC BAA-1640
MYLSRVEIDYENRLALKELNHLGAFHNWVEQSFPEEIKNSERKRKLWRVDRLKNKNYLLIVSEDKPDFERLEKYGVKGTAQAKDYDEFLNTFKNNDRMTFRVVLNPNKSISDRSLRRGKVIPLLQEDEQFKYLIDRSEKNGFSLNNKDFYILKSNFETLYKPNGFKLDLIKAEYQGELTITDVEKFKNALTTGIGKKKAYGFGMMTVIPVIR

SEQ ID NO: 7320 - protein, 161 aa, Corynebacterium accolens ATCC 49726
MEQAGWDTRPGQSVEYDRLLNSLTKGQRWIFELVANPTYSQANGGKRGKVKAHVSVDHQLEWLYRRAENAGFGLAPRAGDDVSDDERSRWSVEEETAIIERKTLDFRKGNGNRRVRIATARYRGTLEVKDPEALRHTLTHGIGRARGYGCGLMTLARPIGS

SEQ ID NO: 7321 - protein, 220 aa, Corynebacterium matruchotii ATCC 14266
MSFMTYLTKFPVHVALARKPEKTQRWRVDDPEFRHRAVMGLFPDFEDNQARSRNNILFRYEFIPGQAPYFLVQSDCDVVAPDLEGVIETKQVEYPSYENGTPIIFRLALNTVTRRTIETNGRKREVITPVALQPLDAETGLNPAEKHVAYKLSTALQGIEFLNHNRQVLQVPKVSRALQIDTFDCMGVVTNSQALEHIMHAGIGRAKAYGCGLLTARRAA

SEQ ID NO: 7322 - protein, 216 aa, Escherichia coli MS 145-7; identical to SEQ ID NO: 7308

SEQ ID NO: 7323 - protein, 219 aa, Lactobacillus iners LactinV 01V1-a
MYLSRVEIDLYNRKKIRELKHIGCYHGWIEDAFPDERDKPESARSRKLWRIDNINDKCYLLILSESKPDFKKLEKYGIQHSACTKNYDEFLNSLKEGMRAKFRIKLNTVKSYSNREVYKKRGRVAPVSMDGLNSFFIERTEKNGFFVKDDEFRIIRREEERFEHYAEDKSEETNINLVSATYEGVLTITDLEKFKQTLTKGIGRKKAYGFGFLTIIPIK

SEQ ID NO: 7324 - protein, 195 aa, Faecalibacterium cf. prausnitzii KLE1255
MAALSAPQKLHGAVESAFAGERRRRLWRLDRLGERLYLLLLSEDAPELSGVVEQFGTGAAAETRSYDPLLQRVEPGSCWQFRLTANPTKSCKDPQNHAARGTVAAHCTTQYQKQWLLERAAKHGFALREEEFTVTRVQWQHFAKHGTRPVTLLAVTYEGILQVTDAEQFRALLCQGMGRGKAYGLGLMTVMRGGN

SEQ ID NO: 7325 - protein, 236 aa, Aminomonas paucivorans DSM 12260
MYLSRLILDPRSRQVRRDTGDCQQMHRTLCRAFPGTEGKDPRFRSRAGLLWRLDRREDGTLCVIAQSEAEPNWGFLQECPGYLLPSFPCPAVRSLDPLWSRLVAGTVWQFLLRANPTRKVATKSSPDGSKSNGRRLPLDTEEDELRWFLRKAAEGGFYLAPEGRQGEESRRLRVCRETPLKGSRGAQGDSHGMTFHAVRFEGYLQVTDGDRFREILKNGLGSAKAYGFGLLSLAPV

SEQ ID NO: 7326 - protein, 219 aa, Lactobacillus iners LEAF 2053A-b
MYLSRVEIDLYNRKKIRELKHIGCYHGWIEDAFPDERDKPKSVRSRKLWRIDNINDKCYLLILSENKPDLEKLEKYGIQHSACTKNYDEFLNSLKEGMRAKFRIKLNTVKSYSNREVYKKRGRVAPVSLDGLNSFFIERTEKNGFFVKDDEFRIIRREEERFEHYAEDKSEETNINLVSATYEGVLTITDLEKFKQTLTKGIGRKKAYGFGFLTIIPIK

SEQ ID NO: 7327 - protein, 219 aa, Lactobacillus iners LEAF 2052A-d
MYLSRVEIDLYNRKKIRELKHIGCYHGWIEDAFPDERDKPKSARSRKLWRIDNINDKCYLLILSESKPDFKKLEKYGIQHSACTKNYDEFLNSLKEGMRAKFRIKLNTVKSYSNREVYKKRGRVAPVSMDGLNSFFIERTEKNGFFVKDDEFRIIRREEERFEHYAEDKSEETNINLVSATYEGVLTITDLEKFKQTLTKGIGRKKAYGFGFLTIIPIK

SEQ ID NO: 7328 - protein, 219 aa, Lactobacillus iners LEAF 3008A-a
MYLSRVEIDLYNRKKIRELKHIGCYHGWIEDAFPDERDKPKSVRSRKLWRIDNINDKCYLLILSESKPDFKKLEKYGIQHSACTKNYDEFLNSLKEGMRAKFRIKLNTVKSYSNREVYKKRGRVAPVSMDGLNSFFIERTEKNGFFVKDDEFRIIRREEERFEHYAEDKSEETNINLVSATYEGVLTITDLEKFKQTLTKGIGRKKAYGFGFLTIIPIK

SEQ ID NO: 7329 - protein, 209 aa, Lactobacillus oris PB013-T2-3
MYISRVEIDDRNRRKINDLSHLGAYHNWVENCFPSEIAQHERRRHLWRIDQLHGKRYLLIVSEDKPEATGMLRYGVAGTAMVKKYQPFLEKITLGEVMQFRLTANPTYRTDGKVYPHITVDQQKNWLLRKAAANGFEIMKNSDGSNAFDPISRDWPVLYHQRQVKISRVSFEGVLRVTDVNKFKDALTHGIGREKAYGMGMLTVIPLRK

SEQ ID NO: 7330 - protein, 221 aa, Cutibacterium acnes HL001PA1; identical to SEQ ID NO: 7296

SEQ ID NO: 7331 - protein, 221 aa, Cutibacterium acnes HL082PA2; identical to SEQ ID NO: 7296

SEQ ID NO: 7332 - protein, 221 aa, Cutibacterium acnes HL110PA3; identical to SEQ ID NO: 7296

SEQ ID NO: 7333 - protein, 221 aa, Cutibacterium acnes HL110PA4; identical to SEQ ID NO: 7296

SEQ ID NO: 7334 - protein, 221 aa, Cutibacterium acnes HL060PA1; identical to SEQ ID NO: 7296

SEQ ID NO: 7335 - protein, 216 aa, Escherichia coli MS 85-1; identical to SEQ ID NO: 7306

SEQ ID NO: 7336 - protein, 215 aa, Streptococcus oralis ATCC 49296
MYISRVEIDRTNRRKIRRLTHIGAYHAWVEESFPEEMEQSIRTRKLWRIDRIQDKDYLIIVSKNKPDLQGLEKYGVAGSAQTKDYQQFLDNIYTGSRMKFRVVLNPVISLVSPDNLKRGIVKPHITSEHQMNYLVERSDKNGFSLIKEDFSIVERGYEVFKKAVKPIRLIKVVYEGVLTVSDADLFKKLLTEGMGKKKAYGFGLMTVIPLGNESW

SEQ ID NO: 7337 - protein, 206 aa, Lachnoanaerobaculum saburreum DSM 3986
MYISRVEVDIYNRQKIRDLTHLGAYHNWVEQSFKEAGVRSRKLWRIDKINNKKYLLLVSGEKPDVKLLEKYGVAGSAITKDYTAYISKIKKGMKLRFRLVTNPVHAVMEDGKRGSEKPHITAEFQKKFFMDRTLKNGFEVIEDEVNIVERGFEVLRKSGAKPVKVVKATFEGVLTVVDEDKFKSLLENGFGKKKAYGFGLMTVIPM

SEQ ID NO: 7338 - protein, 229 aa, Lautropia mirabilis ATCC 51599
MSHYFSKVRLRAMRSRDPWLIRNESQGDAYRDHQIIWRLFASDGGKRDFIFRRLDDMRTYYVVSERPPHDEDGRFDIQSKAYDPSFDVGNTLRFDLRANPVVSRRAAEGGKSRRHDMLMNAKKEARQLGHDAAVAMDEAGLKWILERAAHWGLRVDERSVLQKGYCQHALRPGRWRETGEKHKAIQFSSLDYQGVAEVVDPEALRKALFEGVGHAKSFGCGLLLVRPLC

SEQ ID NO: 7339 - protein, 212 aa, Streptococcus sp. C150
MYISRVEIDRYNRRKVRDLTHVGAYHAWVEESFPSELEQSIRTRKLWRIDRIQDKDYLIIVSKEKPNLQKLEKYGVVGSAQTKHYQHFLDNIKTGCRMNFRVVLNPVISITSPDKSKRGVVKPHVTIEHQMDFLVKRSEKNGFSLVGERFSIVERGYELFQKSENPIRLSKVVYEGTLTVSDETLFKKMLTEGIGKKKAYGFGLMTVVPLEE

SEQ ID NO: 7340 - protein, 216 aa, Escherichia coli MS 117-3
MYLSRITLHTGQLSPAQLLHLVDRGEYVMHQWLWDLFPGGKERQFLYRREELQGAFRFFVLSQERPAESDTFTIECRPFAPELRTGQSLCFNLRANPTICKAGKRHDLLMEAKRQVRGQAEGSDVWLHQQQAALDWLAAQGERSGFALLDTSVDAYRQQQLRRENSRQLIQFSSVDYTGMLTVTDPGLFLQRLSQGYGKSRAFGCGLMLIKPGAEA

SEQ ID NO: 7341 - protein, 212 aa, Anaerococcus prevotii ACS-065-V-Col13
MYLSRVELDVYNRRKMRDLKDLNSYHGFVESCFPEEIEKGIRTRKLWRIDKLNKKTYLLIQSQIKPNKEILEKYGVIGTSLCKDYDKFIDSLEEGMKARFRVKLNTVISKSTGNKDERGRIVPVPTRDLADFFLARTDKNGFKVSPNDFDIFEKELLPYKKVNKKPYSLVSASYEGVLTINDLERFRQSLKNGIGRKKAYGFGMLTIIPYEK

SEQ ID NO: 7342 - protein, 221 aa, Cutibacterium acnes HL103PA1; identical to SEQ ID NO: 7296

SEQ ID NO: 7343 - protein, 215 aa, Atopobium vaginae DSM 15829
MMYLSRVEINCNNLKTMRDLAHVETFHAWVEESFPEEWLTHTRSRKLWRVDTLRGKQYLLVLSNSKPDLTKLEKYGVAHTAATKNYDSLLTSLKKGDRLQFRVALNPVISLPSERVQDGKRPRGRVVPHVTHAQQIEFLASRAQKYGFSLEAGEFDIVERGFSYFRKSQKPIRLVKAVYQGFLTIEDVELFRNALINGIGKKKAYGFGMMTVIPQ

SEQ ID NO: 7344 - protein, 228 aa, Actinomyces sp. oral taxon 170 str. F0386
MFLTKIDLAPERRLARKYLGSPQAMHAVVMSATGGHDGNGPGRVLWRVDRGMTTALYILSPLEPDCSQLVAEAGTAGTQARTLDYSPFLASLDAGQLWAFRLAANPSHSASRGPGARGQRYGHVTVEQQRQWLMDRVPRFGFELMPVDHADGEGTEEAVLVAYRERPVFNRRRPGGVGYDRVTINRTVYEGVLRVTDPEPLRRALIAGIGRSKAYGCGLMTLARVRQD

SEQ ID NO: 7345 - protein, 188 aa, Klebsiella sp. MS 92-3
MHQWLWQLFPGGQQRQFLYRREALQGAFRFFVLSPQLPAESEIFEIQSRSFNPELRAGQRLCFSLRANPTICKAGKRHDLLMDAKRQVKEQVEPRDIWAHQQQAALAWLTRQGEQSGFSLAETVVDAYRQQQIRREKSRQTIQFSSVDYTGMLVVNDPALFLQRLASGYGKSRAFGCGMMMIKPGDGE

SEQ ID NO: 7346 - protein, 219 aa, Lactobacillus iners SPIN 1401G; identical to SEQ ID NO: 7327

SEQ ID NO: 7347 - protein, 214 aa, Parasutterella excrementihominis YIT 11859
MYYSRITLDLAKLPPGRLKELITKGSYALHQWVWLLFTDDETRKFLFREEEGQGFLRFYVLSENAPTKNDLFQIETKEFKPKLRKGDRLIFSLRANPTVCRKGRRYDLFMDLKKRVPQLERQDLLILQQAEAAEWLKRQGTGAGFSLISSNVESYQGKCVYGKNGDRITFSIMDFSGVLEICDPEKFLRKLLIGFGKEKAFGCGLMLIRRQVAW

SEQ ID NO: 7348 - protein, 216 aa, Escherichia coli D9
MYLSRITLHTGQLSPAQLLHLVDRGEYVMHQWLWDLFPGGKERQFLYRREELQGAFRFFVLSQERPAENETFTIECRSFVPELRTGQQLCFNLRANPTICKAGKRHDLLMEAKRQVRGQAEGSDVWLHQQQAALDWLAAQGERSGFTLLDTSVDAYRQQQLRRENSWQLIQFSSVDYTGMLTVTDPGLFLQRLSQGYGKSRAFGCGLMLIKPGAEA

SEQ ID NO: 7349 - protein, 215 aa, Gardnerella vaginalis 315-A; identical to SEQ ID NO: 7258

SEQ ID NO: 7350 - protein, 210 aa, Oribacterium sp. oral taxon 108 str. F0425
MYLSRVEIDKENRRKIRDLTHLGAYHSWVEDSFVGQISMLERSRKLWRIDSIQGRQYLLILSEEKPSLKALEKYGVDGSGETKSYDSFLASIQEGKKYRFRTTLNPVVAKPIEGEKRGKPVPLLTIENQSRFLLDRAEKNGFSLNSSDFVIKERKFETLKKKGMRDTPISQVIYEGILTVIDAEQFRKALCDGIGKKKAYGCGLLTVIPV

SEQ ID NO: 7351 - protein, 209 aa, Lactobacillus oris F0423; identical to SEQ ID NO: 7329

SEQ ID NO: 7352 - protein, 224 aa, Lactobacillus curvatus CRL 705
MYYLSRVEVDVQNRAKIKDLTHLGAYHNWVEQSFPKEIATGERHRHLWRLDTLAGKKYLLIMSESIPDSEFLLKYGVTGTIVTKSYDGFLDKIHDGQIMRFRLTANPTHTITRPGKKRGKVFPHVTVTQQEKWLVDRSDKSGFELVKQVGVNDLNETQTLAFKIVERDWPMLHRNPGRAVRLSRVTFEGLLRVENAETFKQTLVKGIGREKAFGMGMMTVIPEA

SEQ ID NO: 7353 - protein, 215 aa, Streptococcus sp. oral taxon 058 str. F0407
MYISRVEIDRTNRRKIRRLTHIGAYHAWVEESFPEEMEQSIRTRKLWRIDRIQDKDYLIIVSENKPDLQRLEKYGVSGSAQTKDYQQFLDNIYTGSRMKFRVVLNPVISLVSPDNLKRGIVKPHVTSEYQMNYLIDRSDKNGFSLIKEDFSIVERGYEMFKKAVKPIRLIKVVYEGVLTVSDADLFKKLLTEGMGKKKAYGFGLMTVIPLGNESW

SEQ ID NO: 7354 - protein, 224 aa, Leptonema illini DSM 21528
MYFSRITLSPSQIRKFLKTEIYGGLYDEHRLIWRFFPENEEQHRDFLYRKNDDSKTMQFFLLSERKPENDLDAFLIETKPFAPVIRKGAVYQFQLRANPVVTRMPEGKESKKRRRDDVYLDALAKNQALPAAEQITSQEVLTHSGSEWLIGRSEALGFSVNHVLVERYRRLQTRKKDTKMTFGIMDFSGVLTVTDEEPFRRSLLKGIGHGKAFGCGLLLLRRAI

SEQ ID NO: 7355 - protein, 229 aa, Thiorhodovibrio sp. 970
MGYLSKIELKQGLDIRTLANAIPKNAYAEHQAIWRLVGSGEPKARQFLYRREQAGHWPLFYLLSEIEPEPIEGPWDVHTKPFSPKVSGGQRLGFVLRANPVVTTSGSGKPEDKRRVRHDVIMHAKRQEQIREPDPARRMNQHELVQQVGPIWLKDRADQAGFALEALHVDGYRQHRLSKRGQGRPIQFSTLDYQGILRVTDTERFLQSLQTGIGHAKAFGCGLLLIRRV

SEQ ID NO: 7356 - protein, 205 aa, Methylomicrobium album BG8
MYLSKIHIPWHQAKNPYQFHQALWRLFPGQDESTRDFLFRVEQMQKGIGANVLLQSTLQPQSSVQSPSLLAQREYDLNVQNGQHFRFRLRANPIKTIKDSDKGTFEKKGKTYTKTVRVPLLQEEQQQAWLERKLQTFARLETLTMQPEPVLYFRKIKEGRSGKIQTVLFDGILTVTDATLFKQEITQGIGPAKAFGCGLLSIARI

SEQ ID NO: 7357 - protein, 223 aa, Saccharomonospora glauca K62
MSLWLVRILVNPRCHRVWSRGTLDGGALHRDIMRLAPDALGDQARKAANVLFRAEHTQRGLKILAQLSCAPRVDNLAPDFAHGTPECRNIESLVSSMRSGTQVRYRIDANPTKRLGNSAGDKKGRLAALHGADAEEWWHRRAAESGLELLSTTASAMPDILGSRNRDRRGRCRATSHGVTRFEGVAVVAAPEKVRSAVVEGVGRARTYGCGLLSIAPVPTSGG

SEQ ID NO: 7358 - protein, 198 aa, Desulfobacter postgatei 2ac9
MTFLSQVFINKTEAARRRISDSYAWHQVIWKNFMNCDGKPRSFLFRIDDAGVRFRLLVLSDTKPSSDDFGNWQIKTVSPNFLDHQCYRFQIKTNPTMRRASDRRRIGIYSEDRLREWIEKKAKQNGFKIEPHSLSIGSPMDEIFVRNRTRGKHVSVDFQGALNVFDPQAFRTAFEKGIGSAKSFGYGMLMLQLAKRPS

SEQ ID NO: 7359 - protein, 269 aa, Frankia sp. QA3
MTYLSRIWLNPLRTGAQALLTNPQRLHAAVLGGLSRQPVTERVLWRVENADATRGGGRSHRAEVLVLTESTPSWEHLVEQAGWIHADEPQIVVRDYQPLLDRLQTGREFRFRLRANTVSATRTPDKPSPAQREHLAGPRPRGVRVGHRTATHQTAWLTDRVDRWGFTLLTTADLDGEPLGQPADAAGPDRRAPALRLTARERLTFTKRSADGARTGRRVVLNTATFEGAIRVSDPARARETLLHGVGPAKAYGCGLITLAPLLAEPVRS

SEQ ID NO: 7360 - protein, 211 aa, Peptostreptococcus anaerobius VPI 4330 = DSM 2949
MYISRVEIDSDNRRKIKNLSHVAAYHSWVEDCFPIEKDEGIRTRKLWRVDRLNGRTYLLLVSENKPDLLGLEKYGVEGSAQTKSYDEFLEEIKEGSVMKFRVVLNPVVALSQGTGNKNKIKPHVTVEQQMKYLLDRSSKNGFELEESNFSIVERGYENFYKDGQKKVRLIKAVYEGVLTVSNKELFNRILTEGIGKKRAYGFGLMTVIPVV

SEQ ID NO: 7361 - protein, 215 aa, Klebsiella pneumoniae JHCK1
MTDLFASALHLDRAAVKALKISDAYSLHRVVYSLFADARTDREKCSHISSGIAYADQGGDFHGRKILIVSDRPPAAKVDGLYGEVISKSIPAAFLSHSRYRFQVQVNPVRKDKQTGKRVAVKGRADIAQWFIQRAASRWGFDVDLPGLQVEAMEVLQFKDKAGRQVTLGKATVQGLLTVTDRQKFQHSFHHGIGKGRAFGCGLLQIVPVVDALFS

SEQ ID NO: 7362 - protein, 216 aa, Salmonella enterica subsp. enterica serovar Dublin str. UC16
MYLSRITLHTSELSPAQLLHLVERGEYVMHQWLWDLFPGSKERQFLYRREELQGAFRFFVLSQEQPAASAIFDVQTRPFAPTLSAGQTLRFNLRANPTVCKNGKRHDLLMEAKRQRKTQGDSQDIWSYQQQAALTWLARQGEQNGFTLRETSVDAYRQQQIRREKSRQMIQFSSVDYTGVLVLNDPVLFLQRLAQGYGKSRAFGCGMMMIKPGDDA

SEQ ID NO: 7363 - protein, 214 aa, Gardnerella vaginalis JCP8481B
MTYLSRVEIDFQKYKSQMDLKSVGAFHNWVEQSFPDEFVDHERSRKLWRVDVLQGKQYLLVVSDNKPDLQRLEMYGVAGTAVTKSYDKFLEQLKDGMRMQFRVTLNPVVSISDTDETRTTRGRVVPHVTYDQQMNFLLKRAQKLGFVLRDDEFTIVERGYSLFTKSKKPIRLSRVTYQGVLTINDADTMRKTLIEGIGKKKAYGFGMMTLIPIG

SEQ ID NO: 7364 - protein, 214 aa, Gardnerella vaginalis JCP8481A; identical to SEQ ID NO: 7363

SEQ ID NO: 7365 - protein, 193 aa, Gardnerella vaginalis JCP8017A
VGAFHNWVEQSFPYEWENHERIRKLWRVDVLHGKHYLLIVSDSKPDLQRLEMYGVAGTASSKTYDKFLDSLMNGMRMQFRVTLNPVVSISDNAETRTTRGRVVPHVTYDQQMNFLFNRAQKLGFSLNENEFAIVERGYSLFTKSEKPIRLSKAVYQGILTINDADTMRKTLLEGIGKKKAYGFGMMTVIPLGN

SEQ ID NO: 7366 - protein, 215 aa, Gardnerella vaginalis JCP7672
MSYLSRVEIDYKKPSSLRDLKSVGAFHNWVEQSFPDEWEIHERSRKLWRVDVLHGKHYLLIVSDSEPDLQRLEMYGVSGTASSKTYDKFLDSLMNGMRMQFRVTLNPVVSISDTAETRTTRGRVVPHVTYDQQMKFLLNRAQKLGFSLNENEFAIVERGYILFTKSEKPIRLSKAVYQGILTINDADTMRKTLLEGIGKKKAYGFGMMTVIPLDN

SEQ ID NO: 7367 - protein, 215 aa, Gardnerella vaginalis JCP7659
MSYLSRVEIDYKKPSSLRDLKSVGAFHNWVEQSFPYEWENHERIRKLWRVDVLHGKHYLLIVSDSKPDLQRLEMYGVAGTASSKTYDKFLDSLMNGMRMQFRVTLNPVVSISDNAETRTTRGRVVPHVTYDQQMNFLFNRAQKLGFSLNENEFAIVERGYSLFTKSEKPIRLSKAVYQGILTINDADTMRKTLLEGIGKKKAYGFGMMTVIPLGN

SEQ ID NO: 7368 - protein, 215 aa, Gardnerella vaginalis JCP7275
MSYLSRVEIDYKKPSSLRDLKSVGAFHNWVEQSFPDEWENHERSRKLWRVDVLHGKHYLLIVSDSEPDLQRLEMYGVSGTASSKTYDKFLGSLMNGMRMQFRVTLNPIVSISDTDETRTTRGRVVPHVTYDQQMNFLLNRAQKLGFSLNKNEFAIVERGYSLFTKSEKPIRLSKVVYQGILTISDVDIMRKTLLEGIGKKKAYGFGMMTVIPLGN

SEQ ID NO: 7369 - protein, 218 aa, Gardnerella vaginalis JCP8070
MSYLSRVEIDYKKTSSLRDLKSVGAFHNWVEQSFPDEWENHERSRKLWRVDVLHGKHYLLIVSDSEPDLQRLEMYGVAGTASSKNYDKFLGSLMNGMRMQFRVTLNPVVSISDIAETRTTRGRVVPHVTYDQQMNFLLNRAQKLGFSLNENEFAIVERGYSLFTKSEKPIRLSKAVYQGILTINDADTMRKTLLEGIGKKKAYGFGMMTVIPLYNSNK

SEQ ID NO: 7370 - protein, 218 aa, Gardnerella vaginalis JCP8066
MSYLSRVEIDYKKPSSLRDLKSVGAFHNWVEQSFPDEWENHERSRKLWRVDVLHGKYYLLIVSDSKPDLQRLEMYGVSGTASSKAYDKFLGSLINGMRMQFRVTLNPVVAISDTAETRTTRGRVVPHVTYDQQMNFLLNRAQKLGFSLNENEFAIVERGYSLFTKSEKPIRLSKAVYQGILTINDADTMRKTLLEGIGKKKAYGFGMMTVIPLCNLNK

SEQ ID NO: 7371 - protein, 215 aa, Gardnerella vaginalis JCP8017B; identical to SEQ ID NO: 7367

SEQ ID NO: 7372 - protein, 216 aa, Salmonella enterica subsp. enterica serovar Dublin str. DG22; identical to SEQ ID NO: 7362

SEQ ID NO: 7373 - protein, 216 aa, Salmonella enterica subsp. enterica serovar Enteritidis str. 2009K0958
MYLSRITLHTSELSPAQLLHLVERGEYVMHQWLWDLFPGGKERQFLYRREELQGAFRFFVLSQEQPAASTIFDVQTRPFAPMLSAGQTLRFNLRANPTICKNGKRHDLLMEAKRQRKTQGDSQDIWSYQQQAALEWLARQGEQNGFTLREASVDAYRQQQIRREKSRQMIQFSSVDYTGVLVINEPALFLQRLAQGYGKSRAFGCGMMMIKPGDDA

SEQ ID NO: 7374 - protein, 216 aa, Salmonella enterica subsp. enterica serovar Enteritidis str. 08-1080; identical to SEQ ID NO: 7373

SEQ ID NO: 7375 - protein, 216 aa, Salmonella enterica subsp. enterica serovar Enteritidis str. 2010K-0262; identical to SEQ ID NO: 7373

SEQ ID NO: 7376 - protein, 216 aa, Salmonella enterica subsp. enterica serovar Enteritidis str. 2009K1726; identical to SEQ ID NO: 7373

SEQ ID NO: 7377 - protein, 216 aa, Salmonella enterica subsp. enterica serovar Enteritidis str. 2009K1651; identical to SEQ ID NO: 7373

SEQ ID NO: 7378 - protein, 216 aa, Salmonella enterica subsp. enterica serovar Enteritidis str. 2010K-0267; identical to SEQ ID NO: 7373

SEQ ID NO: 7379 - protein, 216 aa, Salmonella enterica subsp. enterica serovar Enteritidis str. 2010K-0284; identical to SEQ ID NO: 7373

SEQ ID NO: 7380 - protein, 216 aa, Salmonella enterica subsp. enterica serovar Enteritidis str. 2010K-0271; identical to SEQ ID NO: 7373

SEQ ID NO: 7381 - protein, 216 aa, Salmonella enterica subsp. enterica serovar Enteritidis str. 2010K-0286; identical to SEQ ID NO: 7373

SEQ ID NO: 7382 - protein, 224 aa, Lactobacillus fermentum MTCC 8711
MDIDLDWREIAMVYLSRVEIDTKNRRKIKDLTNLGAYHNWIEQSFPDEIQKGIRKRHLWRIDTLANRKYLLVVSEDKPDLTILSRYGIANTTATKEYSPFINSIKKGQQLRFRLVANPVLRKGARKNGERERTFPHITINQQKEWLIKRSERAGFKLSENSFEIKERDFVPLYHKGNRPIRLSRVAFEGILEVIDPIALQNTLIYGLGREKAYGMGMLTVIPIN

SEQ ID NO: 7383 - protein, 222 aa, Lactobacillus plantarum EGD-AQ4
MYLSRVEIDRDNRYKTRDLTHLGAYHNWVEQSFPEEIENNQRGRHLWRIDRLNGKDYLLVLSADRPKLEQLEQYGVAGTAMTKSYDTWLDHIESGMVLQFRLTANPTHSIIEPNHPKGRVVPHVTIEQQKRWLADRALRAGFELVTRAEAPADETEKLAFDVVSHDWPTLHRRKGRSVRLSRVTFEGVLRVRDAEIFKQTLTKGLGREKAFGMGLMTVIPTE

SEQ ID NO: 7384 - protein, 216 aa, Escherichia coli 2886-75
MYLSRITLHTGQLSPAQLLHLVDRGEYVMHQWLWDLFPGGKERQFLYRREELQGAFRFFVLSQERPAESETFTIECRSFVPELRTGQQLCFNLRANPTICKAGKRHDLLMEAKRQVRGQAEGSDVWLHQQQAALDWLAAQGERSGFTLLDTSVDAYRQQQLRRENSRQLIQFSSVDYTGMLTVTDPGLFLQRLSQGYGKSRAFGCGLMLIKPGAEV

SEQ ID NO: 7385 - protein, 246 aa, Actinomyces graevenitzii F0530
MFLTRIYLNPYRRGARKLMRSRQTMHAAVLNCFPPGSLDDAAAPRVLWRLDRAANSAGKQGSPAYALFMSSPVPPDPSHIVETAGYDTDGGVVVRELDGFLDRLEAGQRWGFRLCVNPTFRDKGQLDRAGRKKILAHVTQEQQTKWVLDRAERCGFKILESADLGGELPVLEDSQGQRVDGKNLLINGVERSLVEFRRGNGLVRLSIATFEGVLEVSDPQALRHAVVNGIGRGKAYGCGLLTLARA

SEQ ID NO: 7386 - protein, 228 aa, Actinomyces johnsonii F0510
MFLTKIDLAPERRLARKYLGSPQVMHAVVMGATGGHEGNGPGRVLWRVDRGVTTALYILSPLEPDCSQLVAEAGAAGTQARTLDYSPFLASLDAGQLWAFRLAANPSYSTSKGPGVRGQRYGHVTVEQQRQWLIERTPRLGFELMPVDHADGEGTDEAVLVAHRERPVFSRRRPGGGGYDRVTINRTVYEGVMRITDPESLCRALVTGIGKSKAYGCGLMTLARVQQV

SEQ ID NO: 7387 - protein, 247 aa, Actinobaculum sp. oral taxon 183 str. F0552
MHLTKIELDLHRRFARKLLSSPQVMHAVVMKACQPGGESGQSDATDGFPPGRVLWRVDSGSFGVSLYILSPSPPELTQLESEAGLSDTARTLDYEGFLDKLSNGQHWAFRLSANPIHSVPGKPGTRGKRYGHVTVEHQRKWLLERTGKYGFSIAGADAERDGTAEDSDGSSPLDASSVLIVRRDRPVFYRNRRDGQRRDRVTISRVVYEGVLRIDDAEPFKRMLVGGLGPSKAYGCGLMTLARPKRS

SEQ ID NO: 7388 - protein, 228 aa, Actinomyces johnsonii F0542
MFLTKIDLAPERRLARKYLGSPQIMHAVVMGATGGHEGNGPGRVLWRVDRGVTTALYILSPLEPDCSQLVAEAGAAGTQARTLDYSPFLTSLDAGQLWAFRLAANPSYSTSKGPGVRGQRYGHVTVEQQRQWLIERTPRLGFELMPVDHADGEGTDEAVLVAHRERPVFNRRRPGGGGYDRVTINRTVYEGVMRITDPESLCRALVTGIGKSKAYGCGLMTLARVQQV

SEQ ID NO: 7389 - protein, 249 aa, Actinomyces sp. oral taxon 172 str. F0311
MYLTRIYLNPHRRGARQLMRSRQVLHAAVMNCFPPGALEGAGMPRVLWRLDRPPFARSGPSRQGSPSCALFISSPVPPDPSHIVEEAGYSTDGGVLVRDMGDFLDRLEAGQRWGFRLCVNPTFREASQVNARGRKRVLAHVTQDQQTQWVLDRSERLGFRVLTSAEYGGDLPVLEDRDGRRVDGANLLINGVERSIAEFKRQGARVTLAVATFEGVLEVTDPDALRHGLVHGIGRGKAYGCGLLTLARS

SEQ ID NO: 7390 - protein, 252 aa, Actinomyces sp. oral taxon 877 str. F0543
MFLTRIFLNPSRRGCRELISSRQRLHAVVLNCFPPGALDAPEEGRLLWRLDGSGAARASRRAVGGRAHEALILYVSSPVPMDPSLIVETAGYATDEGVTVRDTGAFLEALSPGQRWGFRITVNPTFRDTKQRNGKGKKKTLAHVTIAQQTQWLLDRTEANGFSILTSREIGGDLPVLEDEAGERVDGANLVVDCVGRGIEKFQHDGTYVTIQMATFQGVLEVRDPARLRACLVGGMGRSKAYGCGLMTLAQP

SEQ ID NO: 7391 - protein, 216 aa, Streptococcus sobrinus W1703
MYISRVEIDKNNRRKIKDLKNIESYHGWVEQSFPKEIEQNIRTRKLWRVDQLQGHYYLIIISLEKPDLKLLEKYGVRNSAQTKSYDTFLNSLKEGEVMRFRVVLNPVISLPSRDGNHKRGVVKPHTTIKHQMNYLLNRSEKNGFLLEKDDFSIVERGYEVFNKGNSKPIRLIKAIYEGILTIDDADLFRKTLTEGIGKKKAYGFGMMTAIPLGDEK

SEQ ID NO: 7392 - protein, 212 aa, Peptostreptococcaceae bacterium oral taxon 113 str. W5053
MYISRVEIDMDDRKKIRDLTHVGAYHNWVERSFPSEIQEKSRSRKLWRLDAIGGKSYLLVVSETKPELEMFERYGVKGSVQIKAYHHFLFSLQKGNRMRFRVVLNPVKTFSKGVGNRGETKPIYTTEEQMNYLIERAEKNGFLLNAEDFSVVEKGNVVLKKANQSSTRLNKAVYEGTLTISDVELFKNILTLGMGKHKAYGFGMMTVIPMVD

SEQ ID NO: 7393 - protein, 208 aa, Ruminococcus callidus ATCC 27760
MYLTRIQLDLTKTKTMQALVAPKLFHGAIECAEPEGRTRKLWRLDTLNGNQYLLILTESPLDFSEVVRQFGTGTCAETKKYDVLLDRITNGSKWQFRLKANPVVYKKIAQSKRGKPVAHITTAYQEEWLEKQAAKHGFALEEDQWLVTESKWYRFRKGDSRQYVRILAVTYEGILTVTDAECFQLSLMQGIGRGKAYGLGMLTVAGEH

SEQ ID NO: 7394 - protein, 216 aa, Escherichia coli 113303; identical to SEQ ID NO: 7306

SEQ ID NO: 7395 - protein, 216 aa, Escherichia coli 113290
MYLSRITLHTGQLSPAQLLHLVDRGEYVMHQWLWDLFPGGKERQFLYRREELQGAFRFFVLSQERPAESEMFTIECRPFASELRTGQSLCFNLRANPTICKAGKRHDLLMEAKRQVRGQAEGSDVWLHQQQAALDWLAAQGERSGFTLLDTSVDAYRQQQLRRENSRQLIQFSSVDYTGMLTVTDPGLFLQRLSQGYGKSRAFGCGLMLIKPGAEA

SEQ ID NO: 7396 - protein, 216 aa, Escherichia coli 907357
MYLSRITLHTGQLSPAQLLHLVDRGEYVMHQWLWDLFPGGKERQFLYRREELQGAFRFFVLSQERPAESDTFTIECRSFAPELCTGQQLCFNLRANPTICKAGKRHDLLMEAKRQVRGQAEGSDVWLHQQQAALGWLAAQGERSGFTLLDTSVDAYRQQQLRRENSRQLIQFSSVDYTGMLTVTDPGLFVQRLSQGYGKSRAFGCGLMLIKPGAEA

SEQ ID NO: 7397 - protein, 216 aa, Escherichia coli 110957
MYLSRITLHTGQLLPAQLLHLVGRGEYVMHQWLWDLFPGGKERQFLYRREELQGAFRFFVLSQERPAESDIFTIECRPFAPELRTGQSLCFNLRANPTICKAGKRHDLLMEAKRQVRGQVEGSDVWLHQQQAALDWLAAQGERSGFTLLDTSVDAYRQQQLRRENSRQLIQFSSVDYTGMLTVTDPGLFLQRLSQGYGKSRAFGCGLMLIKPGAEA

SEQ ID NO: 7398 - protein, 199 aa, Escherichia coli 909945-2
MYLSKVIIARAWSRDLYQLHQGLWHLFPNRPDAARDFLFHVEKRNTPEGCHVLLQSAQMPVSTAVATVIKTKQVEFQLQVGVPLYFRLRANPIKTILDNQKRLDSKGNIKCCRVPLIKEAEQIAWLQRKLGNAARVEDVHPISERPQYFSGDGKSGKIQTVCFEGVITINDAPALIDLVQQGIGPAKSMGCGLLSLAPL

SEQ ID NO: 7399 - protein, 216 aa, Escherichia coli 907713
MYLSRITLHTGQLSPAQLLHLVDRGEYVMHQWLWDLFPGGKERQFLYRREELQGAFRFFVLSQERPAESETFTIECRSFVPELRTGQQLCFNLRANPTICKAGKRHDLLMEAKRQVRGQAEGSDVWLHQQQAALDWLAAQGERSGFTLLDTSVDAYRQQQLWRENSRQLIQFSSVDYTGMLTVTDPGLFLQRLSQGYGKSRAFGCGLMLIKPGAEA

SEQ ID NO: 7400 - protein, 216 aa, Escherichia coli 113302
MYLSRITLHTGQLSPAQLLHLVDRGEYVMHQWLWDLFPGGKKRQFLYRREELQGAFRFFVLSQERPAESDTFTIECRSFAPELCTGQQLCFNLRANPTICKAGKRHDLLMEAKRQVRGQAEGSDVWLHQQQAALGWLAAQGERSGFTLLDTSVDAYRQQQLRRENSRQLIQFSSVDYTGMLTVTDPGLFLQRLSQGYGKSRAFGCGLMLIKPGAEA

SEQ ID NO: 7401 - protein, 216 aa, Escherichia coli 907672
MYLSRITLHTGQLSPAQLLHLVDRGEYVMHQWLWDLFPGGKERQFLYRREELQGAFRFFVLSQERPAESETFTIECRSFAPELHTGQSLCFNLRANPTVCKAGKRHDLLMEAKRQVRGQAEGRNVWLHQQQAALDWLAAQGERSGFTLLDTSVDAYRQQQLRRENSRQLIQFSSVDYTGMLTVTDPGLFLQRLCLGYGKSRAFGCGLMLIKPGAEA

SEQ ID NO: 7402 - protein, 216 aa, Escherichia coli 907710
MYLSRITLHTGQLSPAQLLHLVDRGEYVMHQWLWDLFPGGKERQFLYRREELQGAFRFFVLSQERPAESDTFTIECRSFAPELCTGQQLCFNLRANPTICKAGKRHDLLMEAKRQVRGQAEGSDVWLHQQQAALGWLAAQGERSGFTLLDTSVDAYRQQQLRRENSRQLIQFSSVDYTGMLTVTDPGLFLQRLSQGYGKSRAFGCGLMLIKPGAEA

SEQ ID NO: 7403 - protein, 216 aa, Escherichia coli 907715; identical to SEQ ID NO: 7399

SEQ ID NO: 7404 - protein, 216 aa, Escherichia coli 907889; identical to SEQ ID NO: 7397

SEQ ID NO: 7405 - protein, 216 aa, Escherichia coli 908521; identical to SEQ ID NO: 7399

SEQ ID NO: 7406 - protein, 216 aa, Escherichia coli 908522; identical to SEQ ID NO: 7399

SEQ ID NO: 7407 - protein, 216 aa, Escherichia coli 908525; identical to SEQ ID NO: 7401

SEQ ID NO: 7408 - protein, 216 aa, Escherichia coli 908555; identical to SEQ ID NO: 7306

SEQ ID NO: 7409 - protein, 216 aa, Escherichia coli 908541
MYLSRITLHTAQLLPAQLLHLVDRGEYVMHQWLWDLFPGGKERQFLYRREELQGAFRFFVLSQERPAESETFTIECRSFAPELRTGQSLCFNLRANPTICKAGKRHDLLMEAKRQVRGQAEGRDVWLHQQQAALDWLAAQGERSGFTLLDTSVDAYRQQQLRRENSRQLIQFSSVDYTGMLTVTDPGLFLQRLSQGYGKSRAFGCGLMLIKPGAEA

SEQ ID NO: 7410 - protein, 216 aa, Escherichia coli 908573; identical to SEQ ID NO: 7305

SEQ ID NO: 7411 - protein, 216 aa, Escherichia coli 908585; identical to SEQ ID NO: 7399

SEQ ID NO: 7412 - protein, 216 aa, Escherichia coli 908616; identical to SEQ ID NO: 7399

SEQ ID NO: 7413 - protein, 216 aa, Escherichia coli 908658; identical to SEQ ID NO: 7397

SEQ ID NO: 7414 - protein, 221 aa, Cutibacterium acnes HL042PA3; identical to SEQ ID NO: 7296

SEQ ID NO: 7415 - protein, 199 aa, Lactobacillus fermentum NB-22
MVYLSRVEIDTKNRRKIKDLTNLGAYHNWIEQSFPDEIQKGIRKRHLWRIDTLANRKYLLVVSEDKPDLTILSRYGIANTTATKEYSPFINSIKKGQQLRFRLVANPVLRKGARKNGERERTFPHITINQQKEWLIKRSERAGFKLSENSFEIKERDFVPLYHKGNRPIRLSRVAFEGILEVIDPIALQNTLIYGLGRE

SEQ ID NO: 7416 - protein, 275 aa, Frankia sp. CcI6
MTYLSRIWLNPLRTGAQALLKNPQRMHAAVLGGLSRQPVTERVLWRLETGEGLRGADRPHRAEVLVLTESTPSWEHLIEQAGWIHTDEPQVLVRDYQPLLDRLHTGREFRFRLRANTVSATRTPDNPSPAQKEHLAAPRPRGVRVGHRTAAHQTTWLTDRIDRWGFTLLTTADLDGPRNQPDGPRNQPDGPGDTDEPAPALRLTARERLTFPKKAKNTEKTGRRVVLNTATFEGALRVTDPARARATLLHGVGPAKAYGCGLITLAPLHTEQAGR

SEQ ID NO: 7417 - protein, 216 aa, Salmonella enterica subsp. enterica serovar Cubana str. 76814
MYLSRITLHTSELSPAQLLHLVERGEYVMHQWLWDLFPGGKERQFLYRREELQGAFRFFVLSQEQPAASAIFDVQTRPFAPMLSAGQTLRFNLRANPTVCKNGKRHDLLMEAKRQRKTQGDSQDIWSYQQQAALTWLARQGEQNGFTLRETSVDAYRQQQIRREKSRQMIQFSSVDYTGVLVLNDPALFLQRLAQGYGKSRAFGCGMMMIKPGDDA

SEQ ID NO: 7418 - protein, 216 aa, Salmonella enterica subsp. enterica serovar Gallinarum/pullorum str. FCAV198
MYLSRITLHTSELSPAQLLHLVERGEYVMHQWLWDLFPGGKERQFLYRREELQGAFRFFVLSQEQPAASTIFDVQTRPFAPMLSAGQTLRFNLRANPTICKNGKRHDLLMEAKRQRKTQGDSQDIWSYQQQAALEWLARQGEQNGFTLREASVDAYRQQQIRREKSRQMIQFSSVDYTGVLVINEPALFLQRLAQGYGKSWAFGCGMMMIKPGDDA

SEQ ID NO: 7419 - protein, 212 aa, Streptococcus thermophilus TH985
MYISRVEIDRYNRRKVRDLTHVGAYHAWVEESFPSELEQSIRTRKLWRIDRIQGKDYLIIVSKEKPNLQKLEKYGVVGSAQTKDYQHFLDSIKTGFRMNFRIVLNPVISITSPDKSKRGVVKPHVTIKHQMDFLVKQSEKNGFSLVGESFSIVERGYEVFQKPEKPIRLSKVVYEGTLTVSDDTLFKKMLTEGVGKKKAYGFGLMTVVPLEE

SEQ ID NO: 7420 - protein, 199 aa, Escherichia coli str. K-12 substr. MG1655; identical to SEQ ID NO: 7252

SEQ ID NO: 7421 - protein, 202 aa, Geobacter sulfurreducens PCA; identical to SEQ ID NO: 7253

SEQ ID NO: 7422 - protein, 199 aa, Escherichia coli K-12; identical to SEQ ID NO: 7252

SEQ ID NO: 7423 - protein, 215 aa, Streptococcus oralis
MYISRVEIDRTNRRKIRCLTHIGAYHAWVEESFPEEMEQSIRTRKLWRIDRIQDKDYLIIVSENKPDLQRLEKYGVSGSAQTKDYQQFLDNIYTGSRMKFRVVLNPVISLVSPDNLKRGIVKPHVTSEYQMNYLLERSDKNGFSLIKDDFSIVERGYEVFKKAVKPIRLIKVVYEGTLTVSDADLFKKLLTEGMGKKKAYGFGLMTVIPLGNESW

SEQ ID NO: 7424 - protein, 215 aa, Streptococcus sp. oral taxon 058; identical to SEQ ID NO: 7353

SEQ ID NO: 7425 - protein, 215 aa, Streptococcus; identical to SEQ ID NO: 7336

SEQ ID NO: 7426 - protein, 221 aa, Cutibacterium acnes; identical to SEQ ID NO: 7296

SEQ ID NO: 7427 - protein, 212 aa, Streptococcus; identical to SEQ ID NO: 7339

SEQ ID NO: 7428 - protein, 213 aa, Streptococcus ratti
MYISRVEIDHANRRKIKDLTHVDAYHGWVESSFPAEIEKSIRTRKLWRVDTIKGRNYLIVVSQGKPDLSLLEKYGVSGSAQTKPYDPFLENLKPGDNFQFRVVLNPVISLSNRDHSKRGVVKPHVTVERQMQYLMDRSEKNGFSLREGDFSVVERGYEVLKKSTMKPVRLVKAVYEGVLTITDVELFRKVLTDGIGKKKAYGFGLMTVIPIGK

SEQ ID NO: 7429 - protein, 207 aa, Lactobacillus delbrueckii; identical to SEQ ID NO: 7312

SEQ ID NO: 7430 - protein, 207 aa, Lactobacillus delbrueckii
MYLSRVEIDTDNRQKIKDLSHLGAYHNWVERSFPAEIAEGERQRHLWRLDTLNGRNYLLLLSPEKPDLHEFERYGKPGTAISKDYEPFLSRLSEGQLLQFKLTANPVRRGGKSSSHPGSLIPCFAVDEQMKWLQGKAEKNGFELVAAEVVGHDRPLLRKKTHVALNRTVFEGRLKISNLDQFKAMLTSGIGREKAFGMGLMTVIPVD

SEQ ID NO: 7431 - protein, 217 aa, Lactobacillus helveticus; identical to SEQ ID NO: 7276

SEQ ID NO: 7432 - protein, 222 aa, Lactobacillaceae; identical to SEQ ID NO: 7383

SEQ ID NO: 7433 - protein, 227 aa, Lactobacillus coryniformis
MYFSRVEIDFNNRRKIKDLTHLGAYHNWVEHCFETEFQDNYRSRHLWRLDTIQDNNGDEHQFLLLVSEHKPNLEKLARYGIASSAQVKSYDPFLSYLQQGMRAQFRLTANPTYSVTQSGKRGKVYPHITSDQQLQWLGSRALKSGFKFVSKEYLAINDAALNLNNVDIVSRDFPILHKRGNRTVKLSRVSFEGQLEITDLSTFKNTLVNGLGREKAYGMGLLTIIPE

SEQ ID NO: 7434 - protein, 209 aa, Lactobacillus oris; identical to SEQ ID NO: 7329

SEQ ID NO: 7435 - protein, 215 aa, Gardnerella vaginalis
MSYLSRVEIDYKKPSSLRDLKSAGAFHNWVEQSFPDEWENHERSRKLWRVDVLHGKYYLLIVSDSEPDLQRLEMYGVSGTASSKTYDKFLGSLMNGMRMQFRVTLNPVVSISDTAETRTTRGRVVPHVTYDQQMNFLLNRAQKLGFSLNENEFAIVERGYSLFTKSEKPIRLSKAVYQGILTISDADIMRKTLLEGIGKKKAYGFGMMTVIPLDN

SEQ ID NO: 7436 - protein, 215 aa, Gardnerella vaginalis
MSYLSRVEIDYKKPKSQLDLKSVGAFHNWVEQSFPDEWENHERSRKLWRVDVLHGKHYLLIVSDSEPDLQRLEMYGVIGTASSKNYDKFLGSLMNGMRMQFRVTLNPVVSISDTAETRTTRGRVVPHVTYDQQMNFLLSRAQKLGFSLNENEFAIVERGYSLFTKSEKPIRLSKAVYQGILTISDADIMRKTLLEGIGKKKAYGFGMMTVIPLNN

SEQ ID NO: 7437 - protein, 215 aa, Gardnerella vaginalis; identical to SEQ ID NO: 7258

SEQ ID NO: 7438 - protein, 215 aa, Gardnerella vaginalis
MSYLSRVEIDYKKPSSLRDLKSVGAFHNWVEQSFPDEWENHERSRKLWRVDVLHGKYYLLIVSDSEPDLQRLEMYGVSGTASSKNYDKFLGSLMNGMRMQFRVTLNPVVSISDTDETRTTRGRVVPHVTYDQQMNFLLNRAQKLGFSLNENEFAIVERGYSLFTKSEKPIRLSKAVYQGILTISDADIMRKTLLEGIGKKKAYGFGMMTVIPLDN

SEQ ID NO: 7439 - protein, 218 aa, Gardnerella vaginalis
MSYLSRVEIDYNKPSSLRDLKSVGAFHNWVEQSFPNEWENHERSRKLWRVDVLHGKHYLLIVSDSEPDLQRLEMYGVAGTASSKTYDKFLSSLMNGMRMQFRVTLNPVVAISDTVETRTTRGRVVPHVTYDQQMNFLLNRAQKLGFSLNENEFTIVERGYSLFTKSEKPIRLSKAVYQGILTISDANIMRKTLLEGIGKKKAYGFGMMTVIPLCGSNK

SEQ ID NO: 7440 - protein, 215 aa, Gardnerella vaginalis
MSYLSRVEIDYKKPSSLRDLKSVGAFHNWVEQSFPYEWENHERIRKLWRVDVLHGKHYLLIVSDSKPDLQRLEMYGVAGTASSKTYDKFLDSLMNGMRMQFRVTLNPVVSISDNAETRTTRGRVVPHVTYDQQMNFLFNRAQKLGFSLNENEFSIVERGYSLFTKSEKPIRLSKAVYQGILTINDADTMRKTLLEGIGKKKAYGFGMMTVIPLGN

SEQ ID NO: 7441 - protein, 215 aa, Gardnerella vaginalis
MSYLSRVEIDYKKPSSLRDLKSVGAFHNWVEQSFPDEWENHERSRKLWRVDVLHGKHYLLIVSDSKPDLQRLEMYGVSGTASSKNYDKFLGSLMNGMRMRFRVALNPVVAISDTSETRTTRGRVVPHVTYDQQMNFLLNRAQKLGFSLNENEFAIVERGYSLFTKSEKPIRLSKAIYQGILTISDADIMRKTLLEGIGKKKAYGFGMITVIPLDN

SEQ ID NO: 7442 - protein, 211 aa, Peptostreptococcus anaerobius; identical to SEQ ID NO: 7360

SEQ ID NO: 7443 - protein, 224 aa, Lactobacillus curvatus; identical to SEQ ID NO: 7352

SEQ ID NO: 7444 - protein, 215 aa, Gardnerella vaginalis; identical to SEQ ID NO: 7367

SEQ ID NO: 7445 - protein, 221 aa, Cutibacterium avidum
MFLTQFDVNVARRDAVRLLASPERLHAAVLSSFPPGQSASDDGRTLWRLDRGPTPHEAKLMIVSPLRPDLTVLNEQAGWSTGVSGRSADYDPFLQGLRSGSTWRFRCAVNPTTAVRRTAGSRGQRVAEVTAEQQLAWFLGRAEGHGLSVPVTPDGTPSARVTRREVLRFRRRGSMVTLAVTQVDGVIHVADADAARVALTCGIGPAKGYGCGLMTLAPVVS

SEQ ID NO: 7446 - protein, 215 aa, Anaerococcus lactolyticus; identical to SEQ ID NO: 7286

SEQ ID NO: 7447 - protein, 212 aa, Anaerococcus prevotii; identical to SEQ ID NO: 7341

SEQ ID NO: 7448 - protein, 220 aa, Corynebacterium matruchotii; identical to SEQ ID NO: 7321

SEQ ID NO: 7449 - protein, 215 aa, Fannyhessea vaginae; identical to SEQ ID NO: 7343

SEQ ID NO: 7450 - protein, 213 aa, Lactobacillus mucosae
MVYLSRVEIDTKNRRKIKDLTNLGAYHNWIEQSFPDEIQKGIRKRHLWRIDTLANRKYLLVVSEDKPDLTILSRYGIANTTATKEYSPFINSIKKGQQLRFRLVANPVLRKGAGKNGERERTFPHITINQQKEWLIKRSERAGFKLSENSFEIKERDFVPLYHKGNRPIRLSRVAFEGILEVIDPIALQNTLIYGLGREKAYGMGMLTVIPIN

SEQ ID NO: 7451 - protein, 219 aa, Lactobacillus iners; identical to SEQ ID NO: 7323

SEQ ID NO: 7452 - protein, 219 aa, Lactobacillus iners; identical to SEQ ID NO: 7326

SEQ ID NO: 7453 - protein, 219 aa, Lactobacillus iners; identical to SEQ ID NO: 7327

SEQ ID NO: 7454 - protein, 219 aa, Lactobacillus iners; identical to SEQ ID NO: 7328

SEQ ID NO: 7455 - protein, 209 aa, Lactobacillus antri; identical to SEQ ID NO: 7292

SEQ ID NO: 7456 - protein, 207 aa, Lachnoanaerobaculum sp. OBRC5-5
MYISRVELDIYNRQKIRDLTHLGAYHNWVEQSFREDNGVRSRKLWRLDKINDKKYLLLVSGEKPDLKLLEKYGVTGSAVTKEYDAYISKIKNGMKLRFRLVTNPVHAVMEDGKRGSEKPHITAEFQKKFFMDRTIRNGFEVNEDEVNIVERGFELLRKSGSKPVKVVKATFEGVLTVVDEDKFKLLLENGFGKKKAYGFGLMTVIPM

SEQ ID NO: 7457 - protein, 216 aa, Streptococcus ictaluri
MYISRVEIDKNNRQKIRDLRNIESYHGWVEQSFPKELEQKIHTRKLWRIDQLQGSYYLIVISSEKPDLRLLEKYGVKDSAQTKSYDALLSSIKKGKRMGFRVVLNPVISLASRDGYHKRGVMKPHTTVEHQLKYLRDRSLKNGFLLKEDDFSIVEKGYEVFNKGTSHPIKLIKVVYEGILTVNDADLFRRTLIEGIGKKKAYGFGMMTVIPLGDQK

SEQ ID NO: 7458 - protein, 206 aa, Lactobacillus equicursoris; identical to SEQ ID NO: 7274

SEQ ID NO: 7459 - protein, 206 aa, Lachnoanaerobaculum saburreum; identical to SEQ ID NO: 7337

SEQ ID NO: 7460 - protein, 206 aa, Lachnoanaerobaculum saburreum
MYISRVEVDIYNRQKIRDLTHLGAYHNWVEQSFKEAGVRSRKLWRIDKINNKKYLLLVSGEKPDVKLLEKYGVAGSAITKDYTAYISKIKKGMKLRFRLVTNPVHAVMEDGKRGSEKPHITAEFQKKFFMDRTLKNGFEVIEDEVNIVERGFEVLRKSGAKPVKVVKATFEGVLTVVDEDKFKSLLENGFGKKKAYGFGLMTVIPT

SEQ ID NO: 7461 - protein, 214 aa, Parasutterella excrementihominis; identical to SEQ ID NO: 7347

SEQ ID NO: 7462 - protein, 212 aa, Peptoniphilus duerdenii; identical to SEQ ID NO: 7319

SEQ ID NO: 7463 - protein, 211 aa, Peptoniphilus sp. oral taxon 836; identical to SEQ ID NO: 7313

SEQ ID NO: 7464 - protein, 217 aa, Megasphaera genomosp. type_1; identical to SEQ ID NO: 7298

SEQ ID NO: 7465 - protein, 210 aa, Oribacterium sp. oral taxon 108; identical to SEQ ID NO: 7350

SEQ ID NO: 7466 - protein, 217 aa, Peptoniphilus sp. oral taxon 375
MYISRVKLDLNNRKNLRDLSHLGCYHGWIEDSFPDERGKGNRSRKLWRIDSIHNEHYLLVLSEEKPEESILEKYAVKGSLEIKDYDPFIEKLREGMQAKFRIKLNTVKSLADRSQGRRRGRLVPVPLDELIPYFLSRAEKNGFHVDEGDLKIVARSKELFEKQDQEDTRIKLDLVSTSYEGLLTITDLEKFKKALTQGIGKKKAYGFGLLTIIPYHG

SEQ ID NO: 7467 - protein, 210 aa, Oribacterium parvum
MYLSRVEIDKENRRKIRDLTHLGAYHSWVEDSFVGQISMLERSRKLWRIDSIQGNQYLLILSEEKPSLKALEKYGVDGSGETKAYDSFLASIQEGKKYRFRTTLNPVVAKSIEGEKRGKPVPLLTIENQSRFLLDRAEKNGFSLNSDDFVIKERKFETLKKKGMKDTPISQVSYEGILTVIDAEQFRKALCDGIGKKKAYGCGLLTVIPV

SEQ ID NO: 7468 - protein, 205 aa, Lactobacillus pasteurii; identical to SEQ ID NO: 7273

SEQ ID NO: 7469 - protein, 207 aa, Lachnoanaerobaculum sp. ICM7
MYISRVELDIYNRQKIRDLTHLGAYHNWVEQSFREESGVRSRKLWRLDNINDKKYLLLVSVEKPDLKLLEKYGVPSSAVTKDYDAYISKIKTGMRLRFRLVTNPVHAVMEDGKRGSEKPHITAEFQKKFFMYRTIKNGFEVNEDEVNIVERGFEILRKSGSKSVKVVKATFEGVLTVVDEDKFKSVLENGFGKKKAYGFGLMTVIPI

SEQ ID NO: 7470 - protein, 214 aa, Atopobium vaginae
MYLSRVEINCNNLKTMRDLAHVETFHAWVEESFPEEWLTHTRSRKLWRVDTLRGKQYLLVLSNSKPDLTKLEKYGVAHTAATKNYDSLLTSLKKGDRLQFRVALNPVISLPSERVQDGKRPRGRVVPHVTHAQQIEFLASRAQKYGFSLEAGEFDIVERGFSYFRKSQKPIRLVKAVYQGFLTIEDVELFRNALINGIGKKKAYGFGMMTVIPQ

SEQ ID NO: 7471 - protein, 222 aa, Lactobacillus
MYLSRVQIDVNNRQKTKSLTHLGAFHNWIEHCFPDEIRAHNRYRHLWRIDQLAGKKYLLLLSKERPDLTELVKYGIPQTAMSRAYDPFLMQIQEGQIMQFRLTANPTHAIKRPDSKQPRIVPHITIQQQGKWLADRADKLGFQLVEQNQDRFSNVPELAAFDIVNRDWPILRHGGRRIRLSRVTFEGLLRVKNLEEFKQTLENGVGRERAFGMGLMTVIPRG

SEQ ID NO: 7472 - protein, 215 aa, Lactobacillus paracasei
MYLSRVQVNTNDHQIFKHLTHLGAYHDWVKRSFPREIAAGTRLRHLWRLDSLNGRDYLLVLSPDAPELAQLARYGVAGTAQTKDYDPFVTALRQGQRLRFRLTANPTRAIATPGQRGHVAPHVTVAQQMAWLSERAAALGFELPIDDDGPQFQIVGRDYPALRRAQGKPVRLSRVSFEGTLVVSDLVRFKETLATGIGREKAFGMGLLTVIPEAR

SEQ ID NO: 7473 - protein, 224 aa, Lactobacillus fermentum; identical to SEQ ID NO: 7382

SEQ ID NO: 7474 - protein, 215 aa, Gardnerella vaginalis; identical to SEQ ID NO: 7255

SEQ ID NO: 7475 - protein, 198 aa, Streptococcus mutans
MKNLTHVGAFHDWVERSFPNEIEKQIRTRKLWRIDTLQGKNYLVIISSGKPDLLLLEKYGVEGSAQTKLYDNCLNTLKKGNRMKFRVALNPVISLPSSDNKKRGIVKPHVTSEYQMKYLKDRSEKNGFLLDEAEFLIVERGYEVFKKAKPKPIRLIKTVYEGTLTISDVDRFRKVLTEGIGKKKAYGFGLMTVIPAGD

SEQ ID NO: 7476 - protein, 218 aa, Lactobacillus
MYISRVEIDTNNRQKIRDLYHLGAYHNWVENCFPNELKKKVRLRHLWRIDELNGKKYLLVLSEEKPKLDKLERYGVANTAETKDYDHFLSSLNQGKKYRFKLTANPSYRITDAKTGKSKVVPHITVLQQTKWLLDRSEKYGFDLVKSEDDEETYEMNITSRDWPRLRRKGNKIVKLSRVTFEGLLEIKDLQQFKQAMVTGIGREKAFGMGLLTVIPME

SEQ ID NO: 7477 - protein, 207 aa, Lactobacillus delbrueckii
MYLSRVEIDTDNRQKIKDFSHLGAYHNWVERSFPAEIAEGERQRHLWRLDTLNGRNYLLLLSPEKPDLHELERYGKPGTAISKDYEPFLSRLSEGQLLQFKLTANPVRRGGKSSSHPGSLIPCFAVDEQMKWLQGKAEKKGFELVAAEVVGHDRPLLRKKTHVALNRTVFEGRLKISNLDQFKVMLTSGIGREKAFGMGLMTVIPVD

SEQ ID NO: 7478 - protein, 210 aa, Clostridium sp. SY8519
MYLSRVEIDVRNRRKIKDLTHLGAYHNWVECSFPNEWKESIRSRKLWRIDTLQGRRYLLLVSEEKPDLEKLEKYGIHGSAQTKSYDKFLTSITEGGIYRFRVTLNPVKSISRGEGKRGRVVPEITATQQLRYLEERADQLGFELIPDEYQIVERGWEAFRKQGQEMIRLSKATYEGLLKITNRDVFYHTLTRGVGKKKAYGFGLMTVIPV

SEQ ID NO: 7479 - protein, 212 aa, Streptococcus
MYISRVEIDRYNRRRVRDLTHVGAYHAWVEESFPSELEQSIRTRKLWRIDRIQGKDYLIIVSKEKPNLKKLEKYGVVGSAQTKHYQHFLDNIKTGCRMNFRVVLNPVISISSPDKSKRGVVKPHVTIEHQMDFLVKRSEKNGFSLVGESFSIVERGYEVFQKPEKPIRLSKVVYEGTLTVSDETLFKKILTEGIGKKKAYGFGLMTVVPLEE

SEQ ID NO: 7480 - protein, 250 aa, Lactobacillus sanfranciscensis
MYLSRVQIDVNNRQKTKSLTHLGAFHNWIEHCFPDEIRAHKRYRHLWRIDQLAGKKYLLLLSEERPDLTELVKYGIPQTAMSRDYDPFLMQIQEGQIMQFRLTANPTHAIKRPDSKQPRIVPHITIQQQGKWLADRADKLGFQLIEQNQDRFSNVPELAAFDIVNRDWPILRHGGRRIRLSRVTFEGLLRVKNLEEFKQTLENGVGREKAFGMGLMTVIPRDSKPHHALSDAQATLELETKLIENGHLLI

SEQ ID NO: 7481 - protein, 216 aa, Lactobacillus
MYLSRVEIDQGNRQKLKDLTHLGAYHSWVENSFPEKFGQDRPRHLWRIDTLRHKRYLLVVSAEKPNLNLLDKYGVPGTAETKNYDPFLEKVKQNMIYNFRLTANPVHRVTQPGQKNGKLYPHITIEKQKEWLINRAKNCGFEIIKDESGIYQFDVVSRDWPLLFHKGTKRVRLSRVSFEGQLKVVDLKLFKQHLISGIGKEKAYGMGMLTIIPVRA

SEQ ID NO: 7482 - protein, 221 aa, Cutibacterium acnes
MFLTQFDINVARRDAMRLLASPERLHAAVLGAFPPGQSVSNGARTLWRLDRGPARHDARLMIVSPLRPDLTALNEQAGWSNGASSRSANYDPFLQALRSGSTWRFRCTINPTTAVRKSAGSRGQRVAEVTAEQQLTWFIGRVERHGYTVPVNDQGAPSAQVTRREILRFRRQRSTVTLAVTQVDGVIQIQDADAARLALVQGIGPAKSYGCGLMTLAPAVR

SEQ ID NO: 7483 - protein, 184 aa, Streptococcus salivarius
MEESFPSELEQSIRTRKLWRIDRIQGKDYLIIVSKEKPNLKKLEKYGVVGSAQTKHYQHFLDNIKTGCRMNFRVVLNPVISISSPDKSKRGVVKPHVTIEHQMDFLVKRSEKNGFSLVGESFSIVERGYEVFQKPEKPIRLSKVVYEGTLTVSDETLFKKILTEGIGKKKSYGFGLMTVVPLEG

SEQ ID NO: 7484 - protein, 213 aa, Streptococcus mutans
MYISRVEIDMNNRRKVKNLTHVGAFHDWVERSFPNEIEKQIRTRKLWRIDTLQGKNYLIIISSEKPDLLLLEKYGVEGSAQTKLYDNFLNTLKKGNRMKFRVALNPVISLPSSDNKKRGIVKPHVTSEYQMKYLKDRSEKNGFLLDEAEFLIVERGYEVFKKSNPKPIRLIKTVYEGTLTISDVDRFRKVLTEGIGKKKAYGFGMMTVIPVGD

SEQ ID NO: 7485 - protein, 222 aa, Lactobacillus buchneri; identical to SEQ ID NO: 7269

SEQ ID NO: 7486 - protein, 214 aa, Gardnerella vaginalis; identical to SEQ ID NO: 7363

SEQ ID NO: 7487 - protein, 218 aa, Gardnerella vaginalis; identical to SEQ ID NO: 7369

SEQ ID NO: 7488 - protein, 214 aa, Streptococcus sobrinus
MYISRVEIDKNNRRKIKDLKNIESYHGWVEQSFPREIEQNIRTRKLWRIDQLQGRQYLVIISSEKPNLELLEKYGVENTAQTKSYDEFLSALKKGARMRFRVVLNPVISLASRDGYHKRGIMKPHTTIEHQMKYLLDRSVKNGFLLEKEDFSIVEKGYEVFNKGNSKSIRLIKAVYEGILTINDADLFRRTLTEGIGKKKAYGFGMMTVIPAGD

SEQ ID NO: 7489 - protein, 214 aa, Streptococcus sobrinus
MYISRVEIDKNNRRKIKDLKNIESYHGWVEQSFPKEIEQNIRTRKLWRVDQLQGHYYLIIISLEKPDLKLLEKYGVRNSAQTKSYDTFLNSLKEGEVMRFRVVLNPVISLASRDGYHKRGIMKPHTTIEHQMKYLLDRSVKNGFLLEKEDFSIVEKGYEVFNKGNSKSIRLIKAVYEGILTINDADLFRRTLTEGIGKKKAYGFGMMTVIPAGD

SEQ ID NO: 7490 - protein, 193 aa, Gardnerella vaginalis; identical to SEQ ID NO: 7365

SEQ ID NO: 7491 - protein, 215 aa, Gardnerella vaginalis; identical to SEQ ID NO: 7366

SEQ ID NO: 7492 - protein, 215 aa, Gardnerella vaginalis; identical to SEQ ID NO: 7368

SEQ ID NO: 7493 - protein, 218 aa, Gardnerella vaginalis; identical to SEQ ID NO: 7370

SEQ ID NO: 7494 - protein, 247 aa, Actinobaculum sp. oral taxon 183; identical to SEQ ID NO: 7387

SEQ ID NO: 7495 - protein, 246 aa, Actinomyces graevenitzii; identical to SEQ ID NO: 7385

SEQ ID NO: 7496 - protein, 228 aa, Actinomyces johnsonii; identical to SEQ ID NO: 7386

SEQ ID NO: 7497 - protein, 228 aa, Actinomyces johnsonii; identical to SEQ ID NO: 7388

SEQ ID NO: 7498 - protein, 249 aa, Actinomyces sp. oral taxon 172; identical to SEQ ID NO: 7389

SEQ ID NO: 7499 - protein, 252 aa, Actinomyces sp. oral taxon 877; identical to SEQ ID NO: 7390

SEQ ID NO: 7500 - protein, 216 aa, Streptococcus sobrinus; identical to SEQ ID NO: 7391

SEQ ID NO: 7501 - protein, 212 aa, Peptostreptococcaceae bacterium oral taxon 113; identical to SEQ ID NO: 7392

SEQ ID NO: 7502 - protein, 208 aa, Ruminococcus callidus; identical to SEQ ID NO: 7393

SEQ ID NO: 7503 - protein, 218 aa, Lactobacillus fermentum
MYLSRVKVDTKNRQKISDLTHLGAYHSWVEDSFPQEVVKGERKRHLWRLDQVQGKEYLLVLSDDQPNMNRLEKYGVPGSAQSKTYDQFLSQIQTGRVMRFRLTANPVHRVTEPGEKAGKVYPHITIAQQEKWLIDRAEKNGFTLLTTDDGYQFDVVGRDRPQLLHKGQRRVKLNRVSYEGLLKVSDADLFKKLLVNGIGKEKAYGMGLMTVIPVHEKA

SEQ ID NO: 7504 - protein, 210 aa, Lactobacillus ruminis CAG:367; identical to SEQ ID NO: 7275

SEQ ID NO: 7505 - protein, 216 aa, Escherichia coli; identical to SEQ ID NO: 7400

SEQ ID NO: 7506 - protein, 199 aa, Limosilactobacillus fermentum; identical to SEQ ID NO: 7415

SEQ ID NO: 7507 - protein, 215 aa, Gardnerella vaginalis 409-05; identical to SEQ ID NO: 7255

SEQ ID NO: 7508 - protein, 204 aa, Oceanithermus profundus DSM 14977; identical to SEQ ID NO: 7259

SEQ ID NO: 7509 - protein, 215 aa, Deinococcus proteolyticus MRP; identical to SEQ ID NO: 7260

SEQ ID NO: 7510 - protein, 206 aa, Marinithermus hydrothermalis DSM 14884; identical to SEQ ID NO: 7262

SEQ ID NO: 7511 - protein, 229 aa, Coriobacterium glomerans PW2; identical to SEQ ID NO: 7261

SEQ ID NO: 7512 - protein, 198 aa, Sphaerochaeta coccoides DSM 17374; identical to SEQ ID NO: 7264

SEQ ID NO: 7513 - protein, 211 aa, Thermus thermophilus JL-18; identical to SEQ ID NO: 7265

SEQ ID NO: 7514 - protein, 255 aa, Thiocystis violascens DSM 198; identical to SEQ ID NO: 7266

SEQ ID NO: 7515 - protein, 238 aa, Thiocystis violascens DSM 198; identical to SEQ ID NO: 7267

SEQ ID NO: 7516 - protein, 228 aa, Desulfomonile tiedjei DSM 6799; identical to SEQ ID NO: 7268

SEQ ID NO: 7517 - protein, 222 aa, Lactobacillus buchneri CD034; identical to SEQ ID NO: 7269

SEQ ID NO: 7518 - protein, 202 aa, Geobacter sulfurreducens KN400; identical to SEQ ID NO: 7253

SEQ ID NO: 7519 - protein, 205 aa, Thermus oshimai JL-2; identical to SEQ ID NO: 7270

SEQ ID NO: 7520 - protein, 245 aa, Mycobacterium smegmatis JS623; identical to SEQ ID NO: 7271

SEQ ID NO: 7521 - protein, 444 aa, Pasteurella multocida subsp. multocida str. Pm70
MKSNFVRNRISSFFEERKIKKIKTLRRKLAKETDPVEIEKLTQSINNLEHYYQYDICMSDFAIRMTAQLTFGTHISKGIHPDSRGNNVKFQATFIYNEYVGSHCLKTLELDANGDASALPLVALFDYIIDDENELTLRELLLADDPRLVGCFADDLELSEQYKKRFQDVLTGEVRELATYELNKQLFWVNSVSSIENDDYICLIPLYPSALTHTFYQKIVQTRYSEKNKNASTKRYKKVSGQEHYCSINDLGIVSLGGSNSQNVSQLNSSQKGRHYLLPSLPPRCKTHKIKPINLLSNTIFNNDLAYICQGGLDKLYSVVKAQKNVYTVRDNRSKALNMILESILDIVSELQKQPAGWSKDSQLEMCEKYWLDPKRVHLPDEEAFRAEYEKGEWVAEVERRFALWLNKRLQKRFPHIAKDFDDVEYHEWRRNIRRTLRYRLRHP

SEQ ID NO: 7522 - protein, 448 aa, Yersinia pestis KIM10; identical to SEQ ID NO: 51

SEQ ID NO: 7523 - protein, 122 aa, Coxiella burnetii RSA 493
MNDIVANLFTQLINCWDIQLRKVYFFSDINCRKAENMNSLMEKAMKSENEMEELKKRINDFIQGRLEVKLTKLPPSDKKRQQIIEEYQPKNWISNAARRASQIQLVTHAIKFQHPDAKGTSK

SEQ ID NO: 7524 - protein, 469 aa, Chromobacterium violaceum ATCC 12472
MNEHNPRARGLQTLIQDFIQQRLSDKLDKLADDDPKRAELRAQYRPQAWLADAARRAGQLQLVTHPVKASHPDARGSSLFVTPESLPPRPEAGSHHLASAASDVVGNAAALDVYKFLKLEHEGHTLLALLRAGDPDLLAALSDDAEQAAAWRDAFCAIAEPSGGPASHTRAKQIYWPVPPESGLPANPHDDSHYHLLAPLYSSSLSHWLYQRIQRDRFGEEAKAARQARRDRVDHPRGYSDYPLLAEEKKGGTKPQNISQLNSERKGSSYLLASLPPLWDNSDLRPLYRLDSVFSRFGRRKTVRETIRELKQWLAKLNPEATPPDQAKPGNRHVRNRRDAYLEQIFEELLQFGAAYANQLPRGWTADSECRLPLEEQCWLDPRRADSDEDFNRHFQFQDWPRQLTESFARWLNGQLGGDRLQLAEAEFHHWRRELAHDIDWQRQQDNKLREQNTRLLPAGHNPGGQNAD

SEQ ID NO: 7525 - protein, 448 aa, Yersinia pestis biovar Microtus str. 91001; identical to SEQ ID NO: 51

SEQ ID NO: 7526 - protein, 303 aa, Listeria monocytogenes serotype 4b str. F2365
MIKLINVVKKFGKIEAVKGINLEVEKGSLFAFLGENGAGKSTTLSMICTESEPTSGEIFIDDEKLTFKNRKLFRQKLGVVFQENVLDDLLTVRENLYNRASLYGKTKAEITERLALVSSIMGIEDILNRRFEKLSGGQKRRAEIARAIMHDPEILLLDEPTTGLDPKTRVSVWKIIDYLREELGMTVFLTTHYLEEAKDADQLAVIHKGKIIAQGTPANIRSRFSVDKIFFYDAKVAELQKIMKKMNLPFKVTNRTMRVDVIDENVEILAILNQAIGFYDSFEVIKGNLDDAFISMIKEDSND

SEQ ID NO: 7527 - protein, 439 aa, Zymomonas mobilis subsp. mobilis ZM4 = ATCC 31821
MHHNNARIQIFRQAISDFIENRRDEKLKGKADDPAAMRKYDYAIWLEDAARRVGQIHAATHIAKAIHSSAKGSNLYIKPDSLPQREEIGSHLLGENFDIDVVGNAAALDVFKFLKTKVEDKTLLAWAEAGDPDFKAALSENPDQAEEWLSSFAGLLSSDKKVQSHALMKQLYWLRGEDPTQDDQYILLQPLFPSALVNYVHQNIQAVRFGESNKEARSAFSKKEASELVYQEYKKLAVQRLGGTKPQNISQLNSERGGVNYLLASLPPRWKGKRRLLPLNCKSALDVFFKRPDVYGQVDKLIKFLKSNPPDNLNTRQYRQRFEQKLIESLVDFAATIKAEMPVGWSREDGCQLPPYERLWLDPERSLFSLRDDSDEADQIFYNEYMKGDWPDAVAQNFGRRLNAKLKHQDIPVGETEYIHWVRQVTIDAAWPVPWRRRV

SEQ ID NO: 7528 - protein, 450 aa, Nitrosococcus oceani ATCC 19707
MLIDDLTQALSASEGSSAEQLKQLKAQLLGHCRAPVKVTDEDVPPLLIAAINFAYGNPTSPEQLLSAESAKAALTAKVTPKTIGDMFIWAALASHMGTHHPKSRNDKVSSGPIVARSLTPPPAGLVTSANLRTRQFSGSGNGANTAHYQWLAFTYEDSAGVFSVIERAASQDERLGETVLTLGIQESQWQAFQEAAEAHLTVTNSAPLDRQLKQVFIPDPGQNNDFIVITPLAATAVIGAFEQHRTKLREQDANLNFHRIGVGGAKPQNAGSLMNELGGNLRQLTMTIPRLDLTQRQRRLWHLQRGRLFQPLPKKEAQRFTWWLELDWTQRYGNRQDHLQRLEQRIAEWLLPELEVQEQLFAWLSSDSLDAVHERQKLEAENLPNWILTLAGISKNPETEHGTHEARQEAAYKALTFHLKSPLSDEIDKLIQDALESLLARRYSAEGAVA

SEQ ID NO: 7529 - protein, 435 aa, Escherichia coli UTI89
MEKTALIQFITEYIASRRQPKIDAFEKEAAKRVEQGEDASVIAQERQELEARYLPRNWLTDAAKRAGQIKLVTHGAKFSHGDSKASSFYLETSANESYLNTASLANVATDAIGNAAALDVAKLLQTDVNGDSLLASLKRGDYQALSTFAEDKVQLELWVAGFSQAWTTGRPSSHKLAKQIYFPVADGYHLLCPLFSSSLAQAMYEKLTAVRFSEESKAIRDARKAGKWHSQPDIWFPNLAEMHFGGTKPQNISLLNSVRGGRVWLLPSMPPTWATLDRAPQNMRSIFSLRGDFNRAASGIVAQMTYLLKVDINNVHIRTVRAKYIDELIDLLFMQASAFQQEKWQGWSAQSPDLPRHQQLWLDPWRSLSDETFKQEREKNDWQVTVADDFARWLNYRLKKSSFDVGAVEQKEWRSQSLFAQRMREMEAVLQEALK

SEQ ID NO: 7530 - protein, 448 aa, Yersinia pestis Antiqua; identical to SEQ ID NO: 51

SEQ ID NO: 7531 - protein, 448 aa, Yersinia pestis Nepal516; identical to SEQ ID NO: 51

SEQ ID NO: 7532 - protein, 435 aa, Escherichia coli APEC O1; identical to SEQ ID NO: 7529

SEQ ID NO: 7533 - protein, 434 aa, Pseudomonas aeruginosa UCBPP-PA14
MTSPLPTPTWQELRQFIESFIQERLQGKLDKLQPDEDDKRQTLLATHRREAWLADAARRVGQLQLVTHTLKPIHPDARGSNLHSLPQAPGQPGLAGSHELGDRLVSDVVGNAAALDVFKFLSLQYQGKNLLNWLTEDSAEALQALSDNAEQAREWRQAFIGITTVKGAPASHSLAKQLYFPLPGSGYHLLAPLFPTSLVHHVHALLREARFGDAAKAAREARSRQESWPHGFSEYPNLAIQKFGGTKPQNISQLNNERRGENWLLPSLPPNWQRQNVNAPMRHSSVFEHDFGRTPEVSRLTRTLQRFLAKTVHNNLAIRQRRAQLVAQICDEALQYAARLRELEPGWSATPGCQLHDAEQLWLDPLRAQTDETFLQRRLRGDWPAEVGNRFANWLNRAVSSDSQILGSPEAAQWSQELSKELTMFKEILEDERD

SEQ ID NO: 7534 - protein, 418 aa, Psychromonas ingrahamii 37
MLDPAIESFFSDRKEAWLKKKVNASMEESEVNVLQLECQQFFSLNEWLPNAAKRAGQISLATHPCTFSHPSARKNKNGYVSSVIANVQRAEDGFLKTGNVVVDTDALGNAAALDVYKFLTLIMQDNRSLLTHIQQDSALAENLLAMTSKSYQDLKTGFLAMIESSVENITSSKIKQVYFPVDNDYHQLSLLTNSGMLYQLRKRIDRLRFSDQVKELRDKKRKNEFSEQGYCDIYGLTTIGYGGTKPQNISVLNNQNGGKAHLLSSLPPTIEKCHTHFPKSDFFVESFQQQEALSLFYFLQKIIKNKYNNINIRDARNDCIQEIIDKIIDKMWAVRAISAEQYHQESSNLKDHQLIWLHQNFAQKREATDLWLDQLTTEIARWLSRAYEKMIGKQAIKLGEQELAHIEQIVDQNREALR

SEQ ID NO: 7535 - protein, 432 aa, Shewanella sp. W3-18-1
MIDGTISEFFADRKSAWLKKNIKASMSDVEIKALEIECETQFSLANWLPNAASRAGQIAISTHPCTFSHPSARKNKNGYVTSIIAHSEKANDGFLRSGNVEVAADALGNAAALDVYKFLTLVMADGETLIQHLERDSEQAVNLLAAASKETYPDYQTLKQAFLAMTATSSESITSSKIKQVYFPLNRGNSVNGHLASIEYHQLSLLTASGIVFELRQRLDAMRFGETIKEARDKKKTNQFHQGYKEIYNLTTIGYGGTKPQNISVLNNQNGGKAHLLLSLPPNLKNRDVHFPHSDFFSQTLRYTQCKNQFQALHQLYRGDDNNMHIRAQRDDYYQSVIDHVIEKMWQVRSVAQAQFRREDSLLPTVQQTWLCEHTKILRETTDDWLDVICNAITVFLFHGYEKTLGSKAIKFGDAEYRQMQKIVLSNKEALR

SEQ ID NO: 7536 - protein, 481 aa, Acidovorax sp. JS42
MESHRETTERCQRIRLAMHEHVAHRLAHALRKLQGKDDAAAKQRRIEAQEKYQLVHILERGVRTVEQIAVASHIAKGVHPDLPVKKTTNLAVDFSSLPMVDVVGSHVLSKRDGLHDTTGNGSYNSAAYELYLLLECRVEGQKLIDLLRLEDPDATEAVNSSAQLDNAAALCIQLLEPKCTAVSANTLSKQIYWLTGPDASDDTHYTLLAPLYATSLAHAVHAQVQEDRFGEANKAARQARRERKMHDGVFHDYPGLAVQNMGGTKPQNISQLNSERRGVNYLLSSLPPQWQASAVRLPVHATSVFDRLFIARPEVRRTVRALRVFLESNPDANLATRDRREELLDALVDELVSLAAELQQMLPPGWSRDDQRFKELAYEEALWLDPLRAEIPEEAQFAHDWQYMDWPAAIGKAFAGWLNAQLRDKLPVGDAEAREWKKVLLTDEDGFKQQLRELRNKLDAPHYIPIRKTHAELVALREENP

SEQ ID NO: 7537 - protein, 450 aa, Verminephrobacter eiseniae EF01-2
MAKTDTPSHDSFKAAVQAFLQERLEAKLDKLKDDDPKREEERNKYRPTVWIEDAARRVQQIQAVTHSLKPIHPDARGTNLYVEPDSLPMLTELGSHALGKDFAPDVTGNAAALDVYKFLKLQVGERSLLTALQEEDPAAMQVLHDDAAQAKALRDKLVGLTQPGSGGASSHSRAKQLYWLTGSDAAADDDYELLAPLFATSLAHRVYADVQEVRFGEANKAARQAWRERKAHDGVLVDYPGLAMQKMGGTKPQNISQLNSERGGVNYLLASLPPIWKVTERRLPVNTDSVFKHLYPQRPDVQKTVRELRRFLEEDPEPNLATRERRAAYVETLVNELLNLAGELQQGLPAGWTLNDKRFQQLAPVEQLWLDPRRATLPDEDDFAKEWLWQDWPAAIAKRFGNWLNDKLAGRLLVGDVEAREWQRALIGEDDGWREALTEQRKHIHQQRGQ

SEQ ID NO: 7538 - protein, 449 aa, Actinobacillus pleuropneumoniae serovar 5b str. L20
MITPLQIRAKIIDFLQAQHLKKSENDYKKLEKATEPEEIAKIKAEISKSEEKYRLDTWLHIAATEMAQQLKFGTHIAKGIHPDAKGNNINFRANLNLPATLVGSQLIDKLVLDANGNAAALPLAAFFDIMVDEVNKRTLKDLLLTDEPCLDGCFSDDLSLSAQYKIAFQMALKGNLNSPETHERNKQVLWVNSSSAIEDNHYTCLIPLYPSSFTHAIYNKLNQARFSEENKQARENRYKNKAQNPYISIPHLAVTKLGGTKPQNVSLLTSKQGGRNYLLPSLPPIFSKGELRLTNAQNTIFNDRLAYVCRAGLYQLYQAVADSRKNYIVRVPRAEAVNLIVQMVLQQAYKLQKRTAGWSRDYQLAWCEKYWLDPQRAKLNGEEQFHSALTQQDWISEVEQRFAAWLNALLKKRFPKHQDDFTATEYNEWRKYFRKKLHRQLRCLYKEVL

SEQ ID NO: 7539 - protein, 448 aa, Yersinia pestis Pestoides F; identical to SEQ ID NO: 51

SEQ ID NO: 7540 - protein, 435 aa, Enterobacter sp. 638
MSEATLTAFIAEYIAGRRQTKLEAFDKEAAKRNDADIYALAVERHELELRYEPAAWLTDAAKRAGQISLVTHVAKFAHGDSRSSSILIEKQDLEGYLNSSTIPSLIIDASGNAAALDVAKFLQIKIDGYSLLDRIRSGNYTALEYYAKNTHQLEKWVSGFLSAVNITKVSSHKLAKQIYFPVGTGYHLLVPLFSTSFAHEIYHIFKSNYFSEETKVARKALRDKSWHSGTVIFYPEMLKMHFGGSNPQGISALNTARRGEMHLLSCEPPKDKVIKTPPRMIKSIFAVPGSFNNKAAPLINHLTDLLSGKTSKRGAHLHKFRDDLLLQISNLLFDASSGLQRKEWQGWTTQCPDLVRHQKLWLDPWQSKIDEDFKFEREKGDWKELVIKDFSLWVNYRLGESLSDIGETERREWERNVDLLRYLRLSEKMIEWELK

SEQ ID NO: 7541 - protein, 431 aa, Dichelobacter nodosus VCS1703A
MKSISEITTEELKNAIRAFLSAECEKKTKDSSDIEKMKKYRPDIWLQDAQKKAERFKVGTHISKGIHSQSQGDNVYFSQKVDHDYVNTKTVTNNYLDGGGAASDFPLASFFEWEVITGSGIKMRDVIWENGAAVQRCFADDPELSQTYQQTFLTCLQAQPQNPQTDALNKQLLWALPQTDDNRDNYLVLVPLHPSVLTHEFYHKIEAINNNRFDVKSKSVPQKRYADLLDLAQIKLGGSKPQNISVLTSKQRGINYLLPSLPPVFRARQDIHFSPKLESIFFSKSLYYRVEDDLKILFGVIYCKENNYEIRNMRKAAVHRIAHQILSIGETICALRPAGWSKDYDLSSAQKYWLDPKRADLAGEEKFKAERDAADWDKAIEKDFANWLQKVLEERFKKHRHEFTDIEHYEWQREMKAVIKESFRLNKRGLL

SEQ ID NO: 7542 - protein, 453 aa, Shewanella baltica OS185
MELTLSDALADYIAQRKQTKLEPLQKARDKMLEKTQEPIEIATANREYAEAAAPIEADFNPVNWLTDAAKRAKQISLATHAAKFTHSDAKASSILVADTAPESQTYLNTASLANKAIDAVGNAAALDVAKLLKISVNGESLIKQLQAQHVDALTAFTQDTELLKEWQLGFARALADEKLTGHTLTKQLYFPVSTVLNGDESQHYHLLCPLFSSSLAHELYHHVTSTRFGDEPKAIREARKKGHYHASLEKIFPATAVQNFGGSKPQNISQLNSERYGQSFLLNCAPPHYQAQSKPPLTSASIFSRQLRFKTAGFIREFKAFLAGVTAQENNFKARYQRDYGFVLPIIDVLLNEAAIIQNMTEFAGWATSAECQLKTAHGLWLDVANPEPRFQQERAKGDWQDIIANDFATWLLAQLQNKERYVLGDIEHQYVKKLCLVQLKTFERHTPKHGDA

SEQ ID NO: 7543 - protein, 448 aa, Yersinia pseudotuberculosis IP 31758
MEEKGLTAFIVSYIKSREQPKLEAFDKEAEKRLAGLTQAEDIALAQQEIAQQRRELIARYEVRNWLTDAANRAGQISLVTHALKFTHSDAKGSSVFNLPAAENDAIYLSSATLGQPAVDAVGNAAALDVAKLLQTEHNGDSLLACLNRADNSPLAALAENPQQLALWVEGFKQALVDKQLTSHKLAKQFYFPVGPDQYHLLSPLFSSSLAQAMHQRIAEARFSDQSKEAKVAHKAGKWHSEARVIYLKTAVQNIGGTKPQNISYLNSVRGGKVWLLPCGAPPWKNIQKPPIKYRSIFHDRSEFTVLARNNLWQMQQYLLGVKPLSNTMDIRAVRLACSDEIIDILFNYVAEIQNLDGTNGWSDAEDCKLKRSEQLWLDPNRAMDDPVFKLEREKEDWKQEVRQDFGYWLNRWLQHDELVFGYVEQREWSSLFKQRLREFEQGSLETWS

SEQ ID NO: 7544 - protein, 420 aa, Coxiella burnetii Dugway 5J108-111
MLMLNSSIDEFFKKRKVAWLKKAINASMDEIEVSEKELECEQVFALEHWLPSAAKRAGQISISTHPCTFSHPSSRKNKNGYASSIIANSKRSEDGYLRSGNVTVKADALGNAAALDVYKFLSLEMADGQTLLSHIQQDSDLAQQLLNIKSESYNTLKDGFLAMINRNSDCVTSSKIKQVYFPLDNGYHQLSILSASGIMFELRKRIDTIRFSDEAKAARVCEKNNEIYDGDYKQIVNITTIGYGGTKPQNISVLNNQNGGKVHLISSEPPKLIKRDAHFPTVDFFSQSLRYFQCKDLFYSLHELFLNHKNDWNIRHERDEYYQAIIDLIIEKMWLVRSVSQVQYNPDSTRLNETQKIWLCEVNKENRETENDWLDDLCQAIARFIFTGYEKLLGKKAFIFSDDEFKHIHKQVVKNKEALR

SEQ ID NO: 7545 - protein, 469 aa, Coxiella burnetii Dugway 5J108-111
MNDIVANLFTQLINCWDIQLRKVYFFSDINCRKAENMNSLMEKAMKSENEMEELKKRINDFIQGRLEVKLTKLPPSDKKRQQIIEEYQPKNWIANAARRAAQIQLVTHAIKFQHPDAKGTSIYLDAPLLENAEFVSSRALPPEKRYSDVVGNAACLDVYKFLQLSLNGERLLERIIRKDSALYAAFPGKKEEKEAWFKAFANIKEASSPPIAHELMKQIYFPVGDESYHLITPLFPTSLAQAVYQRIQKDRTSEEAQEARKAKKENKPHSKGYRDYPNLAIRRFGGSKPQNISQGNSDRKGRAYLLSSQPPRWKSQKIKPPLQAKSIFEQLFSYRVRDLTKELKDFLIKVQKHNNFDIRQKRDDLVTRISDELLSYAAEIRQLKPGWSAHPDCKLSEAQAFWLDSKRALEDKEWGKKRNTTNWKSLVCDDFGYWLNNTLQTKTLRFGDDEHNEWKKKLKKELSLLKEIL

SEQ ID NO: 7546 - protein, 465 aa, Delftia acidovorans SPH-1
MPPTPSAMRWHDAIATFIQERLKAKLDKLAEDDLKRQELLAQHQRDTWMEDAARRVTQIQAVTHSLKPIHPDARGTNLYVEPASLPALQELGSHALGQSFAGDVVGNAAALDVYKFLKVEVDGTSLLAALLAQDPGALQALHEDPQQAMGLRDAFVGLTQPRAGAPSSHTRAKQLYWLTGSDACADEGYELLAPLFATTLAHAVHAQVQEDRFGESNKAARQARRERKAHDGVFHDYPGLAVQKMGGTKPQNISQLNSERGGVNYLLASLPPVWRSSDVRLPVHASSVFDRLFIGRPEVRSTVRKLRAFLATDPEPNLQTRERREAFMDALIDEMVSLAGEVQQTLPAGWSRDVERFGKLVREEQLWLDPLRTELRDEADFAREWLWMDWPAEVGKRFANWLNSQLFGQLPVGDAEARVWKKELLTDEDGFVQQLRELRKRLDAPAYIPIRKTHDELVMHRGGAV

SEQ ID NO: 7547 - protein, 453 aa, Shewanella baltica OS195
MELTLSDALADYIAQRKQTKLEPLQKARDKMLEKTQEPIEIATANREYAEAAAPIEADFNPVNWLTDAAKRAKQISLATHAAKFTHSDAKASSILVADTAPESQTYLNTASLANKAIDAVGNAAALDVAKLLKISVNGESLIKQLQAQHVDALTAFTQDTELLKEWQLGFARALADEKLTGHTLTKQLYFPVSTALNGDESQHYHLLCPLFSSSLAHELYHHVTSTRFGDEPKAIREARKKGHYHASLEKIFPATAVQNFGGSKPQNISQLNSERYGQSFLLNCAPPHYQAQSKPPLTSASIFSRQLRFKTAGFIREFKAFLAGVTAQENNFKARYQRDYGFVLPIIDVLLNEAAIIQNMTEFAGWATSAECQLKTAHGLWLDVANPEPRFQQERAKGDWQDIIANDFATWLLAQLQNKERYVLGDIEHQYVKKLCLVQLKTFERHTPKHGDA

SEQ ID NO: 7548 - protein, 122 aa, Coxiella burnetii RSA 331
MNDIVANLFTQLINCWDIQLRKVYFFSDINCRKAENMNSLMEKAMKSENEMEELKKRINDFIQGRLEVKLTKLPPSDKKRQQIIEEYQPKNWISNAARRAWQIQLVTHAIKFQHPDAKGTSK

SEQ ID NO: 7549 - protein, 448 aa, Yersinia pestis Angola
MSDEGLAAFIVSYIKSREQPKLEAFDKEAEKRLAGLTQAEDIALAQQEIAQQRQELIARYEVRNWLTDAANRAGQIKLATHAPKYTHSDSKSSGILNIELQSKKKDYFSSVDLAEQASDVIGNAAVFDLVKLLQSECEGGSLIKCLEQGDNSVLKLFSNDDELVEEWTTKFKSILNNEKFTSHKLAKQFYFPVGPDQYHLLSPLFSSSLAQAMHQRIIEARFSDQSKEAKAAHKAGRWHPTVRVLYLDTAVQHIGGTKPQNISYLNSVRGGKVWLLPCGAPSWKNIQKPPIKYRSIFHDRSEFTVLARNNLWQMQLYLLGVKPLRNTMDIRAARLACCDEIIDILFNYVAEIQNLDGTNGWSDAEDCKLKRSEQLWLDPTRAMDDPVFKLEREKEDWKQEVSQDFGYWLNRWLQHDELVFGYVEQREWSSLFKQRLREFEQGSLETSS

SEQ ID NO: 7550 - protein, 449 aa, Actinobacillus pleuropneumoniae serovar 3 str. JL03
MITPLQIRAKIIDFLQAQHLKKSENDYKKLEKATEPEEIAKIKAEISKSEEKYRLDTWLHTAATEMAKQLKFGTHIAKGIHPDAKGNNINFRANLNLPATLVGSQLIDKLVLDANGNAAALPLAAFFDIMVDEVNKRTLKDLLLTDEPCLDGCFSDDHSLSAQYKIAFQMALKGNLNSPETHERNKQVLWVNSSSAIEDNHYTCLIPLYPSSFTHAIYNKLNQARFSEENKQARENRYKNKAQNPYISIPHLAATKLGGTKPQNVSLLTSKQGGRNYLLPSLPPIFTKGELRLTNAQDTIFNDRLAYVCRAGLYQLYQAVADSRKNYIVRVPRAEAVNLIVQMVLQQAYKLQKRTAGWSRDYQLAWCEKYWLDPQRAKLNGEEQFHSALTQQDWISEVEQRFAAWLNALLKKRFPKHQDDFTATEYNEWRKYFRKKLHRQLRCLYKEVL

SEQ ID NO: 7551 - protein, 448 aa, Yersinia pseudotuberculosis YPIII
MEEKGLTAFIVSYIKSREQPKLEAFDKEAEKRLAGLTQAEDIALAQQEIAQQRQELVARYEVRNWLTDAANRAGQISLVTHALKFTHSDAKGSSVFNLPAAENDAIYLSSATLGQPAVDAVGNAAALDVAKLLQTEHNGDSLLACLNRADNSPLAALAENPQQLALWVEGFKQALVDKQLTSHKLAKQFYFPVGPDQYHLLSPLFSSSLAQAMHQRIAEARFSDQSKEAKVAHKAGKWHSEARVIYLKTAVQNIGGTKPQNISYLNSVRGGKVWLLPCGAPPWKNIQKPPIKYRSIFHDRSEFTVLARNNLWQMQQYLLGVKPLSNTMDIRAVRLACSDEIIDILFNYVAEIQNLDGTNGWSDAEDCKLKRSEQLWLDPNRAMDDPVFKLEREKEDWKQEVSQDFGYWLNRWLQHDELVFGYVEQREWSSLFKQRLREFEQGSLETWS

SEQ ID NO: 7552 - protein, 448 aa, Yersinia pseudotuberculosis PB1/+
MEEKGLTAFIVSYIKSREQPKLEAFDKEAEKRLAGLTQAEDIALAQQEIAQQRRELIARYEVRNWLTDAANRAGQISLVTHALKFTHSDAKGSSVFNLPAAENDAIYLSSATLGQPAVDAVGNAAALDVAKLLQTEHNGDSLLACLNRADNSPLAALAENPQQLALWVEGFKQALVDKQLTSHKLAKQFYFPVGLDQYHLLSPLFSSSLAQAMHQRIAEARFSDQSKEAKVAHKAGKWHSEARVIYLKTAVQNIGGTKPQNISYLNSVRGGKVWLLPCGAPPWKNIQKPPIKYRSIFHDRSEFTVLARNNLWQMQQYLLGVKPLSNTMDIRAVRLACSDEIIDILFNYVAEIQNLDGTNGWSDAEDCKLKRSEQLWLDPNRAMDDPVFKLEREKEDWKQEVSQDFGYWLNRWLQHDELVFGYVEQREWSSLFKQRLREFEQGSLETWS

SEQ ID NO: 7553 - protein, 434 aa, Pseudomonas aeruginosa
MTSPLPTPTWQELRQFIESFIQERLQGKLDKLHPDEDDKRQTLLATHRREAWLADAARRVGQLQLVTHTLKPIHPDARGSNLHSLPQAPGQPGLAGSHELGDKLVSDVVGNAAALDVFKFLSLQYQGKNLLNWLTEDSAEALQALSDNAEQAREWRQAFIGITTVKGAPASHSLAKQLYFPLPGSGYHLLAPLFPTSLVHHVHALLREARFGDAAKAAREARSRQESWPHGFSEYPNLAIQKFGGTKPQNISQLNSERYGENWLLPSLPPHWQRQDQRAPIRHSSVFEHDFGRSPEVSRLTRTLQRLLAKTRHNNFTIRRYRAQLVGQICDEALQYAARLRELEPGWSATPGCQLHDAEQLWLDPLRAQTDETFLQRRLRGDWPAEVGNRFANWLNRAVSSDSQILGSPEAAQWSQELSKELTMFKEILEDERD

SEQ ID NO: 7554 - protein, 449 aa, Actinobacillus pleuropneumoniae serovar 7 str. AP76
MITPLQIRAKIIDFLQAQHLKKSENDYKKLEKATEPEEIAKIKAEISKSEEKYRLDTWLHTAATEMAKQLKFGTHIAKGIHPDAKGNNINFRANLNLPATLVGSQLIDKLVLDANGNAAALPLAAFFDIMVDEVNKRTLKDLLLTDEPCLDGCFSDDHSLSAQYKIAFQMALKGNLNSPETHERNKQVLWVNSSSAIEDNHYTCLIPLYPSSFTHAIYNKLNQARFSEENKQARENRYKNKAQNPYISIPHLAATKLGGTKPQNVSLLTSKQGGRNYLLPSLPPIFTKGELRLTNAQDTIFNDRLAYVCRAGLYQLYQAVADSRKNYIVRVPRAEAVNLIVQMVLQQAYKLQKRTAGWSRDYQLAWCEKYWLDPQRAKLNGEEQFHSALTQQDWISEVEQRFAAWLNALLKKRFPKHPDDFTATEYNEWRKYFRKKLHRQLRCLYKEVL

SEQ ID NO: 7555 - protein, 122 aa, Coxiella burnetii CbuG_Q212
MNDIVANLFTQLINCWDIQLRKVYFFSDINCRKAENMNSLMKKAMKSENEMEELKKRINDFIQGRLEVKLTKLPPSDKKRQQIIEEYQPKNWISNAARRAAQIQLVTHAIKFQHPDAKGTSK

SEQ ID NO: 7556 - protein, 420 aa, Coxiella burnetii CbuK_Q154
MLMLNNSIDEFLKKRKVAWLKKAINASMDEIEVSEKELECEQVFALEHWLPSAAKRAGQISISTHPCTFSHPSSRKNKNGYASSIIANSKRSEDGYLRSGNVTVKADALGNAAALDVYKFLSLEMADGQTLLSHIQQDSDLAQQLLNIKSESYNTLKDGFLAMINRNSDCVTSSKIKQVYFPLDNGYHQLSILSASGIMFELRKRIDTIRFSDEAKAARACEKNNEIYDGDYKQIVNITTIGYGGTKPQNISVLNNQNGGKVHLISSEPPKLIKRDAHFPTVDFFSQSLRYFQCKDLFYSLHELFLNHKNDWNIRHERDEYYQAIIDLIIEKMWLVRSVSQVQYNPDSTRLNETQKIWLCEVNKENRETENDWLDDLCQAIARFIFTGYEKLLGKKAFIFSDDEFKHIHKQVVKNKEALR

SEQ ID NO: 7557 - protein, 416 aa, Acinetobacter baumannii AB0057
MAESIHTFLNERKELWLKDRIKKAENESAIAELQQQANYKFSLNEWLPDAAKRVTQLSMVSHPSKFSHPSAKTSSVIAKVEYCNDGYLRSGNVDYSLDVFGNAAAMDVFKFLSLALTENLTVLDGFEKQDQELKKLIAHAELDFDNLSSEFLKIKATDDSIKTDHLVKQVYFPVGEAQYHLLSILTPSGLITRLKQSVDVMRFSEETKQAKESRKKNEHHEVGYSDIFDLTVTGYGGTQPQNVSVLNSQNAGRAYLLPSCPPVLEKRTIRLPKTDFFAQCLYRKNYQDSFIQLHKFMQLDLNNIDIRNAIKNIIQFVIDQILLQALKTREYAVEGWSNQDYYASLPKIQRIWLDKVHQKEREENSDWRDELSREVARWILRSYEKVISDAYTLGTGELLDVKQRVENSLQKAKEFF

SEQ ID NO: 7558 - protein, 416 aa, Acinetobacter baumannii AB307-0294; identical to SEQ ID NO: 7557

SEQ ID NO: 7559 - protein, 528 aa, Laribacter hongkongensis HLHK9
MSKELNATKVCPDEQACPILTDPPPISLDAPRDRALSSLPAWEKSERVTGIEHAGQRWLSTLQDIRDVLLAGAVPTKQQVTADRQTVPMTLPKLQSLWQAICQRQLEMAPQYQPAAWLEDAARRVSQLQLVTHPLKATHPDARGSSLFVAPDSLPVRQEVGAHALTDIASDVVGNAAALDVYKFLKLEHEGQSLLALLQAGDADVLAALSDDATQAEVWREAFCSITEPAGGPASHSLAKQVYWPVSPDDFPPDALDDSHFHLLSALNSSALSHWLFGRIQTHRFGEEAKAARQARRDGVAHPHGYYDYPLLAGEKKGGTKPQNISQLNSERKGSNYLLASLPPQWDSSATRPLHGVDSLFERFGRLPQVRRLVRELRDYLGKQKPEANNMHIKNRRDAWLEDIFTALLQFGAAFSNGLPKGWTADSDCRLLLDEQCWLDPFRAEDDADFNQAFQWQDWPDQLAERFARWLNGSLGAERLSKHQLSLNEAEFDYWRRELAHDLDSKRRELDNRRLPTASTEEAQHEPA

SEQ ID NO: 7560 - protein, 438 aa, Tolumonas auensis DSM 9187
MDTISLSSAIDDYISSRRTSRLETRAKEAEKERKTLANDQLALMAWEQKQADLLRSEVERYLPANWLDDAAKRAKQITLVTHAPKYTNGDAKGSGVLADVTLATGEYLCTASLSALNIDVVGNAAALDVANLLLLEVNGEQLVDVLRRGDASPLSPFARDEMQLAEWLAGFRQALESGALSSHKLAKQIYFPVGGDSYHLISPLFASSLAQAQHERIEGQRFGEEAKTARVARKNREPHETDVIDFPNLAVQTFGGTKPQNVSLLNSGRHGKAYLLNSQPPRWKSQDKPPADDQAFWRQYGRLVYPKIRELKSYLLFVVDKESTLSIRDRRAELVADLVSELHQLAARIQSQVAGWSLNTSLSITLAHWLDPARDDKEFVEVRLRNDWQQGVGEQFATWLNRQLQNEQLQMKDAEHSIWRKLVERELKLLKGDLEVLA

SEQ ID NO: 7561 - protein, 441 aa, Dickeya paradisiaca Ech703
MEESELTQFIVSYINDKEKSKQDDLDKVADNQRMSLSGEALAAMELKLEQERLEIVRTWLTDNAPKAYQIKRATHVLKFTHSSAKGSSRLDLFKDLSLPFLSTASLSHPVLDTAVDNAAVLGIAKLLTEEHQGDSLLAALQRGDYRALEALAESPEQLAQWLAGFKQVLSDKQPSSHSLAKQIYFPVGDGQYHLLSPLYSSSLSQALDQRLNAVRFGEQAKAIREARRQKRWHDEVDVSYPGIAVQNMGGDNKQNVSALNVKRNGRSYLFNCSPPQWRSQDKPPLKHDTIFRNSGELYTRTRDQLSAMRKFLLSVKDVDNNRDIRNQRRRYLDQLIDTLFDYVVTVQNQYPAGWSVDSCLKRHLQLWLDPQRGSRDSAFLRERDMGDWQQDVAHEFGQWLNARLKHEKLIFGEVERREWSTAALFKQRLRETERALKEERA

SEQ ID NO: 7562 - protein, 445 aa, Dickeya chrysanthemi Ech1591
MSSEGLQAFILSYIETRKQAKLDAFDKAADKQRAALSGEALAAAEVALLQQRREIEQAYEVRTWLTDAASRAGQISLVTHALKFTHSDAKGSSVFSAKTATATDVLSTASLAQPAIDAVGNAAALDVAKLLQTEHQGDSLVAALQRGDHRSLEALAENTEQLAQWLAGFGQVLSDKQPSSHKLAKQIYFPVGEEEYHLLSPLYSSSLSQALDQRLNAVRFGEQAKAIREARQQKRWHDEIYVSYPGIAVQNMGGTKPQNISALNSARSGRSYLLSSAPSQWLSQIKLPLEHDTIFRERGEVDALTYTARRELQQFLLSVKEVENNREIRNQRRRYLDRLINALFDYVATVQNLGKAGWSTYSQLNFPLQLWLDPRRCQQDDAFRYARDGGDWKERVAHEFGQWLNARLRHDKLIFGEVERREWSTAALFKQRLRETERALKEELA

SEQ ID NO: 7563 - protein, 439 aa, Zymomonas mobilis subsp. mobilis NCIMB 11163
MHHNNARIQIFRQAISDFIENRRDEKLKGKADDPAAMRKYDYALWLEDAARRVGQIHAATHIAKAIHSSAKGSNLYIKPDSLPQREEIGSHLLGENFDIDVVGNAAALDVFKFLKTKVEDKTLLAWAEAGDPDFKAALSKNPDQAEEWISSFAGLLSSDKKVQSHALMKQLYWLRGKDPTEDDQYILLQPLFPSALVNYVHQNIQAVRFGESNKKARSAFYKKEASELVYQEYKKLAVQRLGGTKPQNISQLNSERGGVNYLLASLPPRWIEKRRLLPLNCKSALEVFFKRPDVYVQVDRLIKFLKSNPPDNLNTRQHRQRFEQELTESLVDFAAAIKAEMPVGWSREDSCQLPMYERLWLDPERSLFSLRDGSDEADQIFYSEYMKGDWPDAVAQDFGRRLNAKLKHQDIPVGDTEYIHWVRQVTIDAAWPVPWRRRA

SEQ ID NO: 7564 - protein, 444 aa, Pectobacterium parmentieri WPP163
MEDNRLTQFIVSYINNRKQAKLDVFDKDAEKKRAALSGETLAVTELELAQVRREIEQKHEVQNWLTDAASRAGQISLVTHALKFTHSDARGSSIFSADTVADAKTLSTATLAQPAIDAVGNAAALDVAKLLQTEYDGDSLVAALQRGDHRALEALAENSEQLAQWLTGFQQVFTDRQPSSHKLAKQIYFPLANGEYHLLSPLYSSSLAQALHQRINAVRFGDEAKAIRQAQKANQWHDQLSISYPNLAVQNMGGTKPQNISALNSSRSGRSYLLSSAPPQWNSIEKPPQQHECIFRLNGEVDYHTRDIVRPMRHFLLSVKEVENNRDIRQQRLRYLDQLIDQLFFYVASVQNLPVGWSAESELKRAQQLWLDPYRADTDTVFRREREAGDWQQAVAYDFGRWLNRRLKHENLIFGEVERREWSTAALFKRRMREMEGTLKEELA

SEQ ID NO: 7565 - protein, 448 aa, Yersinia pestis D106004; identical to SEQ ID NO: 51

SEQ ID NO: 7566 - protein, 448 aa, Yersinia pestis D182038; identical to SEQ ID NO: 51

SEQ ID NO: 7567 - protein, 445 aa, Dickeya zeae Ech586
MSSEGLQAFILSYIETRKQAKLDAFDKAADKQRAALSGEALAAAEVTLLQQRREIEQAYEVRTWLTDAASRAGQISLVTHALKFTHSDAKGSSVFSTEPATATDVLSTASLAQPAIDAVGNAAALDVAKLLQTEHQGDSLVAALQRGDHRALEALAENAEQLTQWLAGFGQVLSDKQPSSHKLAKQIYFPVGDGEYHLLSPLYSSSLSQALDQRLNAVRFGEQAKATREARRQKRWHDEVDVSYPGIAVQNMGGTKPQNISALNSARSGRSYLLNCAPPQWLSQIKPPLDSDTIFRNNGEVDALTYVDRRDMRQFLLSVKDVENNRDIRNQRRRYLDQLIDTLFGYVVTVQNLRPAGWSKDSRLNVPLQLWLDPFRCRQDDAFCYAREGGDWKEQVAREFGLWLNARLQHEKLIFGEVERREWSTAALFKQRLRENERWLKEELA

SEQ ID NO: 7568 - protein, 424 aa, Thioalkalivibrio sp. K90mix
MENVEVKALRTLIERFLNERLQTKIEKLQPDDPKRDELQQHHLRENWVADAARRVGQLQIVTHSLKPVHPDAKGTNLYRPPHKIPDHPEIGSHLLGNDFDEDVVGNAAALDVYKFLKLEHEGRTLLSRALEGNEELAVAFSDDQDQGREWMRAFAAIARPRDTEASHTLAKQVFWLVGEDPTRNQDYHLLAPLYATSLAHRVYQTINEHRFSDEAKAARKARRERAYSDRGYHEYPRLAVQKLGGTKPQNISQLNSERRGQNYLLASLPPNWISRDVRPPLHVESVFPRLFGRRRGARDTSRELQRFLATDPPANADTRHKRDQYLETLIDELLLFASELHSLDPGWSASPECRLNRAETLWLDPWRGEIDEDFAQWRASDEWVEEVSHRFGNWVNAQLDRQLPVGDPEHRHWMDSLREVLSHA

SEQ ID NO: 7569 - protein, 452 aa, Nitrosococcus halophilus Nc 4
MLIDDLNQALSSNKDSPAEQLKQLKTRLLGHCRDPIKVTDEDVPPLLIAAVNFAYGSPTSCEQMLNAEGAKAALVAKVINKNIGGTFIWVALVSHMGTHHPKSRNDKVSSGPIVARSLTPPPAGLVTSANLRTRQFSGSGNAVNTAHYQWLAFTYEDSAGVFSVIERAANRDERLRETVMALGIKESQWQAFQEAAAAHLETTNLAPLDRQLKQVFVPNPDPEQDRDYVVITPLAATAVIGAFEQQRTELREQNATLNFHRIGVGGTKPRNAGSLMNELSGNLRQLIMTIPRLDFTQRQRRLWHLQRGRLFQPLPKKEAQRFTWWLEQDWTQRYGNRQDHLRRLEKQIAEWLLPELEEQEQLFAWLSSDSLDAVQERQKLEAKNLPNWILSLAGISKNPETEHSAHEARQKAAYKALIFHLKSPPSDEIDKLIQDALESLLAKRYLAGEVTA

SEQ ID NO: 7570 - protein, 448 aa, Yersinia pestis Z176003; identical to SEQ ID NO: 51

SEQ ID NO: 7571 - protein, 435 aa, Escherichia coli IHE3034; identical to SEQ ID NO: 7529

SEQ ID NO: 7572 - protein, 457 aa, Moraxella catarrhalis BBH18
MLESIQEIDKAIKGFLQTELDIAIDRELKKKTQTQKNNLSEQNLNKKRDGLYDKLKSDYESTCWLAEVFNSIQEMQNHQLSFATHTAKGIHTALKTENVISISNTKLPVGLVGSQSIPHLMIDANSNNPGSHSGYLKYIIGFINVEVNGVRIYELIQSENVVMMEFFKKHQQESGFDYLNKLLLKKPLGEQTDGKNKQLLFYQQDGNYTCLIPLYPTSITHYVYQKISNVKYSEVNLQARKNRRENKDPAPYCDMPNLAVTILGGTNSNNVSRLNNIQGGRNYLLPSLPPKISQDREFSLSKFCENFFDSKTLKYHIQDDFNYVVQVVKDTRNTIDVRDKRKDAIDRLLHTIFGIAHVLQNKPAGWSKAYALPLAQKIWLDPYRADLDGEAKFADEKTKQEWQKIILQDFASWFNQQLRSTIKELKFDFADAEYNEWQREIEEMQKFYERLGKGVFL

SEQ ID NO: 7573 - protein, 457 aa, Desulfurivibrio alkaliphilus AHT 2
MEQRAAVMSQKIVEYIRVRRDAKLEDFDKKANSERKKVSDPNLLASLEQELAEKRQTQEAKYEVSEWLTDAAARAKQIQMVTHALKYTHPDARGSSLYAVGGETQPESYRQNSLLSTASLHKPAIDVVGNAAALDVAGLLQLEVDGVALIEFIRQGDIAPLLPIAKNEQQASSWLTGFCRALDNKETGAHKLSKQIYFPDSSGGYHLVAPLYSSSFAQALYERIATARFGEEAKEGRKAKRDKKFSVFKVVDYPNTAMQKFGGSNAQNISQLNARRNGSAFLLQCSPPSWVRKLTPPLKVKTVFSWHHFGFRAHGTIKDLRRFLEKNAKKTSTITIRERRGAYIDELMDLLVQYAASIQKLAGVGGWSASPDCRLHRAEQLWLDPRRVAKDVEFAQEREKNDWQVEIADRFALWLNHNLKSDLLKLGDMEHREWQSLLASKLRLLKDDLHDEPEVHA

SEQ ID NO: 7574 - protein, 449 aa, Nitrosococcus watsonii C-113
MLIDNLTQALSASEGSSAEQLKQIKSQFLGHCRAPVKVADEDVSPLLIAAINFAYGSPTSSEQLLSGESAKAALTAKVIDKTIAGTFIWAALASHMGTHHPKSRNDKVSSGPIVARSLTPPPAGLVTSANLRTRQFSGSGNGANTAHYQWLAFTYEDSAGVFSVIERAASQDERLGETVLTLGIQESQWQAFQEAAKAHLETTNLAPLDRQLKQVFIPDPGQNNDFIVITPLAATAVIGAFEQHRSKLREQDANLNFHRIGVGGAKPQNAGSLMNELGGNLRQLTMTIPRLDLTQRQRRLWHLQQGRLFQPLPKKEARRFQQWLALEWTQRYGNRQDHLQRLEQRIDEWLSPELEEQDQLFAWLSSDALDANNERQKFETGNVPNWILTLAGISKNPETGHSVYEARQEAAYDALIFHLNSPGDEINKLIRDALESLLATRHSVGEAVA

SEQ ID NO: 7575 - protein, 445 aa, Dickeya dadantii 3937
MEEGELRQFIVSYIENRKQAKLDAFDKAADKQRAALSGEALAEAELTLAQARREIEQAYEVRNWLTDAASRAGQISLVTHALKFTHSDAKGSSVFSTKPAADSAVLSTASLAQPAIDAVGNAAALDVAKLLQTEHHGDSLLAALQRGDHRALEALAESPQQLTQWLAGFGQVLTDKQPSSHKLAKQIYFPLGDGEYHLLSPLYSSSLSQALDQRLTAVRFGEQAKAIREARRENRWHDEVLVSYPGVAVQNMGGTKPQNISALNSARSGRSYLLSSAPPQWRSQLKPPVEHDSIFRERGEVDALTYADRREMRQFLLSVKEVENNREIRNQRRRYLDQLIDTLFGYVATVQNLRPAGWSVDSRLKRHLQLWLDPLRGLQDTDFLRERDAGDWKEQVAHEFGRWLNARLQHEKLIFGEVERREWSTAALFKQRLRETERALKGELA

SEQ ID NO: 7576 - protein, 435 aa, Escherichia coli UM146; identical to SEQ ID NO: 7529

SEQ ID NO: 7577 - protein, 435 aa, Escherichia coli O83:H1 str. NRG 857C; identical to SEQ ID NO: 7529

SEQ ID NO: 7578 - protein, 453 aa, Shewanella baltica OS678; identical to SEQ ID NO: 7547

SEQ ID NO: 7579 - protein, 387 aa, Desulfurispirillum indicum S5
MQEQETTLADKVLDYISNRLSDKLELNDKEVEKARAVADQDQLEQLQAMRNKLIKPENWLTDASKRAKQISRATHAAKYTHSDTRSSGVLFSEESAKLQKNNYLTSASVSGLEVDFVGNAAVFYVAILLKLEANGVMLLDEIAKGQSPTLEALSQTDEQYQEWLEGFKAALQDKQVQSGQLTKQVYFPLGNSNYHLISPLYASSLAHQLHQKITSAFFSDETKRARKAREKGLYDPQTLVFFPNLAVQAFGGTKPQNISQLNTQRYGKGYLLSCQPPSWTAQDFLPRKGQEAFWKELTHRTWSLTKRLQKHLAISFQRSSTLAIRQKREQLVDDLIDQLLQLAAEIQSKKKNAGWSLDSDLPFAEQLYNGPSKSDRGLSLAKSSEVA

SEQ ID NO: 7580 - protein, 448 aa, Yersinia pestis biovar Medievalis str. Harbin 35; identical to SEQ ID NO: 51

SEQ ID NO: 7581 - protein, 179 aa, Vibrio phage ICP1_2005_A
MIKEMIEDFTSKGGVIFTHSGRYTNTNNSCFVFNKNDIGVDAKVDMYTPKSAGIKNEDGENLWQVLNKDNMFYRIYSGKLGEELQKLIESCCTTKVDITTLPQIYFKNGADHDLLVPIGNAHNLINGTEYLWENKYYNTFTQKLGGSNPQNCTHACNKMRGGFKQFNCTPPQVEDNYNA

SEQ ID NO: 7582 - protein, 179 aa, Vibrio phage ICP1_2004_A
MIKEMIEDFISKGGLIFTHSGRYTNTNNSCFIFNKNDIGVDTKVDMYTPKSAGIKNEEGENLWQVLNKANMFYRIYSGELGEELQYLLKSCCTAKEDVTTLPQIYFKNGEGYDILVPIGNAHNLISGTEYLWEHKYYNTFTQKLGGSNPQNCTHACNKMRGGFKQFNCTPPQVEDNYNA

SEQ ID NO: 7583 - protein, 867 aa, Cellulosilyticum lentocellum DSM 5427
MNAQNFTKKSIEAIQSAQQSAISNQNNQIESLHLLYALLTQEQGLIPHLLTKMNVSVSSMTQSVSEDIAKLPRVSGPGRELDKVYVSSEVDKILSESEKIAKSMSDEYISVEHIMLALIEVSSGYCEKLLKAYGIAKKPFMVVLTEIRGNTHVTSEEPEGTYDVLNKYGYDLVERAKEQKIDPVIGRDSEIRNVIRILSRKTKNNPVLIGEPGVGKTAIAEGLAQRIVRGDVPETLRDRRIFALDMGSLIAGAKYRGEFEERLKAVLQEIKKSEGKIILFIDELHTIVGAGKTEGSMDAGNLLKPMLARGELHCIGATTLNEYRQYIEKDAALARRFQPVMVEEPTVEDTIAILRGIKERYEIYHGVQIQDNALIAAATLSDRYISDRFLPDKAIDLVDEACAMLRTEIDSMPTELDEIARKVLQLEIAETALKKEDDPISKQNLADTQKELAELRDKFKAMRTQWENEKDVITKVRGIKEEIETATANMQKAEREYDYNKAAELKYGIIPGLKKQLEEAEAMAYKGSEGSLLRDKVNEEEIAKIIARWTQIPITKLMEGERHKLLRLEEILHKRVIGQNEAVDKVTDAILRSRAGIKDPRRPIGSFLFLGPTGVGKTELAKALAEALFDDEHSMIRIDMSEYMEKHAVARLIGAPPGYVGYEEGGQLTEAVRRKPYAVILFDEVEKAHPDVFNVLLQVLDDGRITDSKGRTVDFKNTIIILTSNLGSQAILEGINSQGEISEEAEETVNHLLKTHFRPEFLNRLDEIVLYKPLQQHEIVHIVGLLEKDLNKRLENQQLHVRLTEASKAYIAEQGFDPVFGARPLKRFLQRKVETLIARTLIAEEVEPFSTFVVDYEDEQLKVRIEK

SEQ ID NO: 7584 - protein, 425 aa, Marinomonas mediterranea MMB-1
MDKNIQAFFEERKAAWLKKNLKASMSEVEVRQTEQECDEVFALKNWLPNAAKRAGQMSISTHPCTFSHPSARKNKNGYASAIIARSNRGEDGFLRTGNIDVEADALGNAAALDVYKFLTLKLADGQSLIQHIEQDSEQSKSLLELSNIAEGETYEQLKQGFLAMTSVDDNVITSSKIKQVYFPVSSDSTNQAYHQLSILTPSGIVFEMRKRLDAMRFGDEIKAAREKRKNNEQHENYREIYDLTTIGYGGTKPQNISVLNNQNGGKAHLLMSLPPQIEKRDIHFPNTDFFAQSINYFKCRDTFLRLHKLYQSDENNMHVRADRDDMYQNIVDYIIETMWQVRSVASEQYLETMSQLNQTQIIWLCAHTAEIRDTTDDWLDAILSSITQFVFHGYEKVLGKKAVKLGDAEKKHMAKIVEQNKEMLR

SEQ ID NO: 7585 - protein, 400 aa, Sphaerochaeta coccoides DSM 17374
MDKTLVDFFTKKDLFKPENKSSVSEWILKAAIRANQLVMATHSGKYIHTSACKEASCIALSRPQAPDGYLRTGNCDVRYVDTLEKLDCLGNAAALDVYTFLSLVLEDGHTVFHHVQQRSRILQQELRLSDAEYQTACAGFMKIMPEAGYATTQDVMKQVYFPVGKDEYHLLSILTPSVLVSEMNKRISKIRFSDQAKEGREAKKNNEIHEGYDEVFDLTEMGYGGSNSQNAGVLNNRAGGVSLLLPSFPPVLHARAVRLPRRNFFNSLYVRDFADDFKALRDIIAAPDRNVEVRTRRDEIFGVIVDKIIQKSLAIRSYEGGWTKEEYYAQLPEYQKIWLDSLYAEERYTSEDWLERLIDEIGRWIFKALESFRPDSGIPLNDDDFLHIKSVVRDSEGGLL

SEQ ID NO: 7586 - protein, 434 aa, Gallibacterium anatis UMN179
MLKAKILSFLTELAAKKLAPLEKKREKITAINELSALDEKIKQIKAEYQLDTWMEKAANQMSKQLSFATHLSKAVHPDSKGNNIAFKAQNRTLPFVGSHLIDKAIIDASGNAAALPLAALFDLVIDEQHNLRLRDLLLEDSPLLDGVFSDDEEKSTQYKTLFQQALITNITKPVTYERNKQLLWPNNRQAISEDNYTCLIPLYPSSLAHLLYNKIQDIRYSEHYKEIRENRKKEGITQQPYPTIKNLATIPLGGAQPQNISQLNSRQRGKHYLLPSLPPVFSSSKTNISDDTLFNRHLYFQCQLFFNDLFAVVSSPYNVYTERDKRDAAIENIIEVIFSIAQIYQQKPAGWSKNYQHLDVSQKYWLDPERANLDGEAEFKTKFEKANWQNDIAKQFAHWVNYQLKQKLPNIRQDFSEPEFNEWRKAFKRALKRK

SEQ ID NO: 7587 - protein, 465 aa, Delftia sp. Cs1-4
MPPTPSAMRWHDAIAIFIQERLQAKLDKLAEDDPKRQELLAQHQRDTWLEDAARRVTQIQAVTHSLKPIHPDARGTNLYVEPASLPALQELGSHALGQSFAGDVVGNAAALDVYKFLKVEVDGTSLLTALLAQDPGALQALHEDPQQAMGLRDAFVGLTQPRAGAPSSHTRAKQLYWLTGSDACADEGYELLAPLFATSLAHAVHAQVQEDRFGESNKAARQARRERKAHDGVFHDYPGLAVQKMGGTKPQNISQLNSERGGVNYLLASLPPVWRSSDVRLPVHASSVFDKLFVGRPEVRSTVRKLRAFLATDPEPNLQTRERREAFMDALIDEMVSLAGEVQQTLPAGWSRDSERFGKLVREEQLWLDPLRTELRDEEEFAREWLWMDWPAEVGKRFANWLNSQLFGQLPVGDAEARVWRKELLTDEDGFVQQLRELRKRLDAPAYIPIRKTHDELVMHRGGVV

SEQ ID NO: 7588 - protein, 471 aa, Methylomonas methanica MC09
MGGIILAIEEFLIGRRNEFIEKEVAKEIKDKEQKYEKLIESFKDKELINDKVALEKKKLEEAALKAKKKAQPVADEKYDVKTWLRKVSTQAKPNIVTHPAKFTNPKIDTASSIIYHGEQHNDGYVRTGNVKLSVNVDVSGNSATNTIIFELYSLLGITLQDNKKVINYFEEDVKELVKYMSDMGIKYKDFKDKCLNVFYGMNSEQSTHEMVRQVYFPVNTPLADYHLLSAVTASMLMFEVKNRIDGFNRRVNGQNIRNLKKNNQFHGEGFDEIPNLTEIWFGYSSNEDASRFTKMGNVSLLNVRNQKAYLIPSIPPQIQQRQVRLPSQNFFKNSLNPKRFKDDFQPLDKLIRSDLNNIHIREGIRNCLKYLIDRVLQRAFAVRAFGVGWSQTEHYQNLPRAQRIWLDDAYLEQRQQEEEWLEEIVLAFANWILDSYELLFKQTCKQLSDYELREVKRYVELAVSDDQEFFK

SEQ ID NO: 7589 - protein, 439 aa, Zymomonas mobilis subsp. mobilis ATCC 10988
MQHNNARIQIFRQAISDFIKNRRDEKLKGKADDLAAMRKYDYAIWLEDAARRVGQIHAATHIAKAIHSSAKGSNLYIKPDSLPQREEIGSHLLGENFDIDIVGNAAALDVFKFLKTKVEDKTLLAWAEAGDPDFKAALSKNPDQAEEWISSFAGLLSSDKKVQSHALMKQLYWLRGKDPTEDDQYILLQPLFPSALVNYVHQNIQAVRFGESNKEARSAFYKKEASELVYQEYKKLAVQRLGGTKPQNISQLNFERGGVNYLLASLPPRWKNKRRLLPLNCKSALEVFFKRDDVYGQVDRLIKFLKSNPPDNLNTRQYRQRFEQKLTESLVDFAATIKAEMPVGWSREDSCQLPPYEKLWLDPERSLFSLRDGSDEADQIFYNEYMKGDWPDAVAQNFGRRLNAKLKHQDIPVGDTEYIHWVRQVTIDAAWPVPWRRRA

SEQ ID NO: 7590 - protein, 451 aa, Xanthomonas campestris pv. raphani 756C
MTEPTERIDRFRSAIADFIDGRRLAKLKDGDDDAGAASRYDYATWLADAARRVGQIQAVTHVLKATHPDARGSSLHVPPDSLPQHAEVGSHLLGAHYAQDVVGNAAALDVFKFLKIEVEGRGLLAWMQAGDSDLRTALHPDTDIATGWMQAFAALARSEPQLSSHAMAKQVYWLVGDQPTDDTHYHLLQPLFSSALAQVVHADIQDARFGETNKQARQAQRTKQPHTETYRDYRNLVARKLGGTKPQNISQLNSERGGVNYLLASLPPSWTLEHPRSLLNTDSAMDRFGYGKQVRAIVKTLADFLLGDPPRTDKTRRIRERIEQELGAQLAVFGAQTQARFAPGWTRDADCRLPLDEQLWLDPERAELPVRRDPQDPEWTQDDDAFNAAYTFGDWPDQVAGRFANWVNARLHKAGLTSIGDSEYRHWAKQALVEAAWPAPLQQRAPAGDQA

SEQ ID NO: 7591 - protein, 448 aa, Yersinia pestis A1122; identical to SEQ ID NO: 51

SEQ ID NO: 7592 - protein, 434 aa, Pseudomonas aeruginosa M18
MTSPLPTPTWQELRQFIESFIQERLQGKLDKLQPDEDDKRQTLLATHRREAWLADAARRVGQLQLVTHTLKPIHPDARGSNLHSLPQAPGQPGLAGSHELGDRLVSDVVGNAAALDVFKFLSLQYQGKNLLNWLTEDSAEALQALSDNAEQAREWRQAFIGITTVKGAPASHSLAKQLYFPLPGSGYHLLAPLFPTSLVHHVHALLREARFGDAAKAAREARSRQESWPHGFSEYPNLAIQKFGGTKPQNISQLNNERRGENWLLPSLPPNWQRQDVNAPMRHSSVFEHDFGRTPEVSRLTRTLQRFLAKTVHNNLAIRQRRAQLVAQICDEALQYAARLRELEPGWSATPGCQLHDAEQLWLDPLRAQTDETFLQRRLRGDWPAEVGNRFANWLNRAVSSDSQILGSPEAAQWSQELSKELTMFKEILEDERD

SEQ ID NO: 7593 - protein, 434 aa, Pasteurella multocida 36950
MFLQEQNLKKSESDRKKLAKATDPTEIEQLTQLIQEFDQKYQFDTWIANAANVMAKQLKFGTHIAKGIHPDTKGDNVNFQPSDSLPPEYVGSQSVSHLVLDANGNAAALPLASFFNFIVDEEKQVKLRDLLLADDPRLAGCFSDDLALSDVYKKQFQQALTGDLTQPETHERNKQVFWANGENPIEDDDYTCLIPLYPSSLTHAFYQKVNNNRYSEQNKQARENRQKKTVEQTHYLSINQLATVVLGGSKPQNISQLMSAQGGRNYLLPSLPPIIPSSRYFRLSPLQTTIFNDRLAYACRYGLRQLFEVVEARKNVYQVRDSRIDALNNILRTFLFHANLLQKQPAGWSKDSQLEMCEKYWLDPKRVHLPDEEAFRAEYEKGEWVAEVERRFALWLNKRLQKRFPHIAKDFDDVEYHEWRRNIRRTLRYRLRHP

SEQ ID NO: 7594 - protein, 437 aa, Klebsiella michiganensis KCTC 1686
MITEALAHFITDYIASRRQPKLEAFEKEAEKRLAQGEDAGAIAQERQDLEVKYQPCNWLTDAARRAGQISLVTHAAKFTHGDSKSSSIYRETAGDEGYLSTAVLANVAADAVGNAAALDVAKLLQTEVGGDSLLACLKRGDRSPLKAFAENGAQLALWIEGFSQALTPAQPASHKLAKQIYFPVDGGYHLLSPLFATSLAQAMHEKMVAARFGEEAKAVREAHRTGKWHAQPDVRYPNVAEMHFGGTKPQNISALNSSRGGRIWLLPSQPPKWTMLDKAPQNLASLFALRGEFNRAATGTVSRMVSLLKEKTDKNNRHIRRVRAGYVDELIDLLFLQAATYQQEAWQGWTLNSPDLPLHQQLWLDPWRSKTDETFRSEREKGAWQRNIADDFSRWLNYRLNKARLDVGISERREWRTQRLFSQRMREMDAIVREALK

SEQ ID NO: 7595 - protein, 444 aa, Rahnella aquatilis CIP 78.65 = ATCC 33071
METHGLQQLITRYIHDRGQLKLEAFSKTADKQLSAARAEEKAGLEQQLFEQRRELEKKYDVRTWLTDAAARAGQISLVTHAVKYFHGDAKGSSVFSTVKSDTAYLTTATLPSPAIDAVGNSAALDVAKLLQTEHEGDSLLASLKRGDFSALTALAENDAQAQQWISGFMQALSDKSLSTHQLAKQLYFPVSDKGDYHLLSPLYSSSLAQALYQRISHSRYSDESVAARKARREGHWHPEAVQYFPDLAVQNMGGTKPQNISYLNSARGGKNHLLRCAPPQWQQSLKPPVSHKTFLTAVSPKITRVVSELRRYLHSISARDNNMEIRQQRAEYVDELIGMIFSYAAEIQSLTDLQGWSQQEDCILKAAHQLWLDPLRQRTDPDFKRQREGGEWISEIAEDFAHWLNTRLNKDEKLNMGAVEFREWSVLMRRRLQEFDAAQQENWQ

SEQ ID NO: 7596 - protein, 444 aa, Pasteurella multocida subsp. multocida str. HN06
MSYTFRKRIDLFLQEQNLKKSESDRKKLAKATDPTEIEQLTQLIQEFDQKYQFDTWIANAANVMAKQLKFGTHIAKGIHPDTKGDNVNFQPSDSLPPEYVGSQSISHLVLDANGNAAALPLASFFNFIVDEEKQVKLRDLLLADDPRLAGCFSDDLALSDVYKKQFQQALTGDLTQPETHERNKQVFWANGENPIEDDDYTCLIPLYPSSLTHAFYQKVNNNRYSEQNKKASINRYKKNTEQEHYRSINGLAIVSLGGGNSQNVSQLNNLQKGRHYLLPSLPPIMKASRQFQLSPSQTTIFNDRLAYACCYGLRQLFEVIKAHKNISEVRDNRKDALDIILQSVLRIASVLQKQPVGWSKDYQLEMCEKYWLDPKRVHLPDEEAFRAEYEKGEWVAEVERRFALWLNKRLQKRFPHIAKDFDDAEYHEWRRNIRRTLRYRLRHP

SEQ ID NO: 7597 - protein, 417 aa, Spirochaeta africana DSM 8902
MSEEVRVFFAARREAWLKSPDQRKKIKNGVSEEELEQEADEKFHPAEWCAENARRAKSLSLVTHNPKFSHPDIKIKDVNVIQVTAQQKDDGYLRTGNCEYKSDAYGDAASLAVLKFLQLEMTDGRTVLEHFERSSEELRKEIGVSAGQFAEMREQFLNITMPKSKDTTSDLLKQVYFPVGDDYHLLSLITPGGLISVLKQRIDDVRFGNGVNEARDQKRNGKFSECGYADIPNLAVIGYGGTKAQNIGQLNLGNGGKATMLMTLPPALQDRKVYPPRTNFFRNCLRVNTVEEFFDSLDHLRAIDYNNASIRSAIEHWYKKIIDQIVAQAWAIRRECTGWSYDERYSAVPLYQKLWLDEARQSERDLSEDWQQSVIENMVQWIRMTYEKRKNMKGPKFDSTEIQFMTRLASESKEGLV

SEQ ID NO: 7598 - protein, 303 aa, Listeria monocytogenes 07PF0776; identical to SEQ ID NO: 7526

SEQ ID NO: 7599 - protein, 423 aa, Providencia stuartii MRSN 2154
MLDPAIEAFFAERKEGWLKKNLKASMSEAEVHQIEQQCEDTFALSQWLPNAAKRAGQISLSTHPCTFSHPSARKIKNGYVSAIIANAKQANDGFLRSSNVAVEPDALGNAAALDVYKFLTLQMQDGATLLAHIEAETQLAKTLLTLNNESYQEIRNGFLAMSATDDSVVTSSKIKQVYFPVWLDDEDYHLLSILTPSGLLFEMRRRIDDIRFSEQTKTLRDLKRKGEYSEVGFKEIYGLTTIGFGGTKPQNISVLNNQNAGKAHLLLSLPPVLNIRETRLPKTNFFTDTINPWHTKETFQAFHGLINLPKDKRGNRFIEYRDNRIQEYVDYIIVMMWKVRRALEQENITLPNKISNYQKTWLFPDNQEQRDNTDDWLEILIPEIARQFIAGYKVVNGKKALFLGNDEFNAIVDVVARYKELLR

SEQ ID NO: 7600 - protein, 444 aa, Pasteurella multocida subsp. multocida str. 3480; identical to SEQ ID NO: 7596

SEQ ID NO: 7601 - protein, 448 aa, Aggregatibacter actinomycetemcomitans D7S-1
MITKTTVVKAIQQFLVDQNLKKSGTDRKKLENASLSESEKEALLKKIAEYDEKYRFDVWVENAATVMAKQLYFGTHISRGIHSSSKGDNVNFQSDLTLSDTLVGSQSIPKLELDANGNAAALPLAGFFNIIVDEEKNTTLKELLLNDDSCLEGCFADDPELSKQYKICFQNALKGDLTKPRTDERNKQLLWANNFDSGKNAYICLIPLYPSSLTSHFYHKINQLRYSDYNKQSSSNRYKKDVSQLPYVSLQNIGVTVLGGTKPQNVSQLTSNQGGRNYLLPSLPPIFKSQEKIRLTQKQTTIFNRRLAYACREGLNMLYEVVEAEKNIYPERDKRKLALELIAHTVLMQAKYIQNNSPTGWSKDYHLNEYQKYWLDPHRAELDGEDNFRHNIEQNHWTAEIIRQFALWVNACLKWRFKSIQQDFTTPEYNQWCREMEKAIAAQARLSQ

SEQ ID NO: 7602 - protein, 444 aa, Pectobacterium parmentieri
MRGEKLKTFILSYISTRKQAKLDAFDKDAEKKRAALSGEALAVTELELAQVRREIEQKHEVQNWLTDAASRAGQISLVTHALKFTHSDARGSSIFSADTVADAKTLSTATLAQPAIDAVGNAAALDVAKLLQTEYDGDSLVAALQRGDHSALEALAESPEQLAQWLAGFQQVFTDRQPSSHKLAKQIYFPLANGEYHLLSPLYSSSLAQALHQRINAVRFGDEAKAIRQAQKASQWHDQLSISYPNLAVQNMGGTKPQNISALNSSRSGRSYLLSSAPPQWNSIEKPPQQHESIFRPRGEVDYYTRATLAQMQRFLLSVKEVENNRDIRQQRLRYLDQLIDQLFFYVASVQNLPAGWSAESELKRAQQLWLDPYRADTDTVFRREREAGDWQQAVAYDFGRWLNRRLKHENLIFGEVERREWSTAALFKRRMREMEGTLKEELA

SEQ ID NO: 7603 - protein, 421 aa, Methylophaga frappieri
MLDPAIDAFFAERKEGWLKKKLKPDMTNEKKREIELECEEEFSLEKWLPNAAKRAGQISISTHPCTFSHPSSRKNKNGYATSVIAKSSREPDGYLRTGNVDVQADALGNAAALDVHKFLSLVTEDGSTVIEHIEQDSELGKTLLNTPSESYANLKSGFMAMARSDDTPVTSSKIKQVYFPADKDYHQLSILSNSGMIFELRRRIDALRFSDAVKEGRELRRNNTYSESGYSEIYDITTIGYGGTKPQNVSVLNNQNGGKAHLLLSVPPLLEQRDVRFPARDFFIQSLRYYDCKDILERLDKVFKIERDGQIPLEKIRKGRDRCLGDILDVILQKMMALRDVSTQQYWPETSKLRAWQKLWLCEQHKEQRLQEDDWLNTLCDQIARWIVSSYKNSIKHPVMLGEAEHHYIKEFIEDNKEVLR

SEQ ID NO: 7604 - protein, 434 aa, Pseudomonas aeruginosa DK2
MTSPLPTPTWQELRQFIESFIQERLQGKLDKLHPDEDDKRQTLLATHRREAWLADAARRVGQLQLVTHTLKPIHPDARGSNLHSLPQAPGQPGLAGSHELGDRLVSDVVGNAAALDVFKFLSLQYQGKNLLNWLTEDSAEAVQALSDNAEQAREWRQAFIGITAVKGAPASHSLAKQLYFPLPGSGYHLLAPLFPTSLVHHVHALLREARFGDAAKAAREARSRQESWPHGFSEYPNLAIQKFGGTKPQNISQLNSERYGENWLLPSLPPHWQRQDQRAPIRHSSVFEHDFGRSPEVSRLTRTLQRLLAKTRHNNFTIRRYRAQLVGQICDEALQYAARLRELEPGWSATPGCQLHDAEQLWLDPLRAQTDETFLQRRLRGDWPAEVGNRFANWLNRAVSSDSQILGSPEAAQWSPELSKELTMFKEILEDERD

SEQ ID NO: 7605 - protein, 436 aa, Zymomonas mobilis subsp. mobilis ATCC 29191
MHHNNARIQIFRQAISDFIENRRDEKLKGKADDPAAMRKYDYAIWLEDAARRVGQIHAATHIAKAIHSSAKGSNLYIKPDSLPQREEIGSHLLGENFDIDIVGNAAALDVFKFLKTKVEEKTLLAWAEADDPDFKAALSENPDQAEEWLSSFAGLLSSDKKVQSHALMKQLYWLRGEDPTEDDQYILLQPLFPSALVNYVHQNIQDVRFGESNKKARSAFYKKEASELVYQEYKKLAVRRLGGTKPQNISQLNSERGGVNYLLASLPPRWMGKRRILPLNCKSALEVFFKRPNVYSQIDKLIKFLKSNPPDTRQHQQRFEQKLTESLVDFAATIKAEMPVGWSREKSCQLPMDERLWLDPERSLFSLRDDSDEADQIFYNDYMKGDWPDAVAQDFGRRLNAKLRHQDIPVGETEYIHWVRQVKKVTIDAAWPPVPR

SEQ ID NO: 7606 - protein, 157 aa, Marinobacter sp. BSs20148
MRFPNTAVQSFGDTKPENISQLNTGCYSRGFLFSSQPPAWNTQINTPSGSKPSFWRQCDRRARRTVKSLRDYLERIGTVGRRDQRAAMVDELVDILLICAAEVQQLHAQRGWNVETELSFAEQLWLSPYRTELDEKFKQQRAKNDWRAISLASLQPS

SEQ ID NO: 7607 - protein, 444 aa, Pectobacterium carotovorum subsp. carotovorum PCC21
MEESRLTQFIVSYINNRKQTKLDAFDKEAEKKRAVLSGEALAAEELELTEKRREIEQKHEVRAWLSDAASRAGQISLVTHALKFTHSDAKGTSVFSTGTVTEAKTLSTATLAQPAIDAVGNAAALDVAKLLQTEHDGDSLVTALQRGDHRALEKLAENPEQLAQWLAGFQQVFTDRQPSSHKLAKQIYFPIANGEYHLLSPLYSSSLAQALHQRINAVRFGEEAKAIRQAQKANQWHEQLSISYPYLAVQNMGGTKPQNISSLNSSRSGRSYLLSSAPPQWNSIEKPPQQHDSIFRPRGEVDYHTRATLAQMQRFLLSVKEVENNRDIRQQRLRYLDQLIDQLFFYISSVQNLPSGWSAESELKRAQQLWLDPYRAETDTVFRREREAGDWQKAVAYDFGRWLNRRLKHEELIFGEVERREWSTAALFKRRMREMESALKEDLA

SEQ ID NO: 7608 - protein, 299 aa, Alcanivorax dieselolei B5
MEGDPALTGALSKDPEQAREWMTSFAAITEPRGGEASHTHAKQVYWLVGDDPGDNGSFHLLAPLYATSLAHRVYQTINEDRFGEATKAARQARRDGRYWEGGYRDYPNIAVQTFGGTKPQNISQLNNERGGSNYLLASLPPTWIDSDIRPPHFVDSVFPRFGRRKEVRGLVSGLRRLLMSDAEPNAETRDRRDEYVGALIDELVAFASRYSVLESGWSASPDCRLVDAEALWLDPWRDDESFAQRREQGDWAQEVRHRFATWLNSQFGKSLPLGDAEFAFWQKQLAKRLNALQEDLPYV

SEQ ID NO: 7609 - protein, 122 aa, Coxiella burnetii; identical to SEQ ID NO: 7555

SEQ ID NO: 7610 - protein, 122 aa, Coxiella burnetii
MNDIVANLFTQLINCWDIQLRKVYFFSDINCRKAENMNSLMEKAMKSENKMEELKKRINDFIQGRLEVKLTKLPPSDKKRQQIIEEYQPKNWISNAARRAWQIQLVTHAIKFQHPDAKGASK

SEQ ID NO: 7611 - protein, 421 aa, Thioalkalivibrio nitratireducens DSM 14787
MGYLLRNSVEAFLTARFEVKAEKLAPDDPKYLALQQQYQRENWLADAARRVAQLQVVTHSLKAIHPDARGTNLFRPPTELPKHPEVGSHVLSSGFNEDVVGNAAALDVYKFLKVEHGGRTLLSRVLADDDELAAAFSDDLDQGREWLRAFARIVEPRGIEASHTRAKQVYWLAGGDPTVDTDFHLLAPLYAASLAHVVYQTINDHRFSEEAKAARKARREGEYSETGFHEYPNLAVQKLGGTKPQNVSQLNLERHGTNYLLASLPPNWANRDLRPPLFVDSVFSRSSFGRRPGVRQVVTALKRFLATNPPPNVTTRQRRDKHLNKLVDELLLYAAELHTLEPGWSASPDCSLNRFEALWLDPRRADIDPDFATECENEEWVDKVSHRFGNWLNARLQHRLPFDDAAFRFWKDSLREVLLHA

SEQ ID NO: 7612 - protein, 445 aa, Serratia sp. FGI94
MSNQGIVAFIESRKQPKLEAFDKDTEKKLAGLSDAAEIAAVRQAAVEQRRELEQRYEVRNWLTDAASRAGQIGLVTHALKFTHSDAKGSSIFAAQEDNDARYLGTATLRQPAIDAVGNAAALDVAKLLQMEYQGDTLIAQLNRGDHSALAVLAESEQQLELWVSGFKQVLTNKQPASHALAKQLYFPIGDNQYHLLSPLFSSSLAQALHQRLAQARFSEQAKEISAAVRAGKWHAEARVMYPNLAVQSMGGTKPQNISYLNSTRGGRNWLLNCAAPQWVTQSKPPLKHTSIFYRSSEFSAMARDAVRQLRAYLLSVQPREKTREIRQRRAAGVDEVIDMLFSYAAGIQNLEAQAGWSAGAECRLKRSQQLWLDPLRGRDDPDFRAEREAGDWQREIALDFGVWLNRQLEHEQMLFSEVERREWSTAPLFKQRLREFEAEWAEAAL

SEQ ID NO: 7613 - protein, 179 aa, Vibrio phage ICP1_2006_E; identical to SEQ ID NO: 7581

SEQ ID NO: 7614 - protein, 179 aa, Vibrio phage ICP1_2011_A; identical to SEQ ID NO: 7582

SEQ ID NO: 7615 - protein, 241 aa, Morganella morganii subsp. morganii KT
MPDPEITAFFTKYQESKKIPEFSRLQWLSDAAGRAEQLSLTTHPFAFTHPCARRNRYGKAGAILAEVKKKNDGFLRSGNVVVPQDAEGNAAALEIYTFLMLKMQDGKTLLTHLCEESETAKKILGSENYRKLRASFLRIFSGEGVPSTNSKIKQVFFPVPGKECNAGYHLLSVLTPSGLLFELYRRLGKSGIFPGHLVVIHIGGSKPQNISALNMQNKGKACLLLSVPPGAVTTGGRYSVH

SEQ ID NO: 7616 - protein, 506 aa, Psychrobacter sp. G
MIDNNENHWETLILGFLLAKFEADLSKFTKETFKNMQNLITKPNTVSEDFEDFLDTRKNKQPDNISEKSFLMSRMDSLFEHLELTDIVDKSSLESDYTALIDKLNKKYEAHAWIEDASNNASSITFATHVAKLTHSKIDSSSLNDTLSSSRPDVLTTSSLSEIIIDGAVAGNQYAPIYQFLSLEHDGVNLAQAFTQLSNNLLKSFAKDEVQLAEWNERFRQVTQPSTLSTHSLAKQVYFPVNSDTLEQARYHLLCPIISSSLAQHIFTTLFNDALKLSRKQYFDKKYHADIFYDYPQKAAIAVTASNHSNASQLNGKRGGKLYLFNTKPPIWQTQIKPPNFESNMFNHEPLNYLCTDNLKGFQAMFLGAVEVYRKPHIMAGIEKWIQAISDDVIAYASLIQQLPAGWSAGSKLESNNIEHCYFLDCNRQDNTFVLKQQSNDWQRVVAHDFGSWINNKLNKNSKNFTPQAEHRKLWQKLFAQQLHDYLNIFIIENTDQQAIDKGATI

SEQ ID NO: 7617 - protein, 419 aa, Streptomyces rapamycinicus NRRL 5491
MTSTTPPAPSIDGAALLNEVEQHHRRFNVFPSEHAYVAVTLWDAHAHLISAFDSTPRIAFLSPEPGSGKSRALEIVETLVPNRLVAAHATANAMYRAVGDTDNLPTVLFDEVDTIFGPKAGDNESLRGFINAGHRRGVGVLRCVGDGSNQEATEFQTFCAVAMAGLGSLPDTILTRSVIIRMRKRAPNEDIQSYRQRVHEKQGHALRDRLAKWADQVRDQVENAWPELPEGISDRPADVWEPLLAVADAAGGNWPERARAACLELVAAAKEGDKASVGVQLLTDLRDKVFCGADRMPTAAILECLHAIEDAPWGDMDGNGKELTPRVLSKMLGEYVTAANKPIRPRSIRTAGGVPKGYYAEDLADAWLRYCPPAPEKSATSATSATPQVSRGENVADPLPDIRYITDRPATPALGVRRA

SEQ ID NO: 7618 - protein, 303 aa, Listeria monocytogenes; identical to SEQ ID NO: 7526

SEQ ID NO: 7619 - protein, 303 aa, Listeria monocytogenes; identical to SEQ ID NO: 7526

SEQ ID NO: 7620 - protein, 303 aa, Listeria monocytogenes
MIKLINVVKKFGKIEAVKGINLEVEKGSLFAFLGENGAGKSTTLSMICTESEPTSGEIFIDDEKLKFKNRKLFRQKLGVVFQENVLDDLLTVRENLYNRASLYGKTKAEITERLALVSSIMGIEDILNRRFEKLSGGQKRRAEIARAIMHDPEILLLDEPTTGLDPKTRVSVWKIIDYLREELGMTVFLTTHYLEEAKDADQLAVIHKGKIIAQGTPANIRSRFSVDKIFFYDAKVAELQKIMKKMNLPFKVTNRTMRVDVIDENVEILAILNQAIGFYDSFEVIKGNLDDAFISMIKEDSND

SEQ ID NO: 7621 - protein, 303 aa, Listeria monocytogenes; identical to SEQ ID NO: 7526

SEQ ID NO: 7622 - protein, 303 aa, Listeria monocytogenes; identical to SEQ ID NO: 7526

SEQ ID NO: 7623 - protein, 303 aa, Listeria monocytogenes; identical to SEQ ID NO: 7526

SEQ ID NO: 7624 - protein, 303 aa, Listeria monocytogenes; identical to SEQ ID NO: 7620

SEQ ID NO: 7625 - protein, 303 aa, Listeria monocytogenes J1816; identical to SEQ ID NO: 7526

SEQ ID NO: 7626 - protein, 443 aa, Desulfovibrio gigas DSM 1382 = ATCC 19364
MSKPDPERIRGLQQVMDGFLVVRRDAKLEKLKPDDPKREEVSAQYERPAWLADAARRVGQIQAATHTVKPMHPDARGTNLYCKADALPEHALVGSHLLGEGCAADVIGNAAALDVNKFLTQEYQGKTLLAWMQEDEAAVLAAFAVEDAALARQWLQAFLGLTRTPAVRVSHTLAKQLYWLTGDDPRDDAQYHLLAPLYASSLAHRVYLTIQAHRFSDETKAAREAKKSNSPCEHGLHEYRELAVQKFGGTKPQNISQLNSERKGVNYLLASCPPVWSPQPVRPPFGVESVFVGFGRQRDAKALVRVLAEFLASEPAATLATRQHRDELLFQILGELHQFAERYRALPPGWSADPRCRLVEAQQCWLDPQRAAMDAEFADIWLHTAWRDEIKRRFGNWLNAALGDKLPLGDVEHVYWADLFDDERWRRQLDADRRMLEKEAPHA

SEQ ID NO: 7627 - protein, 431 aa, Candidatus Symbiobacter mobilis CR
MLTPRQAALRLLITDFLSQRLESKLEKLPPDDPKRADLQRDFAPAAWLEDAARRAAQIQVVTHSLKPIHPEAKGTNLYCPPDALAPVPVVGSHCLTDDFAGDVVGNAAALDVYKFLKQEHEGQTLLALAVSGDVDWAQALSDDPAQAQAWMSAFASLATPHGNPTSHTLAKQLYWPVGDDLHDDAGYHLLAPLYASSLAHRLYQTLQDDRFSDEAKAAREARKADLVSERPVRDYPNLAVQQLGGTKPQNISQLNSERRGQNSLLASLPPMWRSVELKPLWGTESMFPRYKSRPAVKENLGALLAFLKTDPKRNVDTRDRRAAYVDNLIDDFLQFTAEVRTLEPGWSCNNKCRLPAEQAYWLDPEGAAQADAELGRPPPTDTHERICEAYANWLNAQLRDPLPMGDPEFEAWRKAMQEHILAEEREGLHAD

SEQ ID NO: 7628 - protein, 439 aa, Zymomonas mobilis subsp. mobilis str. CP4 = NRRL B-14023
MHHNNARIQIFRQAISDFIENRRDEKLKGKADDPAAMRKYDYAIWLEDAARRVGQIHAATHIAKAIHSSAKGSNLYIKPDSLPQREEIGSHLLGENFDIDVVGNAAALDVFKFLKTKVEDKTLLAWAEAGDPDFKAALSKNPDQAEEWLSSFAGLLSSDKKVQSHALMKQLYWLRGEDPTQDDQYILLQPLFPSALVNYVHQNIQAVRFGESNKEARSAFSKKEASELVYQEYKKLAVQRLGGTKPQNISQLNSERGGVNYLLASLPPRWKGKRRLLPLNCKSALDVFFKRPDVYGQVDKLIKFLKSNPPDNLNTRQYRQRFEQKLIESLVDFAATIKAEMPVGWSQEDGCQLPPYERLWLDPERSLFSLRDDSDEADQIFYNEYMKGDWPDAVAQNFGRRLNAKLKHQDIPVGETEYIHWVRQVTIDAAWPVPWRRRV

SEQ ID NO: 7629 - protein, 434 aa, Pseudomonas aeruginosa SCV20265
MTSPLPTPTWQELRQFIESFIQERLQGKLDKLHPDEDDKRQTLLATHRREAWLADAARRVGQLQLVTHTLKPIHPDARGSNLHSLPQAPEQPGLAGSHELGDKLVSDVVGNAAALDVFKFLSLQYQGKNLLNWLTEDSAEALQALSDNAEQAREWRQAFIGITAVKGAPASHSLAKQLYFPLPGSGYHLLAPLFPTSLVHHVHGLLREARFGDAAKAAREARSRQESWPHGFSEYPNLAIQKFGGTKPQNISQLNSERYGENWLLPSLPPHWQRQDQRAPIRHSSVFEHDFGRSPEVSRLTRTLQRLLAKTRHNNFTIRRYRAQLVGQICDEALQYAARLRELEPGWSATPGCQLHDAEQLWLDPLRAQTDETFLQRRLRGDWPAEVGNRFANWLNRAVSSDSQILGSPEAAQWSQELSKELTMFKEILEDERD

SEQ ID NO: 7630 - protein, 444 aa, Pasteurella multocida subsp. multocida str. HB03
MSHTFRKRIDLFLQEQNLKKSESDRKKLAKATDPTEIEQLTQLIQEFDQKYQFDTWIANAANVMAKQLKFGTHIAKGIHPDTKGDNVNFQPSDSLPPEYVGSQSVSHLVLDANGNAAALPLASFFNFIVDEEKQVKLRDLLLADDPRLAGCFSDDLALSDVYKKQFQQALTGDLTQPETHERNKQVFWANGENPIEDDDYTCLIPLYPSSLTHAFYQKVNNNRYSEQNKQARENRQKKTVEQTHYLSINQLATVVLGGSKPQNISQLMSAQGGRNYLLPSLPPIIPSSRYFRLSPLQTTIFNDRLAYACRYGLRQLFEVVEARKNVYQVRDSRIDALNNILRTFLFHANLLQKQPAGWSKDSQLEMCEKYWLDPKRVHLPDEEAFRAEYEKGEWVAEVERRFALWLNKRLQKRFPHIAKDFDDVEYHEWRRNIRRTLRYRLRHP

SEQ ID NO: 7631 - protein, 427 aa, Thioalkalivibrio paradoxus ARh 1
MSDAEVTALRTLIDTFLEERLQPKLKDIRPEDPKYLALQQQYQRKNWLSKAAQRVNSLQLATHIIKATHPAIKGATSLYCLPTSLKDQPEVGSHVLSAGFPKDVTVADAAHLDVYTLLKLEHDDRTLLSRVLADDDALAAAFSDDHEQGLEWMHAFATVAQPRGSEASHTRAKQVYWLAGGDPTVDTDFHLLAPLYATSLAHVVYQTINDHRFSEEAKAARKARREGEYSETGFHEYPNLAVQKLGGTKPQNVSQLNLERHGTNYLLASLPPNWANRDLRPPLFVGSVFSRSSFGRRPGVRQAVHALKRFLATNPLPNVTTRQRRDKYLHELVDELLLYAAELHTLEPGWSAAPDCRLDRFEALWLDPRRADIDPDFASERENEEWVDEVSHGFGNWLNGRLEHQLPVGDPEYLHWKDSLREVLLHA

SEQ ID NO: 7632 - protein, 427 aa, Thiomicrospira aerophila AL3
MIEPAIQAFLSERKEAWLKKQLNPSQTESEQAEIYAEAEVSFLLAQWLPNAAKRAKQLNLVSHPAKFTHPGAKTSSVIAQTPQENDGFLRFGNVKDIEEDVFGNAAAIDVYKFLSLKLIDGKSVLQHIEQASELIQSQFSIPTLDFEQLRELFLLIKQDGHPEPLTSGQVKQVYFPVADETNGYHLLSILNSSGMMFALKDRINQVRFSDETKQAREDRKNKAYNPNGLYEIYDLTAIGFGGTKPQNISVLNSSNGGVAFLLKSMPPELEVRKVRLPKNDFFKQTLWAKDYGWIFSRLNYLLNEDWRNNMEIRQKRDQIFQEAVYQAAETLWQVRAQNEGWSQSDTYSSLPAWQKIWLDNARQAEREVDYAYIDQAISAFTSWFITVFEEYLKKNAIVFNDVDIQHFINVADLFDVQSNLQIKEAFR

SEQ ID NO: 7633 - protein, 433 aa, Pseudomonas aeruginosa YL84
MSERPNGDSPTLRQLIESFIQERLQGKLDKLKPDEDVKRQSLLAGHRREAWLADAARRVGQLQLVTHTLKPIHPDARGSNLHSLPQAPGQPGLAGSHELGDKLVSDVVGNAAALDVFKFLSLQYQGKNLLNWLTEDSAEAVQALSDNAEQAREWRQAFIGITAVKGAPASHSLAKQLYFPLPGSGYHLLAPLFPTSLVHHVHGLLREARFGDAAKAAREARSRQESWPHGFSEYPNLAIQKFGGTKPQNISQLNSERYGENWLLPSLPPHWQRQDQRAPIRHSSVFEHDFGRSPEVSRQTRTLQRLLAKTRHNNFTIRRYRAQLVGQICDEALQYAARLRELEPGWSATPGCQLHDAEQLWLDPLRAQTDETFLQRRLRGDWPAEVGNRFANWLNRAVSSDSQILGSPEAAQWSQELSKELTMFKDILEDERD

SEQ ID NO: 7634 - protein, 454 aa, Desulfovibrio magneticus RS-1
MDEQDTRQIRFCKLIEDFLAERLESKLKPLVAEEAKAEGEKIEKVLTQKKEVLDKFKLRNWVEDAARRVAQLTMVTHTIKAVNPNAKGTNFYCPIEKLPILQEVGSHVLSCGNVPLDVVGNAAALDVYAFLRLEFEGKTILRWLDEGDTDLLAVMGGDDTAKSWADAFAGIRVLKGPMASHKLAKQIYWLVGDDPCDDGQYHLLSPLYASSLAHTVYSIVQGNLFGDAAKEARDAKRKGQYSDQVLHEYFGLAVQKLGGTKPQNVSQLNSERGGRNYLLDSRPPHWPQRETRPLKGTASLFERFGKQMVCVNLVAKLKEFLESFPPNNVHTRNKRDELIDRIVGEFILYVDRLLKLEPGWTSNPECQIPYIEMLLIDPGRVDSDPEFAAIRDKSCWHDDIAKCFGQWLNGQLSKKLPMGDAEVLFWSDEFEELVNYPPRLLNFERKKSREDGHD

SEQ ID NO: 7635 - protein, 384 aa, Selenomonas ruminantium subsp. lactilytica TAM6421
MSVLTDYVQAESEKKGVPPGQWLADTAKNASKCQFATHIGRFINPDVTVNWQAKINGKLDDVYVSTGSVACSPDIFVAANYLATASLLQLRLEDGKTFYEHLQAADDCLREDFQIMQADYEQVREDLLTVKSDVLPDSTDKRLRQVFFPVGEDDYHLLTVLPPASLMQEVRARIRAMEDGARQACSKKSETYGSDHRRIYNLVQTKFGGTKPQNISYGNNRQGGRSYMLPAMPPVLEKRTIIYPRKDFFKETLRLRDFIGLFQRLHKRYVDKRNNMEIRQVVRSIERQIMEMVLLRVYVLREKCGWTDNRSLSRAQSIWLDDKYAEDRQIDEEWQKKLAGEFADWLMAAYEKVMKREKIEFGDGELTALRKEVAEFIRSDLQKQ

SEQ ID NO: 7636 - protein, 452 aa, Photorhabdus laumondii subsp. laumondii TTO1
MNENGLSRFIVDYIESRKQSKLEVFDKEAEKKLAKLTSMEDITPVKQKLAEQRKELEEHYEVRNWLDDAVSRVDQIRLVTHVLKFAHTDARGSSIFAVQSKANVKEDIKYLSMAALDRPAIDAAGNAAALDIAKLLLTEYREGDSLLANINRADYSALAELAKNEQQLELWINGFRQVLSDKRLSSHRLAKQLYFPVGYDKYHLLGPLFSSSLAHTMHQRITEARFGELSKEINKARKEESWRPETIVVYPNTAVQYFGSTKPQITSYLNNMRGGRVYLLPCSAPEWKNITKPPMKHRSIFDLGCEFVSLVRSTVWQMQRYLLSVQKYENTLEIQQCRQEYVDEIIDVLFNYVVGIQNLIELKGWSANEDCALKRAQQLWLDPYRCQQDETFKFEREGGDWKKEIAADFSYWLNQSLKHERLEMGLSERREWASVFKERLREFEDELPEVMP

SEQ ID NO: 7637 - protein, 443 aa, Pectobacterium atrosepticum SCRI1043
MRNGLPEFILSYINNRKQAKLDAFDKEAEKKRATLSGEALSVAELELAKARREIEQKHEVRNWLTDAASRAGQISLVTHALKFTHSDAKGSSVFNAETVEDATTLSTATLAQPAIDAVGNAAALDVAKLLQTEHDGDSLVAALQRGDNRALEALAENPEQLAQWLTGFQQVFTNRQPSSHKLAKQIYFPLANGEYHLLSPLYSSSLAHALHQRISAVRFGDEAKAIRQAQRTNQWHDQLSISYPNLAVQNMGGTKPQNISALNSSRSGRSYLLSSAPPQWNSIEKPPQQHESIFRPRGEVDYHTRATLAQMQRFLLSVKDVENNRDIRQQRLHYLDQLIDQLFFYVASVQNLPVGWSAESELKRAQQLWLDPYRAETDTVFRREREAGDWQQAVAYEFGRWLNRRLKHENLIFGEVERREWSTAALFKRRMREMESALKEELA

SEQ ID NO: 7638 - protein, 421 aa, Legionella pneumophila str. Lens
MFDPAITDFFAERKKSWLKKKLKPDMTELEKNNILQECEDIFALENWLPNAAKRAGWMSISTHPCTFSHPSSRKNKNGYVTSIIAKAPRKADGYLRSGNVHVALDALGNAAALDVYKFLSLVTEDGKTIIEHIQQNTEVAKSLLSIKTDSYENLRVGFLEMVSSNEASITSSKIKQVYFPMGNEYHQLSVLSNSGMIFELRERIDALRFSDTVKRGRELRRGNFYSELGYKEIYDVTTIAYGGTKPQNVSVLNNQYGGKAYLLFSAPPMLEQREITFPTKDFFVQSIRYYDCKEILEQLDNIFKIECYGKISLDKIRKGRDRCLSDMLDMILQKMMVLREASKNQFRSQSSSLPDWQKIWLCEQYIEERVKRDDWLETLCVQIALWINSAYKNSIKHPTMLGEAERRYFNDFINQHREALR

SEQ ID NO: 7639 - protein, 421 aa, Legionella pneumophila str. Lens
MFDPAITDFFAERKKSWLKKKLKSDMTELEKNNILQECEDIFALENWLPNAAKRAGWMSISTHPCTFSHPSSRKNKNGYVTSIIAKAPRKADGYLRSGNVHVALDALGNAAALDVYKFLSLVTEDGKTIIEHIQQNTEVAKSLLSIKTDSYENLRVGFLEMVSSNEASITSSKIKQVYFPMGNEYHQLSVLSNSGMIFELRERIDALRFSDTVQREREFRRDNIYSELGYKEIYDVTTIAYGGTKPQNVSVLNNQYGGKAYLLFSAPPMLEQREITFPTKDFFVQSIRYYDCKEILEQLDNIFKIERYGKISLDKIRKGRDRCLSDMLDMILQKMMVLREASKNQFRSQSSSLPAWQKIWLCEQYIEERGKRDDWLETLCKQIALWINSAYKNSIKHPTMLGEAERRYFKDFIDEHREVLR

SEQ ID NO: 7640 - protein, 448 aa, Yersinia pseudotuberculosis IP 32953; identical to SEQ ID NO: 7552

SEQ ID NO: 7641 - protein, 274 aa, Aspergillus niger
MSSSVQAGRVTKNTTTARRRRVQHPKTRAKPQPQDHEYDRNGSYYNSSPSLPLVERTNQLSIQEFSSKYISSEFLTYTYKPEDTISSEEQKYKLSIYDAATIPTTDLNACFNLIEETSSEAYKNSSTGWSPTKKKKEMKLPDMKYLVVRREVLSSDDGEGEGENAVVGFMSFMITYEDGKEVIYLYEIHLSSEVQKQGLGKRLLLVLMEIGRRVGMEKAMLTVFTSNGVAQRLYEAIGFGTDEYSPRPRRLRNGMVKEPDYKIMSVRLDGGPYV

SEQ ID NO: 7642 - protein, 448 aa, Yersinia pestis CO92; identical to SEQ ID NO: 51

SEQ ID NO: 7643 - protein, 416 aa, Acinetobacter baumannii AYE; identical to SEQ ID NO: 7557

SEQ ID NO: 7644 - protein, 447 aa, Erwinia tasmaniensis Et1/99
MLRETLASFITSYIAARKTAKLEAFDKESAKKLAVLASEDEISVLRQQLQQQRAELEQKYQPQAWLSDAASRAGQIKLVTHAAKFTHSDVRGSSIFSSGSGQHETYLSTATLQKPALDAVGNAAALDIARLLQSEVEGDSLIASLQRGDYSALESLTDNPELCASWISGFKQVLVDRQPASHKLAKQIYFPIADGQYHLLSPLFSSSLAHALNQRITEAKFSEQAKTARAALKAKSWHDAPVVAYPDTAITQFGGTKPQNISYLNSVRGGKVWLLPCAPPVWQTLSKPPAKHKSIFNSSNDFSRQSWPVIQRMSRFLRRVERLDSTLDIRQQRLAMTDEIIDILFNYVAGIQNQTESIGWSAHPDCVLKRSQQLWLDPWRGDKEFQFEREGGDWKSEVARDFGHWLSRHLHSDKLNMGETERRHFSTAPLFKQRLRELEKDLAEDLP

SEQ ID NO: 7645 - protein, 435 aa, Escherichia coli LF82; identical to SEQ ID NO: 7529

SEQ ID NO: 7646 - protein, 451 aa, Photorhabdus asymbiotica
MNENGLSRFIVDYIESRKQSKLEVFDKEAEKKLAKLSTSEDITLVQQDIAEQRKELEKRYEVRNWLDDAASRAKQISLVTHALKFTHSDARGSSVFAITLNSARNAEYLSTATLYKPVVDSVGNAAALDVAKLLQTECQEDSLVACLNRGDYSALAELAEDEQQLECWVNGFRQALSDETLSSHKLAKQIYFPVNSECDEYHLLSPLFSSSLVDAMHQRIIETRFGELSKEINKARKEEGWHPGIRVIYPNTAVQNFGGTKPQNISYLNSVRGGRVWLLPCSIPNWKTISKPPIKHKSIFRSRGEFDSLARNTIWEMKSYLRRVRYCKNNAEIRRRRQEFVDEIIDTLFDYVTSVQSLVAFKGWSASDDCELKRSQQLWLDPYRCEFDEIFQYEREGGDWKKEVAKDFGYWLNAALKHKELEVAYPERREWAFVFRKRLREFENELPKVPL

SEQ ID NO: 7647 - protein, 451 aa, Photorhabdus asymbiotica
MNENRLSRFIVDYIGSCKQLKLQSKLEDFDRKAGEKLAKLTSSEDITMIQQKLADKRKELEESYEVRNWLDNAANHAKKISRATHAPKYTHSNAKGSSILLVLSDAKENTQYLSTSVLYKPVIDIVVDAKYLEVAKLLQTEYQGDSLIECLSRRDYSALAELAENEQQLERWVNGFRQALSDETRSSHKLAKQLYFPVNGECGEYHLLSPLFSSSLIHAMYQRIAEARFSELSKDINKAKKEERWHPGTRVIYPNTAIQNMGGTKPQNISYLNNVLGGRVWLLSCSPPNWQSNIKLPERQRSIFEQRSQFVRLSYDTVRLMRKYLFRAQKRTEEIRQKRQAYIDEIIDILFDYVASVQDQVEFKGWSANCDLKRSQQLWLDPYRCQQDEIFKFEREGGDWKKEIADDFGLWLNNELRHERLEVGLTERNEWASVFKKRLREFEDELPEVPL

SEQ ID NO: 7648 - protein, 435 aa, Escherichia coli S88; identical to SEQ ID NO: 7529

SEQ ID NO: 7649 - protein, 435 aa, Escherichia coli ED1a
MEKTALIQFITDYIASRRQPKIDAFEKEAAKRLEQGEDASVIALERQELEARYLPRNWLTDAAKRAGQIKLVTHGAKFSHGDSKASSFYLETSATESYLNTASLANVATDAIGNAAALDVAKLLQTDVNGDSLLASLKRGDYQALSTFAEDKVQLELWVAGFSQAWTTGRPSSHKLAKQIYFPVADGYHLLCPLFSSSLAQAMYEKLTAGRFSEESKAIRDARKAGKWHSQPDIRFPNLAEMHFGGTKPQNISLLNSVRGGRVWLLPSMPPAWGPLDRAPQKMHSIFALRGDFNRAASGIIARMTYLLKVDTNNVHIRTVRAKYIDELIDLLFMQASAFQQEKWQGWSAQSPDLPRHQQLWLDPWRSLSDETFKQEREKNDWQVTVADDFARWLNYRLKKSSFDVGAVEQKEWRSQSLFAQRMREMEAVLQEALK

SEQ ID NO: 7650 - protein, 303 aa, Listeria monocytogenes serotype 4b str. CLIP 80459; identical to SEQ ID NO: 7526

SEQ ID NO: 7651 - protein, 449 aa, Erwinia pyrifoliae Ep1/96
MLRETLASFITSYIAARKTAKLEAFDKESAKKLAALASEDQISVLRQQLQQQRAELEQKYQPQAWLSDAASRAGQINLVTHAAKFTHSDARGSSIFASSSVQHEMYLSTAALQKPALDVVGNAAILDVAKLLQTEVEGNSLIASLQRGDYSALESLTDNPELCASWVNGFKQVLVDRQPASHKLAKQIYFPIADGQYHLLSPLFSSALAHALNQRIISAKFSEEAKTARAALKAKSWHDGPVVAYPGTAITQFGGTKPQNISYLNSVRGGKVWLLPCAPPVWQTQSQPPSQHKSIFNFSNDFSRQSWPVIQRLKHFLRRVKTLDSTLDIRQQRLAMTDEIIDILFNYVAGLQNQTDLRGWSAHPDCVLKRSQQLWLDPWRSQDDAEFQFEREGGDWKNEVARDFGHWLSRHLHSDKLNMGETERRHFSTAPLFKQRLRELEKDLAEDLS

SEQ ID NO: 7652 - protein, 449 aa, Erwinia pyrifoliae DSM 12163; identical to SEQ ID NO: 7651

SEQ ID NO: 7653 - protein, 455 aa, Xanthomonas albilineans GPE PC73
MTEDPQHLTRSERFRSAIAAFIDARREAKLKGNEGDSDTDSKYDYATWLSDAARRVSQIQAVTHVLKATHPDARGSSLHVAPTRLQAHTEVGTHVLGTDYAEDVVGNAAALDVFKLLKLEVDGRRLLDWMQDDDADLRVALHDNAKVASDWMGAFCNLVRHDALPSSHQAAKQVYWLVGDEPREDTHYHLLQPLFSSSLAHAVHADIQDARFGERNKQARQAYRDKHPFDGTYHDYRNLVARKLGGTKPQNISQLNSERGGINYLLASLPPRWTQEERPRTLLKLDSALDRFAYFDEVPTLIKKLADFLATDPPKNDATQKKREGMENDLINKLALFAAETAVRFEPGWSRNPDCVLPLSQQLWLDAERVELPIRIDPEHAEWEQQDRNFVDTYHLGDWQDEIAGQFATWLNDRLRAAGITGLGDDQYRHWAKQAIVDAAWPVPMRRRAPAGGVT

SEQ ID NO: 7654 - protein, 230 aa, Arsenophonus nasoniae
MTPSCYLFELRQRIGKLLPFTEQNKAARLLKSKNEFSEHGFREIYGITTMSFGGKNAQNASRLNSQNGGKARLLLSLPPTLQTRTLRMPQHNFFSDTFNPFSLKETFQAFHCFLHIDKNNINLRTKRDSYIQEYIEHIILIMYHIRQKFSENDIKLPENLPSYQKIWLFPDRQDERDQTNDWLTHLIEKLARQFIASYKKVVGKKYIQLGDAELKKIIQLVVENNKESLR

SEQ ID NO: 7655 - protein, 376 aa, Sporisorium reilianum SRZ2
MAITLQTVLPQKVLPRAPSLNASSPNPGIRSAITQFIPASPDASVDDDSPTTPTQGTSANGIALPSYSNSSKLNLFRTNSNGSQDHNDARSVAPPLKSPRLGAMDGRKPMSAGAGSRRGIAHSSRILGVDKDTEEAFALSQLTSGKVDVSFEGTLSERAQHSASQSKGKGRARDGDVDEAEDGQTPLFDIDLESGQPTASSSSNTSRAGRLLQMGSHSMPWIKSKSKSNSVPAYEESVTTTAAPASDARDDSLDFHRTPKPYTDHKAADYSADVEDDDYRAQGAFDDDREQLLHGDGDDASRSGYFAIGDRSLGYNSLQGGAGLGGYGGAVGFEAVTWREGGWMVLSCILVAVLMAVAILISVDVIDWPGDGIGKY

SEQ ID NO: 7656 - protein, 458 aa, Halomonas elongata DSM 2581
MPTMSGGWQELRELIEAFLKDRFDTKAEKLATDDPKYQALVEQFQRDSWLQDAARRVSQLQVVTHSLKPIHPDAKGSNLYTPPEFLSKHQGVGSHLLPADFDGDVVGNAAALDVYKFLKIEYDGKSLLERVLEGDTELARALSDNSEQSQAWMKAFAGITEPRGEHASHTRAKQVYWLTGDDAVDDGDFHLLAPLYATSLAHQVFQTINRDRFSDEAKEARKAKREGKLGEQEVHDYPNIASQKMGGTKPQNISQLNSERGGNNYLLASLPPAWSSRDIRPPLKADSVLSRGGMFGRRKEVRALVGDLKRFLETNPNIDMHTRDLRDDYTAMIMDELVLFTMQMHSLEPGWSADENCRLAEEEVFWLDPGRAQEDAEFRKARHAADWPDEIRQRFANWLNEALGGKLPLGDVEFRHWKKELGQDASHQRLLDKDRRWMAALVEELDELEELKGREDDE

SEQ ID NO: 7657 - protein, 423 aa, Desulfobacterium sp.
MADPAIDAFFQEKKEAWLKKNLKASMEESEVRENQMECDQLFSREVWLPKAAKKAGSRAFSTHPSKYSHPSTGIGKKNLNNHTYVSPVICTAEKAADGFLRSGNVKAELDSLGDAAALDVDNFLKLQMTDGNTLLKHIEIETDLAKKILNIQSESYDSLRKGFLEIARPASEIATSSKIKQVYFPVLDEYHLLSLLSNSGIIFELRKRIDSLRFSDEVKEIREKKRNSTYCEQGFAELYSITTIGYGGAQPQNISVLNNQYRGKAYLLISLPPTIQKRDIRFPKQNFFIESFRYFEYREVFDALHKLFKTDYNNIRIREVRDYRLQDLMDRIIDKMWAVRAVSKEQYWSENSQLKPHQKIWLCDEFQQTREEENEWLDKLCMEISVWTVRTYEKLLGKQAYKLGESERTHIHEIVTQNKEALR

SEQ ID NO: 7658 - protein, 303 aa, Listeria monocytogenes serotype 7 str. SLCC2482; identical to SEQ ID NO: 7620

SEQ ID NO: 7659 - protein, 303 aa, Listeria monocytogenes SLCC2755; identical to SEQ ID NO: 7620

SEQ ID NO: 7660 - protein, 303 aa, Listeria monocytogenes L312; identical to SEQ ID NO: 7526

SEQ ID NO: 7661 - protein, 303 aa, Listeria monocytogenes ATCC 19117; identical to SEQ ID NO: 7526

SEQ ID NO: 7662 - protein, 303 aa, Listeria monocytogenes SLCC2378; identical to SEQ ID NO: 7526

SEQ ID NO: 7663 - protein, 303 aa, Listeria monocytogenes SLCC2540; identical to SEQ ID NO: 7526

SEQ ID NO: 7664 - protein, 383 aa, Megasphaera elsdenii DSM 20460
MGIFMDYVVENSAKKKKTHNAWLQSVVDRIPSCTLSTHVGKFTNPEVKVNILDRGQGTNREYVSTDTVTHDIDIVVSSAAYLSTASLLMLPLEDRQLVLLHLKQRDLALKKDFTSLGIDYEKVCTDVDGLFQAALPDHTDQNLKQVYFPVSDGNYHLLTVMPSSSLLLQLKKRIDDMGSEEREHKKSGEAYTKIFSLTGIGFGGTKPQNISTLNSRQHGIAYLLPSLPPQLKLRTLRFPKRDFFRESIPYRPLNDLLHQLHVILKTEKNNMGIRMQRDEVTAALVDLVLMTAYEFRKHEAGWSNQPSFSNLPQAQKIFLDDAYKADRSEGTWQQMISRSFARYIISQYEKVMKSEKIVLGDAELSYLQDAMKNVLEEEVRYGL

SEQ ID NO: 7665 - protein, 346 aa, Taylorella equigenitalis 14/56
MDQIEVYKEIIEQFFDSESKYKDLDRSHRFKNLVNKFAEDAKHIVATKYPSKFTHPNSEFNLKNIDSFDFCNDGYVREGNCGELNYKTKIDYYTSAEYLPTVRFYEIVLEKETNVKLYEYLLSLRQDMIDNNRLPEKNLFREFDDATNIVKKLLIPFESSIPNETSTPNETSSPYETLPLLKQLLFPIRSKEGINGYVNVSVLSNSPLMCQLNSELSKYSNKNKQKDEEKQEQQEDFYIPNLVFYKLGGTRPQNISSINSSKKGYWYALSSTPPTFNKQYTRKPVVDFFRECLSDLDTYSPIKKLEKLIKTDFNNTNIRLGINHYLDELVNMLIERALIIRFSESG

SEQ ID NO: 7666 - protein, 413 aa, Taylorella asinigenitalis 14/45
MNQIELYIDKIEKFFESEKKFKDKEKSIRFEHNINKIADYAKNIAATKFPSKFTHPDSKVILKNNNSIPYSNDGYIREGNCGENNYKIKLDFVTPAQNLPYVKFYQIALDEKSNFKLYNYLLDLKQYMIKHKRLPENHLFSNLNNSKSIVDKLIKPFENSIPDQSSHLLKQLIFPKPTDDGLYEYVNISVLSNSPLMHQINSPYFKFSEKEIMTEGEIKQEIQDDYYIPDMIKYKLGGSKPLNISFINSLHDGYWYALSCIPPSLNIKYIRKPYFSFFKECLSDKYNYGTVKKLEKLTTNDFNTIHIRTAIDSYLDKLINMSIEKALIIRSCEAGWSDNKKFSRLSDVEKEFLDSKYEKTSLSNVNLLAHEFTKWVKNKIETNTSIKLEDSVFLYIKKKFLNQITLNWEVFND

SEQ ID NO: 7667 - protein, 445 aa, Erwinia piriflorinigrans CFBP 5888
MLRETLASFITSYIAARKTAKLEAFDKESAKKLAALASEDAISVLRQQLQQQRAELEQKYQPQAWLSDAASRAGQIKLVTHAVKFTHSDARGSSIFTSGSGQHEAYLSTVTLQKSALDIACNAAALDVAKLLQSEVEGDSLIASLQRGDYSALESLTDDPELCASWVSGFKQVLVDRQPASHKLAKQIYFPIADGQYHLLSPLFSSSLAHALNQRIISTKFSEETKAARAALKAKSWHGEALVTFPGTAITQFGGTKPQNISYLNSVRGGKVWLLPCAPPVWQTQNRPPSQHKSIFNSSNDFSRQAWPVIQRLGRFLRRVKPLDIRQQRLAMTDEIIDILFNYVAGVQNQTELRGWSAHPDCVLKRSQQLWLDPWRSQDDTEFQFEREGGDWKNEVARDFGHWLSRHLHSDRLNMGETERRHFSTALLFKQRLRELEKDLAEDLP

SEQ ID NO: 7668 - protein, 453 aa, Pseudomonas pseudoalcaligenes CECT 5344
MNAPSSSRQQAIRSLIERFIAERLATKLESLSADDPKRATLLAQYAPDVWLEDAARRAGQIQAVTHTLKAIHPDAKGTNLYCLPSALPQHQLVGSHCLGDDFAGDVVGNAAALDVYKLLKLEHDGQTLLDLLLAADADAIAALHTDDEQARSLAAAFTGITRARDGLASHTYGKQLYWLVGDDPRNDEHYHLLAPLYASSLAHRVYQEIQADRFGEPAKEARQARRDKQFHPGVIHEYPDLAVQKLGGTKPQNISQLNSERRGDNYLLASLPPSWQPRDVRLPIRTRDGSIFPAFGQRPAVAELVRTLRDFLLSGPPANVHTRNSRDELLTELIDELLLYAVELWAFEPGWSAKPECNLNRAEQLWLDFRRAEHDAIFASEWRRMEWLTEIRERFANWLNARLVSKLSVGDVENSYWAKQAGSNALWLDLDWLNRAWVEQFEREQRDLEAEHE

SEQ ID NO: 7669 - protein, 111 aa, Corynebacterium otitidis ATCC 51513
MFHVKPSIFVRLTFSVEGVGSATHAAHLEELDDDTCRLRRIVEIAPGEKVAGAFDGTSAPGMTAPPTSVVPHPRHYGDYPDIAVDALGRREFEELWAAAVEKFPVLDADSE

SEQ ID NO: 7670 - protein, 437 aa, Cronobacter dublinensis 582
MSQGALAAPAADYIATRRQSKLEQFDKDAAKRLAAGERDEATLLQERRELETRYETRHWLTDAASRASQINLVTHAAKFTHGDSRSSSVYRTTENGDGYLSTASLENPAADAVGNAAALDVAKLLQTEVEGDSLLAALQRGDYSALQALAQDDAQRQHWVDGFSRALTTSAPASHKLAKQIYFPVGEGYHLLSPLFASSLAHAMHQKMLAYRFGEEAKAAWAARKAQRWHSTPLTLFPATAEMHFGGTKPQNISSLNSSRGGRIWLLCTRPPLWQRQEKPPRYLSSIFAGKTFNREASGTVQRLADLLVGVKDHTNLAIRRARDRYVDELIDLLFAQASELQRPEWQGWSLECEKLVAHQQCWLDPWRTRQDEAFCRERESDHWQAAVEEDFARWLNYRLSKQLPDVGKVEKAFWGFRPLFRQRLREMESILEEVLK

SEQ ID NO: 7671 - protein, 458 aa, Desulfovibrio hydrothermalis
MRGAMSEVNPDEVGAIKKAIRDFVEGRAEEKYEPVTKTIAKLEEKLADPAVLSGEREEIEGKIEKEEAKLTGLRDKYEIENWLLDAAKRAQHIQRVTHTPKHMNSKAKGATGFFCNLEEKSIPSTLVSSFSLGSKNTLTDVIGNAAVLDVNKLLQIECNGRTLLSRLIDGDEDFKKALSSTPALASQIYEGLKVFISNRDPVAHSLTKQIYFPVKGNYHLILPLYPSVLVSRVHSQIRSDFFSDEVKEAKEARKKNGYHDCAIHSYPNLVVQSFGGSKPQNISQLNSERGGKSYLLPSLPPSWQSPEIKAPRKSIFTSELYYRKNVKYWVNALGCYLKKTTIDNMNTKYGRDKILAAIVDDILTYAMELRSLPSGWSDSAECQLPDNEKKWLDPFSEKAKSIQDDQWLDRICHNFASTLNNRLKKYHKVEVDGISHAVWKKGLKEEMKMFRWELCDES

SEQ ID NO: 7672 - protein, 458 aa, Desulfovibrio hydrothermalis AM13 = DSM 14728; identical to SEQ ID NO: 7671

SEQ ID NO: 7673 - protein, 303 aa, Listeria monocytogenes serotype 4b str. LL195; identical to SEQ ID NO: 7526

SEQ ID NO: 7674 - protein, 433 aa, Pseudomonas aeruginosa 18A
MSERPNGDSPTLRQLIESFIQERLQGKLDKLKPDEDVKRQSLLAGHRREAWLADAARRVGQLQLVTHTLKPIHPDARGSNLHSLPQAPGQPGLAGSHELGDKLVSDVVGNAAALDVFKFLSLQYQGKNLLNWLTEDSAEAVQALSDNAEQAREWRQAFIGITAVKGAPTSHSLAKQLYFPLPGSGYHLLAPLFPTSLVHHVHGLLREARFGEAARAAREARSRQESWPHGFSEYPNLAIQKFGGTKPQNISQLNSERYGENWLLPSLPPHWQRQDQRAPIRHSSVFEHDFGRSPEVSRLTRTLQRLLAKTRHNNFTIRKYRAQLVGQICDEALQYAARLRELEPGWSATPGCQLHDAEQLWLDPLRAQTDETFLQRRLRGDWPAEVGNRFANWLNRAVSSDSQILGSPEAAQWSQELSKELTMFKEILEDERD

SEQ ID NO: 7675 - protein, 103 aa, Mesorhizobium sp. STM 4661
MLSMTRVGAFDAVSKGCSIPSTLMIFAVRVVLFGRGVQHHGVERTAEKKGRCGLDERRLMPEPAFRSEYPGKNWLQRIALSARWAELVRVAKPGERGSSWAMW

SEQ ID NO: 7676 - protein, 387 aa, Dialister invisus CAG:218
MGILREYIEKQAKKKKKTSAEWFAGMLASLSECRFTTHVGKFTDPDSKIYFYCNKDDNCSGYVITGNVDVELDFAVSANFITPALFLLQILEDGETLLKHIQEKDENIKAEFAELGINTLAPLYQAVEGINKVERSQKSEFHLRQVYFPVGDGYHLLTVLPASGLLLTARRRVDRINGYSRLCHDSKSSEYGKSCSRIFDMASINFGSGKPQNISAGIQSYYGEAYLLESLPPVLGNKGVHLTKYNFLEENVSYKDYIATFQRLHKLFKQDRKNQQIREAIKNRIKDVIDVVMVSCYQIREQKAGWSDDECCKNLPVFQKIWLDEAYRDKRESESWREEVGRYFARWFIYKYKKIIKGERVSFGEEEFRYLKWKMIKILEEEVRYNS

SEQ ID NO: 7677 - protein, 125 aa, Dialister sp. CAG:357
MHALFKINWNNAGIREKRDRILGGIIDTAMMTAGRIREENPSGWSDDEKYNGLPRFQKIWLDNAYESEREGDAWVEAVSKDFARWIIRTYEKIERDEKVTLGDAETDYFRNTIYDQLREEVRLGL

SEQ ID NO: 7678 - protein, 401 aa, Megasphaera elsdenii CAG:570
MGSIATYIADKAAKKKQNPAEWLEDNLKNLDRYWVSSHIGRYTHPDAAVHLHDDSSPTGKGYLTTADAVVKQDIYVDGGSAFMSIASFLVSRFSQKETIAEQREDLEAKTAWQYFYDDSPFIRREIESLGIEYEPLREKFLHIQISEIPEKSDERLKQVYFPIPDRDGEYHLLSILPPSILMIELTHRIKIAFQVQRRCQDKKSGCYGGAYQSFPDLTVVRFGGANVQNVSVRNSSLGMQVLPSLPPCLTGRKMKLPKRNFFSDSLYWRRFSDTLSDLDALFRDQRHNLETRKRRENIILDFVEAILYEANRLQILPAGWSKETELSDEQAVWLDEAYGSQRQADTDWIWPVCLDFARWLVDAHKRFCREQKRSLIALSDAELHSFAATLESVLKQEVREG

SEQ ID NO: 7679 - protein, 416 aa, Acinetobacter baumannii 107m
MAESIHTFLNERKELWLKDRIKKAENESAIAELQQQANDKFSLNEWLPDAAKRVTQLSMVSHPSKFSHPSAKTSSVIAKVEYCNDGYLRSGNVDYSLDVFGNAAAMDVFKFLSLALTENLTVLDGFEKQDQELKKLIAHAELDFDNLSSEFLKIKATDDSIKTDHLVKQVYFPVGEAQYHLLSILTPSGLITRLKQSVDAMRFSEETKQAKESRKKNEHHEVGYSDIFDLTVTGYGGTQPQNVSVLNSQNAGRAYLLPSCPPVLEKRTIRLPKADFFAQSLYRKNYQDSFIQLHKFMQLDLNNIDIRNAIKNIIQFVIDQILLQALKTREYAVEGWSNQDYYASLPKIQRIWLDKVHQKEREENSDWRDELSREVARWILRSYEKVISDAYTLGTGELLDVKQWVENSLQKAKEFF

SEQ ID NO: 7680 - protein, 435 aa, Escherichia coli PMV-1; identical to SEQ ID NO: 7529

SEQ ID NO: 7681 - protein, 303 aa, Listeria monocytogenes str. 4b H7858; identical to SEQ ID NO: 7526

SEQ ID NO: 7682 - protein, 428 aa, Marinomonas sp. MED121
MEDRNVIDPAITKFFTERKEAWLKKNLKSDMEQWEILEKEHECEANFTLANWLPDAAKRAGQISIASHPCTFSHPSARKNKNGYVSSIIAHCDSRADGFVRSGNLNVKLDALGNAAALDVYKFLTLIMGDANTLLEHIEQETTLARSLLDQVNGDYQALRKGFLKMVEPDEELITSSKIKQVYFPVDEGEYHLLSLLTHSGHLFELRKRLDNLRFAEEVKTARACKKANQYHVDGYREIYGLTTIGFGGTKPQNISVLNNQNAGKAHLLASVPPTLSNRNIRLPKQEFFKETLNPWSAKSIFTAFHQLLSTSYDKSVLPNRNLRTARDNLFQAYMDHVIQAMWQVRLCLKDYKGDVSSELNLEQKKWLYPEHEDLRLESDEWLEVIIRQISRSFIQSYQKVIAKPVSLADEELLAIEKIVANNKEGLR

SEQ ID NO: 7683 - protein, 455 aa, delta proteobacterium MLMS-1
MEHNRLATKIADYIQARGTVKLEAFDKDAEKKRKQQLEDAEKLAALDQELAEQRMAWEAHYRPANWLDDAGVRAKQIKMVTHAIKYTHSDAKGSSLYAVDNGLPAYPADGNVVISTASLTKPAIDVVGNAAALDVAGLLLLEHEGETLLDKIKQNDDSALKPFAANKDQLNGWMTEFRKVLDSEQPSSHTFTKQLYFPLEDGYHLVAPLFSSAMADALYKRISFFRYDEVAKEARKAKREARFCPHPVVDFPNTARQNFGGTKPQNISKLNSARGGRSFLLSCAPPAWQPQKKPPIGAKTIFSRNHFGARVYRTIWNARNFLEKQVDKPSIMQVRAKREAYIDELIDHLVHYAAEIQQIQGMRGWSALPECRLGRAEQLWLDPKRAGMDPEFAKERESNDWQGEIADQFARWLNNRIKSSKLSLGDVEHREWQSLLEEKLRLLKDDLRDDLEVFT

SEQ ID NO: 7684 - protein, 449 aa, Chlorobium ferrooxidans DSM 13031
MEQNNSVMTEAAALKDLMHNFLQERLDKKLDELQKEEHKKSATIILDEELEKLKDKYEGKKQSLIESYQLEVWLDDAAKRVRQITLVTHAIKYQNPDAKGSSLYAAMEERDSFCVSTACLEHPANDVVGNAAALDVYKFLQLSLSDNGETILSRIFRNDEALRAALPASDEKKERWFQEFSAIRSPKILPTTHTLAKQLYFPVGDGKYHLLAPLFPSALAHEVYLKVQTRFDDETKEARKAKRESRYHPHGYRDYPNLAVQNFGGTKPQNISQLNSERRGQAFLLPSLPPIWHSSAVRPPLGVESVFPKIFAGRVKRLTHELKNFLVKVQDRESNAEMRQTRVELVGKIIDELLQYSSEVQGLPPGWSTKPECLLEKAQLFWLDPERTDDEWQQQREATGWEQQIIYEFANWLNATLQTDYLRFGDDERQEWKKLLQKELAWLTPEKAL

SEQ ID NO: 7685 - protein, 418 aa, Coxiella burnetii 'MSU Goat Q177'
MLNNSIDEFLKKRKVAWLKKAINASMDEIEVSEKELECEQVFALEHWLPSAAKRAGQISISTHPCTFSHPSSRKNKNGYASSIIANSKRSEDGYLRSGNVTVKADALGNAAALDVYKFLSLEMADGQTLLSHIQQDSDLAQQLLNIKSESYNTLKDGFLAMINRNSDCVTSSKIKQVYFPLDNGYHQLSILSASGIMFELRKRIDTIRFSDEAKAARACEKNNEIYDGDYKQIVNITTIGYGGTKPQNISVLNNQNGGKVHLISSEPPKLIKRDAHFPTVDFFSQSLRYFQCKDLFYSLHELFLNHKNDWNIRHERDEYYQAIIDLIIEKMWLVRSVSQVQYNPDSTRLNETQKIWLCEVNKENRETENDWLDDLCQAIARFIFTGYEKLLGKKAFIFSDDEFKHIHKQVVKNKEALR

SEQ ID NO: 7686 - protein, 434 aa, Pseudomonas aeruginosa C3719
MTSPLPTPTWQELRQFIESFIQERLQGKLDKLHPDEDDKRQTLLATHRREAWLADAARRVGQLQLVTHTLKPIHPDARGSNLHSLPQAPGQPGLAGSHELGDRLVSDVVGNAAALDVFKFLSLQYQGKNLLNWLTEDSAEAVQALSDNAEQAREWRQAFIGITAVKGAPASHSLAKQLYFPLPGSGYHLLAPLFPTSLVHHVHALLREARFGDAAKAAREARSRQESWPHGFSEYPNLAIQKFGGTKPQNISQLNSERYGENWLLPSLPPHWQRQDQRAPIRHSSVFEHDFGRSPEVSRLTRTLQRLLAKTRHNNFTIRRYRAQLVGQICDEALQYAARLRELEPGWSATPGCQLHDAEQLWLDPLRAQTDETFLQRRLRGDWPAEVGNRFANWLNRAVSSDSQILGSPEAAQWSQELSKELTMFKEILEDERD

SEQ ID NO: 7687 - protein, 434 aa, Pseudomonas aeruginosa 2192
MTSPLPTPTWQELRQFIESFIQERLQGKLDKLHPNEDDKRQTLLATHRREAWLADAARRVGQLQLVTHTLKPIHPDARGSNLHSLPQAPGQPGLAGSHELGDRLVSDVVGNAAALDVFKFLSLQYQGKNLLNWLTEDSAEAVQALSDNAEQAREWRQAFIGITAVKGAPASHSLAKQLYFPLPGSGYHLLAPLFPTSLVHHVHALLREARFGDAAKAAREARSRQESWPHGFSEYPNLAIQKFGGTKPQNISQLNSERYGENWLLPSLPPHWQRQDQRAPIRHSSVFEHDFGRSPEVSRLTRTLQRLLAKTRDNNFTIRRYRAQLVGQICDEALQYAARLRELEPGWSATPGCQLHDTEQLWLDPLRAQTDETFLQRRLRGDWPAEVGNRFANWLNRAVSSDSQILGSPEAAQWSQELSKELTMFKEILEDERD

SEQ ID NO: 7688 - protein, 448 aa, Yersinia pestis CA88-4125; identical to SEQ ID NO: 51

SEQ ID NO: 7689 - protein, 131 aa, Faecalibacterium prausnitzii M21/2
MDELRLINATPLEKEMLEYADYIGRETTNECESTAETCADMVSSAPTIDPESLPPHWRKSEETPPKKKDGDVLGSVFAVAYHRNIRNGIWLASNMPWHIVADCPEMYPLWMPLPKLPDLPTPERRCMLGND

SEQ ID NO: 7690 - protein, 419 aa, Shewanella benthica KT99
MLDPAITSFFAERKEAWLKKNLKASMDEAQTREAQQQCEAAFSLSIWLPKAAKRAGQISMATHPCTFSHPSARKNKNGYVSSVIAKAERATDGFLRSGNVVVDTDALGNAAALDVYKFLTLEMTDGQQLLTHIQHDSELATQLLTLKDVTYLELKAGFVAMAESGSENVTSSKIKQVYFPVDDDYHQLSILTNSGMLYQLRKRIDTLRFSDEVKVLRDLKKKNEYSAQGFAEIYGLTTIGYGGTKPQNISVLNNQNGGKAHLLSSLPPQIEKRTLHFPRSNFFSESFRPYEYKDVFQALHRIFKIDYKNNKQLRNSRDARIHEVMDKVIAKMWAIRSISELQYNSESSQLSRAQKIWLHHDFTEQRENTDEWLDTLLNEISSWFASTYKTAVGKQAMILGEEERLHFLKMITQHKEALR

SEQ ID NO: 7691 - protein, 535 aa, Physcomitrella patens
MGLRDAFVGLTQPRAGAPSSHTRAKQLYWLTGSDACADEGYELLAPLFATSLAHAVHAQVQEDRFGESNKAARQARRERKAHDGVFHDYPGLAVQKMGGTKPQNISQLNSERGGVNYLLASLPPVWRSSDVRLPVHASSLFDRLFIGRPEGAQRGIALDGALDFAHAGAAREQGRGHDGQGMDAAQLHGVLLGRKKARLHGPWLEWGDCYRFSRQDDSCTTCRPGSHVAVGVGNAGGLGVLEVVQLGVHHVRGHDVAHGAEHAFHAAREFLVPLAQQLAHGHALQAVLAAAEVAGDDGEVLVLGPAHGVLLGHVAQRADHHMLAVVRDQLRGHALHAAAVEHVEHQRLHDVVAVVAQGHLGAAQLVGHLVQDGAAQARAQAAGGLALGHHALDHAVGVLRFDVVVHADALEVLGQYMVGKTGLLLVEVHGHQLELHGRALLQLAQHVQHRVAVLAARHADHDLVAFLDHVEVGDGAAHLAAQALFQLDLLALDLDAVAVRGMGLGIRIGGGGFGGGFFGQPGVVGHCIHGVHHCP

SEQ ID NO: 7692 - protein, 418 aa, Coxiella burnetii Q321
MLNSSIDEFFKKRKVAWLKKAINASMDEIEVSEKELECEQVFALEHWLPSAAKRAGQISISTHPCTFSHPSSRKNKNGYASSIIANSKRSEDGYLRSGNVTVKADALGNAAALDVYKFLSLEMADGQTLLSHIQQDSDLAQQLLNIKSESYNTLKDGFLAMINRNSDCVTSSKIKQVYFPLDNGYHQLSILSASGIMFELRKRIDTIRFSDEAKAARACEKNNEIYDGDYKQIVNITTIGYGGTKPQNISVLNNQNGGKVHLISSEPPKLIKRDAHFPTVDFFSQSLRYFQCKDLFYSLHELFLNHKNDWNIRHERDEYYQAIIDLIIEKMWLVRSVSQVQYNPDSTRLNETQKIWLCEVNKENRETENDWLDDLCQAIARFIFTGYEKLLGKKAFIFSDDEFKHIHKQVVKNKEALR

SEQ ID NO: 7693 - protein, 448 aa, Yersinia pestis biovar Orientalis str. F1991016; identical to SEQ ID NO: 51

SEQ ID NO: 7694 - protein, 448 aa, Yersinia pestis biovar Antiqua str. E1979001; identical to SEQ ID NO: 51

SEQ ID NO: 7695 - protein, 442 aa, Yersinia pestis biovar Antiqua str. B42003004
AAFIVSYIKSREQPKLEAFDKEAEKRLAGLTQAEDIALAQQEIAQQRQELIARYEVRNWLTDAANRAGQIKLATHAPKYTHSDSKSSGILNIELQSKKKDYFSSVDLAEQASDVIGNAAVFDLVKLLQSECEGGSLIKCLEQGDNSVLKLFSNDDELVEEWTTKFKSILNNEKFTSHKLAKQFYFPVGPDQYHLLSPLFSSSLAQAMHQRIIEARFSDQSKEAKAAHKAGRWHPTVRVLYLDTAVQHIGGTKPQNISYLNSVRGGKVWLLPCGAPSWKNIQKPPIKYRSIFHDRSEFTVLARNNLWQMQLYLLGVKPLSNTMDIRAARLACCDEIIDILFNYVAEIQNLDGTNGWSDAEDCKLKRSEQLWLDPTRAMDDPVFKLEREKEDWKQEVSQDFGYWLNRWLQHDELVFGYVEQREWSSLFKQRLREFEQGSLETSS

SEQ ID NO: 7696 - protein, 448 aa, Yersinia pestis biovar Orientalis str. MG05-1020; identical to SEQ ID NO: 51

SEQ ID NO: 7697 - protein, 423 aa, Providencia stuartii ATCC 25827
MLDPAIEAFFAERKEGWLKKNLKASMSEAEVHQIEQQCEDTFALSQWLPNAAKRAGQISLSTHPCTFSHPSARKNKNGYVSAIIANAKQANDGFLRSSNVAVEPDALGNAAALDVYKFLTLQMQDGATLLAHIEAETQLAKTLLTLNNESYQEIRNGFLAMSATDDSVVTSSKIKQVYFPVWLDDEDYHLLSILTPSGLLFEMRRRIDDIRFSEQTKTLRDLKRKGEYSEVGFKEIYGLTTIGFGGTKPQNISVLNNQNAGKAHLLLSLPPVLNIRETRLPKTNFFTDAINPWHTKETFQAFHGLINLPKDKRGNRFIEYRDNRIQEYVDYIIVMMWKVRRALEQENITLPNKISNYQKTWLFPDNQEQRDNTDDWLEILIPEIARQFIAGYKVVNGKKALFLGNDEFNAIVDVVARYKELLR

SEQ ID NO: 7698 - protein, 435 aa, Escherichia coli B7A
MEKTALIQFITDYIASRRQPKIDAFEKEAAKRLEQGEDASVIALERQELEARYLPRNWLTDAANRIRSIRIISHGAKYSNGDSKAYGRYLEKFVSEGYLNTASLAIIKEDAEGNAAVFDVAKLLLTEINGDSLLASLKRGDYHSLNVFALNDEQLKQWVECFSKAYASEWIKAHKLSKQIYFPVDDGYHLLCPLFSSSLAQAMYEKLTAVRFSEESKVIRDAHKAGKWHSQPDIRFPNLAEMHYGGGNQQNISLLNSARIGRVWLLPSMPPTWVTLDRAPQNMRSIFALRGDFNRAASGIIARMTYLLKVDINNVHIRTARAKYIDELIDLLFMQASAFQQEKWQGWSAQSQDLPRHQQLWLDPWRSLSDETFKQEREKNDWQETVADDFARWLNYRLKKSSFDVGAVEQKEWRSQSLFAQRMREMEAVLQEALK

SEQ ID NO: 7699 - protein, 450 aa, Nitrosococcus oceani AFC27; identical to SEQ ID NO: 7528

SEQ ID NO: 7700 - protein, 435 aa, Escherichia coli; identical to SEQ ID NO: 7529

SEQ ID NO: 7701 - protein, 420 aa, Oxalobacter formigenes OXCC13
MQESTEPIEESDEAPSTSTTKKQAANPWKHQSEETYRKTAEKLVHFSSKTVNSNASAAGIRLTAGDGLDLPYVSARTLINAGVELELDYAEGGAAQAGIIKQLMACQTNDPFADAATAEEKACIRPLLEKIRDERFELGTGKVDLRLRQLLIPKENAPGGYVAVTPITSGSVCHILFNNEDGLVLEHNRKASDAAKTKKTSPFSFIRQARMGIGGANPQNVGRLTRNMQQPILVSAPPQDARLRHALSIYHKGLTFDFSRYGPYWDALIRYSIYRDELTDKEKNTMQTNMKNRAGETTHFHGLGALVEAQAQQAFSLLWKHRENLPQEHLFETGIEPEYELVSRKVHGVIRGLIDPRLRKTDYKKDRTGREMNWPREMAEYIADAIVNVRHVKDGESILLFPLDDVAKMDLTNQLEDYFR

SEQ ID NO: 7702 - protein, 448 aa, Yersinia pestis Nepal516; identical to SEQ ID NO: 51

SEQ ID NO: 7703 - protein, 448 aa, Yersinia pestis biovar Orientalis str. India 195; identical to SEQ ID NO: 51

SEQ ID NO: 7704 - protein, 448 aa, Yersinia pestis biovar Orientalis str. PEXU2; identical to SEQ ID NO: 51

SEQ ID NO: 7705 - protein, 448 aa, Yersinia pestis Pestoides A; identical to SEQ ID NO: 51

SEQ ID NO: 7706 - protein, 447 aa, Yersinia kristensenii ATCC 33638
MQENGLAAFIVSYIEGRKQPKLEAFDKEAEKRLAGLTAAEDIARVQQENALQRQELAARYETRSWLTDAASRAGQISLVTHALKYIHSDARGSSVFNLPAAEDNAVYLSSATLAKPAIDAVGNAAALDVAKLLQTEHNGDSLLACLHRADYSPLAELAENPAQLTLWVEGFKQALVDKQLTSHKLAKQLYFPVGPNQYHLLSPLFSSSLAHAMHQRITDARFGDQSKEAKAAYKAKTWHPQPRVMYLDTAVQNIGGTKPQNISYLNSVRGGKVWLLPAGAPQWRSSRKPPTKHSSIFNDNSEFTALAYSTARQMQQYLLSVKPLTNTMGIRASRLAYSDEIIDILFNYVAEVQNLKIAAGWSQEDGCNLKLSQQIWLDPAFKQQRELGDWKKEVAQEFGYWLNRRLKHDELVFGEVERREWASLFKQRLREFEQGSLSEPESLEAES

SEQ ID NO: 7707 - protein, 401 aa, Yersinia rohdei ATCC 43380
MAISTEYQAQLQALDNQFAYIPWLTDAAKRAKQISLVTHAPKFTHGDAKGSGVLDDRESTVAKGYLSTLVLSQPEIDTIGNAAAANSATLLLLTVDGISVADCIAQDDISPFTPFTDDPQLLGEWLAGFKLALVDKDPSSHPLAKQIFFPVAEQKYHLLSPLFPSSLAHEIYARIGQSRFGEQAKEIREAKKAGKYHAELQVSYPGTAIQIYGGSKPLNISSLNVARGGKMLLLSCAPPSWRGRLAPPSGKDILYSSEFNRRTWQQVNQLKSYLLSVAEKESTLEIRQQRGRYVVALVDALLNYATEIQSLTELAGWSSHPDCKLPDAQKIWLDPHHPSTEFQQQRSKNAWPGEIAKQFAHWLNKKLEHKRMTFALAESQAWQKVFSQRLWAFDLGRREEV

SEQ ID NO: 7708 - protein, 130 aa, Acidovorax delafieldii 2AN
MRPPVHAALVFERLFIARPEVRRAVRALRVFLESAPDANLATRERREELLDALVDELVSLAAELQQLLPAGWSRDDERFKELDDQEALWLDPLRAEIPEEAQFAHDWQYMDWPAAFGKAMSQLRVERSSL

SEQ ID NO: 7709 - protein, 148 aa, Acidovorax delafieldii 2AN
MNGRSLLAALLAHDADALAALHADPAQAEKLRDAFVSLTQPRAESPSSHALAKQLYWLTGTDACDDAHYTLLAPLYATSLAHAVHTQVQEDRFGEANKAARQARRERKMHDGVFHDYPGLAVQNMGGTKPQNISQLNSERRGMNYLLS

SEQ ID NO: 7710 - protein, 412 aa, Enhydrobacter aerosaccus SK60
MSDASTIPIDQYRQTLAESVNFSNKTINSNIEKGGIRLAKSQALDLPYISARTLLADDITIPTDYQANAGKTATIFKAIKSAMLDEDLSEQDDDFKTVVNTIQPDIVSLFDTPYQAGLEHINIRMRQLLLPKGDDYLSISPISSAGVNHWLNDEVDDIKEARKIDNDLHSITTAVFGIGGANPQNVGSLVRAMQRPIYLTAPTANDTIRQAFSLYYKGLDYYIPNKLPKDKLVQPALLAWADLVNQGIATTEQDLNNQDWKNKGIEATSTNMDSREAEQQFLTHILRIVLAQGREAKNSLEQVADRLPNITKISNEPYDENPGEMVSKERVALTPLQHPSVDLAIQGLIDPKLRDEGWMTVFAEHLAKNIVRQSYEVEGQSNPVAFVLEDSTIPFLARRIRGLLYDLQELAS

SEQ ID NO: 7711 - protein, 425 aa, Vibrio mimicus VM603
MEGSRVLDPAIAAFFAERKEAWLKKNISAAMSDTEVLEKQQECEQNFLLDNWLPDAAKRAGQIAVASHPCTFSHPSARKNKNGYVSSIIAKNKPRIDGFLRSGNVSVEPDALGNAAALDVYKFLSLEMSDQRSLLVHIEQESELAMQLLDIPSCEYQALRDGFLKMVDNEQASVSSSKIKQVYFPIADGDYHLLSLLTHSGHLFELRKRLDALRFGDAVKEARECKKTNHFHPAGYQEIFGLTTIGFGGTKPQNISVLNNQNAGKAHLLASIPPELTPRDIRLPRTDFFKESFNAWQAKEVLESLHRLFLTDYNNINLRDGRDYRIQQYVDLVIEKMWQVRLFLEEYSGELSSVLPLEQKIWLYPEFAEQRHQEDEWLDKIIRHIARGLINHYSRSKVITSPITLADQELLAIEKVVASNKENLR

SEQ ID NO: 7712 - protein, 303 aa, Listeria monocytogenes FSL R2-503; identical to SEQ ID NO: 7620

SEQ ID NO: 7713 - protein, 389 aa, Dialister invisus DSM 15470
MILSGLTAYISEAAAGKKKTPQKWLADTVSLLSKCDMATHVGKFTHPDVKVYLQRKNKAGQNAYVVTENVDCETDIVYSSAAYMGAAKLLLYALDDGRPLWKHIYENDENVRREVESLGVSFDTMRQEVERMMATADLAATDGRLRQIYFPVGEGMYHLLTVLPSSSLLQVLNGRSRNMRQHRFDCRNEKSEFYGNACDEIMERTVIGFGGTKAQNISAFNARVAGKADLLMSMPALLEEKKIRRPHRNFLEETVPYRDYFFLFRNLHELFLMERNNVEIRNKREALVCDLIDVILQSCYRLREEPAGWSNGEEFLNLPQIQKIWLDEQYREERTDEWAKETGKYFAKWFIYKYRRIKKEQRISLGEEEMKYIRHAMIEVLMEEVRSLS

SEQ ID NO: 7714 - protein, 444 aa, Pasteurella dagmatis ATCC 43325
MSHFIKSRISLFLKEQNLKKSEGDRKKLAKATDPAEIENLTQIIQEFDQKYQFDTWIANAANVMAKQLKFGTHISKGIHPDTKGDNVNFQSNDLLPPEYVGSQSVSSLELDANGNAAALPLASFFNFIVDEEKQLKLRDLLLSDDLRLDSCFADDLELSKCYKKQFQQALMGDLTQPETHERNKQLLWANGENAIENDDYTCLIPLYPSSLTYAFYQKVNNNRYSEQNKQARENRNKKTVEQAHYVSINQLATVALGGSKPQNISLLMSAQGGRNYLLPSLPPIMTSSHYFKLSTSQTTIFNDRLVYACRYGLRQLFEVVEARKNVYEVRDNRIEALNIVLQSVLRIASTLQKQQAGWSKDYQLEMCEKYWLDPKRSLLPEEEAFRVEYEKGDWVDEVERHFALWINRCLQKRFPKIADDFADPEYNEWRRNIRNTLRYRLRHP

SEQ ID NO: 7715 - protein, 401 aa, Mitsuokella multacida DSM 20544
MGSIATYIADKAAKKKQTPSEWLEGNWKNFDRYWVSSHIGRYTHPDAAVHLHDDSSPTGKGYLTTADTAVQQDIFVDGGSAFMTIASFLVSRFSQKETIAEQKDDLEAKTAWQYFREDSPFIRREIESLGIKYEPLREKILRIQISKIPEESDERLKQVYFPIPDHDGEYHLLSILPPSVLMLELTNRIRMAFQVQRKCQDKKSECYGGSYKFFSDLTNVRFGGANVQNVSTRNSSLGIQVLPSLPPCLTSRKIKMPKRNFFFDSLYWRNFIKMLFHLDALLRDQRHNLEIRERRENIILDFVEPILYEANRLQTLPAGWSKDTELTEEQAVWLDAAYSNQRQDDTDWIWPVCMDFARWLVNAYGWFCRIEKRKEISLSDAELHSFASTMEDVLKEEVREG

SEQ ID NO: 7716 - protein, 386 aa, Acinetobacter lwoffii SH145
MTNNTGENPYQQALAESVHHSLKTINSNIEKGGVRLSLHQKLDKPYISARTLLADDLLVPTDYQANVGKTATLFKVVKAAQLDEDLSEADDEFKQNVALLKPQLTAAFNQPFSAGLEMVDIRMRQLLLPKNDEYISVSPLSAAGINLLLNHEVDTLKEQRKQEGKDTKLKTIKTAVFGIGGSNPQNVGSLVRSMQRPIVLTSPTLDPKTRLAFQYFYKGFEYQISNAYINLAMYQELTEYVKSLIEQQKLSLELGFHENGIHAPFSNLKTRQAELSSIEKVVNDVLQQGKQILAILKTIKDQLPSLKALERKSLWSHPRVSIITQGLINPEIHQFDDWKVLFADDLAVKITQHQYWKKEIQNHIGISLSEADAKSFLSRRIQELLK

SEQ ID NO: 7717 - protein, 448 aa, Yersinia pestis KIM D27; identical to SEQ ID NO: 51

SEQ ID NO: 7718 - protein, 435 aa, Enterobacter cancerogenus ATCC 35316
MSVEALTAFIAEYIAARRQTKLEAFDKEAAKRDVADRVALAGERRELELRYEPQTWLTDAARRAGQISLVTHAAKFTHGDSKSSSLYSETTQKEGYLSSAALDDVEPDAVGNAAALDVAKLLQTRVEGDSLLACLKRGDYSPLAAFTKDAVQLEEWITGFSRALTSGEPTSHKLAKQNYFPVGDDYHLLSPLFATSLVHAYHQKMIAFRFGDDVNAIRKARREKTWHSQPLVLFPESAEMHFGGTKPQNISYLNSVRGGRVWLLSAQPPQWKRADKPPVTLRSVFTEGGQFDRRANATVQRLVTLLTRSTDYTNRRIREARDNYIDDLIDLLFLVVSELQREEWQNWTLKCPTLKTHQQLWLDPWRTKTDEAFRKERGKDDWLEEVAADFSIWLNTRLRKNLPDVGAVEKREWATREKLRTNLRETEKMLREALK

SEQ ID NO: 7719 - protein, 303 aa, Listeria monocytogenes HPB2262; identical to SEQ ID NO: 7526

SEQ ID NO: 7720 - protein, 303 aa, Listeria monocytogenes FSL J1-194
MIKLINVVKKFGKIEAVKGINLEVEKGSLFAFLGENGAGKSTTLSMICTESEPTSGEIFIDDEKLTFKNRKLFRQKRGVVFQENVLDDLLTVRENLYNRASLYGKTKAEITERLALVSSIMGIEDILNRRFEKLSGGQKRRAEIARAIMHDPEILLLDEPTTGLDPKTRVSVWKIIDYLREELGMTVFLTTHYLEEAKDADQLAVIHKGKIIAQGTPANIRSRFSVDKIFFYDAKVAELQKIMKKMNLPFKVTNRTMRVDVIDENVEILAILNQAIGFYDSFEVIKGNLDDAFISMIKEDSND

SEQ ID NO: 7721 - protein, 450 aa, Neisseria sp. oral taxon 014 str. F0314
MPDISTAQVRAAILGFLQSQHEKKAEADLKKLAKAEEAGDEAEIASLQTALSALKTKYGLDAWLEQDAVRFAAQLKFGSHIAKGVHPDSKGDNVNFQAGFDLPASLAGSQSLRKAEAELDANGNAAALPLAAFFDTVVDEASQSTLLDLLLQDHPALKGAFADDPERSDRYRQVFQTALQAQTDTPAAHERNKQVLWPLGGDAAAADRYITLIPLHPASLTHSLYRKVNELRFGEENVQARKNRREGKGSQTAHAVFSPLAYVKLGGTKPQNVSLLTSRQGGRNYLLPSLPPQYERPKQLHFSRKSNSFFNNGLRYLCRSGYHTLTDAVKAKKNKKDTRLLREQALEQMVRQIVVVSEHLRETQPAGWTDDYRLETNHKHWLDRKYPLSDGPDGWQEKIADDFGKWLQDLLRKNFQSIKHDFDEIEYAQWCKTLADALKAAQRRNKRRAA

SEQ ID NO: 7722 - protein, 303 aa, Listeria monocytogenes FSL N1-017; identical to SEQ ID NO: 7620

SEQ ID NO: 7723 - protein, 449 aa, Actinobacillus pleuropneumoniae serovar 2 str. 4226
MITPLQIRAKIIDFLQAQHLKKSENDYKKLEKATEPEEIAKIKAEISKSEEKYRLDTWLHIAATEMAKQLKFGTHIAKGIHPDAKGNNINFRTNLALPTTLVGSQLIDQVVLDANGNAAALPLAAFFDIMIDEVNKRTLKDLLLTDEPCLDGCFSDDHSLSAQYKIAFQMALKGNLNSPETHERNKQVLWVNSSSAIEDNHYTCLIPLYPSSFTHAIYNKLNQARFSDENKQARENRYKNKAQNPYISIPHLAATKLGGTKPQNVSLLTSKQGGRNYLLPSLLPIFTKGELRLTNAQDTIFNDRLAYVCRAGLYQLYQAVADSRKNYIVRVPRAEAVNLIVQIVLQQAYKLQKRTAGWSRDYQLAWCEKYWLDPQRAKLNGEEQFHSALTQQDWISDVEQRFAAWLNALLKKRFPKHQDDFTATEYNEWRKYFRKKLHRQLRCLYKEVL

SEQ ID NO: 7724 - protein, 449 aa, Actinobacillus pleuropneumoniae serovar 6 str. Femo; identical to SEQ ID NO: 7550

SEQ ID NO: 7725 - protein, 435 aa, Escherichia coli NC101
MEKTALIQFITDYIASRRQHKIDAFEKEAAKRVEQGEDASVIAQERQELEARYLPRNWLTDAAKRAGQIKLVTHGAKFSHGDSKASSFYLETSANESYLNTASLANVATDAIGNAAALDVAKLLQTDVNGDSLLASLKRGDYQALSTFAEDKVQLELWVAGFSQAWTTGRPSSHKLAKQIYFPVADGYHLLCPLFSSSLAQAMYEKLTAGRFSEESKAIRDARKAGKWHSQPDIRFPNLAEMHFGGTKPQNISLLNSVRGGRVWLLPSMPPAWGPLDRAPQKMHSIFALRGDFNRAASGIIARMTYLLKVDTNNVHIRTVRAKYIDELIDLLFMQASAFQQEKWQGWSAQSPDLPRHQQLWLDPWRSLSDETFKQEREKNDWQVTVADDFARWLNYRLKKSSFDVGAVEQKEWRSQSLFAQRMREMEAVLQEALK

SEQ ID NO: 7726 - protein, 449 aa, Actinobacillus pleuropneumoniae serovar 1 str. 4074
MITPLQIRAKIIDFLQAQHLKKSENDYKKLEKATEPEEIAKIKAEISKSEEKYRLDTWLHTAATEMAKQLKFGTHIAKGIHPDAKGNNINFRANLNLPATLVGSQLIDKLVLDANGNAAALPLAAFFDIMVDEVHKRTLKDLLLTDEPCLDGCFSDDHSLSVQYKIAFQMALKGNLNSPETHERNKQVLWVNSSSAIEDNHYTCLIPLYPSSFTHAIYNKLNQARFSEENKQARENRYKNKAQNPYISIPHLAATKLGGTKPQNVSLLTSKQGGRNYLLPSLPPIFTKGELRLTNAQDTIFNDRLAYVCRAGLYQLYQAVADSRKNYIVRVPRAEAVNLIVQMVLQQAYKLQKRTAGWSRDYQLAWCEKYWLDPQRAKLNGEEQFHSALTQQDWISEVEQRFAAWLNALLKKRFPKHQDDFTATEYNEWRKYFRKKLHRQLRCLYKEVL

SEQ ID NO: 7727 - protein, 449 aa, Actinobacillus pleuropneumoniae serovar 2 str. S1536; identical to SEQ ID NO: 7723

SEQ ID NO: 7728 - protein, 449 aa, Actinobacillus pleuropneumoniae serovar 4 str. M62
MITPLQIRAKIIDFLQAQHLKKSENDYKKLEKATEPEEIAKIKAEISKSEEKYRLDTWLHTAATEMAKQLKFGTHIAKGIHPDAKGNNINFRANLNLPATLVGSQLIDKLVLDANGNAAALPLAAFFDIMVDEVNKRTLKDLLLTDEPCLDGCFSDDHSLSAQYKIAFQMALKGNLNSPETHERNKQVLWVNSSSAIEDNHYTCLIPLYPSSFTHAIYNKLNQARFSEENKQARENRYKNKAQNPYISIPHLAATKLGGTKPQNVSLLTSKQGGRNYLLPSLPPIFTKGELRLTNAQDTIFNDRLAYVCRAGLYQLYQAVADSRKNYIVRVPRAEAVNLIVQIVLQQAYKLQKRTAGWSRDYQLAWCEKYWLDPQRAKLNGEEQFHSALTQQDWISDVEQRFAAWLNALLKKRFPKHQDDFTATEYNEWRKYFRKKLHRQLRHIYKEVL

SEQ ID NO: 7729 - protein, 449 aa, Actinobacillus pleuropneumoniae serovar 6 str. Femo; identical to SEQ ID NO: 7550

SEQ ID NO: 7730 - protein, 449 aa, Actinobacillus pleuropneumoniae serovar 9 str. CVJ13261; identical to SEQ ID NO: 7726

SEQ ID NO: 7731 - protein, 449 aa, Actinobacillus pleuropneumoniae serovar 10 str. D13039
MITPLQIRAKIIDFLQAQHLKKSENDYKKLEKATEPEEIAKIKAEISKSEAKYRLDTWLHTAATEMAKQLKFGTHIAKGIHPDAKGNNINFRANLNLPATLVGSQLIDKLVLDANGNAAALPLAAFFDIMVDEVNKRTLKDLLLTDEPCLDGCFSDDHSLSVQYKIAFQMALKGNLNSPETHERNKQVLWVNSSSAIEDNHYTCLIPLYPSSFTHAIYNKLNQARFSEENKQARENRYKNKAQNPYISIPHLAATKLGGTKPQNVSLLTSKQGGRNYLLPSLPPIFTKGELRLTNAQDTIFNDRLAYVCRAGLYQLYQAVADSRKNYIVRVPRAEAVNLIVQMVLQQAYKLQKRTAGWSRDYQLAWCEKYWLDPQRAKLNGEEQFHSALTQQDWISEVEQRFAAWLNALLKKRFPKHQDDFTATEYNEWRKYFRKKLHRQLRCLYKEVL

SEQ ID NO: 7732 - protein, 449 aa, Actinobacillus pleuropneumoniae serovar 11 str. 56153; identical to SEQ ID NO: 7726

SEQ ID NO: 7733 - protein, 449 aa, Actinobacillus pleuropneumoniae serovar 12 str. 1096; identical to SEQ ID NO: 7550

SEQ ID NO: 7734 - protein, 449 aa, Actinobacillus pleuropneumoniae serovar 13 str. N273; identical to SEQ ID NO: 7554

SEQ ID NO: 7735 - protein, 435 aa, Escherichia coli MS 145-7
MEKTALIQFITDYIASRRQPKIDAFEKEAAKRLEQGEDASVIALERQELEARYLPRNWLTDAANRIRSIRIISHGAKYSNGDSKAYGRYLEKFVSEGYLNTASLAIIKEDAEGNAAVFDVAKLLLTEINGDSLLASLKRGDYHSLNVFALNDEQLKQWVECFSKAYASEWIKAHKLSKQIYFPVDDGYHLLCPLFSSSLAQAMYEKLTAVRFSEESKVIRDAHKAGKWHSQPDIRFPNLAEMHYGGGNQQNISLLNSARIGRVWLLPSMPPTWATLDRAPQNMRSIFALRGDFNRAASGIIARMTYLLKVDINNVHIRTARAKYIDELIDLLFMQASAFQQEKWQGWSAQSQDLPRHQQLWLDPWRSLSDETFKQEREKNDWQETVADDFARWLNYRLKKSSFDVGAVEQKEWRSQSLFAQRMREMEAVLQEALK

SEQ ID NO: 7736 - protein, 435 aa, Escherichia coli MS 110-3; identical to SEQ ID NO: 7529

SEQ ID NO: 7737 - protein, 85 aa, Actinobacillus ureae ATCC 25976
MITPLQIRAKIIDFLQAQHLKKAENDYKKLEKATEPEEIAKIKAEISKSEEKYQFNTWIHTAAEMARQLKFGTHIAKGIPPRCQR

SEQ ID NO: 7738 - protein, 174 aa, Actinobacillus ureae ATCC 25976
MNLPATLVSSQLIDKLVLDANGNAAALPLAAFFDIMIDEVNKPTLKDLLLTDEPCLDGCFSDDHSLSEQYKIAFQIALKGNLNSPETHERNKQVLWVNSSSAIEDNHYTCLIPLYPSSFTHAIYNKLNQARFSEENKQARENRYKNKAQNPYISIPNYTQFSSHQTRWNKAAER

SEQ ID NO: 7739 - protein, 116 aa, Actinobacillus ureae ATCC 25976
MVLQQAYKLQKRTAGWSRGYQLTWCEKYWLDPQLAKLNGEEQFHSALTQQDWISDVEQRFAAWLNALLKKRFPNIRTILPLQNITNGVNISEKNYIDNYAAYIRRYYELSKLLSAV

SEQ ID NO: 7740 - protein, 435 aa, Escherichia coli H252; identical to SEQ ID NO: 7529

SEQ ID NO: 7741 - protein, 435 aa, Escherichia coli H263; identical to SEQ ID NO: 7529

SEQ ID NO: 7742 - protein, 435 aa, Escherichia coli MS 57-2
MEKTALIQFITEYIASRRQPKIDAFEKEAAKRVEQGEDASVIAQERQELEARYLPRNWLTDAAKRAGQIKLVTHGAKFSHGDSKASSFYLETSANESYLNTASLANVATDAIGNAAALDVAKLLQTDVNGDSLLASLKRGDYQALSTFAEDKVQLELWVAGFSQAWTTGRPSSHKLAKQIYFPVADGYHLLCPLFSSSLAQAMYEKLTAVRFSEESKAIRDARKAGKWHSQPDIWFPNLAEMHFGGTKPQNISLLNSVRGGRVWLLPSMPPTWATLDRAPQNMRSIFSLRGDFNRAASGIVAQMTYLLKVDTNNVHIRTVRAKYIDELIDLLFMQASAFQQEKWQGWSAQSPDLPRHQQLWLDPWRSLSDETFKQEREKNDWQVTVADDFARWLNYRLKKSSFDVGAVEQKEWRSQSLFAQRMREMEAVLQEALK

SEQ ID NO: 7743 - protein, 102 aa, Histoplasma capsulatum H88
MIEAGAKPPITGGSNFEPGTIARKSDASNLNRAHRKVLAGDWSEKTKQLTMTQDKYIDCHLDSVLQNNLHVEDIRNTAPWIGLFNVSIDVGSRVFDLRKKRK

SEQ ID NO: 7744 - protein, 456 aa, Moraxella catarrhalis 46P47B1
MTTNDLAKTAVSRFLQNQIAIKSEKLQKQLTKAQEDGDVTTIGQLQSQIQEIEQRFKKSVWLDLAANRWTQWMTFGTHISKGMHLSARGDNVNFVFNRQLPNTLIGTHSLTDPVLDASGHAAALPLATFFDFDVADGLKIRDLILQNHAGFISSLSDDERMAANYHSAFKKALQNNTDNPSTHELNKQLLWHINADTACQLNELDYINIIPLYPSVLTHGVYLKINQLRYSDDNKKALENRFKSNALHTSYVSMPNLAIVQLGGSKPQNISQLTSRQGGRNYLLPSLPPKISQDREFSLSKFCENFFESKTLKYHIQDDFNYVVQVVKDTRNTIDVRDKRKDAIDRLLHTIFGIAHVLQNKPAGWSKTYALPLAQKIWLDPYRADLDGEAKFADEKTKQEWQKIILQDFASWFNQQLRSTIKELKFDFADAEYNEWQREIEEMQKFYERLGKGVFL

SEQ ID NO: 7745 - protein, 456 aa, Moraxella catarrhalis 7169
MTTNDLAKTAVSRFLQNQIAIKSEKLQKQLTKAQEDGDVTTIGQLQSQIQEIEQRFKKSVWLDLAANRWTQWMTFGTHISKGIHLSARGDNVNFVFNRQLPNTLIGTHSLTDPVLDASGHAAALPLATFFDFDVADGLKIRDLILQNHAGFISSLSDDERMAANYHSAFKKALQNNTDNPSTHELNKQLLWHINADTACQLNELDYINIIPLYPSVLTHGVYLKINQLRYSDDNKKALENRFKSNALHISYVSMPNLAIVQLGGSKPQNISQLTSRQGGRNYLLPSLPPKISQDREFSLSKFCENFFESKTLKYHIQDDFNYVVQVVKDTRNTIDVRDKRKDAIDRLLHTIFGIAHVLQNKPAGWSKTYALPLAQKIWLDPYRADLDGEAKFADEKTKQEWQKIILQDFASWFNQQLRSTVKELKFDFADAEYNEWQREIEEMQKFYERLGKGVFL

SEQ ID NO: 7746 - protein, 456 aa, Moraxella catarrhalis 12P80B1
MTTNDLAKTAVSRFLQNQIAIKSEKLQKQLTKAQEDGDVTTIGQLQSQIQEIEQRFKKSVWLDLAANRWTQWMTFGTHISKGIHLSARGDNVNFVFNRQLPNTLIGTHSLTDPVLDASGHAAALPLATFFDFDVADGLKIRDLILQNHAGFISSLSDDERMAANYHSAFKKALQNNTDNPSTHELNKQLLWHINADTACQLNELDYINIIPLYPSVLTHGVYLKINQLRYSDDNKKALENRFKSNALHTSYVSMPNLAIVQLGGSKPQNISQLTSRQGGRNYLLPSLPPKISQDREFSLSKFCENFFDSKTLKYHIQDDFNYVVQVVKDTRNTIDVRDKRKDAIDRLLHTIFGIAHVLQNKPAGWSKTYALPLAQKIWLDPYRADLDGEAKFADEKTKQEWQKIILQDFASWFNQQLRSTVKELKFDFADAEYNEWQREIEEMQKFYERLGKGVFL

SEQ ID NO: 7747 - protein, 456 aa, Moraxella catarrhalis BC1; identical to SEQ ID NO: 7745

SEQ ID NO: 7748 - protein, 456 aa, Moraxella catarrhalis BC7; identical to SEQ ID NO: 7746

SEQ ID NO: 7749 - protein, 456 aa, Moraxella catarrhalis BC8
MTTNDLAKTAVSRFLQNQIAIKSEKLQKQLTKAQEDGDVTTIGQLQSQIQEIEQRFKKSVWLDLAANRWTQWMTFGTHISKGIHLSARGDNVNFVFNRQLPNTLIGTHSLTDPVLDASGHAAALPLATFFDFDVADGLKIRDLILQNHAGFISSLSDDERMAANYHSAFKKALQNNTDNPSTHELNKQLLWHINADTACQLNELDYINIIPLYPSVLTHGVYLKINQLRYSDDNKKALENRFKSNALHTSYVSMPNLAIVQLGGSKPQNISQLTSRQGGRNYLLPSLPPKISQDREFSLSKFCENFFDSKTLKYHIQDDFNYVVQVVKDTRNTIDVRDKRKDAIDRLLHTIFGIAHVLQNKPAGWSKTYALPLAQKIWLDPYRADLDGEAKFTDEKTKQEWQKIILQDFASWFNQQLRSTVKELKFDFADAEYNEWQREIEEMQKFYERLGKGVFL

SEQ ID NO: 7750 - protein, 457 aa, Moraxella catarrhalis CO72
MLESIQEIDKAIKGFLQTELDIAIDRELKKKTQTQKNNLSEQNLNKKRDGLYDKLKSDYESTCWLAEVFNSIQEMQNHQLSFATHTAKGIHTALKTENVISISNTKLPVGLVGSQSIPHLMIDANSNNPGSHSGYLKYIIGFINVEVNGVRIYELIQSENVVMMEFFKKHQQESGFDYLNKLLLKKPLGEQTDGKNKQLLFYQQDGNYTCLIPLYPTSITHYVYQKISNVKYSEVNLQARKNRRENKDPAPYCDMPNLAVTILGGTNSNNVSRLNNIQGGRNYLLPSLPPKISQDREFSLSKFCENFFESKTLKYHIQDDFNYVVQVVKDTRNTIDVRDKRKDAIDRLLHTIFGIAHVLQNKPAGWSKTYALPLAQKIWLDPYRADLDGEAKFADEKTKQEWQKIILQDFASWFNQQLRSTVKELKFDFADAEYNEWQREIEEMQKFYERLGKGVFL

SEQ ID NO: 7751 - protein, 457 aa, Moraxella catarrhalis 101P30B1; identical to SEQ ID NO: 7750

SEQ ID NO: 7752 - protein, 457 aa, Moraxella catarrhalis O35E
MLESIQEIDKAIKGFLQTELDIAIDRELKKKTQTQKNNLSEQNLNKKRDGLYDKLKSDYESTCWLAEVFNSIQEMQNHQLSFATHTAKGIHTALKTENVISISNTKLPVGLVGSQSIPHLMIDANSNNPGSHSEYLKYIIGFINVEVNGVRIYELIQSENVVMMEFFKKHQQASGFDYLNKLLLKKPLGEQTDGKNKQLLFYQQDGNYTCLIPLYPTSITHYVCQKISNVKYSEVNLQARKNRRENKDPAPYCDMPNLAVTILGGTNSNNVSRLNNIQGGRNYLLPSLPPKISQDREFSLSKFCENFFESKTLKYHIQDDFNYVVQVVKDTRNTIDVRDKRKDAIDRLLHTIFGIAHVLQNKPAGWSKTYALPLAQKIWLDPYRADLDGEAKFADEKTKQEWQKIILQDFASWFNQQLRSTVKELKFDFADAEYNEWQREIEEMQKFYERLGKGVFL

SEQ ID NO: 7753 - protein, 303 aa, Listeria monocytogenes J1816; identical to SEQ ID NO: 7526

SEQ ID NO: 7754 - protein, 435 aa, Escherichia coli D9
MEKTALIQFITDYIASRRQPKIDAFEKEAAKRLEQGEDASVIALERQELEARYLPRNWLTDAANRIRSIRIISHGAKYSNGDSKAYGRYLEKFVSEGYLNTASLAIIKEDAEGNAAVFDVAKLLLTEINGDSLLASLKRGDYHSLNVFALNDEQLKQWVECFSKAYASEWIKAHKLSKQIYFPVDDGYHLLCPLFSSSLAQAMYEKLTAVRFSEESKVIRDAHKAGKWHSQLDIRFPNLAEMHYGGGNQQNISLLNSARIGRVWLLPSMPPTWATLDRAPQNMRSIFALRGDFNRAASGIIARMTYLLKVDINNVHIRTARAKYIDELIDLLFMQASAFQQEKWQGWSAQSQDLPRHQQLWLDPWRSLSDETFKQEREKNDWQETVADDFARWLNYRLKKSSFDVGAVEQKEWRSQSLFAQRMREMEAVLQEALK

SEQ ID NO: 7755 - protein, 303 aa, Listeria monocytogenes str. Scott A; identical to SEQ ID NO: 7526

SEQ ID NO: 7756 - protein, 416 aa, Acinetobacter baumannii 6013150; identical to SEQ ID NO: 7557

SEQ ID NO: 7757 - protein, 416 aa, Acinetobacter baumannii 6013113; identical to SEQ ID NO: 7557

SEQ ID NO: 7758 - protein, 456 aa, Rheinheimera sp. A13L
MQYEGLAAVIADYIDQRRLQKLELIEKELEKALKGVEDDDKKAQINTEFSPQILQMNRQFNTQHWLDDAAKRAKQISLVTHALKFTHGDAKGSSVLSLEYMEDADYLVTASLSNLAVDAVGNAAALDVAKLLQLEFEGQSLARALTGGDFNALAVFSENQTQLKEWVEGFKLALADKALSSHTLAKQLYFPVVDGQYHLLSPVFASSFAHQFNGKITAVRFGDDPKAIREARKAGKFHDKPDIRFIDTAMKSFGGSKPQNISQLNSQRGGKTYLLNCAPPSWQSTLKPPFNEQSIFFGREFNRRVWRDLQELQRYLLSIKGRDSTLEIRRNIAAYVNDLIDGLLNYAAEVQGLSEHAGWSSQNCKLKLAEQLWLDTWCEDLQFQQKRANSNWQQDICLAFAGWLNNKLNNALKNDGLVFGTVQHQHWAKLLSPRLRDYELGTIVFSAGKAQAEAAV

SEQ ID NO: 7759 - protein, 34 aa, Pasteurella multocida subsp. gallicida str. Anand1_poultry
QKRFPHIAKDFDDAEYHEWRRNIRRTLRYRLRHP

SEQ ID NO: 7760 - protein, 94 aa, Pasteurella multocida subsp. multocida str. Anand1_goat
LQKQPAGWSKDYQLEMCEKYWLDPKRAHLPDEEAFRAEYEKGEWVAEVERRFALWLNKCLQKRFPHIAKDFDDAEYHEWRRNIRRTLRYRLRHP

SEQ ID NO: 7761 - protein, 152 aa, Pasteurella multocida subsp. gallicida str. Anand1_poultry
MKLEKIVDVLKLNSQLIKSEKLEKEEKKLQKTEEPTEREKILQKIAKINREYDHANLMSYRASFMAEQIKFGTHHPKGIHSSAKIECNTIYFDLKTPLPNTFCASQNIDNLTLDASGNAAALPLSKFFDIYVDDEKKIQLRDLLLLFGVICC

SEQ ID NO: 7762 - protein, 359 aa, Pasteurella multocida subsp. multocida str. Anand1_goat
TFRKRIDLFLQEQNLKKSESDRKKLAKATDPTEIEQLTQLIQEFDQKYQFDTWIANAANVMAKQLRFGTHIAKGIHPDTKGDNVNFQPSDSLPPEYVGSQSVSHLVLDANGNAAALPLASFFNFIVDEEKQLKLRDLLLVDDPRLAGCFSDDLALSDVYKKQFQQALTGDLTQPETHERNKQVFWANGENPIEEDDYTCLIPLYPSSLTHAFYQKVNNNRYSEQNKQARENRHKKTAEQVPYLSVNQLATVVLGGSKPQNISQLMSAQGGRNYLLPSLPPIMTSSRQFKLSTSQTTIFNDRLAYACRYGLRQLFDVVEARKNGYQVRDSRIDALNNILRTFLFHANLLQKQPAGWSKDY

SEQ ID NO: 7763 - protein, 67 aa, Prevotella pallens ATCC 700821
MHLFSCDEINWRRKVLSGAIKVLYCYSSVFIEYFSFYYKKQYIKWKFISFLLSLQVENWFLPHRNNK

SEQ ID NO: 7764 - protein, 431 aa, Vibrio cholerae HC-02A1
MEGSRVLDPVIAAFFAERKEAWLKKNISAAMSDTEVLEKQQDCEQSFLLDNWLPDAARRICSRALTTHPSKFSHPSTGVGKTNIKDGTFVSPVLFEGNQRNDGFVRSGNVRFDLTDSVGDAGALAAEDFLRVTLSDGMSVLQHIESETKVARELLTVKGLDYEQLRSSFLAIKSTSEETSTNSKIKQVYFPVADQQYHLLSLLTHSGHLFELRQRLDALRFSNEANDARECKKANRFHPVGYQEIFGLTTIGFGGTKPANISVLNNKFAGKAHLLASMPPELTSRDIRLPKTDFFKESFTARQAKEVLEALHRLFLTDYNNINLRDGRDYRIQQYVDLVIEKMWQVRLFLEAYSGELSSALPLEQKIWLYPEFAEQRQQEDEWLDKIIRHIARGLINHYSRSKVITNPVTLADQELLAIEEVVASNKENLR

SEQ ID NO: 7765 - protein, 99 aa, Desulfosporosinus sp. OT
MACPSIVGNLKRLAEGYPQCGTIHSLLGNREFIYNKLLEKFYKLKVYGLSDRVVIESDGAHLLHCFFDPPPFLQNFRSAFLLVFCSGTWGWFLLVTLTV

SEQ ID NO: 7766 - protein, 435 aa, Escherichia coli 3030-1; identical to SEQ ID NO: 7735

SEQ ID NO: 7767 - protein, 208 aa, Erysipelotrichaceae bacterium 2_2_44A
MEIITIMVSALLGAVLTWITSTVLYKKQSTIEMRWTLFQSIRDEMYASKKLIATYFNELGKIAADMREEKEASEHVHIDFTNLSSIHQEYSVLTNKFLAYMKMYEPDTICKIMSHLPFVFKNSARKMKFYFYLETWRTAMYCDLKYLLDVENKLQEILIPYLDKTAAPDIYDEILTVISNVHASDMQTIDLDEIGLYDFMAESFRKIV

SEQ ID NO: 7768 - protein, 184 aa, Aggregatibacter actinomycetemcomitans serotype a str. H5P1
MSANLPVTKGDGIICFLHFRLFFKSQEKIRLTQKQTTIFNRRLAYACREGLNMLYEVVEAEKNIYPERDKRKLALELIAHTVLMQAKYIQNNSPTGWSKDYHLNEYQKYWLDPHRAELDGEDNFRHNIEQNHWTAEIIRQFALWVNACLKWRFKSIQQDFTTPEYNQWCREMEKAIAAQARLSQ

SEQ ID NO: 7769 - protein, 140 aa, Aggregatibacter actinomycetemcomitans serotype a str. H5P1
MITKTTVVKAIQQFLVDQNLKKSGTDRKKLENASLSESEKEALLKKIAEYDEKYRFDVWVENAATVMAKQLYFGTHISRGIHSSSKGDNVNFQSDLTLSDTLVGSQSIPKLELDANGNAAALPLAGFFNIIVDEEKKYDT

SEQ ID NO: 7770 - protein, 448 aa, Aggregatibacter actinomycetemcomitans serotype d str. I63B; identical to SEQ ID NO: 7601

SEQ ID NO: 7771 - protein, 112 aa, Aggregatibacter actinomycetemcomitans serotype e str. SCC393
MALELIAHTVLMQAKYIQNNSPTGWSKDYHLNEYQKYWLDPHRAELDGEDNFRHNIEQNHWTAEIIRQFALWVNACLKWRFKSIQQDFTTPEYNQWCREMEKAIAAQARLSQ

SEQ ID NO: 7772 - protein, 60 aa, Aggregatibacter actinomycetemcomitans serotype e str. SCC393
MLPSLPPIFKSQEKIRLTQKQTTIFNRRLAYACREGLNMLYEVVEAEKIFIRKEINVNWR

SEQ ID NO: 7773 - protein, 172 aa, Aggregatibacter actinomycetemcomitans serotype e str. SCC393
MITKTTVVKAIQQFLVDQNLKKSGTDRKKLENTSLSESEKEALLKKIAEYDEKYRFDVWVENAATVMAKQLYFGTHISRGIHSSSKGDNVNFQSDLTLSDTLVGSQSIPKLELDANGNAAALPLAGFFNIIVDEEKIRHLKNCYLMTILALKAVSLMILNYPSNIRFAFKMH

SEQ ID NO: 7774 - protein, 448 aa, Aggregatibacter actinomycetemcomitans serotype f str. D18P1; identical to SEQ ID NO: 7601

SEQ ID NO: 7775 - protein, 448 aa, Aggregatibacter actinomycetemcomitans D17P-3; identical to SEQ ID NO: 7601

SEQ ID NO: 7776 - protein, 435 aa, Escherichia coli cloneA_i1; identical to SEQ ID NO: 7529

SEQ ID NO: 7777 - protein, 454 aa, Halomonas boliviensis LC1
MADNSRAAEIRSGIKAFLKERFDTKAEKLAPDDPKYQALVEQFQFDTWINDAARRVGQLQVVTHSLKPIHPDAKGSNLYVPPESLNNHYLVGSHVLPADFAGDVVGNAAALDVYKFLKLQFEGKSLLERALENDSEFAKALSDNPEQAQTWINAFAAITEPRGEHASHTRGKQLYWLVGDEALENGAFHLLAPLYATSLAHRVFQTINHDRFSEEAKEARKAKREGKYAEQPVHSYPNLAVQKMGGTKPQNISQLNSERGGNNYLLASLPPSWNVRDIRPPLKVASVFSHPGVFGSRSEVRSLVKDLKRFLEANPSTDMHTRDLRDDYTAMLMDELALFAMQMHSLPAGWSDDEKCELVAEEAFWLDPGRAEEDAAFREARNSVEWSDDIRHRFANWLNATLGGKLPLGDVEFRHWQKTLAKDATHQRLQDRDRRWMESLMEDLHNLPGGDDDE

SEQ ID NO: 7778 - protein, 701 aa, Trichoderma atroviride IMI 206040
MQNLTPSAAADDPSARRACDQCRLRKIRCDKEWPCSNCRTANRTCTSTGAGQRPKEPRQRVLISSQYERKIDQIETRLGSIEGILKNVLSSLATDASKFIHTPATTATDFNIQTTSSNADYDSASEESALGGDSGLTVHTAFASEFLERAVKRAPLRALDPKMESALANLRQLVEMQKKRSISHGPRFPLQQPVPPGGVSKLAMPPQATVAALLRHVKTAPPTFFTILCTLVGIKDFSELCSAVYFPTEDYPDATFAVVNAMLYNLFVEQHSLAKEEAVREEYSKYVIICKTNLETTLANFPLFLSPKIENVQALLLGCLYAIDVSRPSVAWHLITMAAWLCQAGGYHRTESLRNDPPLVARQKKIVFWHVYTLDKGLGLRLGRASVIAECDIDIPREFEVNGFDHLTSTTFPTLWVKISSLQSRIYEQLYSPVALASPQADLVQRAQALAAESSKLEIETDETREKVYTLLKSIGTSEVVDVFIKGDEVQFYVTKTLIYRVIPAPEGSITRFCDECLDAARHAMKTHQECVVFMDISTYMRSMYIHWNLLLTPFAPFFVLFCYVIETSSLADLKVLQDFVDSLEGGRGLSEPIDKLYLLCKVMFDIAKLYVEAKTQQQQDENSIFIGDEFEMYLSQLGFIPNEDQVMANASTNDAGVPAQGSGQVSQLADWFFGSRNMIGLLEEDLSQIDSHRWMQPDEM

SEQ ID NO: 7779 - protein, 388 aa, Anaeroglobus geminatus F0357
MNTLEEYIMKESEAWSKKNKPITWMDNIIENIGKCRVATHVGKFTHSKSKVSIRIFNGFNTNIKYVITESVKCKEDIVYESAAYMAAAKFLDLMLEDGNRVIDHIVNNDMEVQTLVEQYGGNYNILLEKLKMATNLIENSSTESILKQVYFPINERQYHLLTILPNSSVMCELSRRIREMISIRNDARDTKKESDIGQYKEILNRTIIGFGGAQPQNVSVLNSMNVGKYTLLESLPPMIEKRNLRYPKKDFWNETMRYYYVSGIMKELHLNLCNDRNNLTIRNRIKENIHSLIDRVLQMKYKLWSEYPCWIKHDIYGQLPKEQIVWLDLENDMDLNSEMIDTLSKAFSRWLIHTYGRVLKKDSLSLGSEEFRYFAHCMEDVLKKEVMR

SEQ ID NO: 7780 - protein, 425 aa, Hafnia alvei ATCC 51873
MKLDGLSKLIADYIDKKGGIDKNNVFTDIEKICSYRAWLTAKSRSSFNAKRFMRVTHAAKYTHGGSKSSSVYLVAKNFMTSEIYLSSLSLSYPEVDLDGGANFMGIAGLLKLEADGVSLLSAIERGDYSSLQYFAENEQQLAEWVSGFKRIFEPRQPSSHILAKQVYFPVGDGKYHLISPLFPSSLAHAVHQRIVDARFSDATKAANQARKEGEWHETPITYYLNTAVMNVGGTKPQNISYLNSVRGGCVWLLPCSPPQFKPVEKKPVHLKSIFQKRSPFHFVAKDNAYQLQQYLRSKLGCDSTLEIRERRQELVNAIIEQLFSVVAGIQREEWQGWTLDKDCELKPAQQLWLDPYRCRIDDDFKFEREGGDWKKAVADDFALWLNKQLYDQALKLSMAERVKWRTQPLFKKYIREFEWSLAEKL

SEQ ID NO: 7781 - protein, 435 aa, Escherichia coli H397; identical to SEQ ID NO: 7529

SEQ ID NO: 7782 - protein, 435 aa, Escherichia coli SCI-07; identical to SEQ ID NO: 7649

SEQ ID NO: 7783 - protein, 412 aa, Methylomicrobium album BG8
MLDPAIQSFLTERKAAWLKDKLKSAKTEFERQDVETKADEKFAPENWIPDAAKRAAWLSIVSHSGKFTHPGVKISPVISTPPHKRDGYLRSGNADADFDVFGNAAALDVFKFLSLPLSDGQTVLEHLEQNSELIRRQFNLAATSFAELQKGLMAIKPDEIAKIKTSEKIKQVYFPIEGGYHLLSILTPSGLMFKLKERINAMRFSEQAKQARDDRRNQAHNEHGCDEIYNLAAIGFGGTKPQNISVLNNQNGGIAYLLPSLPPVLAQRVVRRPKSSFFKDSLYFKPYREEFLALHRLFMAKPNNIDIRDGRDDWIISIAERVLETVGQLRQETAGWSENTRLPLAQKIWLDSAFDAWREQEDEWLAEIIVSLADWFRIAYRNVIGAEKAIALGDDELKHIRKVLGEHEELLR

SEQ ID NO: 7784 - protein, 369 aa, Pseudomonas aeruginosa PADK2_CF510
MTHTLKPIHPDARGSNLHSLPQAPGQPGLAGSHELGDRLVSDVVGNAAALDVFKFLSLQYQGKNLLNWLTEDSAEAVQALSDNAEQAREWRQAFIGITAVKGAPASHSLAKQLYFPLPGSGYHLLAPLFPTSLVHHVHALLREARFGDAAKAAREARSRQESWPHGFSEYPNLAIQKFGGTKPQNISQLNSERYGENWLLPSLPPHWQRQDQRAPIRHSSVFEHDFGRSPEVSRLTRTLQRLLAKTRHNNFTIRRYRAQLVGQICDEALQYAARLRELEPGWSATPGCQLHDAEQLWLDPLRAQTDETFLQRRLRGDWPAEVGNRFANWLNRAVSSDSQILGSPEAAQWSPELSKELTMFKEILEDERD

SEQ ID NO: 7785 - protein, 456 aa, gamma proteobacterium BDW918
MDGITQQQVNNALETFLTTQYEKKAEADLKSLEKLDSENDIVKISAIQAKLAPLKAKYEFENWMQDAATRMAGQLRFGTHISKGIHPDSKGDNLNFRADGCLPEAVIGSQTLDSLALDANGNAAALPLAAFFETTVDESSGTKLRHLIQAEHPALECAFSAKPELSTEYARRFKSALDNVIEKPATYELNKQLLWPMANAISEDTYVTIVPLYPSALTSQWFSKINDLRFSEENKAGRDSRKKKPAEHLPYISIPEIAFLKLGGTKPQNISQLISKQGGRNYLLPSLPPVIASVKEFRLSQRTQTLFDSKLAYYCRNGFRDLYEVLITDKNVVDVREARKDALDLILAMLFELVEFIQQTYAPGWSKNYELPMTEKYWLDPYRSDLEDETDFAEGRVSSDWPEMIVDKFALWVNERLQKKFTKLASDIGDAEYKEWQQEIEHAIKASLRSGKETFV

SEQ ID NO: 7786 - protein, 433 aa, Cellvibrio sp. BR
MIDPAISKFFEDQKTAWLSENAKKLEGEELAQKQIECDAIFDITEWLTVNAPKAASRAMTTHPSKFSHPDTGVGKTNVKNGTYVSSIMFYGERSEDGLLKTGNVTGCEVDSIGDAGALKIEAFLKIKTDFDGRLLVNHLLDDTQVAKELYECSKLDGEWLKGSLLGGMAKDSGGVIFTNSRIKQVYFPVKESYHQLSVLANSGLVFELRKRLNNMHFGEGVKSKRELKKKAEYSESGYSEIYDITTIVFGGSKPLNISSLNNRYNGTAYLLASVPPHVSIREFRFPKSDFFNESLNYRQFKELFEDLHKVMKIELGGNITRQKLLTARDNRIKALVLKIMDSVYLMRESSASQYKESSGLPVAQVIWLCAEKADERDSSDAWLDEIIHDCTRWLNYTYAKLLGDKQILLGNEEFNEIKKLIEHRVSENREFLR

SEQ ID NO: 7787 - protein, 435 aa, Escherichia coli KD1
MEKTALIQFITDYIASRRQPKIDAFEKEAAKRLEQGEDASVIALERQELEARYLPRNWLTDAAKRAGQIKLVTHGAKFSHGDSKASSFYLETSANESYLNTASLANVATDAIGNAAALDVAKLLQTDVNGDSLLASLKRGDYQALSTFAEDKVQLELWVAGFSQAWTTGRPSSHKLAKQIYFPVADGYHLLCPLFSSSLAQAMYEKLTAVRFSEESKAIRDARKAGKWHSQPDIWFPNLAEMHFGGTKPQNISLLNSVRGGRVWLLPSMPPTWATLDRAPQNMRSIFSLRGDFNRAASGIVAQMTYLLKVDINNVHIRTVRAKYIDELIDLLFMQASAFQQEKWQGWSAQSPDLPRHQQLWLDPWRSLSDETFKQEREKNDWQVTVADDFARWLNYRLKKSSFDVGAVEQKEWRSQSLFAQRMREMEAVLQEALK

SEQ ID NO: 7788 - protein, 435 aa, Escherichia coli HM605; identical to SEQ ID NO: 7529

SEQ ID NO: 7789 - protein, 206 aa, Rhodanobacter sp. 115
MNSVRHGNNYLLSSLPPPAWKPRGGVNLLKIDSVFDEKRGALNGFGGMRELLRTLADFLKQSPDPTMETRTRRETIEQAVGAELAMFGVAIHGNYAAGWTRDDTCSLPLCEQLWLDPDRTELPERHDPQHPHWQELDREFNDAYERGDWADEVAGRFGRWVNQQLRNRSDKLIALGEAEMRHFARQAILDVAWPIPLQRRAKAGVA

SEQ ID NO: 7790 - protein, 448 aa, Yersinia pestis PY-01; identical to SEQ ID NO: 51

SEQ ID NO: 7791 - protein, 448 aa, Yersinia pestis PY-02; identical to SEQ ID NO: 51

SEQ ID NO: 7792 - protein, 448 aa, Yersinia pestis PY-03; identical to SEQ ID NO: 51

SEQ ID NO: 7793 - protein, 448 aa, Yersinia pestis PY-04; identical to SEQ ID NO: 51

SEQ ID NO: 7794 - protein, 448 aa, Yersinia pestis PY-05; identical to SEQ ID NO: 51

SEQ ID NO: 7795 - protein, 448 aa, Yersinia pestis PY-06; identical to SEQ ID NO: 51

SEQ ID NO: 7796 - protein, 448 aa, Yersinia pestis PY-07; identical to SEQ ID NO: 51

SEQ ID NO: 7797 - protein, 448 aa, Yersinia pestis PY-08; identical to SEQ ID NO: 51

SEQ ID NO: 7798 - protein, 448 aa, Yersinia pestis PY-09; identical to SEQ ID NO: 51

SEQ ID NO: 7799 - protein, 448 aa, Yersinia pestis PY-10; identical to SEQ ID NO: 51

SEQ ID NO: 7800 - protein, 448 aa, Yersinia pestis PY-11; identical to SEQ ID NO: 51

SEQ ID NO: 7801 - protein, 448 aa, Yersinia pestis PY-12; identical to SEQ ID NO: 51

SEQ ID NO: 7802 - protein, 448 aa, Yersinia pestis PY-13; identical to SEQ ID NO: 51

SEQ ID NO: 7803 - protein, 448 aa, Yersinia pestis PY-15; identical to SEQ ID NO: 51

SEQ ID NO: 7804 - protein, 448 aa, Yersinia pestis PY-14; identical to SEQ ID NO: 51

SEQ ID NO: 7805 - protein, 448 aa, Yersinia pestis PY-16; identical to SEQ ID NO: 51

SEQ ID NO: 7806 - protein, 448 aa, Yersinia pestis PY-19; identical to SEQ ID NO: 51

SEQ ID NO: 7807 - protein, 448 aa, Yersinia pestis PY-25; identical to SEQ ID NO: 51

SEQ ID NO: 7808 - protein, 448 aa, Yersinia pestis PY-29; identical to SEQ ID NO: 51

SEQ ID NO: 7809 - protein, 448 aa, Yersinia pestis PY-34; identical to SEQ ID NO: 51

SEQ ID NO: 7810 - protein, 448 aa, Yersinia pestis PY-32; identical to SEQ ID NO: 51

SEQ ID NO: 7811 - protein, 448 aa, Yersinia pestis PY-36; identical to SEQ ID NO: 51

SEQ ID NO: 7812 - protein, 448 aa, Yersinia pestis PY-42; identical to SEQ ID NO: 51

SEQ ID NO: 7813 - protein, 448 aa, Yersinia pestis PY-45; identical to SEQ ID NO: 51

SEQ ID NO: 7814 - protein, 448 aa, Yersinia pestis PY-46; identical to SEQ ID NO: 51

SEQ ID NO: 7815 - protein, 448 aa, Yersinia pestis PY-47; identical to SEQ ID NO: 51

SEQ ID NO: 7816 - protein, 448 aa, Yersinia pestis PY-48; identical to SEQ ID NO: 51

SEQ ID NO: 7817 - protein, 448 aa, Yersinia pestis PY-52; identical to SEQ ID NO: 51

SEQ ID NO: 7818 - protein, 448 aa, Yersinia pestis PY-53; identical to SEQ ID NO: 51

SEQ ID NO: 7819 - protein, 387 aa, Yersinia pestis PY-54
MRNWLTDAANRAGQIKLATHAPKYTHSDSKSSGILNIELQSKKKDYFSSVDLAEQASDVIGNAAVFDLVKLLQSECEGGSLIKCLEQGDNSVLKLFSNDDELVEEWTTKFKSILNNEKFTSHKLAKQFYFPVGPDQYHLLSPLFSSSLAQAMHQRIIEARFSDQSKEAKAAHKAGRWHPTVRVLYLDTAVQHIGGTKPQNISYLNSVRGGKVWLLPCGAPSWKNIQKPPIKYRSIFHDRSEFTVLARNNLWQMQLYLLGVKPLSNTMDIRAARLACCDEIIDILFNYVAEIQNLDGTNGWSDAEDCKLKRSEQLWLDPTRAMDDPVFKLEREKEDWKQEVSQDFGYWLNRWLQHDELVFGYVEQREWSSLFKQRLREFEQGSLETSS

SEQ ID NO: 7820 - protein, 448 aa, Yersinia pestis PY-55; identical to SEQ ID NO: 51

SEQ ID NO: 7821 - protein, 448 aa, Yersinia pestis PY-56; identical to SEQ ID NO: 51

SEQ ID NO: 7822 - protein, 448 aa, Yersinia pestis PY-58; identical to SEQ ID NO: 51

SEQ ID NO: 7823 - protein, 448 aa, Yersinia pestis PY-60; identical to SEQ ID NO: 51

SEQ ID NO: 7824 - protein, 448 aa, Yersinia pestis PY-59; identical to SEQ ID NO: 51

SEQ ID NO: 7825 - protein, 448 aa, Yersinia pestis PY-61; identical to SEQ ID NO: 51

SEQ ID NO: 7826 - protein, 448 aa, Yersinia pestis PY-63; identical to SEQ ID NO: 51

SEQ ID NO: 7827 - protein, 387 aa, Yersinia pestis PY-64; identical to SEQ ID NO: 7819

SEQ ID NO: 7828 - protein, 448 aa, Yersinia pestis PY-65; identical to SEQ ID NO: 51

SEQ ID NO: 7829 - protein, 448 aa, Yersinia pestis PY-66; identical to SEQ ID NO: 51

SEQ ID NO: 7830 - protein, 448 aa, Yersinia pestis PY-71; identical to SEQ ID NO: 51

SEQ ID NO: 7831 - protein, 448 aa, Yersinia pestis PY-72; identical to SEQ ID NO: 51

SEQ ID NO: 7832 - protein, 448 aa, Yersinia pestis PY-76; identical to SEQ ID NO: 51

SEQ ID NO: 7833 - protein, 448 aa, Yersinia pestis PY-88; identical to SEQ ID NO: 51

SEQ ID NO: 7834 - protein, 448 aa, Yersinia pestis PY-89; identical to SEQ ID NO: 51

SEQ ID NO: 7835 - protein, 448 aa, Yersinia pestis PY-90; identical to SEQ ID NO: 51

SEQ ID NO: 7836 - protein, 448 aa, Yersinia pestis PY-91; identical to SEQ ID NO: 51

SEQ ID NO: 7837 - protein, 448 aa, Yersinia pestis PY-93; identical to SEQ ID NO: 51

SEQ ID NO: 7838 - protein, 448 aa, Yersinia pestis PY-92; identical to SEQ ID NO: 51

SEQ ID NO: 7839 - protein, 448 aa, Yersinia pestis PY-94; identical to SEQ ID NO: 51

SEQ ID NO: 7840 - protein, 448 aa, Yersinia pestis PY-95; identical to SEQ ID NO: 51

SEQ ID NO: 7841 - protein, 448 aa, Yersinia pestis PY-96; identical to SEQ ID NO: 51

SEQ ID NO: 7842 - protein, 448 aa, Yersinia pestis PY-98; identical to SEQ ID NO: 51

SEQ ID NO: 7843 - protein, 448 aa, Yersinia pestis PY-99; identical to SEQ ID NO: 51

SEQ ID NO: 7844 - protein, 448 aa, Yersinia pestis PY-100; identical to SEQ ID NO: 51

SEQ ID NO: 7845 - protein, 448 aa, Yersinia pestis PY-101; identical to SEQ ID NO: 51

SEQ ID NO: 7846 - protein, 448 aa, Yersinia pestis PY-102; identical to SEQ ID NO: 51

SEQ ID NO: 7847 - protein, 448 aa, Yersinia pestis PY-103; identical to SEQ ID NO: 51

SEQ ID NO: 7848 - protein, 448 aa, Yersinia pestis PY-113; identical to SEQ ID NO: 51

SEQ ID NO: 7849 - protein, 416 aa, Acinetobacter baumannii OIFC143; identical to SEQ ID NO: 7679

SEQ ID NO: 7850 - protein, 456 aa, Alishewanella aestuarii B11
MQTKGLAAVIADYIDQRRLQKLEPIEKALEKALKGVDDAVKQAQINTEFSPQILQINQQFDVRHWLDDAAKRAKQISLVTHALKFTHGDAKGSSVLSLEYMEDADYLVTASLANLAIDAVGNAAALDVAKLLQLEFEGRSLAQTLTDGDFSALAVFSEDQMQLTEWVEGFKLALADKALSSHTLAKQLYFPIADGQYHLLSPVFASSLAHQFNSKITAVRYGDEPKAIREARRAGKYHDKPDIRFLDTAIQSFGGSKPQNISQLNSQRGGKTNLLNCAPPSWQSTLKPPLNEQSIFNSREFNRRVWRDLQELQRYLLSVKGRDSTLEIRRNIAAYVNDLIDGLLNYAAEVQGLSEYAGWSFQNCELKLAEQLWLDVWCEDLLFQQKRANNNWQQDICLAFAGWLNSKLNKALKNDGLVFGTVQYQHWAKLLSPRLRDYELGTMVFSAAKAQAEAAV

SEQ ID NO: 7851 - protein, 416 aa, Acinetobacter baumannii Canada BC-5; identical to SEQ ID NO: 7557

SEQ ID NO: 7852 - protein, 416 aa, Acinetobacter baumannii Naval-18; identical to SEQ ID NO: 7679

SEQ ID NO: 7853 - protein, 89 aa, Pasteurella multocida subsp. multocida str. Anand1_buffalo
NPQGVGQLASIQGGRNYLLSSLPPIMPSSRYFRLSPLQTTIFNDRLAYACRYGLRQLFEVVEARKNGYQVRDSRIDALNNILRTFLFLR

SEQ ID NO: 7854 - protein, 346 aa, Pasteurella multocida subsp. multocida str. P52VAC
MKLERIVDVLKLNSQLIKSEKLEKEEKKLQKTEEPTEREKILQKIAKINREYDHANLMSYRAGFMADQIKFGTHHPKGIHSSAKIECNTIYFDLKTPLPNTFCASQNIDNLTLDASGNAAALPLSKFFDIYVDDEKKIQLRDLLLQDHPVLDYCFAEDPELSVHYKKQFQKTLKSDFDNPISYEKCKQLLWVNSNSSVEDDDYTCLVPLYPSSLIYNFYQKVQFIKYNSDENKLNRENRKKSNVVQKPYKNLVDLAVFKVGGSNPQGVGQLASIQGGRNYLLSSLPPIMPSSRYFRLSPLQTTIFNDRLAYACRYGLRQLFEVVEARKNGYQVRDSRIDALNNILR

SEQ ID NO: 7855 - protein, 94 aa, Pasteurella multocida subsp. multocida str. P52VAC
LQKQPAGWSKDSQLEMCEKYWLDPKRVHLPDEEAFRAEYEKGEWVAEVERRFALWLNKCLQKRFPHIAKDFDDAEYHEWRRNIRRTLRYRLRHP

SEQ ID NO: 7856 - protein, 69 aa, Pasteurella multocida subsp. multocida str. Anand1_buffalo
RVHLPDEEAFRAEYEKGEWVAEVERRFALWLNKCLQKRFPHIAKDFDDAEYHEWRRNIRRTLRYRLRHP

SEQ ID NO: 7857 - protein, 94 aa, Pasteurella multocida subsp. multocida str. Anand1_cattle; identical to SEQ ID NO: 7855

SEQ ID NO: 7858 - protein, 444 aa, Pectobacterium wasabiae CFBP 3304
MEDNRLTKFIVSYIEERRQDKLDEHDKKVKTARTELSSDALADAELTLAEKRREIERKYEVRNWLTDAASRAGQISLVTHALKFTHSDARGSSIFSANTVADAKTLSTATLVQPAIDAVGNAAALDVAKLLQTEYEGDSLVAALQRGDHRALEALAESPEQLAQWLAGFQQVFTDRQPSSHKLSKQIYFPLANGEYHLLSPLYSSSLAQALYQRITAVRFGDEAKAIRRAQKVSQWHDQLSISYPNLAVQNMGGTKPQNISALNSSRSGRSYLLSSAPPQWNHIEKPPQQHESIFRPRGEVDYHTRATLAQMQRFLLSVKDVENNRDIRQQRLRYLDQLIDQLFFYVASVQNLPVGWSAESELKRAQQLWLDPYRADTDTVFRREREAGDWQQAVAYDFGRWLNRRLKHENLIFGEVERREWSTAALFKRRMREVESALKEELA

SEQ ID NO: 7859 - protein, 444 aa, Pasteurella multocida subsp. gallicida X73
MSYTFRKRIDLFLQEQNLKKSESDRKKLAKATDPTEIEQLTQLIQEFDQKYQFDTWIANAANVMAKQLKFGTHIAKGIHPDTKGDNVNFQPSDSLPPEYVGSQSVSHLVLDANGNAAALPLASFFNFIVDEEKQVKLRDLLLVDDPRLAGCFSDDLALSDVYKKQFQQALTGDLTQPETHERNKQVFWANGENPIEDDDYTCLIPLYPSSLTHAFYQKVNNNRYSEQNKQARENRQKKTAEQVPYLSVNQLAAVVLGGSKPQNISLLMSAQGGRNYLLPSLPPIMTSSRQFKLSTSQTTIFNDRLAYACRYGLRQLFEVVEARKNVYQVRDSRIDALNNILRTFLFHANLLQKQPAGWSKDSQLEMCEKYWLDPKRVHLPDEEAFRAEYEKGEWVAEVERRFALWLNKRLQKRFPHIAKDFDDVEYHEWRRNIRRTLRYRLRHP

SEQ ID NO: 7860 - protein, 401 aa, Pasteurella multocida subsp. gallicida P1059
MSPEQVKNIIANALEDIPSSKKEVIDEKYIFNWIKNELLPKVTKSNFSTHISKGIHPSSYGEGVTFKPEMSLPVGYVGSQSVAKLDLDLSGNAKNLPVAEFFAIQIDDSHTLKDLILDNSPSLVGVFAVNSKESEEYRAIFSKVLQGTQLRGVTDQRNKQLLWCNNQDSIINDDYTCLIPLHPVSLLKETHHKIVSRRRAPDISIPSLARVAFGGKHPKNISFFTRNQAGVNYLLPSFPPISHHSSDFKLKLSDRTIFNKRLAYVCRFGFRKLFESTEIRNRNFHRKTKMFDAVNTILQIVLSHVVFLQEQNVGWSKAYSLAWEEKYWLDPKRAELEGETDFKEGYELGEWREIIEHKFTLWIRYFLQKYFPSLNEDFKDTDYQELRTKVTQLLRYRLRQV

SEQ ID NO: 7861 - protein, 108 aa, Corynebacterium otitidis ATCC 51513
MKPSIFVRLTFSVEGVGSATHAAHLEELDDDTCRLRRIVEIAPGEKVAGAFDGTSAPGMTAPPTSVVPHPRHYGDYPDIAVDALGRREFEELWAAAVEKFPVLDADSE

SEQ ID NO: 7862 - protein, 434 aa, Pseudomonas aeruginosa CI27; identical to SEQ ID NO: 7533

SEQ ID NO: 7863 - protein, 433 aa, Pseudomonas aeruginosa E2
MSERPNGDSPTLRQLIESFIQERLQGKLDKLKPDEDVKRQSLLAGHRREAWLADAARRVGQLQLVTHTLKPIHPDARGSNLHSLPQAPGQPGLAGSHELGDKLVSDVVGNAAALDVFKFLSLQYQGKNLLNWLTEDSAEALQALSDNAEQAREWRQAFIGITTVKGAPASHSLAKQLYFPLPGSGYHLLAPLFPTSLVHHVHALLREARFGEAARAAREARNRRESWPHGFSEYPNLAIQKLGGTKPQNISQLNNERRGENWLLPSLPPNWQRQDVNAPMRHSSVFEHDFGRTPEVSRLTRTLQRFLAKTVHNNLAIRQRRAQLVAQICDEALQYAARLRELEPSWSAAPECRLHETEQLWLDPLRAQTDETFLQRRLRGDWPAEVGNRFANWLNRAVSSDSQILGSPEAAQWSQELSKELTMFKEILEDERD

SEQ ID NO: 7864 - protein, 416 aa, Acinetobacter baumannii IS-58; identical to SEQ ID NO: 7557

SEQ ID NO: 7865 - protein, 456 aa, Moraxella catarrhalis RH4; identical to SEQ ID NO: 7746

SEQ ID NO: 7866 - protein, 426 aa, Vibrio cholerae HC-50A1
MLDPVIAAFFAERKEAWLKKNISAAMSDTEVLEKQQDCEQSFLLDNWLPDAARRICSRALTTHPSKFSHPSTGVGKTNIKDGTFVSPVLFEGNQRNDGFVRSGNVRFDLTDSVGDAGALAAEDFLRVTLSDGMSVLQHIESETKVARELLTVKGLDYEQLRSSFLAIKSTSEETSTNSKIKQVYFPVADQQYHLLSLLTHSGHLFELRQRLDALRFSNEANDARECKKANRFHPVGYQEIFGLTTIGFGGTKPANISVLNNKFAGKAHLLASMPPELTSRDIRLPKTDFFKESFTARQAKEVLEALHRLFLTDYNNINLRDGRDYRIQQYVDLVIEKMWQVRLFLEAYSGELSSALPLEQKIWLYPEFAEQRQQEDEWLDKIIRHIARGLINHYSRSKVITNPVTLADQELLAIEEVVASNKENLR

SEQ ID NO: 7867 - protein, 431 aa, Vibrio cholerae HC-52A1; identical to SEQ ID NO: 7764

SEQ ID NO: 7868 - protein, 426 aa, Vibrio cholerae HC-56A1; identical to SEQ ID NO: 7866

SEQ ID NO: 7869 - protein, 431 aa, Vibrio cholerae HC-55A1; identical to SEQ ID NO: 7764

SEQ ID NO: 7870 - protein, 426 aa, Vibrio cholerae HC-57A1; identical to SEQ ID NO: 7866

SEQ ID NO: 7871 - protein, 426 aa, Vibrio cholerae HC-51A1; identical to SEQ ID NO: 7866

SEQ ID NO: 7872 - protein, 416 aa, Acinetobacter baumannii IS-235; identical to SEQ ID NO: 7557

SEQ ID NO: 7873 - protein, 416 aa, Acinetobacter baumannii IS-251; identical to SEQ ID NO: 7557

SEQ ID NO: 7874 - protein, 168 aa, Vibrio cholerae HC-1A2
MNNKFAGKAHLLASMPPELTSRDIRLPKTDFFKESFTARQAKEVLEALHRLFLTDYNNINLRDGRDYRIQQYVDLVIEKMWQVRLFLEAYSGELSSALPLEQKIWLYPEFAEQRQQEDEWLDKIIRHIARGLINHYSRSKVITNPVTLADQELLAIEEVVASNKENLR

SEQ ID NO: 7875 - protein, 431 aa, Vibrio cholerae HC-55C2; identical to SEQ ID NO: 7764

SEQ ID NO: 7876 - protein, 431 aa, Vibrio cholerae HC-60A1; identical to SEQ ID NO: 7764

SEQ ID NO: 7877 - protein, 426 aa, Vibrio cholerae HC-59A1; identical to SEQ ID NO: 7866

SEQ ID NO: 7878 - protein, 154 aa, Vibrio cholerae HC-61A2
MPPELTSRDIRLPKTDFFKESFTARQAKEVLEALHRLFLTDYNNINLRDGRDYRIQQYVDLVIEKMWQVRLFLEAYSGELSSALPLEQKIWLYPEFAEQRQQEDEWLDKIIRHIARGLINHYSRSKVITNPVTLADQELLAIEEVVASNKENLR

SEQ ID NO: 7879 - protein, 416 aa, Acinetobacter baumannii OIFC074; identical to SEQ ID NO: 7557

SEQ ID NO: 7880 - protein, 416 aa, Acinetobacter baumannii Naval-83; identical to SEQ ID NO: 7557

SEQ ID NO: 7881 - protein, 426 aa, Vibrio cholerae HC-02C1; identical to SEQ ID NO: 7866

SEQ ID NO: 7882 - protein, 426 aa, Vibrio cholerae HC-55B2; identical to SEQ ID NO: 7866

SEQ ID NO: 7883 - protein, 431 aa, Vibrio cholerae HC-59B1; identical to SEQ ID NO: 7764

SEQ ID NO: 7884 - protein, 416 aa, Acinetobacter baumannii Naval-21; identical to SEQ ID NO: 7557

SEQ ID NO: 7885 - protein, 416 aa, Acinetobacter baumannii Canada BC1; identical to SEQ ID NO: 7557

SEQ ID NO: 7886 - protein, 448 aa, Yersinia pestis INS; identical to SEQ ID NO: 51

SEQ ID NO: 7887 - protein, 423 aa, Providencia burhodogranariea DSM 19968
MLDPAIEDFFAERKDGWLKKNLKASMSDAEISEKQQECENTFALAQWIPNAAKRAGQISLSTHPCTFSHPSARKNKNGSVSATIANAKQANDGFLRSGNVAAEPDALGNAAALDVYKFLTLEMQDKQTLLEHINAETELAKTLLTISNEPYQTLRDGFLEMAAVDDTVVTSSKIKQVYFPIFYDDEDYHLLSLLTPSGLLFEMRRRIDVIRFSEQTKALRELRRKGEYSEVGYQEIYDITSIGFGGTKPQNISVLNNQNAGRAYLLPSLPPVINIREMRLPKTNFFADTQNPWHAKETFKAFHGLISLPKDKRGSRFIEYRDNLIQEYVDYILVMMWKVRRAFELENSVLPTGLSKYQQTWLFPNEQTQRDNMDDWLLVLIPEIARCFIEGYKKINGNKALSLGNDEFSAIADVVAINKELLR

SEQ ID NO: 7888 - protein, 448 aa, Aggregatibacter actinomycetemcomitans Y4; identical to SEQ ID NO: 7601

SEQ ID NO: 7889 - protein, 435 aa, Escherichia coli KTE4; identical to SEQ ID NO: 7529

SEQ ID NO: 7890 - protein, 435 aa, Escherichia coli KTE5; identical to SEQ ID NO: 7529

SEQ ID NO: 7891 - protein, 435 aa, Escherichia sp. KTE11
MEKTALIQFITDYIASRRQPKIEAFEKEAAKRLEQGDDASVIALERQELEARYLPRNWLTDAAKRVRSIRIISHGAKYSNGDSKAYGRYLEKFVSEGYLNTASLAIIKEDAEGNAAVFDVAKLLLTEVNGDSLLASLKRGDYQSLNAFALDDEQLKQWVECFSEAYASEWIKAHKLSKQIYFPVDDGYHLLCPLFSSSLAQVMYEKLTAVRFSEESKAIRDAHKAGKWHSQPDIRFPNLAEMHYGGGNQQNISLLNSARVGRVWLLPSMPPTWATLDRAPQNMRSIFSLRGDFNRAASGIIARMTYLLKVDINNVHIRTARAKYIDELIDLLFMQASSFQQEKWQGWSVQSPDLPRHQQLWLDPWRSLSDEAFKQEREKNDWQETIADDFARWLNYRLKKARFDVGAVEQREWRSQSLFTQRMREMEAVLQEALK

SEQ ID NO: 7892 - protein, 435 aa, Escherichia coli KTE16
MEKTALIQFITDYIASRRQHKIDAFEKEAAKRVGQGEDASVIAQERQELEARYLPRNWLTDAAKRAGQIKLVTHGAKFSHGDSKASSFYLETSANESYLNTASLANVATDAIGNAAALDVAKLLQTDVNGDSLLASLKRGDYQALSTFAEDKVQLELWVAGFSQAWTTGRPSSHKLAKQIYFPVADGYHLLCPLFSSSLAQAMYEKLTAGRFSEESKAIRDARKAGKWHSQPDIRFPNLAEMHFGGTKPQNISLLNSVRGGRVWLLPSMPPAWGPLDRAPQKMHSIFALRGDFNRAASGIIARMTYLLKVDTNNVHIRTVRAKYIDELIDLLFMQASAFQQEKWQGWSAQSPDLPRHQQLWLDPWRSLSDETFKQEREKNDWQVTVADDFARWLNYRLKKSSFDVGAVEQKEWRSQSLFAQRMREMEAVLQEALK

SEQ ID NO: 7893 - protein, 435 aa, Escherichia coli KTE15; identical to SEQ ID NO: 7725

SEQ ID NO: 7894 - protein, 435 aa, Escherichia coli KTE224
MEKTALIQFITDYIASRRQHKIDAFEKEAAKRVGQGEDASVIAQERQELEARYLPRNWLTDAAKRAGQIKLVTHGAKFSHGDSKASSFYLETSANESYLNTASLANVATDAIGNAAALDVAKLLQTDVNGDSLLASLKRGDYQALSTFAEDKVQLELWVAGFSQAWTTGRPSSHKLAKQIYFPVADGYHLLCPLFSSSLAQAMYEKLTAGRFSEESKAIRDARKAGKWHSQPDIRFPNLAEMHFGGTKPQNISLLNSVRGGRVWLLPSMPPAWGPLDRAPQKIHSIFALRGDFNRAASGIIARMTYLLKVDTNNVHIRTVRAKYIDELIDLLFMQASAFQQEKWQGWSAQSPDLPRHQQLWLDPWRSLSDETFKQEREKNDWQVTVADDFARWLNYRLKKSSFDVGAVEQKEWRSQSLFAQRMREMEAVLQEALK

SEQ ID NO: 7895 - protein, 435 aa, Escherichia coli KTE47
MEKTALIQFITEYIASRRQPKIDAFEKEAAKRVEQGEDASVIAQERQELEARYLPRNWLTDAAKRAGQIKLVTHGAKFSHGDSKASSFYLETSANESYLNTASLANVATDAIGNAAALDVAKLLQTDVNGDSLLASLKRGDYQALSTFAEDKVQLELWVAGFSQAWTTGRPSSHKLAKQIYFPVADGYHLLCPLFSSSLAQAMYEKLTAVRFSEESKAIRDARKAGKWHSQPDIWFPNLAEMHFGGTKPQNISLLNSVRGGRVWLLPSMPPTRATLDRAPQNMRSIFSLRGDFNRAASGIVAQMTYLLKVDINNVHIRTARAKYIDELIDLLFMQASAFQQEKWQGWSAQSPDLPRHQQLWLDPWRSLSDETFKQEREKNDWQVTVADDFARWLNYRLKKSSFDVGAVEQKEWRSQSLFAQRMREMEAVLQEALK

SEQ ID NO: 7896 - protein, 435 aa, Escherichia coli KTE55; identical to SEQ ID NO: 7529

SEQ ID NO: 7897 - protein, 435 aa, Escherichia coli KTE58; identical to SEQ ID NO: 7529

SEQ ID NO: 7898 - protein, 435 aa, Escherichia coli KTE58; identical to SEQ ID NO: 7529

SEQ ID NO: 7899 - protein, 435 aa, Escherichia coli KTE72; identical to SEQ ID NO: 7725

SEQ ID NO: 7900 - protein, 435 aa, Escherichia coli KTE86; identical to SEQ ID NO: 7725

SEQ ID NO: 7901 - protein, 435 aa, Escherichia coli KTE93; identical to SEQ ID NO: 7725

SEQ ID NO: 7902 - protein, 435 aa, Escherichia coli KTE169; identical to SEQ ID NO: 7894

SEQ ID NO: 7903 - protein, 435 aa, Escherichia coli KTE45; identical to SEQ ID NO: 7742

SEQ ID NO: 7904 - protein, 435 aa, Escherichia coli KTE43; identical to SEQ ID NO: 7894

SEQ ID NO: 7905 - protein, 435 aa, Escherichia coli KTE22; identical to SEQ ID NO: 7529

SEQ ID NO: 7906 - protein, 435 aa, Escherichia coli KTE46; identical to SEQ ID NO: 7742

SEQ ID NO: 7907 - protein, 435 aa, Escherichia coli KTE59; identical to SEQ ID NO: 7529

SEQ ID NO: 7908 - protein, 435 aa, Escherichia coli KTE65; identical to SEQ ID NO: 7529

SEQ ID NO: 7909 - protein, 435 aa, Escherichia coli KTE118; identical to SEQ ID NO: 7529

SEQ ID NO: 7910 - protein, 435 aa, Escherichia coli KTE123; identical to SEQ ID NO: 7529

SEQ ID NO: 7911 - protein, 435 aa, Escherichia coli KTE194; identical to SEQ ID NO: 7725

SEQ ID NO: 7912 - protein, 435 aa, Escherichia coli KTE183; identical to SEQ ID NO: 7725

SEQ ID NO: 7913 - protein, 435 aa, Escherichia coli KTE207; identical to SEQ ID NO: 7725

SEQ ID NO: 7914 - protein, 435 aa, Escherichia coli KTE215; identical to SEQ ID NO: 7725

SEQ ID NO: 7915 - protein, 435 aa, Escherichia coli KTE227; identical to SEQ ID NO: 7529

SEQ ID NO: 7916 - protein, 435 aa, Escherichia coli KTE229; identical to SEQ ID NO: 7529

SEQ ID NO: 7917 - protein, 435 aa, Escherichia coli KTE113; identical to SEQ ID NO: 7725

SEQ ID NO: 7918 - protein, 435 aa, Escherichia coli KTE133; identical to SEQ ID NO: 7725

SEQ ID NO: 7919 - protein, 435 aa, Escherichia coli KTE145; identical to SEQ ID NO: 7725

SEQ ID NO: 7920 - protein, 435 aa, Escherichia coli KTE168; identical to SEQ ID NO: 7894

SEQ ID NO: 7921 - protein, 435 aa, Escherichia coli KTE176; identical to SEQ ID NO: 7529

SEQ ID NO: 7922 - protein, 435 aa, Escherichia coli KTE179; identical to SEQ ID NO: 7529

SEQ ID NO: 7923 - protein, 435 aa, Escherichia coli KTE180; identical to SEQ ID NO: 7529

SEQ ID NO: 7924 - protein, 435 aa, Escherichia coli KTE88; identical to SEQ ID NO: 7725

SEQ ID NO: 7925 - protein, 426 aa, Vibrio cholerae HC-78A1; identical to SEQ ID NO: 7866

SEQ ID NO: 7926 - protein, 460 aa, Halomonas titanicae BH1
MPTIPSGSWQQLRALIEVFLKERFDTKAEKLAPDDPKYQALVEQFQFDTWVNDAARRVGQLQVVTHSLKPIHPDAKGSNLYAPPESLHAHNLVGSHVLPADFAGDVVGNAAALDVYKFLKLQFEGKSLLEHALENDSEFAKALSDNPEQAQAWINAFAAITEPRGEHASHTRGKQLYWLVGDDAAELENDADNFRLLAPLYATSLAHRVFQTINHDRFSEEAKDSRKAKREGKYAEQPVHSYPNLAVQKMGGTKPQNISQLNSERGGNNYLLASLPPSWNVSDIRPPLKVASVFSHPGVFGSRSEVRSLVKDFKRFLETDPSTDMHTRDLRDDYTAMLMDELALFAMQMHSLPAGWSDDEKCELVAEEAFWLDPGRAEEDVPFREARNSVEWAEEIRHRFANWLNAALGEKLPLGDVEFRHWQKTLAKDATHQRLQDRDRRWMESLMEDLHNLPGGDDDE

SEQ ID NO: 7927 - protein, 420 aa, Rhodopirellula maiorica SM1
MNERRDAKLAKAKPEAVAKIESDFRFDNWVQSAAMRASQLNVASHIGPISHPDAKIAPFVAEPTPAPDGYVRSGNVSTPWDAFGNAAALDTLAFMKIELSDNRTALQHLREGTSQIRRLFDFADDETYETIRNQFLQMFANSKPYPVTCSEIKQIYFPLPEGGYHLLSLVSSSGLMRENRLRLQERQWGEKAKAARELEKEDRAAIASGRSPQVEGVPAEVIYQSIPGRGSIKLGGANAQNVSSFNAECRGVWPLFASYRETTSIYQRLAKSDYFRNLRWDTYCRSIFVKLDNIFRKSNPGNSELREARIRRLEELWLWASSFALELQSLPGGWSNNDDNRLPMHQKLWLDAANGDLASDNSGWRHEVAGEFAAWTLAAYRKMNWGDQGSVPLGVVENTEFRNEVAELPFNAQEWQTWER

SEQ ID NO: 7928 - protein, 241 aa, Morganella morganii SC01
MPDPEITAFFTKYQESKKIPEFSRLQWLSDAAGRAEQLSLTTHPFAFTHPCARRNRYGKAGAILAEVKKKNDGFLRSGNVVVPQDAEGNAAALEIYTFLMLKMQDGKTLLTHLCEESETAKKILGSENYRKLRAGFLRIFSGEGVPSTNSKIKQVFFPVPGKECNAGYHLLSVLTPSGLLFELYRRLGKSGIFPGHLVVIHIGGSKPQNISALNMQNKGKACLLLSVPPGAVTAGDHYCVH

SEQ ID NO: 7929 - protein, 416 aa, Acinetobacter baumannii ABNIH7; identical to SEQ ID NO: 7557

SEQ ID NO: 7930 - protein, 416 aa, Acinetobacter baumannii ABNIH11; identical to SEQ ID NO: 7557

SEQ ID NO: 7931 - protein, 416 aa, Acinetobacter baumannii ABNIH10; identical to SEQ ID NO: 7557

SEQ ID NO: 7932 - protein, 416 aa, Acinetobacter baumannii ABNIH19; identical to SEQ ID NO: 7557

SEQ ID NO: 7933 - protein, 435 aa, Escherichia coli BCE034_MS-14; identical to SEQ ID NO: 7735

SEQ ID NO: 7934 - protein, 435 aa, Escherichia coli 2875000; identical to SEQ ID NO: 7735

SEQ ID NO: 7935 - protein, 435 aa, Escherichia coli 2872800
MEKTALIQFITDYIASRRQPKIDAFEKEAAKRLEQGEDASVIALERQELEARYLPRNWLTDAANRIRSIRIISHWAKYSNGDSKAYGRYLEKFVSEGYLNTASLAIIKEDAEGNAAVFDVAKLLLTEINGDSLLASLKRGDYHSLNVFALNDEQLKQWVECFSKAYASEWIKAHKLSKQIYFPVDDGYHLLCPLFSSSLAQAMYEKLTAVRFSEESKVIRDAHKAGKWHSQPDIRFPNLAEMHYGGGNQQNISLLNSARIGRVWLLPSMPPTWATLDRAPQNMRSIFALRGDFNRAASGIIARMTYLLKVDINNVHIRTARAKYIDELIDLLFMQASAFQQEKWQGWSAQSQDLPRHQQLWLDPWRSLSDETFKQEREKNDWQETVADDFARWLNYRLKKSSFDVGAVEQKEWRSQSLFAQRMREMEAVLQEALK

SEQ ID NO: 7936 - protein, 435 aa, Escherichia coli 2867750
MEKTALIQFITDYIASRRQPKIDAFEKEAAKRLEQGEDASVIALERQELEARYLPRNWLTDAANRIRSIRIISHGAKYSNGDSKAYGRYLEKFVSEGYLNTASLAIIKEDAEGNAAVFDVAKLLLTEINGDSLLASLKRGDYHSLNVFALNDEQLKQWVECFSKAYASEWIKAHKLSKQIYFPVDDGYHLLCPLFSSSLAQAMYEKLTAVRFSEESKVIRDAHKAGKWHSQPDIRFPNLAEMHYGGGNQQNISLLNSARIGRVWLLPSMPPTWATLDRAPQNMRSIFALRGDFNRAASGIIARMTYLLKVDINNVHIRTARAKYIDELIDLLFMQASAFQQEKWQGWAAQSQDLPRHQQLWLDPWRSLSDETFKQEREKNDWQETVADDFARWLNYRLKKSSFDVGAVEQKEWRSQSLFAQRMREMEAVLQEALK

SEQ ID NO: 7937 - protein, 435 aa, Escherichia coli 2866550; identical to SEQ ID NO: 7735

SEQ ID NO: 7938 - protein, 435 aa, Escherichia coli 2866450; identical to SEQ ID NO: 7735

SEQ ID NO: 7939 - protein, 435 aa, Escherichia coli 2866750; identical to SEQ ID NO: 7735

SEQ ID NO: 7940 - protein, 435 aa, Escherichia coli 2851500; identical to SEQ ID NO: 7735

SEQ ID NO: 7941 - protein, 435 aa, Escherichia coli 2853500; identical to SEQ ID NO: 7735

SEQ ID NO: 7942 - protein, 435 aa, Escherichia coli 2850750
MEKTALIQFITDYIASRRQPKIDAFEKEAAKRLEQGEDASVIALERQELEARYLPRNWLTDAANRIRSIRIISHGAKYSNGDSKAYGRYLEKFVSEGYLNTASLAIIKEDAEGNAAVFDVAKLLLTEINGDSLLASLKRGDYHSLNVFALNDEQLKQWVECFSKAYASEGIKAHKLSKQIYFPVDDGYHLLCPLFSSSLAQAMYEKLTAVRFSEESKVIRDAHKAGKWHSQPDIRFPNLAEMHYGGGNQQNISLLNSARIGRVWLLPSMPPTWATLDRAPQNMRSIFALRGDFNRAASGIIARMTYLLKVDINNVHIRTARAKYIDELIDLLFMQASAFQQEKWQGWSAQSQDLPRHQQLWLDPWRSLSDETFKQEREKNDWQETVADDFARWLNYRLKKSSFDVGAVEQKEWRSQSLFAQRMREMEAVLQEALK

SEQ ID NO: 7943 - protein, 435 aa, Escherichia coli 2850400; identical to SEQ ID NO: 7735

SEQ ID NO: 7944 - protein, 435 aa, Escherichia coli 2848050; identical to SEQ ID NO: 7698

SEQ ID NO: 7945 - protein, 435 aa, Escherichia coli 2756500; identical to SEQ ID NO: 7735

SEQ ID NO: 7946 - protein, 435 aa, Escherichia coli Jurua 20/10; identical to SEQ ID NO: 7735

SEQ ID NO: 7947 - protein, 435 aa, Escherichia coli 2720900; identical to SEQ ID NO: 7735

SEQ ID NO: 7948 - protein, 434 aa, Pseudomonas sp. P179; identical to SEQ ID NO: 7686

SEQ ID NO: 7949 - protein, 435 aa, Escherichia coli 2735000; identical to SEQ ID NO: 7735

SEQ ID NO: 7950 - protein, 435 aa, Escherichia coli 179550; identical to SEQ ID NO: 7735

SEQ ID NO: 7951 - protein, 435 aa, Escherichia coli 180200; identical to SEQ ID NO: 7735

SEQ ID NO: 7952 - protein, 455 aa, Thauera sp. 28
MPSTSTERRAAFRNAIEHFLKERLDAKLDKLPPDDPKRDELIAQHARETWLADAARRVAQIQIVTHTLKPIHPDARGTNLFRAPNELPAHREVGSHVLGQDFSSDVVGNAAALDVFKLLKLPLDGRPLLAWMQDGDPDMLGALSDDADQASEWLTAFTGITAPRSATPSSHALAKQLYWLAGEDPADDAQYHLLAPLYSSALAHAVFQTINEDRFGEAGKLARQARYAQRDHDTGYREYPDLAVQKFGGTKPQNISQLNSERGGNNYLLASRPPKWKTRALKAPLFTESVFPRFGGIREVRATVRVLRDFLESDPPSTMETRNRRDALLDRLIDELVDFAHPLQATLPAGWTRDTDCRLVEAERLWLDPGRAETDEETDTEFGAAWQRMDWPAELGRRFGNWLNHELGQSLPLGDIEGRHWRDELLLHTAWAGKLHTLRIQGDAPTYIPVREAVQ

SEQ ID NO: 7953 - protein, 416 aa, Acinetobacter bohemicus ANC 3994
MTASIEAFLNERKELWLKDRLKKAENETVIAELQQQANERFSLQEWLPDAAKRVSQLSMVSHPSKFSHPSAKTSSVIVQAKHSVDGYLRSGNVNYPLDVFGNAAAMDVFKFLSVNLDNGQTVLDAFEKQDEDLKQFIQRSSLDFDVLRLAFLVIKDNDTSVKTDHLVKQVYFPIGEKNYHLLSLLTPSGLITKLKQSIDAIRFSDATKLAKDRRKKNELDKVGYADIYDLTVTAYGGTQPQNVSVLNSQNAGRAYLLSSAPPQFEKRTIRLPKTDFFAQSLYRKNFQDSFLQLHKLMQLDVNNIDIRTAIRNIIQFVIDQVMFQAFKIRQSYAEGWSNEDYYASLPKLQRVWLDDFYENEREQDDEWRDELSREIARWILRSYEKSIEGSFTLGTGELVELKQRVEKSLQQTKEFF

SEQ ID NO: 7954 - protein, 413 aa, Acinetobacter proteolyticus
MAESIHAFLNERKELWLKDRLKKAESDVETLTLQHQANDKFSLNEWLPDAAKRVTQLAMVSHPSKFSHPSAKTSSLIAKAKHCNDGYLRSGNVEYSLDVFGNAAAMDVFKFLSLPLTEKMTVLDGFEQDNQELRALITHVDLNFEALSSEFLKIKAADHSVKTDPLVKQVYFPINQSEYHLLSLLTPSGLITRLKQAIDAMRFSEETKKSKELRKKNEHDEVGYADIFDLTITAYGGTQPQNVSVLNSQNAGRAYLLSSCPPVFESRNIKLPSHDFFQQCLYRKKFGTEFEKLKKYVAEINNQYIRKKIKKLLRQIVGVILFHAFCVRQNEKGWSKKEHYKSLSLEQKIWLDDAYLDVREIENEWRYEIARRIAKWILDSFEDFYGSKLFGSPELVELKDIVFEALDEDKEFF

SEQ ID NO: 7955 - protein, 416 aa, Acinetobacter parvus DSM 16617 = CIP 108168
MTESIQNFLNERKELWLKDRLKKAENDSVISELQGQADDKFSLKEWLPDAAKRVTQLSMVSHPSKFSHPSAKTSSVIAQAKQINDGYLRSGNVSYPLDVFGNAAAMDVFKFLSLPLTEKLTVLDGFERQEESLKTLLVGADLDFETLGTEFLKIKATDTSVKTDHLVKQVYFPIEQAEYHLLSVLTPSGLITRLKQSIDTIRFSEETKQAKELRRKNEHHEIGYADIFDLTITAYGGTQPQNVSVLNSQNAGRAYLLSSCPPMLEKRAIRLPKTDFFAQCLYRKNYQESFIQLHKFMQLDLNNDDIRTAIRNIIQFVIDQILVLASKTREYSVEGWSNQDYYASLPKLQRIWLDKIYQTERDEDDDWRNDLSKEIARWILRSYEKVISDAYKLGTGEILDVKQRVEKSLQQAKEFF

SEQ ID NO: 7956 - protein, 422 aa, Acinetobacter lwoffii NIPH 715
MNVDVIHASIESFLRHRIDKKVEAERKKLKEAFTDEHLSKIHSDHEIVSWINYIAENASKVSLNVSHVAKLTHSSNKAINLIDLIPQQKYHYLLTTQTAKVNELDSAYTDASYAPVAEFLSFNVIDLDKNLGQFLAEDEIYFSKISDNADVRKQWQMQISEAYVAKKLNSHVLAKQVYIPVDDHYHVISPVKSSALAHKIFEKITHSRSKDTPVNQARKQNLSYEGVYTFFPKTAFLSVTKSNHQNASKLNGTRRGGLYFFQANPPQWRKDALPPPNMENFLARCRTTHSVEIFKEIKRLFYVMKKENLSINLNRRNVLTELVESLADEVIHQILWIQQSYAKGWANDLEIEPYLRAFLDPIENKQQENKAFIDEFTEQVSKWINKNMGEKYERRELKAIWFNTLHPVFKDFHAVLTVESIE

SEQ ID NO: 7957 - protein, 416 aa, Acinetobacter baumannii NIPH 146; identical to SEQ ID NO: 7679

SEQ ID NO: 7958 - protein, 416 aa, Acinetobacter baumannii NIPH 146
MAESIHTFLNERKELWLKDRIKKAENESAIAELQQQANDKFSLNEWLPDAAKRVTQLSMVSHPSKFSHPSAKTSSVIAKVEYCNDGYLRSGNVDYSLDVFGNAAAMDVFKFLSLALTENLTVLDGFEKQNQELKKLIAHAELDFDNLSSEFLKIKATDDSIKTDHLVKQVYFPVGEAQYHLLSILTPSGLITRLKQSVDAMRFSEETKQAKESRKKNEHHEVGYSDIFDLTVTGYGGTQPQNVSVLNSQNAGRAYLLPSCPPVLEKRTIRLPKADFFAQCLYRKNYHDSFIQLHKFMQLDLNNIDIRNAIKNIIQFVIDQILLQALKTREYAVEGWSNQDYYASLPKIQRIWLDKVHQKEREENSDWRDELSREVARWILRSYEKVISDAYTLGTGELLDVKQWVENSLQKAKEFF

SEQ ID NO: 7959 - protein, 444 aa, Acinetobacter sp. ANC 3789
MNEEVDGVSDSEPTSIRELIEQYIQGRLNEKLEKLKADDVAEREKLLEKYQVETWLEDASLRISQLRLATHTPKQHHPDSKASAMFYNVTEQTHEYVGSQGVQLEADVIGNAAVLDVFKLLRLKFQEQTLLDRLLNADTDFIVALALNKDLAEIRYQRFLAFSQLPTELNAGRLSKQVLFPVQQDDYHTLVLLYPSALVHRAYQQISNDRFGENSKILREARFKKLNHSQESREYPNLLVQNFGGSKPQNISQLNSDRRGLMWLMPSIPPTWQGQVFALPKGDTVFSGYLINRKDVKSLLNKIIALYRKEDRRNTVEFRDQRDALVAELADCVIDLSFELQQSAVAGWTQTKEFSAAQSFWLDRGYREALFDKEDANELTEDEEVWLHAYRERDWRKEIGYNFGNWLSEILVKKAKLTDLDDNEDRAWSLILREKLQLLKEEFA

SEQ ID NO: 7960 - protein, 416 aa, Acinetobacter sp. CIP 102159; identical to SEQ ID NO: 7955

SEQ ID NO: 7961 - protein, 416 aa, Acinetobacter sp. CIP 102129
MIENIQAFLDDRKELWLKERLKKVKDDHEIVALQQQATAKFSLAEWLSDAANRAKQLTIVSHPAKFSHPRAQVSDIYFISDRKNDGYIKSGNVNYPFDIIGSAGAIDVYKFLFLKLEDGKSILEHLEEKTDLIKQALSLQIDRFEEVRTGFLQIKSSNTDLKTDRFVKQIYFPIDKKNYHILSLLTPSGLLVEMKNRINIMRFSENSKKAKENFKNRIYDLNDFSDICNTTSTAYGSGNPQGISILNNENSGKYYLLPSIPPSLEQRSTRLPKTDFFKQCLYRGSFQESFFHLNKLMKTEKRNDAVRTAIQNIIHFVIDRIMFEAFKIREHYEPGWSNQDYYESLPKLQRMWLDNIYRDERGNDSEWRDELARDIAHWILASYQKTIKDAFQLGDSELLHVKTVVNEAVQEDKEFF

SEQ ID NO: 7962 - protein, 416 aa, Acinetobacter sp. CIP 102529; identical to SEQ ID NO: 7955

SEQ ID NO: 7963 - protein, 416 aa, Acinetobacter sp. CIP 102082; identical to SEQ ID NO: 7955

SEQ ID NO: 7964 - protein, 416 aa, Acinetobacter sp. CIP 102637
MTESIQNFLNERKELWLKDRLKKAENDSVISELQGQADDKFSLKEWLPDAAKRVTQLSMVSHPSKFSHPSAKTSSVIAQAKQINDGYLRSGNVSYPLDVFGNAAAMDVFKFLSLPLTEKLTVLDGFERQEESLKTLLVGADLDFETLGTEFLKIKATDTSVKTDHLVKQVYFPIEQAEYHLLSVLTPSGLITRLKQSIDTIRFSQETKQAKELRRKNEHHEIGYADIFDLTITAYGGTQPQNVSVLNSQNAGRAYLLSSCPPMLEKRAIRLPKTDFFAQCLYRKNYQESFIQLHKFMQLDLNNDDIRTAIRNIIQFVIDQILVLASKTREYSTEGWSNQDYYASLPKLQRIWLDKIYQTERDEDSDWRDELSREIARWILRSYEKVISDAYKLGTGEILDVKQRVEKSLKQAKEFF

SEQ ID NO: 7965 - protein, 416 aa, Acinetobacter sp. CIP 56.2
MTESIHAFLNERKELWLKDRLKKAESDVETSTLQHQANDKFSLNEWLPDAAKRVTQLAMVSHPSKFSHPSAKTSSLIAKAKHCNDGYLRSGNVEYSLDVFGNAAAMDVFKFLSLPLTEKMTVLDGFEQDNQELRALITHADLNFEALSSEFLKIKAADHSVKTDHLVKQVYFPINQSEYHLLSILTPSGLITRLKQVIDAMRFSEETKKSKELRKKNEHDEIGYADIFDLTITAYGGTQPQNVSVLNSQNAGRAYLLSSCPPVLEKRAIRLPKTDFFMQCLYRKNYQDSFIQLHKFIQLDLNNTDIRNAITNIIQFVIDQVLLQALKTRQYAIEGWTNQDYYANLPKMQRIWLDKTYQIEREENSDWRDELSREIARWILRSYEKVISDAYMLGTRELVEVKQRVENSLQQAKEFF

SEQ ID NO: 7966 - protein, 416 aa, Acinetobacter baumannii NIPH 190
MAESIHTFINERKELWLKDRIKKAENESAIAELQQQANDKFSLNEWLPDAAKRVTQLSMVSHPSKFSHPSAKTSSVIAKVEYCNDGYLRSGNVDYSLDVFGNAAAMDVFKFLSLALTENLTVLDGFEKQDQELKKLIAHAELDFDNLSSEFLKIKATDDSIKTDHLVKQVYFPVGEAQYHLLSILTPSGLITRLKQSVDAMRFSEETKQAKESRKKNEHHEVGYSDIFDLTVTGYGGTQPQNVSVLNSQNAGRAYLLPSCPPVLEKRTIRLPKADFFAQSLYRKNYQDSFIQLHKFMQLDLNNIDIRNAIKNIIQFVIDQILLQALNTREYAVEGWSNQDYYASLPKIQRIWLDKVHQKEREENSDWRDELSREVARWILRSYEKVISDAYTLGTGELLDVKQWVENSLQKAKEFF

SEQ ID NO: 7967 - protein, 397 aa, Acinetobacter gerneri DSM 14967 = CIP 107464
MTSQNSNDNVYQQALAESVHFSAKTINSNIEKGGIRLKNSQKLDLPYISARTLLADDFLIPTDYQANAGKTATYFKVIKAAQLDEDLTEADDEFKQNVAALKPHLKDTFSEFYSAGLEHINVRMRQLLIPKDDQYISISPISAAGVNHYLNQEVDALKEQRKNQGKDSKLKNIQTAVFGIGGANPQNVGSLVRSMQRPIVMGSPTLSHKARLAFQYFYKGFDYQISNAFINKELYIELTIYAHDLEKQSSLTHHLGFAEQEIYAPFSNLKGREKELKTIEKVVSNVLAQGAEILEILKTIEPQLPSQKVLERKSFWSHPEVKILRQGLINPELQQFDDWKELFAEHLAKKISKHSYWQKELENGRKNAAKTKEKIDILLDDVNSKGLFKRRILELLK

SEQ ID NO: 7968 - protein, 437 aa, Acinetobacter schindleri CIP 107287
MQNIIVSYLEARKEDFLQSKINSKLRGKKNEFDEEARLKVRLEYQGEADAKYNIGVWLDNIIRKVKPNVTTHPAKFTNAKIDTDTSQIFLGHYVNDGYIKTGNVHLKNKVDVSGNSATNTIVYELYDLLDQDLDNDQKLIHKFEDNNESLIQFFEKNKADFEYIKAKCLKVYYGEKSTPETHSSTRQVYFPIGNNEYHLLSVKTASMLMYEVKNRIDDMNIWVDGQHARSFKKENKFLEGGFSEVFDITEIGFSNGDFIKMGNYSLLNVKNKGIAYLLSSCPPILEKRTVRLPRTDFFAQCLYRKNYQDSFVQLHKFMQLDLNNIDIRTAIRNILQFVIDQVILEGLKIRESHPAGWSQQEYYASLPKLQRIWLDSMYAEQRENDSEWRNELSEDIARWILRTYEKIISEAGMLGTAEINDVKQRVEESLRQAKEFF

SEQ ID NO: 7969 - protein, 417 aa, Acinetobacter junii CIP 107470
MIENIFEKYLLHQKKLWLERKSKGKEPTPELLGESEIRYEKSAWLNKAIKQARHAITTHASTFTHPDAKSSCFKFSNPSVNNGFLSTNNVTCKNDFDLFGNAATDSFVKEIYLFLIEPVNDITIWDHFKNESNEIKKFIQSYNVDFNEVKTSLSKLMIDPEPPKTHKLLKQVYFPVEDNYHLLSLLTPSIVTSELLDRLNLIRFSEIAKQARGLKKENKFSEYDYEDIFDLTEVAFGGSKPQNISVLNSQNAGRAYLLASCPPILEKRTLRLPRTDFFVQCLYRKNYQDSFVQLHKFIQLDLNNIVIRTAIQNILQFVIDQVILEGLKIRESYPAEWSQQEYYANLPKLQRIWLDSMYVEQRENDSEWRNELSEDIARWILRSYEKVISESEMLGTTEINDVKQRVEESLRQAKEFF

SEQ ID NO: 7970 - protein, 413 aa, Acinetobacter junii CIP 64.5
MAESIHAFLNERKELWLKDRIKKAENESVIAELQQQAKDKFSLNEWLPDAAKRVTQLSMVSHPSKFSHPSAKTSSVIANVEQRNDGYLRSGNVNYSLDVFGNAAAMDVFKFLSLPLNEELTVLDGFEENDQGLKNLIADAKLNFETLSAEFLKIKATDNSIRTDHLVKQVYFPVSEVNYHLLSILTPSGLITRLKQAIDVMRFSEETKQAKESRKKNEHHEVGYSDIFDLTVTAYGGTQPQNVSVLNSQNAGRAYLLSSCPPVFENRNIKLPNQDFFQQCLYWKKFSSEFESLQKYVTEINNQHTRKKIKKILRKMVEDILFIAFCVRKNEKGWSKKEHYQSLVLKQKIWLDDAYLDVRQTENEWRDEIARRTAKWILDSFEDFYGSKLFGSPEIIELKAIVFEALDEDKEFF

SEQ ID NO: 7971 - protein, 416 aa, Acinetobacter ursingii ANC 3649
MTESIHTFLNERKELWLKDHLKKAETEAVISELNQQADDKFSLNEWLPDAAKRVSQLSMVSHPSKFSHPSAKTSSVIATSNKKSDGYLRSGNVDYSLDVFGNAAAMDVFKFLSLPLTDQSTVLDGFEQQNEDLKKLLVQNKLDFEQLSFEFLKIKTTDFSVKTDHLVKQVYFPIAEGEYHLLSLLTPSGLITKLKQTIDQIRFSEETKQAKENRKKNELNEIGYADIYDLTVTAYGGTQPQNVSVLNSQNAGRAYLLSSCPPVIEKRAIRLPKTDFFAQCLYRRNYQDSFVQLHKFMQLDLNNIDIRTAIRNIIQFVIDQVLLQALKTREYAESGWSNQDYYVGLPKLQRIWLDQIYKEEREENSEWRDELSREIARWIIRSYEKVISDAYKLGTGELLDVKQRIEKSLQQIKEFF

SEQ ID NO: 7972 - protein, 178 aa, Acinetobacter haemolyticus CIP 64.3
MIEEKYENFLLNQKREWLNKSSNKGKFSEADERYHPELWLVKAIKNARYAVTTHSSTFTHPDAKSTPILFFKEPCNNGYLISNNVNLSQVFDVFGNAATDTIVKETYLFLTSKLADGRTIWQQFEEETDTAKVFVQNLNQDFDQAYCNLNKIFVNKNETKTTGLLGRVKLEVRHKPPN

SEQ ID NO: 7973 - protein, 255 aa, Acinetobacter haemolyticus CIP 64.3
MFEFALKQVYFPVDEADYHLLSLVISSPLITEFVKRIDQIRFNVSNKEAKEYKRKNQHYEGGYSDLFDLTQVGFGGSKPQNVSVLNSQNAGRAYLLSSSPPVLEKRTIRLPKTDFFVQCLYRKNYQDSFIQLHKFMQLDLNNIDIRNAIRNIIQFVIDQILLQAFRTREYAVEGWSNQDYYSSLPKLQRIWLDKVHQTTRDEDNDWRDELSREIARWILRSYEKVVSDAFILGTGELLGVKQGVEKSLQRAKEFF

SEQ ID NO: 7974 - protein, 416 aa, Acinetobacter baumannii NIPH 201
MAESIHTFLNERKELWLKDRIKKAENESAIAELQQQANDKFSLNEWLPDAAKRVTQLSMVSHPSKFSHPSAKTSSVIAKVEYCNDGYLRSGNVDYSLDVFGNAAAMDVFKFLSLALTENLTVLDGFEKQDQELKKLIAHAELDFDNLSSEFLKIKATDDSIKTDHLVKQVYFPVGEAQYHLLSILTPSGLITRLKQSVDAMRFSEETKQAKESRKKNEHHEVGYSDIFDLTVTGYGGTQPQNVSVLNSQNAGRAYLLPSCPPVLEKRTIRLPKADFFAQSLYRKNYQDSFIQLHKFMQLDLNNIDIRNAIKNIIQFVIDQILLQALNTREYAVEGWSNQDYYASLPKIQRIWLDKVHQKEREENSDWRDELSREVARWILRSYEKVISDAYTLGTGELLDVKQWVENSLQKAKEFF

SEQ ID NO: 7975 - protein, 416 aa, Acinetobacter baumannii NIPH 527; identical to SEQ ID NO: 7557

SEQ ID NO: 7976 - protein, 416 aa, Acinetobacter baumannii NIPH 290; identical to SEQ ID NO: 7557

SEQ ID NO: 7977 - protein, 416 aa, Acinetobacter baumannii ANC 4097; identical to SEQ ID NO: 7557

SEQ ID NO: 7978 - protein, 444 aa, Acinetobacter sp. NIPH 284
MNDEVEGVQDSEPASIRELIEQYIQGRLNEKLEKLKADDTAERNKLLEKYEVETWLDDASLRISQLRLATHTPKQHHPDSKASAMFYSNTDKTHDYVGSQGIKLDADVIGNAAVLDVFKMLRLSFQGTSLLERLLNADQELITALSVKSETAQLRYERFLAFSQLPTELNAGRLSKQVLFSVQDDEYHTLVILYPSSLVHRAYQQLSYDRFSDESKALHEARFKKLHHAHESREYPNLLVQNFGGSKPQNISQLNSDRRGSMWLLPSIPPTWKGQQIELPKRGSVFTGYLSNRKDIKPLLHKIVTLYRKEDRRNNVEFRAQRDDLVSKLVDCIIDMSFELQQSASSGWTQDSNFSRAESFWLDYGYREALFDKEDAKELTEEEAEWLQAYRERDWHTEVGYNFGKWLNDILIKKGKIVDLDDHEARTWSLILRDKLQLLKEEFA

SEQ ID NO: 7979 - protein, 413 aa, Acinetobacter sp. ANC 3862
MAESIYAFLNERKELWLKDRIKKAENENVIAELQQQANDKFSLNEWLPDAAKRVTQLSMVSHPSKFSHPSAKTSSVIAKVEQSNDGYLRSGNVDYSLDVFGNAAAMDVFKFLSLPLNEKFTVLDGFEQQDHALKTLITHAKLNFDTLSTEFLKIKVTDHSVKTDHLVKQVYFPVREAQYHLLSILTPSGLITRLKQSIDAIRFSEDTKQAKESRKKNEHHEIGYSDIFDLTVTGYGGTQPQNVSVLNSQNAGRAYLLSSCPPKFENRNIKLPSQDFFQQCLYWKRFGGEFEILQKYVNGINNQHTRKKIKKILRQMVGDILFIAFCIRKNEKGWSKKEHYQSLALKQKIWLDDAYLDVRETENEWRDEIARRTAKWILDSFGDFYGSKLFSSPEIIELKGIVFEALDEDKEFF

SEQ ID NO: 7980 - protein, 416 aa, Acinetobacter ursingii NIPH 706
MTENIHAFLNERKELWLKDRLKKAEDETVILELNQQADDKFSLNEWLPDAAKRVSQLSMVSHPSKFSHPSAKTSSVIATSNKKSDGYLRSGNVDYSLDVFGNAAAMDVFKFLSLPLTDQSTVLDGFEQQNEDLKKLLVQNKLDFEQLSFEFLKIKTTDSSVKTDHLVKQVYFPIAEGEYHLLSLLTPSGLITKLKQTIDQIRFSEETKQAKENRKKNELNEIGYADIYDLTVTAYGGTQPQNVSVLNSQNAGRAYLLSSCPPVIEKRAIRLPKTDFFAQCLYRRNYQESFVQLHKFMQLDLNNIDIRTAIRNIIQFVIDQVLLQALKTRQYAESGWSNQDYYVGLPKLQRIWLDQIYKEEREENTEWRDELSREIARWIIRSYEKVISDAYILGTGELLDVKQRIEKSLQQIKEFF

SEQ ID NO: 7981 - protein, 208 aa, Clostridium innocuum 2959; identical to SEQ ID NO: 7767

SEQ ID NO: 7982 - protein, 451 aa, Xanthomonas fragariae LMG 25863
MTEPTERAKRFRSAIVDFIEARRLAKLKDGKGDAGAASKYDYATWLADAARRVGQIQAVTHVLKATHPDARGSSLHVPPDSLPQHAEIGSHLLGAHYAQDVVGNAAALDVFKFLKIEVEGQGLLAWMQAGDSDLRAALHPDTDVATGWMQAFAALARSEPQLSSHGMAKQVYWLVGDQPTDDTQYHLLQPLFSSTLAHVVHADIQDARFGETNKLARQAQRTKQPHDGSYRDYRNLVARKLGGSNQQNVSQLNSERGGVNYLLASLPPSWTLDHPRSLLKTDSVIDRFGYGKDVRAIVKTLADFLLDDPPPNDKTRRIRQRIEQELSAQLAVFAAETQARFAPGWTRDANCTLPLYEQLWLDPERTVLPVRRDPQHPQWTQDDDAFNAAYAFGDWPDQVAGRFANWVNAQLHKAGLTSVGDNEYRHWARQAIIEATWPVPLQRRASAGGQA

SEQ ID NO: 7983 - protein, 434 aa, Escherichia coli KTE33
MNNNLVDFITDYIASRRQPKIDAFEKEAAKRLEQGNDASAIAQERQELEARYLPRNWLTDAAKRAGQIKLVTHGAKFSHGDSKASSFYLDTSANESYLNTASLAKVATDAIGNAAALDVAKLLQTDVNGDSLLASLKRGDYQALSTFAEDEAQLAQWVAGFRQAWTLAQPVSHKLAKQIYFPVDDGYHLLCPLFSSSLAQAMYEKLTAVRFSEESKAIRDARKAGKWHPQPDIRFPNLAEMHFGGTKPQNISLLNSVRGGRIWLLPSMPPTWSTQDRAPQNMRSIFALRGDFNRLASGTIARMTYLLKVDINNVHIRTARAKYIDELIDLLSMQASSFQQEKWQGWSAQSPDLPRHQQLWLDPWRSLSDEAFKLEREKNDWQRTVADDFARWLNYRLKKASFDVGAVEQREWRSQSLFTQRMREMEAVLQEALK

SEQ ID NO: 7984 - protein, 434 aa, Pseudomonas aeruginosa PA14; identical to SEQ ID NO: 7533

SEQ ID NO: 7985 - protein, 434 aa, Pseudomonas aeruginosa MSH-10; identical to SEQ ID NO: 7686

SEQ ID NO: 7986 - protein, 435 aa, Escherichia coli KTE7; identical to SEQ ID NO: 7529

SEQ ID NO: 7987 - protein, 435 aa, Escherichia coli KTE3; identical to SEQ ID NO: 7529

SEQ ID NO: 7988 - protein, 435 aa, Escherichia coli KTE19
MEKTALIQFITDYIASRRQPKIDAFEKEAAKRLEQGEDASVIALERQELEARYLPRNWLTDAAKRAGQIKLVTHGAKFSHGDSKASSFYLETSATESYLNTASLANVATDAIGNAAALDVAKLLQTDVNGDSLLASLKRGDYQALSTFAEDKVQLELWVAGFSQAWTTGRPSSHKLAKQIYFPVADGYHLLCPLFSSSLAQAMYEKLTAGRFSEESKAIRDARKAGKWHSQPDIRFPNLAEMHFGGTKPQNISLLNSVRGGRVWLLPSMPPAWGPLDRAPQKMRSIFALRGDFNRATSGIIARMTYLLKVDINNVHIRTARAKYIDELIDLLFMQASAFQQEKWQGWSAQSPDLPRHQQLWLDPWRSLSDETFKQEREKNDWQVTVADDFARWLNYRLKKSSFDVGAVEQKEWRSQSLFAQRMREMEAVLQEALK

SEQ ID NO: 7989 - protein, 435 aa, Escherichia coli KTE27; identical to SEQ ID NO: 7529

SEQ ID NO: 7990 - protein, 434 aa, Escherichia sp. KTE31; identical to SEQ ID NO: 7983

SEQ ID NO: 7991 - protein, 435 aa, Escherichia sp. KTE52
MEKTALIQFITDYIASRRQPKIDAFEKEAAKRLEQGDDASVIALERQELEARYLPRNWLTDAAKRAGQIKLVTHGAKFSHGDSKASSFCLETSANESYLNTASLANVATDAIGNAAALDVAKLLQTDVNGDSLLASLKRGDYQALSTFAEDKAQLEQWVAGFSQAWTTGQPASHKLAKQIYFPVDDGYHLLCPLFSSSLAQAMYEKLTAVRFSEESKAIRDAHKAGKWHSQPDIRFPNLAEMHFGGTKPQNISLLNSVRGGRVWLLPSMPPTWAALDRAPQNMRSIFALRGDFNRAASGIIARMTYLLKVDKNNVHIRTTRAKYIDELIDLLFMQASSFQQEKWQGWSAQSPDLPRHQQLWLDPWRSLSDEAFKLEREKNDWQGMVAEDFARWLNYRLKKASFDVGAIEQKEWRSQSLFAQRMREMEAVLQEALK

SEQ ID NO: 7992 - protein, 435 aa, Escherichia sp. KTE96; identical to SEQ ID NO: 7891

SEQ ID NO: 7993 - protein, 435 aa, Escherichia coli KTE89; identical to SEQ ID NO: 7725

SEQ ID NO: 7994 - protein, 435 aa, Escherichia coli KTE126; identical to SEQ ID NO: 7895

SEQ ID NO: 7995 - protein, 435 aa, Escherichia sp. KTE159
MEKTALIQFITDYIASRRQPKIDAFEKEAAKRLEQGDDASVIALERQELEARYLPRNWLTDAAKRVRSIRIISHGAKYSNGDSKAYGRYLEKFVSEGYLNTASLAIIKEDAEGNAAVFDVAKLLLTEVNGDSLLASLKRGDYQSLNAFALDDEQLKQWVECFSEAYASEWIKAHKLSKQIYFPVDDGYHLLCPLFSSSLAQVMYEKLTAVRFSEESKAIRDAHKAGKWHSQPDIRFPNLAEMHYGGGNQQNISLLNSARVGRVWLLPSMPPTWATLDRAPQNMRSIFSLRGDFNRAASGIIARMTYLLKVDINNVHIRTARAKYIDELIDLLFMQASSFQQEKWQGWSVQSPDLPRHQQLWLDPWRSLSDEAFKQEREKNDWQETIADDFARWLNYRLKKARFDVGAVEQREWCSQSLFTQRMREMEAVLQEALK

SEQ ID NO: 7996 - protein, 435 aa, Escherichia coli KTE240; identical to SEQ ID NO: 7529

SEQ ID NO: 7997 - protein, 435 aa, Escherichia coli KTE186; identical to SEQ ID NO: 7649

SEQ ID NO: 7998 - protein, 433 aa, Halomonas anticariensis FP35 = DSM 16096
MTRPLSRERNELRSLIGRFLLERLEGKTEKLAPDDPKRDVLTEQFQRENWIGDAARRVGQLQVVTHSLKPIHPDAKGTNLYAPPESLGQHVAVGSHVLPADFQGDVVGNAAALDVYKFLKLEHQGKSLLERVLEDDTELAAALSDDPVQAREWMQAFAAITEPRGSETSHTRAKQLYWLVGDDPTADSDYHLLAPLYATSLAHQVFQTINEDRFGEAAKAARQARRDNAESETGYHDYPELAVQKLGGTKPQNISQLNSERGGNNYLLASLPPSWKSREVKEPLHTESIFPRFGRRREVQWLIRGLRKLLELDPSPNVQTRERRDEYVWALIDELVLFASQYHPLEPGWSAKPECRLVEAEALWLDPYRGEDDQAFAERREQGEWVEEVRHRFANWLNGRLQDVLPVGDAEHHYWMAQLKKKLDALQEVLPHA

SEQ ID NO: 7999 - protein, 444 aa, Pasteurella multocida 1500E; identical to SEQ ID NO: 7630

SEQ ID NO: 8000 - protein, 468 aa, Delftia acidovorans CCUG 15835
MSNAPATGRKAGFRAAIDQFLQERLQSKLEKLKPDDPQRDELVASFLRDTWVASAAKRVDQIQAVTHSLKPIHPDARGTNLYVEPAGLPVLQELGSHALGQSFSGDVVGNAAALDVYKFLKVEVDGTSLLAALLAQDPGALQALHEDPQQAMGLRDAFVGLTQPRAGIPSSHTRAKQLYWLTGSDACADEGYELLAPLFATSLAHAVHAQVQEDRFGESNKAARQARRERKAHDRVFHDYPGLAVQKMGGTKPQNISQLNSERGGVNYLLASLPPVWRSSDVRLPVHASSVFDKLFIGRPEVRSTVRKLRAFLATDPEPNLQTRERREAFVDALIDEMVSLAGEVQQALPAGWSCDSERFGKLVREEQLWLDPLRAELRDEADFAREWLWMDWPAEVGKRFANWLNSQLFGQLPVGDAEARVWRKELLTDEDGFVQQLRELRKRLDAPAYIPIRKTHDELVMHRGGVV

SEQ ID NO: 8001 - protein, 444 aa, Pasteurella multocida 2000; identical to SEQ ID NO: 7630

SEQ ID NO: 8002 - protein, 444 aa, Pasteurella multocida P1933; identical to SEQ ID NO: 7630

SEQ ID NO: 8003 - protein, 444 aa, Pasteurella multocida 93002; identical to SEQ ID NO: 7630

SEQ ID NO: 8004 - protein, 444 aa, Pasteurella multocida RIIF; identical to SEQ ID NO: 7521

SEQ ID NO: 8005 - protein, 444 aa, Pasteurella multocida 671/90
MSYTFRKRIDLFLQEQNLKKSESDRKKLAKATDPTEIEQLTQLIQEFDQKYQFDTWIANAANVMAKQLKFGTHIAKGIHPDTKGDNVNFQPSDSLPPEYVGSQSVSHLVLDANGNAAALPLASFFNFIVDEEKQVKLRDLLLADDPRLAGCFSDDLALSDVYKKQFQQALTGDLTQPETHERNKQVFWANGENPIEDDDYTCLIPLYPSSLTHAFYQKVNNNRYSEQNKKASINRYKKNTEQEHYRSINGLAIVSLGGGNSQNVSQLNNLQKGRHYLLPSLPPIMKASRQFQLSPSQTTIFNDRLAYACCYGLRQLFEVIKAHKNISEVRDNRKDALDIILQSVLRIASVLQKQPVGWSKDYQLEMCEKYWLDPKRVHLPDEEAFRAEYEKGEWVAEVERRFALWLNKRLQKRFPHIAKDFDDAEYHEWRRNIRRTLRYRLRHP

SEQ ID NO: 8006 - protein, 261 aa, Pasteurella multocida 1500C
QLLWVNSNSSVEDDDYTCLVPLYPSSLIYNFYQKVQFIKYNSDENKLNRENRKKSNVVQKPYKNLVDLAVFKVGGSNPQGVGQLASIQGGRNYLLSSLPPIMPSSRYFRLSPLQTTIFNDRLAYACRYGLRQLFEVVEARKNGYQVRDSRIDALNNILRTFLFHANLLQKQPAGWSKDSQLEMCEKYWLDPKRVHLPDEEAFRAEYEKGEWVAEVERRFALWLNKCLQKRFPHIAKDFDDAEYHEWRRNIRRTLRYRLRHP

SEQ ID NO: 8007 - protein, 188 aa, Pasteurella multocida 1500C
MKLERIVDVLKLNSQLIKSEKLEKEEKKLQKTEEPTEREKILQKIAKINREYDHANLMSYRAGFMADQIKFGTHHPKGIHSSAKIECNTIYFDLKTPLPNTFCASQNIDNLTLDASGNAAALPLSKFFDIYVDDEKKIQLRDLLLQDHPVLDYCFAEDPELSVHYKKQFQKTLKSDFDNPISYKKCKQ

SEQ ID NO: 8008 - protein, 420 aa, Vibrio fluvialis PG41
MIDPAITAFFAERKEAWLKKNISAAMSDAEVLEKQQECEQNFLLDNWLSDAAKRAGQISMASHPCTFSHPSARKNKNGYVSSIIAKNKPRIDGFLRSGNVSVEQDALGNAAALDVYKFLSLEMSDQRSLLVHIEQESDLARQLLDIPSCEYQALRDGFLKMIDSDQASVSSSKIKQVYFPIADGEYHLLSLLTHSGHLFELRKRLDALRFGDAVKEARECKKKNHFHPAGYQEIFGLTTIGFGGTKPQNISVLNNQNAGKAHLLVSIPPELTPRDIRLPRTDFFKESFTAWQAKEVLEALHRLFQTDYNNVNLRDGRDYRIQQYVDLVIEKMWQVRLFLEAYSGELSSALPLEQKIWLYPEFADLRHQEDEWLDKIIRHIARGLINHYSRSKVITSPITLADQELLAIEKVVASNKENLR

SEQ ID NO: 8009 - protein, 85 aa, Chlamydia psittaci 10_743_SC13
MLIRLFFGIPLTKELAKTFAFPLTLTTFKNKEYIGIYSPAVSSLLTHEFTTHFHFAKQQLEKVLCEYYFVDKEDTLIVFPEILIG

SEQ ID NO: 8010 - protein, 85 aa, Chlamydia avium; identical to SEQ ID NO: 8009

SEQ ID NO: 8011 - protein, 397 aa, Acinetobacter gerneri MTCC 9824; identical to SEQ ID NO: 7967

SEQ ID NO: 8012 - protein, 417 aa, Acinetobacter junii MTCC 11364; identical to SEQ ID NO: 7969

SEQ ID NO: 8013 - protein, 255 aa, Acinetobacter haemolyticus MTCC 9819; identical to SEQ ID NO: 7973

SEQ ID NO: 8014 - protein, 178 aa, Acinetobacter haemolyticus MTCC 9819; identical to SEQ ID NO: 7972

SEQ ID NO: 8015 - protein, 416 aa, Acinetobacter baumannii 1605; identical to SEQ ID NO: 7557

SEQ ID NO: 8016 - protein, 434 aa, Pseudomonas aeruginosa WC55
MTSPLPTPTWQELRQFIESFIQERLQGKLDKLHPDEDDKRQTLLATHRREAWLADAARRVGQLQLVTHTLKPIHPDARGSNLHSLPQAPGQPGLAGSHELGDRLVSDVVGNAAALDVFKFLSLQYQGKNLLNWLTEDSAEAVQALSDNAEQAREWRQAFIGITAVKGAPASHSLAKQLYFPLPGSGYHLLAPLFPTSLVHHVHALLREARFGDAAKAAREARSRQESWPHGFSEYPNLAIQKFGGTKPQNISQLNSERYGENWLLPSLPPHWQRQDQRAPIRHSSVFEHDFGRSPEVSRLTRTLQRLLAKTRDNNFTIRRYRAQLVGQICDEALQYAARLRELEPGWSATPGCQLHDTEQLWLDPLRAQTDETFLQRRLRGDWPAEVGNRFANWLNRAVSSDSQILGSPEAAQWSQELSKELTMFKEILEDERD

SEQ ID NO: 8017 - protein, 435 aa, Escherichia coli HVH 1 (4-6876161)
MEKTALIQFITEYIASRRQPKIDAFEKEAAKRVEQGEDASVIAQERQELEARYLPRNWLTDAAKRAGQIKLVTHGAKFSHGDSKASSFYLETSANESYLNTASLANVATDAIGNAAALDVAKLLQTDVNGDSLLASLKRGDYQALSTFAEDKVQLELWVAGFSQAWITGRPSSHKLAKQIYFPVADGYHLLCPLFSSSLAQAMYEKLTAVRFSEESKAIRDARKAGKWHSQPDIWFPNLAEMHFGGTKPQNISLLNSVRGGRVWLLPSMPPTWATLDRAPQNMRSIFSLRGDFNRAASGIVAQMTYLLKVDINNVHIRTVRAKYIDELIDLLFMQASAFQQEKWQGWSAQSPDLPRHQQLWLDPWRSLSDETFKQEREKNDWQVTVADDFARWLNYRLKKSSFDVGAVEQKEWRSQSLFAQRMREMEAVLQEALK

SEQ ID NO: 8018 - protein, 435 aa, Escherichia coli HVH 3 (4-7276001); identical to SEQ ID NO: 7529

SEQ ID NO: 8019 - protein, 435 aa, Escherichia coli HVH 5 (4-7148410); identical to SEQ ID NO: 7529

SEQ ID NO: 8020 - protein, 435 aa, Escherichia coli HVH 9 (4-6942539); identical to SEQ ID NO: 7529

SEQ ID NO: 8021 - protein, 435 aa, Escherichia coli HVH 19 (4-7154984); identical to SEQ ID NO: 7529

SEQ ID NO: 8022 - protein, 435 aa, Escherichia coli HVH 24 (4-5985145); identical to SEQ ID NO: 7529

SEQ ID NO: 8023 - protein, 435 aa, Escherichia coli HVH 30 (4-2661829); identical to SEQ ID NO: 7529

SEQ ID NO: 8024 - protein, 435 aa, Escherichia coli HVH 32 (4-3773988); identical to SEQ ID NO: 7529

SEQ ID NO: 8025 - protein, 435 aa, Escherichia coli HVH 35 (4-2962667); identical to SEQ ID NO: 7529

SEQ ID NO: 8026 - protein, 435 aa, Escherichia coli HVH 38 (4-2774682); identical to SEQ ID NO: 7894

SEQ ID NO: 8027 - protein, 435 aa, Escherichia coli HVH 42 (4-2100061)
MEKTALIQFITEYIASRRQPKIDAFEKEAAKRVEQGEDASVIAQERQELEARYLPRNWLTDAAKRAGQIKLVTHGAKFSHGDSKASSFYLETSANESYLNTASLANVATDAIGNAAALDVAKLLQTDVNGDSLLASLKRGDYQALSTFAEDKVQLELWVAGFSQAWTTGRPSSHKLAKQIYFPVADGYHLLCPLFSSSLAQAMYEKLTAVRFSEESKAIRDARKAGKWHSQPDIWFPNLAEMHFGGTKPQNTSLLNSVRGGRVWLLPSMPPTWATLDRAPQNMRSIFSLRGDFNRAASGIVAQMTYLLKVDINNVHIRTVRAKYIDELIDLLFMQASAFQQEKWQGWSAQSPDLPRHQQLWLDPWRSLSDETFKQEREKNDWQVTVADDFARWLNYRLKKSSFDVGAVEQKEWRSQSLFAQRMREMEAVLQEALK

SEQ ID NO: 8028 - protein, 435 aa, Escherichia coli HVH 48 (4-2658593); identical to SEQ ID NO: 7529

SEQ ID NO: 8029 - protein, 435 aa, Escherichia coli HVH 59 (4-1119338); identical to SEQ ID NO: 7529

SEQ ID NO: 8030 - protein, 435 aa, Escherichia coli HVH 73 (4-2393174); identical to SEQ ID NO: 7529

SEQ ID NO: 8031 - protein, 435 aa, Escherichia coli HVH 76 (4-2538717); identical to SEQ ID NO: 7529

SEQ ID NO: 8032 - protein, 435 aa, Escherichia coli HVH 80 (4-2428830); identical to SEQ ID NO: 7529

SEQ ID NO: 8033 - protein, 435 aa, Escherichia coli HVH 102 (4-6906788); identical to SEQ ID NO: 7529

SEQ ID NO: 8034 - protein, 435 aa, Escherichia coli HVH 104 (4-6977960); identical to SEQ ID NO: 7529

SEQ ID NO: 8035 - protein, 435 aa, Escherichia coli HVH 118 (4-7345399); identical to SEQ ID NO: 7529

SEQ ID NO: 8036 - protein, 435 aa, Escherichia coli HVH 125 (4-2634716)
MEKTALIQFITDYIASRRQPKIDAFEKEAAKRVEQGEDASVIAQERQELEARYLPRNWLTDAAKRAGQIKLVTHGAKFSHGDSKASSFYLETSANESYLNTASLANVATDAIGNAAALDVAKLLQTDVNGDSLLASLKRGDYQALSTFAEDKVQLELWVAGFSQAWTTGRPSSHKLAKQIYFPVADGYHLLCPLFSSSLAQAMYEKLTAVRFSEESKAIRDARKAGKWHSQPDIWFPNFAEMHFGGTKPQNISLLNSVRGGRVWLLPSMPPTWATLDRAPQNMRSIFSLRGDFNRAASGIVAQMTYLLKVDINNVHIRTVRAKYIDELIDLLFMQASAFQQEKWQGWSAQSPDLPRHQQLWLDPWRSLSDETFKQEREKNDWQVTVADDFARWLNYRLKKSSFDVGAVEQKEWRSQSLFAQRMREMEAVLQEALK

SEQ ID NO: 8037 - protein, 435 aa, Escherichia coli HVH 126 (4-6034225); identical to SEQ ID NO: 7529

SEQ ID NO: 8038 - protein, 435 aa, Escherichia coli HVH 127 (4-7303629); identical to SEQ ID NO: 7529

SEQ ID NO: 8039 - protein, 435 aa, Escherichia coli HVH 137 (4-2124971); identical to SEQ ID NO: 7529

SEQ ID NO: 8040 - protein, 435 aa, Escherichia coli HVH 170 (4-3026949); identical to SEQ ID NO: 7529

SEQ ID NO: 8041 - protein, 435 aa, Escherichia coli HVH 180 (4-3051617); identical to SEQ ID NO: 7529

SEQ ID NO: 8042 - protein, 435 aa, Escherichia coli HVH 191 (3-9341900); identical to SEQ ID NO: 7529

SEQ ID NO: 8043 - protein, 435 aa, Escherichia coli HVH 192 (4-3054470); identical to SEQ ID NO: 7529

SEQ ID NO: 8044 - protein, 435 aa, Escherichia coli HVH 196 (4-4530470); identical to SEQ ID NO: 7529

SEQ ID NO: 8045 - protein, 435 aa, Escherichia coli HVH 198 (4-3206106); identical to SEQ ID NO: 7649

SEQ ID NO: 8046 - protein, 435 aa, Escherichia coli HVH 199 (4-5670322); identical to SEQ ID NO: 7529

SEQ ID NO: 8047 - protein, 435 aa, Escherichia coli HVH 201 (4-4459431); identical to SEQ ID NO: 7529

SEQ ID NO: 8048 - protein, 435 aa, Escherichia coli HVH 203 (4-3126218); identical to SEQ ID NO: 7529

SEQ ID NO: 8049 - protein, 435 aa, Escherichia coli HVH 211 (4-3041891); identical to SEQ ID NO: 7529

SEQ ID NO: 8050 - protein, 435 aa, Escherichia coli HVH 217 (4-1022806); identical to SEQ ID NO: 7529

SEQ ID NO: 8051 - protein, 435 aa, Escherichia coli HVH 222 (4-2977443); identical to SEQ ID NO: 7529

SEQ ID NO: 8052 - protein, 435 aa, Escherichia coli KOEGE 32 (66a); identical to SEQ ID NO: 7529

SEQ ID NO: 8053 - protein, 435 aa, Escherichia coli KOEGE 56 (169a); identical to SEQ ID NO: 8036

SEQ ID NO: 8054 - protein, 435 aa, Escherichia coli UMEA 3041-1; identical to SEQ ID NO: 7529

SEQ ID NO: 8055 - protein, 435 aa, Escherichia coli UMEA 3117-1; identical to SEQ ID NO: 7742

SEQ ID NO: 8056 - protein, 435 aa, Escherichia coli UMEA 3140-1; identical to SEQ ID NO: 7529

SEQ ID NO: 8057 - protein, 435 aa, Escherichia coli UMEA 3162-1; identical to SEQ ID NO: 7529

SEQ ID NO: 8058 - protein, 435 aa, Escherichia coli UMEA 3203-1; identical to SEQ ID NO: 7529

SEQ ID NO: 8059 - protein, 435 aa, Escherichia coli UMEA 3206-1; identical to SEQ ID NO: 7529

SEQ ID NO: 8060 - protein, 435 aa, Escherichia coli UMEA 3221-1; identical to SEQ ID NO: 8036

SEQ ID NO: 8061 - protein, 435 aa, Escherichia coli UMEA 3230-1; identical to SEQ ID NO: 8036

SEQ ID NO: 8062 - protein, 435 aa, Escherichia coli UMEA 3391-1; identical to SEQ ID NO: 7725

SEQ ID NO: 8063 - protein, 435 aa, Escherichia coli UMEA 3632-1; identical to SEQ ID NO: 7529

SEQ ID NO: 8064 - protein, 435 aa, Escherichia coli UMEA 3662-1; identical to SEQ ID NO: 7529

SEQ ID NO: 8065 - protein, 435 aa, Escherichia coli UMEA 3702-1; identical to SEQ ID NO: 7529

SEQ ID NO: 8066 - protein, 435 aa, Escherichia coli UMEA 3893-1; identical to SEQ ID NO: 7529

SEQ ID NO: 8067 - protein, 435 aa, Escherichia coli UMEA 3834-1; identical to SEQ ID NO: 7529

SEQ ID NO: 8068 - protein, 435 aa, Escherichia coli HVH 210 (4-3042480); identical to SEQ ID NO: 7529

SEQ ID NO: 8069 - protein, 435 aa, Escherichia coli UMEA 3298-1; identical to SEQ ID NO: 7529

SEQ ID NO: 8070 - protein, 434 aa, Gallibacterium anatis 12656/12
MLKAKILSFLTELAAKKLAPLEKKREKITAINELSALDDKIKQIKAEYQLDTWMEKAANQMSKQLSFATHLSKAVHPDSKGNNIAFKAQNHTLPFVGSHLIDKAIIDASGNAAALPLAALFDLVIDEQHNLRLRDLLLEDSPLLDGVFSDDEEKSTQYKTLFQQALITNITKPVTYERNKQLLWPNNRQAISEDNYTCLIPLYPSSLAHLLYNKIQGIRYSEHYKEIRENRKKEGITQQPYPTIEDLATIPLGGAQPQNISQLNSRQRGKHYLLPSLPPVFSSSKTNISDDTLFNRHLYFQCQLFFNDLFAVVSSPYNVYTERDKRDVAIENIIEVIFSIAQIYQQKPARWSKNYQHLDISQKYWLDPERANLDGEAEFKTKFEKVNWQNDIAKQFAHWVNYQLKQKFPNIRQDFSEPEFNEWRKAFKRALKRK

SEQ ID NO: 8071 - protein, 430 aa, Pseudoalteromonas citrea DSM 8771
MIDEAIDTFFEERKAAWLKKNIKASFSDDEIKDKHMECETIFSLRVWLPNAAKRAGQISISTHPCTFSHPSARKNKNGYVSSVIAKSERCNDGFLRSGNVAVQADALGNAAALDVYKFLTIVTENGQTLLQHLEQDSNLAINLFRSTAMNEPSDYEVLKEGLLAMIAPSEEVVTSSKIKQVYFPITDESKHTQPYHQLSLLTASGIVFELRKRLDNMRFGDEVKQAREQRKANQVHQSHQEIIDLTTIGYGGTKPQNISVLNNQHGGKAHLLMSMPPKLKSRDLHFPTSDFFSQTVRYSQCIKQFQALHKLYLLPNEYHNNMHTRSERDELYQEVIDHVIEQMFTIRSVSIEQFNKLTSTLPAAQRIWLCHDKVTERLTSDNWLEAICNSIVSFLFYGYERTLGKKAIKFSDGEYLKMQEIVLKNKEILR

SEQ ID NO: 8072 - protein, 303 aa, Listeria monocytogenes serotype 4bV str. LS642; identical to SEQ ID NO: 7526

SEQ ID NO: 8073 - protein, 303 aa, Listeria monocytogenes serotype 4bV str. LS645
MIKLINVVKKFGKIEAVKGINLEVEKGSLFAFLGENGAGKSTTLSMICTESEPTSGEIFIDNEKLTFKNRKLFRQKLGVVFQENVLDDLLTVRENLYNRASLYGKTKAEITERLALVSSIMGIEDILNRRFEKLSGGQKRRAEIARAIMHDPEILLLDEPTTGLDPKTRVGVWKIIDYLREELGMTVFLTTHYLEEAKDADQLAVIHKGKIIAQGTPANIRSRFSVDKIFFYDAKVAELQKIMKKMNLPFKVTNRTMRVDVIDENVEILAILNQAIGFYDSFEVIKGNLDDAFISMIKEDSND

SEQ ID NO: 8074 - protein, 303 aa, Listeria monocytogenes serotype 4bV str. LS643; identical to SEQ ID NO: 8073

SEQ ID NO: 8075 - protein, 303 aa, Listeria monocytogenes serotype 4bV str. LS644; identical to SEQ ID NO: 8073

SEQ ID NO: 8076 - protein, 303 aa, Listeria monocytogenes serotype 4bV str. LS542; identical to SEQ ID NO: 7526

SEQ ID NO: 8077 - protein, 448 aa, Pasteurella multocida subsp. multocida str. PMTB
MKLERIVDVLKLNSQLIKSEKLEKEEKKLQKTEEPTEREKILQKIAKINREYDHANLMSYRAGFMADQIKFGTHHPKGIHSSAKIECNTIYFDLKTPLPNTFCASQNIDNLTLDASGNAAALPLSKFFDIYVDDEKKIQLRDLLLQDHPVLDYCFAEDPELSVHYKKQFQKTLKSDFDNPISYEKCKQLLWVNSNSSVEDDDYTCLVPLYPSSLIYNFYQKVQFIKYNSDENKLNRENRKKSNVVQKPYKNLVDLAVFKVGGSNPQGVGQLASIQGGRNYLLSSLPPIMPSSRYFRLSPLQTTIFNDRLAYACRYGLRQLFEVVEARKNGYQVRDSRIDALNNILRTFLFHANLLQKQPAGWSKDSQLEMCEKYWLDPKRVHLPDEEAFRAEYEKGEWVAEVERRFALWLNKCLQKRFPHIAKDFDDAEYHEWRRNIRRTLRYRLRHP

SEQ ID NO: 8078 - protein, 100 aa, Pseudomonas aestus
MLKATHPDARGSSLHVAPQTLPRHREVGSHMLGSDYAQDIVGNAAALDVYKFLKLEVEQRRLLDWLLEDDADLLAALSPDPALAQSWPKPSRAWFAPIRP

SEQ ID NO: 8079 - protein, 155 aa, Pseudomonas aestus
MAKQVFWCVSGEPGDDAGFELLQPMFSSSLVHAVHADINDARFGERNQAARQARRQRQAHDGIYRDYPQLVIRKLGGTKPQNISQLNSERGGVNYLLASLPPKWRQQHPGNLLHLESVFSRLRRFEDMGELIEALCLLLQADPARSLRTRLNVNV

SEQ ID NO: 8080 - protein, 117 aa, Pseudomonas aestus
MAAFGLSLRASLPPGWSRDRHCQLPLCEQLWLDPQRAQLASADDHQDADQAFAAAFAQRRWPDEIAQRFGHWLNAILLQRGLPVGDTEQAHWARQAVVDAEISCATRQVVEQEVRHG

SEQ ID NO: 8081 - protein, 431 aa, Vibrio cholerae HC-36A1; identical to SEQ ID NO: 7764

SEQ ID NO: 8082 - protein, 448 aa, Yersinia pestis S3; identical to SEQ ID NO: 51

SEQ ID NO: 8083 - protein, 448 aa, Yersinia pestis 24H; identical to SEQ ID NO: 51

SEQ ID NO: 8084 - protein, 448 aa, Yersinia pestis 113; identical to SEQ ID NO: 51

SEQ ID NO: 8085 - protein, 448 aa, Yersinia pestis 9; identical to SEQ ID NO: 51

SEQ ID NO: 8086 - protein, 385 aa, Megasphaera sp. BV3C16-1
MSIFMDYLQQEAAKEKGAVSKEEWLRKTAKNAAKCTFATHVGKFVHPSADVKVLVKPNTVQDSPYVLTSAVRCPVDISTGASYLGAAKLLLLPLENGRTVYENFFDDSDFIKMEMQNLQADYQEIRRLILQAVQPDGCDVSDERLRQVYFPLKEDSYHLLTVLPPSSVMMELRKRLRDMENIKKMAKDKESESYGQPYAEVYDLTEVSFGGTKPQNISFLNNAAGGRTCLLPSNPPVLRARTVTKPRYDFFDTLWIRNFQIFFRQLHDVYTCKVNNRISRCRARNIEDTIIDQVVLNVYALRQVEPGWTDADNNYLPKDQKIWLDQKYDVIRAQEEEWQESIDKAFARWIMKSYERIMGKEKVQLGDGEFKALKHRIHTAIRETV

SEQ ID NO: 8087 - protein, 433 aa, Pseudomonas aeruginosa C23
MSERPNGDSPTLRQLIESFIQERLQGKLDKLKPDEDVKRQSLLAGHRREAWLADAARRVGQLQLVTHTLKPIHPDARGSNLHSLPQAPGQPGLAGSHELGDKLVSDVVGNAAALDVFKFLSLQYQGKNLLNWLTEDSAEAVQALSDNAEQAREWRQAFIGITAVKGAPASHSLAKQLYFPLPGSGYHLLAPLFPTSLVHHVHGLLREARFGDAAKAAREARSRQESWPHGFSEYPNLAIQKFGGTKPQNISQLNSERYGENWLLPSLPPHWQRQDQRAPIRHSSVFEHDFGRSPEVSRLTRTLQRLLAKTRHNNFTIRRYRAQLVGQICDEALQYAARLRELEPGWSATPGCQLHDAEQLWLDPLRAQTDETFLQRRLRGDWPAEVGNRFANWLNRAVSSDSQILGSPEAAQWSQELSKELTMFKEILEDERD

SEQ ID NO: 8088 - protein, 433 aa, Pseudomonas aeruginosa C20; identical to SEQ ID NO: 8087

SEQ ID NO: 8089 - protein, 434 aa, Pseudomonas aeruginosa M8A.1
MTSPLPTPTWQELRQFIESFIQERLQGKLDKLQPDEDDKRQTLLATHRREAWLADAARRVGQLQLVTHTLKPIHPDARGSNLHSLPQAPGQPGLAGSHELGDKLVSDVVGNAAALDVFKFLSLQYQGKNLLNWLTEDSAEALQALSDNAEQAREWRQAFIGITTVKGAPASHSLAKQLYFPLPGSGYHLLAPLFPTSLVHHVHGLLREARFGEAARAAREARNRRESWPHGFSEYPNLAIQKLGGTKPQNISQLNNERRGENWLLPSLPPNWQRQDVNAPMRHSSVFEHDFERTPEVSRLTRTLQRFLAKTVHNNLAIRQRRAQLVAQICDEALQYAARLRELEPGWSATPGCQLHDAEQLWLDPLRAQTDETFLQRRLRGDWPAEVGNRFANWLNRAVSSDSQILGSPEAAQWSQELSKELTMFKEILEDERD

SEQ ID NO: 8090 - protein, 434 aa, Pseudomonas aeruginosa BL15
MTSPLPTPTWQELRQFIESFIQERLQGKLDKLHPDEDDKRQTLLATHRREAWLADAARRVGQLQLVTHTLKPIHPDARGSNLHSLPQAPGQPGLAGSHELGDKLVSDVVGNAAALDVFKFLSLQYQGKNLLNWLKEDSTEALQALSDNAEQAREWRQAFIDITAVKGAPASHSLAKQLYFPLPGSDYHLLAPLFPTSLVHHVHALLREARFGEAARAAREARSRQESWPHGFSEYPNLAIQKFGGTKPQNISQLNSERYGENWLLPSLPPHWQRQDQRAPIRHSSVFEHDFGRSPEVSRLTRTLQRLLAKTRHNNFTIRKYRAQLVGQICDEALQYAARLRELEPGWSATPGCQLHDAEQLWLDPLRAQTDETFLQRRLRGDWPAEVGNRFANWLNRAVSSDSQILGSPEAAQWSQELSKELTMFKEILEDERD

SEQ ID NO: 8091 - protein, 434 aa, Pseudomonas aeruginosa BL16; identical to SEQ ID NO: 7533

SEQ ID NO: 8092 - protein, 433 aa, Pseudomonas aeruginosa BL10
MSERPNGDSPTLRQLIESFIQERLQGKLDKLKPDEDVKRQSLLAGHRREAWLADAARRVGQLQLVTHTLKPIHPDARGSNLHSLPQAPGQPGLAGSHELGDKLVSDVVGNAAALDVFKFLSLQYQGKNLLNWLTEDSAEAVQALSDNAEQAREWRQAFIGITAVKGAPASHSLAKQLYFPLPGSGYHLLAPLFPTSLVHHVHGLLREARFGEAARAAREARSRQESWPHGFSEYPNLAIQKFGGTKPQNISQLNSERYGENWLLPSLPPHWQRQDQRAPIRHSSVFEHDFGRSPEVSRLTRTLQRLLAKTRHNNFTIRKYRAQLVGQICDEALQYAARLRELEPGWSATPGCQLHDAEQLWLDPLRAQTDETFLQRRLRGDWPAEVGNRFANWLNRAVSSDSQILGSPEAAQWSQELSKELTMFKEILEDERD

SEQ ID NO: 8093 - protein, 434 aa, Pseudomonas aeruginosa BWHPSA028; identical to SEQ ID NO: 8016

SEQ ID NO: 8094 - protein, 434 aa, Pseudomonas aeruginosa BWHPSA027; identical to SEQ ID NO: 7533

SEQ ID NO: 8095 - protein, 433 aa, Pseudomonas aeruginosa BWHPSA024; identical to SEQ ID NO: 8087

SEQ ID NO: 8096 - protein, 433 aa, Pseudomonas aeruginosa BWHPSA021; identical to SEQ ID NO: 8092

SEQ ID NO: 8097 - protein, 433 aa, Pseudomonas aeruginosa BWHPSA023; identical to SEQ ID NO: 8087

SEQ ID NO: 8098 - protein, 433 aa, Pseudomonas aeruginosa BWHPSA020; identical to SEQ ID NO: 8087

SEQ ID NO: 8099 - protein, 433 aa, Pseudomonas aeruginosa BWHPSA014; identical to SEQ ID NO: 8092

SEQ ID NO: 8100 - protein, 433 aa, Pseudomonas aeruginosa BWHPSA012; identical to SEQ ID NO: 8092

SEQ ID NO: 8101 - protein, 433 aa, Pseudomonas aeruginosa BWHPSA005; identical to SEQ ID NO: 8087

SEQ ID NO: 8102 - protein, 433 aa, Pseudomonas aeruginosa BWHPSA004; identical to SEQ ID NO: 8092

SEQ ID NO: 8103 - protein, 434 aa, Pseudomonas aeruginosa BWHPSA001
MTSPLPTPTWQELRQFIESFIQERLQGKLDKLHPDEDDKRQTLLATHRREAWLADAARRVGQLQLVTHTLKPIHPDARGSNLHSLPQAPGQPGLAGSHELGDKLVSDVVGNAAALDVFKFLSLQYQGKNLLNWLTEDSAEALQALSDNAEQAREWRQAFIGITTVKGAPASHSLAKQLYFPLPGSGYHLLAPLFPTSLVHHVHALLREARFGDAAKAAREARSRQESWPHGFSEYPNLAIQKFGGTKPQNISQLNNERRGENWLLPTLPPNWQRQDVNAPMRHSSVFEHDFGRTPEVSRLTRTLQRFLAKTVHNNLAIRQRRAQLVAQICDEALQYAARLRELEPGWSATPGCQLHDAEQLWLDPLRVQTDETFLQRRLRGDWPAEVGNRFANWLNRAVSSDSQILGSPEAAQWSQELSKELTMFKEILEDERD

SEQ ID NO: 8104 - protein, 433 aa, Pseudomonas aeruginosa UDL; identical to SEQ ID NO: 8087

SEQ ID NO: 8105 - protein, 434 aa, Pseudomonas aeruginosa CF18; identical to SEQ ID NO: 8103

SEQ ID NO: 8106 - protein, 434 aa, Pseudomonas aeruginosa MSH3; identical to SEQ ID NO: 7686

SEQ ID NO: 8107 - protein, 433 aa, Pseudomonas aeruginosa E2; identical to SEQ ID NO: 7863

SEQ ID NO: 8108 - protein, 433 aa, Pseudomonas aeruginosa BL02; identical to SEQ ID NO: 8087

SEQ ID NO: 8109 - protein, 434 aa, Pseudomonas aeruginosa BWHPSA010; identical to SEQ ID NO: 7604

SEQ ID NO: 8110 - protein, 434 aa, Pseudomonas aeruginosa BWHPSA008; identical to SEQ ID NO: 7629

SEQ ID NO: 8111 - protein, 434 aa, Pseudomonas aeruginosa BWHPSA009; identical to SEQ ID NO: 8103

SEQ ID NO: 8112 - protein, 433 aa, Pseudomonas aeruginosa CF5; identical to SEQ ID NO: 8087

SEQ ID NO: 8113 - protein, 434 aa, Pseudomonas aeruginosa MSH10; identical to SEQ ID NO: 7686

SEQ ID NO: 8114 - protein, 435 aa, Escherichia coli 908519; identical to SEQ ID NO: 7742

SEQ ID NO: 8115 - protein, 435 aa, Escherichia coli 908675; identical to SEQ ID NO: 7529

SEQ ID NO: 8116 - protein, 416 aa, Acinetobacter gyllenbergii NIPH 230
MAESIHAFLNERKELWLKDRLKRAESDVETSTLQHQANDKFSLNEWLPDAAKRVTQLAMVSHPSKFSHPSAKTSSLIAKAKHCNDGYLRSGNVEYSLDVFGNAAAMDVFKFLSLPLTEKMTVLDGFEQDNQELRALITHADLNFEALSSEFLKIKAADHSVKTDHLVKQVYFPINQSEYHLLSILTPSGLITRLKQAIDAMRFSEETKKSKELRKKNEHDEIGYTDIFDLTITAYGGTQPQNVSVLNSQNAGRAYLLSSRPPVLEKRTIRLPKTDFFMQCLYLKNYHDSFIQLHKFIQLDLNNTDIRNAVKNIIQFVIDQVLLQALKTRQYAIEGWTNQDYYANLPKIQRIWLDKAYQVERAENGDWRDELSREIARWILRSYEKVISDAYMLGTVELAEVKQRVENSLQQAKEFF

SEQ ID NO: 8117 - protein, 411 aa, Acinetobacter tjernbergiae DSM 14971 = CIP 107465
MIEEEYKKFLINQKNEWLNKSSNKGKFSEADERYHPELWFAKAIKNSRYAVTTHSSTFTHPDAKSTPILFFKESSNNGYLISNNVNLSKLFDVFGNAATDTIVKETYSFLTLKLADGCTIWQKFEEGTDTAKLFVQNLNQDFDQAYSNLNKIFVNKNETRTTGLLKQVYYHVDKADYHLLSLVVSSPLITEFVKRIDQIRFNISNKEAREYRRKQQHYEDGYSDLFDLTQVGFGGSKPQNVSVLNSQNAGRAYLLSTCPPKFENRNIKLPSQDFFQQCLYWKRFGSEFESLQKYVTGINNQHTRKKIKKILRQMVGDILFIAFCIRKNEKGWSQKEHYQSLALKQKIWLDDAYLDVRETESEWRDEIARRTAKWILDSFEDFYGSKLFGSPEIIELKGIVFEALDEDKEFF

SEQ ID NO: 8118 - protein, 437 aa, Klebsiella oxytoca MGH 42
MTTEALTHFIIDYIASRKQPKLDAFEKEAAKRLAQGEDAGAIAQERQELEVKYQPRNWLTDAARRAGQISLVTHAAKFTHGDSKSSSIYRETVGDEGYLSTAVLANVAADAVGNAAALDVAKLLQTEVGGDSLLACLKRGDRSPLMGFAENDAQLALWMEGFSQALTPAQPASHKLAKQIYFPVDGGYHLLSPLFATSLAQAMHEKMVAARFGEQAKAAREARRAGKWHAQPDVRYPNVSEMHFGGTKPQNISALNSSRGGRVWLLPSQPPKWTMLDKAPQNLTSLFALRGDFNRAATDTVSRMVSLLKEKTDNNNRHIRNARAGYVDELIDLLFLHAATYQQEAWQGWTLNSPDLPLHQQLWLDPWRSKTDETFRSEREKGDWQRSVADDFARWLNYRLNKARLDVGIAERREWQTQRLFSQRMREMEAIVQEALK

SEQ ID NO: 8119 - protein, 436 aa, Enterobacter roggenkampii MGH 34
MSVEALSAFIAEYIAGRRQTKLEAFDKEAAKRSAEDSATLAAERRELELRYEPKAWLTDAAKRAGQINLVTHAAKFTHGDSKSSSIYSEAVAQEGYLSTAALSGLEPDAVGNAAALDVAKLLQTRVNGGDSLLASLKRGDRAALAAFTDDANQLGEWIAGFSRALTSGEPASHKLAKQGYFPVGESYHLLSPLFATSLVHAMHQKMIAFRFGDDVKAIWKARREKTWHPTPLTLFPDSAEIHFGGTKPQNISYLNSVRGGRSWLLSCQPPQWKKADKPPTTLRSIFTLGGQFDRRANSTVQLLVSLLARTGDYTNVRIREARDEYIDALIDLLFVVASELQRDTWQNWTLSCERLVTHQQLWLDPWRTKTDEAFRLERDKDDWQVSVATDFALWLNARLSKALKDVGYVEQREWQTRERLRSNLREMEKIIREALK

SEQ ID NO: 8120 - protein, 437 aa, Klebsiella oxytoca MGH 28; identical to SEQ ID NO: 8118

SEQ ID NO: 8121 - protein, 435 aa, Enterobacter sp. MGH 23
MSVKALSAFIAEYIAGRRQTKLEAFHKAAAKRSEDSATLAAERRELERRYEPKAWLTDAAKRAGQINLVTHAAKFTHGDSKSSSIYSEAVAQEGYLSTAALSGLEPDAVGNAAALDVAKLLQTRVEGGDSLLASLKRGDHAALGAFTDDASQLREWIAGFSRALTPGKPASHKLAKQGYFPVGENYHLLSPLFATSLVHAMHQKMIASRFGDDVKAIWKARREKTWHPTPLILFPDSAEIHFGGTKPQNISYLNSVRGGRSWLLSCQPPKWKKSGKPPASLRSVFASGGQFDRRAKSHIQLLVSLLMKAGDYTNFRVREARDGYIDMIIDLLFEIASEFQRETAQNWTRNCPDLKPHQQLWLDPWRTKSDEAFRLEREKDDWQDAVAEDFALWLNARLRKSMPDVGAVEKREWETRERLRSNLREMEKIIQEALK

SEQ ID NO: 8122 - protein, 435 aa, Enterobacter sp. MGH 22
MSVKALSAFIAEYIAGRRQTKLEAFHKAAEKRSEDSATLAAERRELERRYEPKAWLTDAAKRAGQINLVTHAAKFTHGDSKSSSIYSEAVAQEGYLSTAALSGLEPDAVGNAAALDVAKLLQTRVEGGDSLLASLKRGDHAALGAFTDDASQLREWIAGFSRALTPGKPASHKLAKQGYFPVGENYHLLSPLFATSLVHAMHQKMIASRFGDDVKAIWKARREKTWHPTPLILFPDSAEIHFGGTKPQNISYLNSVRGGRSWLLSCQPPKWKKSGKPPASLRSVFASGGQFDRRAKSHIQLLVSLLMKAGDYTNFRVREARDGYIDMIIDLLFEIASEFQRETAQNWTRNCPDLKPHQQLWLDPWRTKSDEAFRLEREKDDWQDAVAEDFALWLNARLRKSMPDVGAVEKREWETRERLRSNLREMEKIIQEALK

SEQ ID NO: 8123 - protein, 444 aa, Serratia sp. ATCC 39006
MKENTLTHFILSYIEKRRQAKLDAFDKEAEKKRSPLSGEALAVAGLELAQARQVIEQRHEVRTWLTDAASRAGQISLVTHALKFTHSDAKGTSVFSPEAVKNATSLSTATLTQPAIDAVGNAAALDVAKLLQTEYEGDSLVAALQRHDYSALTALAESPEQLAQWLAGFQQVFTVRQPSSHKLAKQIYFPIGKGEYHLLSPLYASSLAQALYQRIIAVRFGDEAKAIRLAQKENRWHDQLSISYPNLAVQNMGGTKPQNISALNSTRSGRSYLLSCAPPQWQGEEKPPQQHQSIFRERGEVDYHTRAIIPLMRQFLLSVKEVENNREIRRLRLRYLDQLIDQLFCYVASIQNLRSGWSADSKLSRIQQLWLDPHRSNEDAVFRREREAGDWQKDVAYDFGRWLNRRLQHEKLIFGEAERREWSTAVLFKRRMREMESALKEELA

SEQ ID NO: 8124 - protein, 435 aa, Escherichia coli HVH 12 (4-7653042); identical to SEQ ID NO: 7529

SEQ ID NO: 8125 - protein, 435 aa, Escherichia coli HVH 148 (4-3192490); identical to SEQ ID NO: 7529

SEQ ID NO: 8126 - protein, 435 aa, Escherichia coli HVH 178 (4-3189163); identical to SEQ ID NO: 7529

SEQ ID NO: 8127 - protein, 444 aa, Pasteurella multocida subsp. multocida P1062; identical to SEQ ID NO: 7630

SEQ ID NO: 8128 - protein, 435 aa, Escherichia coli CE418; identical to SEQ ID NO: 7698

SEQ ID NO: 8129 - protein, 435 aa, Escherichia coli HVH 214 (4-3062198); identical to SEQ ID NO: 7529

SEQ ID NO: 8130 - protein, 416 aa, Acinetobacter baumannii CI86; identical to SEQ ID NO: 7679

SEQ ID NO: 8131 - protein, 416 aa, Acinetobacter baumannii CI79; identical to SEQ ID NO: 7679

SEQ ID NO: 8132 - protein, 434 aa, Pseudomonas aeruginosa Z61; identical to SEQ ID NO: 7686

SEQ ID NO: 8133 - protein, 433 aa, Pseudomonas aeruginosa BWHPSA048; identical to SEQ ID NO: 8087

SEQ ID NO: 8134 - protein, 434 aa, Pseudomonas aeruginosa BWHPSA044; identical to SEQ ID NO: 7533

SEQ ID NO: 8135 - protein, 433 aa, Pseudomonas aeruginosa BWHPSA040; identical to SEQ ID NO: 8092

SEQ ID NO: 8136 - protein, 434 aa, Pseudomonas aeruginosa BWHPSA038; identical to SEQ ID NO: 7686

SEQ ID NO: 8137 - protein, 435 aa, Escherichia coli BIDMC 49b; identical to SEQ ID NO: 7529

SEQ ID NO: 8138 - protein, 435 aa, Escherichia coli BIDMC 49a; identical to SEQ ID NO: 7529

SEQ ID NO: 8139 - protein, 436 aa, Enterobacter sp. BIDMC 28
MSVEALSAFIAEYIAGRRQTKLEAFDKEAAKRSDADSATIAAERRELELRYEPKAWLTDAAKRAGQINLVTHAAKFTHGDSKSCSIYSEAVAQEGYLSTAALSGLEPDAVGNAAALDVAKLLQTRVDGGDSLLASLKRGDHAALAAFADGENQLREWIAGFSRALTPGEPASHKLAKQGYFPVGEGYHLLSPLFATSLVHAMHQKMIAFRFGDEVKAIWKARREKTWHPTPLTLFPDAAEIHFGGTKPQNISYLNSVRGGRCWLLSCQPPQGKRAEKAPTNLRSVFASGGQFDRRARSQIQLLVSLLTKTGSYTSFRIREARDGYINMLIDLLFEIASELQREAWQNWTLNCPNLKPHQQLWLDPWRTKTDEAFRLEREKGDWQGAVAEDFALWLNARLRKAMPDLGAVEKREWETRERLRSNLREMEKIIQEALK

SEQ ID NO: 8140 - protein, 434 aa, Pseudomonas aeruginosa VRFPA09; identical to SEQ ID NO: 7592

SEQ ID NO: 8141 - protein, 247 aa, Clonorchis sinensis
MGFHSQNNGALNLTATTGYPGAYPFGSTEASRATYYSGFGWQQHSAYPVLSATSSLGISKPAFQFPFTSSSVAQFSGTTSSSNPALPFSPPQTSTSVGIEIHRSNLSSLGNNRPHSRSSKAQVQKPSHRVRPKKTVNPDEAANRKRQEFDELVKARTEKLLSDGPVYTPPGSGPLSSSSSGGGSTCTGNPSGDPSSPNYKKLIEAVLDAKKSELLRSPSVCAYLESRQRALAEFKRRTELFCVDLGK

SEQ ID NO: 8142 - protein, 418 aa, Pseudoalteromonas sp. BSi20652
MLDPAIQNYFIERKEAWLKKNVKASMEEYEIKELELLCEQQFSLNEWLPSAAKRAGQISMSTHPCTFSHPSARKNKNGYVSSVLAEIERIEDGYLKTGNVAVATDALGNAAALDVYKFLTLNMQDGCNLLTHIQDETELAQTLLTIKSTNYQELRAGFLTMIEGATESITSSKIKQVYFPVDDDYHQLSLLTNSGMVYQLRSRLDKLRFSDEVKELRDKKRKNEFSEQGYSEIYGLTTIGYGGTKPQNISVLNNQNGGKAHLLSSLPPSIEKRNIHFPKSNFFVESFKKYEYADHFKALHKLFQADYNNINIRDARDGYLQNIIDLLIEKMWAVRAVSQTQFHEGTSSLSSTQRTWLLANNIKERENSEQWLDLLVTEISAWLSRSYEKVLDKQAIKLGEAERLLFADIINRNREFFK

SEQ ID NO: 8143 - protein, 451 aa, Pseudoalteromonas sp. BSi20495
MEATLTQALADYIEQRKQAKLEPFQKALNKVLEKSENETEIATAKAEYAEKSAPIEEGYKAVVWLTDAARRAKQISLATHAAKFTHSDAKASSILVSQSCTDSQTINNQYLVTTSLTNKAIDAVGNAAALDVAKLLNITVNGESLITQLQQNHAQALSAFTDNAELLQTWIDGFKLALADEKLSSHNLSKQVYFPVKSENDDVGYHLLCPLFSSALAHNLHKKVTDTRFGDSKDIRDARRANKYDERMDISFPNTAVQSFGGSKPQNISQLNSERYGQNFLLNTAPPTFTAQVKPPINNTSLFNRQLTYKISGYLRDFKAFLSKLNPEENNFKVRYKRDYHFILPILDQLMIHAANIQTLPAGWASESHCKLKHAHALWLDVYNPHEGFKREREKLDWQAVIAADFASWLIKQLKNDEKYRLGDIEHAYFSKVCLHQLKRFEHNTPKLAEA

SEQ ID NO: 8144 - protein, 125 aa, Gordonia amarae NBRC 15530
MPDSRAQVLAVVNELADCTLAAEIVPLPKQWRSDDYLLFWLDPRVAEAEAERRTRRAISRWYDQHCGWRTGRIPVSETESIGADVRESLKGELEVFRSRLLQEYRTGGTVTEFSPDEMALVERWL

SEQ ID NO: 8145 - protein, 451 aa, Paraglaciecola chathamensis S18K6
MEATLTQALADYIEQRKKSKLEPFQKTLNKVLEKSENEIEIAAAKAEYEEKSSPIEGSYNPEVWLTDAARRAKQISLATHAAKFTHSDAKASSILVSQPCTDNQTVNNQYLVTASLTDKAIDAVGNAAALDVAKLLNITVNGENLITQLQQNHAQALSAFTDNVELLQTWIDGFKLALGDEKVSSHSLSKQVYFPITSEDGSVSYLLLCPLFSSALAHKLHKKVTETRFGDSKDIRDARRANKYDARIDVSFPNTAVQTFGGSKPQNISQLNSERYGQNFLLNTAPPIFQAQAKPPINSSSLFNRQLSYKVSGYLRDFKAFLSNVKPEENNFKVRYKRDYHFILPMLDQLMIHATNIQTLPAGWASEPYCQLKHAHALWLDVYNLNESFQREREKLDWQAVIAADFASWLIKQLKNDEKYRLGDIEHAYFSKVCLHQLKRFERNTPKLAEA

SEQ ID NO: 8146 - protein, 451 aa, Aliiglaciecola lipolytica E3
MEATLTQALADYIEQRKQAKLEPFQKALNKVLEKSENEIEIATAKAEYAEKSAPIEESYKPVVWLTDAAKRAKQISLATHAAKFTHSDAKASSILVSQPYTVSQTVNNQYLVTASISNKAIDAVGNAAALDIAKLLNITVNGESLITQLQQNHAQALSAFTDNEELLQTWVNGFKLALADEKLSSHSLSKQVYFPVKSEKDGFRYHLLCPLFSSALAHNLHKKVTGTRFGDSKNIRDARRSNKYDERIDVSFPDTAVQTFGGSKPQNISQLNSERYGQNFLLNTAPPTFQAQVKPPINNTSLFNRQLTFKVSGYLRDFKAFLSNLKPEENNFKVRYKRDYHFILPILDQLMIHAANIQTLPTGWATESHCKLKQAHALWLDVYNPHESFQREREKLDWQAVIAADFASWLMKQLKNDEKYRLGDIEHAYFSKVCLHQLKRFEHNTPKLAEA

SEQ ID NO: 8147 - protein, 440 aa, Paraglaciecola arctica BSs20135
MVDPAITTFFDERKAAWLKKNLTASMSQAEVREKEQECESVFTLKNWLPDAAKRAKSRAMTSHPSKFTHPSTGVGPKNIKNLTYVTPIICNAVLENDGFLRTGNVRLVDPIDSIGNAGELDVHEFLTLVMVDGRNLIQHLEQNTELALSLFTLPNIDETQNYASLKQGLLAMTSAGSDVVTSSKIKQVFFPTANQSDEKTAVTNSYHQLSILTASGVLFELRKRLDGMRFGDAIKLARDKKKNNQEHEGYCEIYNLTTIGYGGTQPQNISVLNSQNAGKAHLFMCASPQLKNRNMHFPNSDFFSQTVNYFQCKNQFYQLHKLYQRDDNNMHIRAERDEYYQSVIDHIIEKMWQVRSIALEQFNASENQLPSAQKTWLCEQDENKNLREGTDDWLDSIVKSVTTFLFYGYEKILGKKAIKLSDAEHKHMHKLVLLNKEALR

SEQ ID NO: 8148 - protein, 199 aa, Paraglaciecola polaris LMG 21857
MDELISIFLSKKLLTAKATNEEEKIEFIKLKSKVLKTKVTAANRPTFENFYCTLRDRGQIEDFSKDIDFISNKNNFVNIWICRTVELSEGVVPGTHIAKLSHSSSAGSSILDRSNIKDNRYLTTSSLAKEIVDGTYPDARLSKQVKFLLLEHKGIKLFDEILKGNYSVFSGLENNSDELKSWGKNTPRTYLNHLKQIFF

SEQ ID NO: 8149 - protein, 256 aa, Paraglaciecola polaris LMG 21857
MLSLLPSSSLVQKVYSSHFAKDVRKAREKTHKARLSETYSTDVSIRLPSVVRLLVTQSQPQNVSVLNGSRGGAIRLLSSRPPTWQNQLKPPINRKSWFEHGIPLSAIKEDVDYLRNFFLRFEQLNLSIKDPKKWAWLITWGNRILSTVLFYAQSIQNLPSGWSNAVDIKLKVAHQYFLDPYRTAEAFNKPKEASDWQNVVATDFAYWLNRKIQGNDKMFTPLVEHTKLWKELMLRQLREQNQMVKAVLAVTKEEQA

SEQ ID NO: 8150 - protein, 448 aa, Yersinia pseudotuberculosis NBRC 105692; identical to SEQ ID NO: 7552

SEQ ID NO: 8151 - protein, 426 aa, Bacillus sp. JCM 19047
MTDLQVKSTEQNGLHLHLGATDKFKTISIMLMVNAPLQEETVTARALIPHVLQGGTKDHPNRKRLKQKLEEMYGATLTADVQKKGEAKSLRFEWMSSEQYLKDSVSLVEEALTLLHQLVYQPVLEDGVFVTQTVEQEKRSLKQRIASIYDDKMRYANVRITEEMFQHEAYRLPPYGREKDLDQLNSQTLYDAYQSMLEQDRFDLYVIGSFQEEEVKQTVSRVFTEQHKAVNTVKPTKADKEIEQVHIVHDEQQVKQGKLHLGYRTHSTFSDDDYEAARVGNALFGGFPSSKLFINVREKEVLAYYAASQIESHKGVLMVMSGIEFDKYDRAVEIIQEQEKAMKKGDFSEAEVEQAKGMLLKQALEALDAPRGIAELSYHEIVANHRKSIQERIENIKTVTKEDVVRAVSKWELDTIYFLKGQGEKA

SEQ ID NO: 8152 - protein, 444 aa, Pasteurella multocida subsp. multocida str. Pm70; identical to SEQ ID NO: 7521

SEQ ID NO: 8153 - protein, 448 aa, Yersinia pestis KIM10; identical to SEQ ID NO: 51

SEQ ID NO: 8154 - protein, 122 aa, Coxiella burnetii RSA 493; identical to SEQ ID NO: 7523

SEQ ID NO: 8155 - protein, 469 aa, Chromobacterium violaceum ATCC 12472; identical to SEQ ID NO: 7524

SEQ ID NO: 8156 - protein, 452 aa, Photorhabdus luminescens subsp. laumondii TTO1; identical to SEQ ID NO: 7636

SEQ ID NO: 8157 - protein, 448 aa, Yersinia pestis biovar Microtus str. 91001; identical to SEQ ID NO: 51

SEQ ID NO: 8158 - protein, 434 aa, Pseudomonas aeruginosa UCBPP-PA14; identical to SEQ ID NO: 7533

SEQ ID NO: 8159 - protein, 272 aa, Acinetobacter baumannii
DNLSSEFLKIKATDDSIKTDHLVKQVYFPVGEAQYHLLSILTPSGLITRLKQSVDVMRFSEETKQAKESRKKNEHHEVGYSDIFDLTVTGYGGTQPQNVSVLNSQNAGRAYLLPSCPPVLEKRTIRLPKTDFFAQCLYRKNYQDSFIQLHKFMQLDLNNIDIRNAIKNIIQFVIDQILLQALKTREYAVEGWSNQDYYASLPKIQRIWLDKVHQKEREENSDWRDELSREVARWILRSYEKVISDAYTLGTGELLDVKQRVENSLQKAKEFF

SEQ ID NO: 8160 - protein, 425 aa, Vibrio mimicus; identical to SEQ ID NO: 7711

SEQ ID NO: 8161 - protein, 431 aa, Vibrio cholerae; identical to SEQ ID NO: 7764

SEQ ID NO: 8162 - protein, 435 aa, Escherichia coli; identical to SEQ ID NO: 7725

SEQ ID NO: 8163 - protein, 435 aa, Escherichia
MEKTALIQFITDYIASRRQPKIDAFEKEAAKRLEQGDDVSAIAQERQELEARYLPRNWLTDAAKRVRSIRIISHGAKYSNGDSKAYGRYLEKFVSEGYLNTASLAIIKEDAEGNAAFYDVAKILLTDVHGDSLLASLKRGDYQSLNAFALDDEQLKQWVECFSQAYASEWIKAHKLSKQIYFPVDDGYHLLCPLFSSSLAQAMYEKLTAVRFSEESKAIRDAHKAGKWHSQPDIRFPNLAEMHYGGGNQQNISLLNSARVGRVWLLPSMPPTWSTQERAPQNMRSIFALRGDFNRSASGTIARMTYLLKVDINNVHIRTTRAKYIDELIDLLFMQASSFQQEKWQGWSAQSPDLPRHQQLWLDPWRSLSDEAFKLEREKNDWQRTVADDFARWLNYRLKKASFDVGAVEQREWRSQSLFTQRMREMEAVLQEALK

SEQ ID NO: 8164 - protein, 435 aa, Escherichia coli; identical to SEQ ID NO: 7787

SEQ ID NO: 8165 - protein, 435 aa, Escherichia coli; identical to SEQ ID NO: 7649

SEQ ID NO: 8166 - protein, 435 aa, Escherichia coli; identical to SEQ ID NO: 7754

SEQ ID NO: 8167 - protein, 435 aa, Enterobacteriaceae; identical to SEQ ID NO: 7735

SEQ ID NO: 8168 - protein, 435 aa, Escherichia
MEKTALIQFITDYIASRRQPKIEAFEKEAAKRLEQGDDASVIALERQELEARYLPRNWLTDAAKRVRSIRIISHGAKYSNGDSKAYGRYLEKFVSEGYLNTASLAIIKEDAEGNAAVFDVAKLLLTEVNGDSLLASLKRGDYQSLNAFALDDEQLKQWVECFSEAYASEWIKAHKLSKQIYFPVDDGYHLLCPLFSSSLAQVMYEKLTAVRFSEESKAIRDAHKAGKWHSQPDIRFPNLAEMHYGGGNQQNISLLNSARVGRVWLLPSMPPTWAALDRAPQNMRSIFALRGDFNRAASGIIARMTYLLKVDKNNVHIRTARAKYIDELIDLLFMQASSFQQEKWQGWSAQSPDLPRHQQLWLDPWRSLSDEAFKQEREKNDWQETIADDFARWLNYRLKKARFDVGAVEQREWRSQSLFTQRMREMEAVLQEALK

SEQ ID NO: 8169 - protein, 435 aa, Escherichia coli; identical to SEQ ID NO: 7529

SEQ ID NO: 8170 - protein, 435 aa, Escherichia coli; identical to SEQ ID NO: 7742

SEQ ID NO: 8171 - protein, 416 aa, Acinetobacter baumannii; identical to SEQ ID NO: 7966

SEQ ID NO: 8172 - protein, 416 aa, Acinetobacter; identical to SEQ ID NO: 7679

SEQ ID NO: 8173 - protein, 416 aa, Acinetobacter baumannii
MAESIHTFLNERKELWLKDRIKKAENESAIAELQQQANDKFSLNEWLPDAAKRVTQLSMVSHPSKFSHPSAKTSSVIAKVEYCNDGYLRSGNVDYSLDVFGNAAAMDVFKFLSLALTENLTVLDGFEKQNQELKKLIAHAELDFDNLSSEFLKIKATDDSIKTDHLVKQVYFPVGEAQYHLLSILTPSGLITRLKQSVDAMRFSEETKQAKESRKKNEHHEVGYSDIFDLTVTGYGGTQPQNVSVLNSQNAGRAYLLPSCPPILEKRTIRLPKADFFAQCLYRKNYHDSFIQLHKFMQLDLNNIDIRNAIKNIIQFVIDQILLQALKTREYAVEGWSNQDYYASLPKIQRIWLDKVHQKEREENSDWRDELSREVARWILRSYEKVISDAYTLGTGELLDVKQWVENSLQKAKEFF

SEQ ID NO: 8174 - protein, 416 aa, Acinetobacter baumannii
MAESIHTFLNERKELWLKDRIKKAENESAIAELQQQANDKFSLNEWLPDAAKRVTQLSMVSHPSKFSHPSAKTSSVIAKVEYCNDGYLRSGNVDYSLDVFGNAAAMDVFKFLSLALTENLTVLDGFEKQNQELKKLIAHAELDFDNLSSEFLKIKATDDSIKTDHLVKQVYFPVGEAQYHLLSILTPSGLITRLKQSVDAMRFSEETKQAKESRKKNEHHEVGYSDIFDLTVTGYGGTQPQNVSVLNSQNAGRAYLLPSCPPVLEKRTIRLPKADFFAQCLYRKNYHDSFIQLHKFMQLDLNNIDIRNAIKNIIQFVIDQVLLQALKTREYAVEGWSNQDYYASLPKIQRIWLDKVHQKEREENSDWRDELSREVARWILRSYEKVISDAYTLGTGELLDVKQWVENSLQKAKEFF

SEQ ID NO: 8175 - protein, 149 aa, Acinetobacter baumannii
MAESIHTFLNERKELWLKDRIKKAENESAIAELQQQANYKFSLNEWLPDAAKRVTQLSMVSHPSKFSHPSAKTSSVIAKVEYCNDGYLRSGNVDYSLDVFGNAAAMDVFKFLSLALTENLTVLDGFEKQDQELKKLIAHAELDFDNLSS

SEQ ID NO: 8176 - protein, 416 aa, Acinetobacter; identical to SEQ ID NO: 7557

SEQ ID NO: 8177 - protein, 434 aa, Escherichia sp. TW11588
MNNNLVDFITDYIASRRQPKIDAFEKEAAKRLEQGDDASAIAQERQELEARYLPRNWLTDAAKRAGQIKLVTHGAKFSHGDSKASSFYLDTSANESYLNTASLAKVATDAIGNAAALDVAKLLQTDVNGDSLLASLKRGDYQALSTFAEDEAQLAQWIAGFRQAWTLAQPVSHKLAKQIYFPVDDGYHLLCPLFSSSLAQAMHEKLIAVRFSEESKAIRDARKAGKWHSQPDIRFPNLAEMHFGGTKPQNISLLNSVRGGRIWLLPSMPPTWTTQERAPQNMRSIFALRGDFNRSASGTIARMTYLLKVDINNVHIRTARAKYIDELIDLLFMQASSFQQEKWQGWSAQSPELPRHQQLWLDPWRSLSDEAFKLEREKNDWQRIVADDFARWLNYRLKKASFDVGAVEQREWRSQSLFTQRMREMETVLQEALK

SEQ ID NO: 8178 - protein, 434 aa, Escherichia albertii
MNNNLVDFITDYIASRRQPKIEAFEKEAAKRLEQGEDASVIAQERQELEARYLPRHWLTDAAKRAGQIKLVTHGAKFSHGDSKASSFYLETSANESYLNTASLANVATDAIGNAAALDVAKLLQTDVNGDSLLASLKRGDYQALSTFAEDKAQLEQWVAGFSQAWTTGRPASHKLAKQIYFPVADGYHLLCPLFSSSLAQAMYEKLTAVRFSEESKAIRDARKAGKWHSQPDIWFPNLAEMHFGGTKPQNISLFNSVRGGRVWLLPSMPPTWATLDRAPQNMRSIFALRGDFNRAASGIIARMTYLLKVDINNVHIRTARAKYIDELIDLLFMQASAFQQEKWQGWSAQSQDLPRHQQLWLDPWRSLSDEAFKLDREKNDWQETVADDFARWLNYRLKKSRFDVGAVEQREWRSQSLFTQRMREMEAVLQEALK

SEQ ID NO: 8179 - protein, 435 aa, Escherichia coli; identical to SEQ ID NO: 7698

SEQ ID NO: 8180 - protein, 435 aa, Escherichia; identical to SEQ ID NO: 7891

SEQ ID NO: 8181 - protein, 435 aa, Escherichia coli; identical to SEQ ID NO: 7892

SEQ ID NO: 8182 - protein, 435 aa, Escherichia coli; identical to SEQ ID NO: 7894

SEQ ID NO: 8183 - protein, 435 aa, Escherichia coli; identical to SEQ ID NO: 7895

SEQ ID NO: 8184 - protein, 435 aa, Escherichia coli; identical to SEQ ID NO: 7935

SEQ ID NO: 8185 - protein, 435 aa, Escherichia coli; identical to SEQ ID NO: 7936

SEQ ID NO: 8186 - protein, 435 aa, Escherichia coli; identical to SEQ ID NO: 7942

SEQ ID NO: 8187 - protein, 426 aa, Vibrio cholerae; identical to SEQ ID NO: 7866

SEQ ID NO: 8188 - protein, 168 aa, Vibrio cholerae; identical to SEQ ID NO: 7874

SEQ ID NO: 8189 - protein, 154 aa, Vibrio cholerae; identical to SEQ ID NO: 7878

SEQ ID NO: 8190 - protein, 442 aa, Yersinia pestis
MRVIVSYIKSREQPKLHYLDKEAEKRLAGLFQAEDIALAQQEIAQQRQELIARYEVRNWLTDAANRAGQIKLATHAPKYTHSDSKSSGILNIELQSKKKDYFSSVDLAEQASDVIGNAAVFDLVKLLQSECEGGSLIKCLEQGDNSVLKLFSNDDELVEEWTTKFKSILNNEKFTSHKLAKQFYFPVGPDQYHLLSPLFSSSLAQAMHQRIIEARFSDQSKEAKAAHKAGRWHPTVRVLYLDTAVQHIGGTKPQNISYLNSVRGGKVWLLPCGAPSWKNIQKPPIKYRSIFHDRSEFTVLARNNLWQMQLYLLGVKPLSNTMDIRAARLACCDEIIDILFNYVAEIQNLDGTNGWSDAEDCKLKRSEQLWLDPTRAMDDPVFKLEREKEDWKQEVSQDFGYWLNRWLQHDELVFGYVEQREWSSLFKQRLREFEQGSLETSS

SEQ ID NO: 8191 - protein, 448 aa, Yersinia pestis; identical to SEQ ID NO: 51

SEQ ID NO: 8192 - protein, 442 aa, Yersinia pestis; identical to SEQ ID NO: 7695

SEQ ID NO: 8193 - protein, 208 aa, Clostridium innocuum; identical to SEQ ID NO: 7767

SEQ ID NO: 8194 - protein, 1072 aa, Cystobacter fuscus
MDRETIVERLERDLVGPPGGEETLSARPSDVYLTGILWPRQTRMGAEEDDRLGVGSGDEDTGGPASEEEEVSLAGLSRPCSAGISFAVAAEPGTPAVKVTLRCATYTSREAESQAKRSAKGRPQLEWVRRQHILELEPIPCESASRELDLANLPSGVHCEAMTPHGIPAGLKLHVRTANWERGRLVTLTALNTAVPDESEGRNGIEHATLFQVVIEVKPCPGTQLVARPSRRAIVDDEDRSAALLYRRAREFAAGHTCSVTWSTERDAAHASSISTTWVPRAIVPAVSARGHEVFSSLSGGESLPLSADWLSTASDVQLRLALMRLVNAYREWIVLREAEIPGLPAELRSTGLHSLATCRTTADRMEEGVRQISGNPKAALAFRLANRAMLMQHGWDPDKRKGGPLMWRPFQLGFFLLSVASLADRSHPHRGIMDLLWFPTGGGKTEAYLALIAFLTFHRRLTAADGPDSGAGVAALMRYTLRLLTTQQFSRAAAMMLACEAMRRRKAPGVPAGIELGSTPFSIGLWVGGEATPNKFDVAREALSGSSNVASPKQLLECPACGASLRWEPKVPERSIHVRCLTPDCLLYDPELPLPVWTVDEDVYRKQPTLLIGTVDKFAQIVRKEEVNQLFAIGRGLAPDLIIQDELHLISGPLGTVVGLYEAAVDSLFTREGRRPKIIGSTATIRRAADQVGALFGRETCQFPPPGLSAADSGFAVEDTEAPGRLYAAVTTAGRSAKFSLQGTAASLLQSAQAAFPSVDAADPYWTLVAYFNSLRELGGALVLMQDDVADTVGMYATRRGEPPRPVKAVEELTSRRSQDEVRDMLGLLATKAGKDGALDAVLASNMLSVGVDVPRLGVMLVNGQPKGTAEYIQATSRVGRRHPGLVVAVLNNAKARDRSHFETFPTWHATLYRDVEATSVTPFSSRARDRALHAVLVALVRHLVPGMLKRPDLDAADPAALQAIVDGLVARARAVDPSEKDVLSELTDRLEQWRARSPQRYWEDRMHRQSLLQSAERVATMRALGRSPGEAWATLNNMRNVEPSAHFRLAERLKDTTAAGGKTGGDNGQQ

SEQ ID NO: 8195 - protein, 451 aa, Xanthomonas fragariae; identical to SEQ ID NO: 7982

SEQ ID NO: 8196 - protein, 450 aa, Nitrosococcus oceani; identical to SEQ ID NO: 7528

SEQ ID NO: 8197 - protein, 455 aa, Thauera sp. 28; identical to SEQ ID NO: 7952

SEQ ID NO: 8198 - protein, 369 aa, Pseudomonas aeruginosa; identical to SEQ ID NO: 7784

SEQ ID NO: 8199 - protein, 434 aa, Pseudomonas; identical to SEQ ID NO: 7533

SEQ ID NO: 8200 - protein, 433 aa, Pseudomonas aeruginosa; identical to SEQ ID NO: 7863

SEQ ID NO: 8201 - protein, 433 aa, Pseudomonas aeruginosa; identical to SEQ ID NO: 7674

SEQ ID NO: 8202 - protein, 453 aa, Pseudomonas oleovorans; identical to SEQ ID NO: 7668

SEQ ID NO: 8203 - protein, 456 aa, Moraxella catarrhalis; identical to SEQ ID NO: 7744

SEQ ID NO: 8204 - protein, 456 aa, Moraxella catarrhalis; identical to SEQ ID NO: 7746

SEQ ID NO: 8205 - protein, 456 aa, Moraxella; identical to SEQ ID NO: 7745

SEQ ID NO: 8206 - protein, 456 aa, Moraxella catarrhalis; identical to SEQ ID NO: 7749

SEQ ID NO: 8207 - protein, 457 aa, Moraxella catarrhalis; identical to SEQ ID NO: 7750

SEQ ID NO: 8208 - protein, 457 aa, Moraxella catarrhalis; identical to SEQ ID NO: 7752

SEQ ID NO: 8209 - protein, 303 aa, Listeria monocytogenes; identical to SEQ ID NO: 7526

SEQ ID NO: 8210 - protein, 303 aa, Listeria monocytogenes; identical to SEQ ID NO: 7720

SEQ ID NO: 8211 - protein, 303 aa, Listeria monocytogenes; identical to SEQ ID NO: 7620

SEQ ID NO: 8212 - protein, 303 aa, Listeria monocytogenes
MIKLTNVVKKFGKVEAVKGINLEVEKGSLFAFLGENGAGKSTTLSMICTESEPTSGEIFIADEKLTFKNRKSFRQKLGVVFQENVLDDLLTVRENLYNRASLYGKTKAEISERLELVSSIMGIEDILNRRFEKLSGGQKRRAEIARAIMHDPEILLLDEPTTGLDPKTRVSVWKIIDYLREELGMTVFLTTHYLEEAKDADQLAVIHKGKIIAQGTPANIRSRFSVDKIFFYDAKVAELQAIIEKVNLPLKITKETMRVDVINQDVEILAILNQAAGLYGSFEVIKGNLDDAFISMIKEDSND

SEQ ID NO: 8213 - protein, 425 aa, Hafnia alvei; identical to SEQ ID NO: 7780

SEQ ID NO: 8214 - protein, 241 aa, Morganella; identical to SEQ ID NO: 7928

SEQ ID NO: 8215 - protein, 386 aa, Acinetobacter lwoffii; identical to SEQ ID NO: 7716

SEQ ID NO: 8216 - protein, 434 aa, Pseudomonas; identical to SEQ ID NO: 7686

SEQ ID NO: 8217 - protein, 434 aa, Pseudomonas aeruginosa; identical to SEQ ID NO: 7687

SEQ ID NO: 8218 - protein, 447 aa, Yersinia kristensenii; identical to SEQ ID NO: 7706

SEQ ID NO: 8219 - protein, 108 aa, Corynebacterium otitidis; identical to SEQ ID NO: 7861

SEQ ID NO: 8220 - protein, 111 aa, Corynebacterium otitidis; identical to SEQ ID NO: 7669

SEQ ID NO: 8221 - protein, 416 aa, Acinetobacter bohemicus; identical to SEQ ID NO: 7953

SEQ ID NO: 8222 - protein, 413 aa, Acinetobacter proteolyticus; identical to SEQ ID NO: 7954

SEQ ID NO: 8223 - protein, 416 aa, Acinetobacter; identical to SEQ ID NO: 7955

SEQ ID NO: 8224 - protein, 401 aa, Yersinia rohdei; identical to SEQ ID NO: 7707

SEQ ID NO: 8225 - protein, 422 aa, Acinetobacter lwoffii; identical to SEQ ID NO: 7956

SEQ ID NO: 8226 - protein, 416 aa, Acinetobacter baumannii; identical to SEQ ID NO: 7958

SEQ ID NO: 8227 - protein, 444 aa, Acinetobacter sp. ANC 3789; identical to SEQ ID NO: 7959

SEQ ID NO: 8228 - protein, 416 aa, Acinetobacter sp. CIP 102129; identical to SEQ ID NO: 7961

SEQ ID NO: 8229 - protein, 416 aa, Acinetobacter sp. CIP 102637; identical to SEQ ID NO: 7964

SEQ ID NO: 8230 - protein, 416 aa, Acinetobacter sp. CIP 56.2; identical to SEQ ID NO: 7965

SEQ ID NO: 8231 - protein, 397 aa, Acinetobacter gerneri; identical to SEQ ID NO: 7967

SEQ ID NO: 8232 - protein, 437 aa, Acinetobacter; identical to SEQ ID NO: 7968

SEQ ID NO: 8233 - protein, 241 aa, Morganella morganii; identical to SEQ ID NO: 7615

SEQ ID NO: 8234 - protein, 417 aa, Acinetobacter; identical to SEQ ID NO: 7969

SEQ ID NO: 8235 - protein, 423 aa, Providencia stuartii; identical to SEQ ID NO: 7697

SEQ ID NO: 8236 - protein, 413 aa, Acinetobacter junii; identical to SEQ ID NO: 7970

SEQ ID NO: 8237 - protein, 416 aa, Acinetobacter; identical to SEQ ID NO: 7980

SEQ ID NO: 8238 - protein, 416 aa, Acinetobacter; identical to SEQ ID NO: 7971

SEQ ID NO: 8239 - protein, 178 aa, Acinetobacter haemolyticus; identical to SEQ ID NO: 7972

SEQ ID NO: 8240 - protein, 255 aa, Acinetobacter haemolyticus; identical to SEQ ID NO: 7973

SEQ ID NO: 8241 - protein, 416 aa, Acinetobacter baumannii; identical to SEQ ID NO: 7974

SEQ ID NO: 8242 - protein, 444 aa, Acinetobacter sp. NIPH 284; identical to SEQ ID NO: 7978

SEQ ID NO: 8243 - protein, 125 aa, Gordonia amarae; identical to SEQ ID NO: 8144

SEQ ID NO: 8244 - protein, 413 aa, Acinetobacter sp. ANC 3862; identical to SEQ ID NO: 7979

SEQ ID NO: 8245 - protein, 282 aa, Aeromonas veronii
MGWHSGHEKLYFPNSQQFFNGGYNDRTYILTCKQHIDAININKLSSFNELKLRIHVQLLSDLISGYVQFDHIQPLLKRVEASLNSLERVFDIGDTPPSNKLLSIISLRKTNQEIKKILPLLLAKYYYSSHKQKVINQSPPKHTFHMIIDEAHNILSTQSNRESESWKDYRLELFEEIIKEGRKFGFFLTLSSQRPADISPTIMSQLHNFFIHRLVNDRDLKLLESTISSLDDLSRQMIPNLAKGCAVITGTSFDIPMVVQFNEMAEGSRPDSDDIDIGNLWG

SEQ ID NO: 8246 - protein, 412 aa, Methylomicrobium album; identical to SEQ ID NO: 7783

SEQ ID NO: 8247 - protein, 419 aa, Shewanella benthica; identical to SEQ ID NO: 7690

SEQ ID NO: 8248 - protein, 448 aa, Aggregatibacter actinomycetemcomitans; identical to SEQ ID NO: 7601

SEQ ID NO: 8249 - protein, 140 aa, Aggregatibacter actinomycetemcomitans; identical to SEQ ID NO: 7769

SEQ ID NO: 8250 - protein, 184 aa, Aggregatibacter actinomycetemcomitans; identical to SEQ ID NO: 7768

SEQ ID NO: 8251 - protein, 112 aa, Aggregatibacter actinomycetemcomitans; identical to SEQ ID NO: 7771

SEQ ID NO: 8252 - protein, 60 aa, Aggregatibacter actinomycetemcomitans; identical to SEQ ID NO: 7772

SEQ ID NO: 8253 - protein, 172 aa, Aggregatibacter actinomycetemcomitans; identical to SEQ ID NO: 7773

SEQ ID NO: 8254 - protein, 449 aa, Actinobacillus pleuropneumoniae; identical to SEQ ID NO: 7726

SEQ ID NO: 8255 - protein, 449 aa, Actinobacillus pleuropneumoniae; identical to SEQ ID NO: 7723

SEQ ID NO: 8256 - protein, 449 aa, Actinobacillus pleuropneumoniae; identical to SEQ ID NO: 7728

SEQ ID NO: 8257 - protein, 449 aa, Actinobacillus pleuropneumoniae; identical to SEQ ID NO: 7550

SEQ ID NO: 8258 - protein, 449 aa, Actinobacillus pleuropneumoniae; identical to SEQ ID NO: 7731

SEQ ID NO: 8259 - protein, 449 aa, Actinobacillus pleuropneumoniae; identical to SEQ ID NO: 7554

SEQ ID NO: 8260 - protein, 85 aa, Actinobacillus ureae; identical to SEQ ID NO: 7737

SEQ ID NO: 8261 - protein, 174 aa, Actinobacillus ureae; identical to SEQ ID NO: 7738

SEQ ID NO: 8262 - protein, 116 aa, Actinobacillus ureae; identical to SEQ ID NO: 7739

SEQ ID NO: 8263 - protein, 152 aa, Pasteurella multocida; identical to SEQ ID NO: 7761

SEQ ID NO: 8264 - protein, 34 aa, Pasteurella multocida; identical to SEQ ID NO: 7759

SEQ ID NO: 8265 - protein, 359 aa, Pasteurella multocida; identical to SEQ ID NO: 7762

SEQ ID NO: 8266 - protein, 94 aa, Pasteurella multocida; identical to SEQ ID NO: 7760

SEQ ID NO: 8267 - protein, 94 aa, Pasteurella multocida; identical to SEQ ID NO: 7855

SEQ ID NO: 8268 - protein, 346 aa, Pasteurella multocida; identical to SEQ ID NO: 7854

SEQ ID NO: 8269 - protein, 444 aa, Pasteurella multocida; identical to SEQ ID NO: 7859

SEQ ID NO: 8270 - protein, 401 aa, Pasteurella multocida; identical to SEQ ID NO: 7860

SEQ ID NO: 8271 - protein, 444 aa, Pasteurella dagmatis; identical to SEQ ID NO: 7714

SEQ ID NO: 8272 - protein, 418 aa, Coxiella burnetii; identical to SEQ ID NO: 7685

SEQ ID NO: 8273 - protein, 418 aa, Coxiella burnetii; identical to SEQ ID NO: 7692

SEQ ID NO: 8274 - protein, 130 aa, Acidovorax delafieldii; identical to SEQ ID NO: 7708

SEQ ID NO: 8275 - protein, 148 aa, Acidovorax delafieldii; identical to SEQ ID NO: 7709

SEQ ID NO: 8276 - protein, 401 aa, Mitsuokella multacida; identical to SEQ ID NO: 7715

SEQ ID NO: 8277 - protein, 420 aa, Oxalobacter formigenes; identical to SEQ ID NO: 7701

SEQ ID NO: 8278 - protein, 131 aa, Faecalibacterium prausnitzii; identical to SEQ ID NO: 7689

SEQ ID NO: 8279 - protein, 444 aa, Pectobacterium wasabiae; identical to SEQ ID NO: 7858

SEQ ID NO: 8280 - protein, 67 aa, Prevotella pallens; identical to SEQ ID NO: 7763

SEQ ID NO: 8281 - protein, 435 aa, Enterobacter cancerogenus; identical to SEQ ID NO: 7718

SEQ ID NO: 8282 - protein, 103 aa, Mesorhizobium sp. STM 4661; identical to SEQ ID NO: 7675

SEQ ID NO: 8283 - protein, 449 aa, Chlorobium ferrooxidans; identical to SEQ ID NO: 7684

SEQ ID NO: 8284 - protein, 388 aa, Anaeroglobus geminatus; identical to SEQ ID NO: 7779

SEQ ID NO: 8285 - protein, 702 aa, Salinisphaera shabanensis
MRKLALLFLIALFVFAQTGCAADSPADPEPVPDAGGGTAEGYSPLVPEDNQGEIDREIVKQLQQNHYNKVELNDAFSEKFFNAYLDELDGTRGVFLQSDIDRLRDKYEHALDDELKQGQTRAAFDIYNTYQKRRIQIDQWALDRIEQGIDSLNIDDDESFEIDRENAPWPANAAEREALWTKQLENQLINLRLNDLDEAEVEKRLTQRYSNELKQLRQTEPMDAFSAYMDAYTHSYDPHTDYFSPRRSEDFNIDMNLQLQGIGAELRSKNGYAELVRLIPGGPAAKSGKLKPTDQIIAVGQGESGEFTDVVGMRLDETVQLIRGEKGSTVRLQISSQDGSQTKTVVLVRDKIELKDQAARKQIIEIERGGQTVDVGLITLPSFYNGTAKDVKNLVEELKKNEDLAGIVLDLRNNGGGALGEAMKLTGLFMNSVPVVQIRDADGNVQVLGDRNDGPLYDGPLAVMVNRLSASASEIVAGALQDYGRAIVLGGQTFGKGTVQTLMPLSEGQIKLTQAKFYRVSGESTQDRGVTPDLTFPAAIDPSKIGESALPNALPWDRIKPTTFPYSDEIVQLLDTLKRGHTLRIENDPDYQYRVDRIRLARQQSEKTRVSLNLEERRAEQETLKQQSLKLANVHRKATGEQPFENYAAFEESEEGEDPQEQELSAHTLETGDEVDAYQTESARILLDLVEAFIREKQSAAS

SEQ ID NO: 8286 - protein, 389 aa, Dialister invisus; identical to SEQ ID NO: 7713

SEQ ID NO: 8287 - protein, 199 aa, Paraglaciecola polaris; identical to SEQ ID NO: 8148

SEQ ID NO: 8288 - protein, 256 aa, Paraglaciecola polaris; identical to SEQ ID NO: 8149

SEQ ID NO: 8289 - protein, 454 aa, Halomonas boliviensis; identical to SEQ ID NO: 7777

SEQ ID NO: 8290 - protein, 412 aa, Enhydrobacter aerosaccus; identical to SEQ ID NO: 7710

SEQ ID NO: 8291 - protein, 455 aa, delta proteobacterium MLMS-1; identical to SEQ ID NO: 7683

SEQ ID NO: 8292 - protein, 440 aa, Paraglaciecola arctica; identical to SEQ ID NO: 8147

SEQ ID NO: 8293 - protein, 433 aa, Cellvibrio sp. BR; identical to SEQ ID NO: 7786

SEQ ID NO: 8294 - protein, 283 aa, Burkholderia
MHYLTISRVGNARCIDAPATLKRYGFPAAYRGSIVKNLLNMRRAAVSNGAAAHFHFPPQNAPQAEPARVDDLPASESDAGATIEARPASSPPRPVTPLHAVQVTPSAPNGRAVQLADAADVERMSDNAELTTFHTFRTFDYSVSLLFYPKEMKYFAALFQEDRLWRVLSTSDINTARQLFHHMQDQATRLSDGETRRLQLEAQNEQLKRAIAESEAHAERLRQGLQRTTEQDQAVTSRQHQLRKELAQLEAQRTAAQAQLNKVHRQVHQLNVANNETIPHMPR

SEQ ID NO: 8295 - protein, 437 aa, Cronobacter dublinensis; identical to SEQ ID NO: 7670

SEQ ID NO: 8296 - protein, 451 aa, Paraglaciecola chathamensis; identical to SEQ ID NO: 8145

SEQ ID NO: 8297 - protein, 451 aa, Pseudoalteromonas sp. BSi20495; identical to SEQ ID NO: 8143

SEQ ID NO: 8298 - protein, 418 aa, Pseudoalteromonas sp. BSi20652; identical to SEQ ID NO: 8142

SEQ ID NO: 8299 - protein, 206 aa, Rhodanobacter sp. 115; identical to SEQ ID NO: 7789

SEQ ID NO: 8300 - protein, 456 aa, Zhongshania aliphaticivorans; identical to SEQ ID NO: 7785

SEQ ID NO: 8301 - protein, 456 aa, Alishewanella aestuarii; identical to SEQ ID NO: 7850

SEQ ID NO: 8302 - protein, 420 aa, Rhodopirellula maiorica; identical to SEQ ID NO: 7927

SEQ ID NO: 8303 - protein, 451 aa, Aliiglaciecola lipolytica; identical to SEQ ID NO: 8146

SEQ ID NO: 8304 - protein, 456 aa, Rheinheimera sp. A13L; identical to SEQ ID NO: 7758

SEQ ID NO: 8305 - protein, 423 aa, Providencia burhodogranariea; identical to SEQ ID NO: 7887

SEQ ID NO: 8306 - protein, 450 aa, Neisseria sp. oral taxon 014; identical to SEQ ID NO: 7721

SEQ ID NO: 8307 - protein, 460 aa, Halomonas titanicae; identical to SEQ ID NO: 7926

SEQ ID NO: 8308 - protein, 99 aa, Desulfosporosinus sp. OT; identical to SEQ ID NO: 7765

SEQ ID NO: 8309 - protein, 428 aa, Marinomonas sp. MED121; identical to SEQ ID NO: 7682

SEQ ID NO: 8310 - protein, 449 aa, Actinobacillus pleuropneumoniae; identical to SEQ ID NO: 7538

SEQ ID NO: 8311 - protein, 434 aa, Pseudomonas aeruginosa; identical to SEQ ID NO: 8103

SEQ ID NO: 8312 - protein, 451 aa, Verminephrobacter aporrectodeae
MAETDAPAYSSFQAAVQAFIQERLQTKLDKLKEDDPERERLRARYQPAAWIEDAAQRVQQIQAVTHSLKPIHPDARGTQLYAEPSSLPTLSELGSHALGNAFDFDVVGNAAALDVYKFLKLEVNGRSLLTALQEEDASALRALHGDATQAKTLRNALLRLTQPRSDRTSSHTRAKQLYWLTGSDACADDSYELLAPLFATSLAHGVHAQVQEARFGEANKAARQARRERRAHGGVFVDYPGLAVQKMGGTKPLNISQLNSERGGVNYLLASLPPIWQPRRQRLPVNTDSVFKHLYPERPGVRNTVRALRRFLERDPRPNQATRERRAADIEKLVDELVMLATKLQQSLAPGWTRDDERFHKLARAEQLWLDPLRAELPGEDDFAKEWRWMDWPNTIGRFFANWLNAKLAGQLPVGDVEAREWQRTLLVKDDGWRETLAEQRRRIDGQRDSR

SEQ ID NO: 8313 - protein, 452 aa, Psychrobacter sp. PAMC 21119
MENITQAQIKQAINSFLSAQYDKKAMPMLKGLEKALQDNDVEASEKIEAELKKSEEKYAQDTWMAYASGWMSTQLSFGTHISKGVHASSKGDNLIYVPLSDSDDRPFSGHHSLANPIIDASGNAAALPFAAFVQTIVVDNITIGDLIKNQNAALKGAFHSDSKMSDHINSVFYKLVIAHIDTPFIDEYNKQILFPSADSYVCLAPLYPASLTHYIFTYIQTIKFSDENALAKKNRSKVTEEQKPYLTIHDLAVLNIGGSNPQGVSQLMSKKRGKTYLLPSLPPSFTQSEALPFSKHARSIFNAKTMAYKTRRTLDALYKIITANHNNMTLRDARKSILDDLLLQILKITNTIQTNRPAGWSIAYHQLDYAEKLWLDPHRGALADEETFKADFEKGDWQREIEKKFASWLQELLKKEFPKIKNDFDDPEHNEWEKEMQIALTESKRLGQGAFR

SEQ ID NO: 8314 - protein, 520 aa, Alistipes timonensis
MNMNGCLNILWHFPFFGFLFAFFYALFGAILCCTVVLYPVGLGFFQIARFLLTPFSSALVTRKELDLVRPEERSTAAAAFSTVITILYFPFGLIAAAGALFAMIGEFLSIIGIPCGIVWFKALPAIFMPVDKICVPKAVADEIARIKAGDTVRRYKGETGEPEPHSAERHFTEDPGETLPPMPEVRQYDDEKLHEIVSDAAMYRASLVEECRRELEIRSRSAEFTAQVRAMDNDKLHEVLASPQLYAEELIYACTLEQNERRRVWREEQAKEEEKLRLRREQEEKAAAERRTALWKKNRPYLFAALAVLILVGAGIKYHNYRKEQVRLEQERIAAEERRIAEERRAEEQRIAEQKQAEAERIAAEKRRKEAERLAAERQQQAEAQRKADRERREAGYYKPGELYEKDGVKGVVFTANGTHGQYIRLKQGRSMPWSTANREGNLPSMDEMKEIYRLLKTLNLTLKQAHGDCIEGSYWLSGRRNGIVWFCNMEATSWETHNCTEYDVRSKPYVKNALWIKSY

SEQ ID NO: 8315 - protein, 444 aa, Pectobacterium brasiliense
MEESRLTRFIVSYINNRKQAKLDAFDKEAEKKRATLSGEDLAAEELDLAEKRREIEQKHEVRAWLSDAASRAGQISLVTHALKFTHSDAKGTSVFSTGTVTEAKTLSTATLAQPAIDAVGNAAALDVAKLLQTEHDGDSLVAALQRGDHHALEKLAENPEQLAQWLVGFQQVFTDRQPSSHKLAKQIYFPIANGEYHLLSPLYSSSLAQALHQRINTVRFGDEVKAIRQAQKANQWHEQLSISYPYLAVQNMGGTKPQNISSLNSSRSGRSYLLSSAPPQWNSIEKPPQQHDSIFRPRGEVDYHTRATLAQMQRFLLSVKEVENNRDIRHQRLRYLDQLIDQLFFYVSSVQNLPSGWSAESELKRAQQLWLDPYRAETDTVFRREREAGDWQKAVAYDFGRWLNRRLKHEDLIFGEIERREWSTAALFKRRMREMESALKEDLA

SEQ ID NO: 8316 - protein, 444 aa, Pectobacterium carotovorum
MSGEKLKAFILSYINTRKQAKLDAFDKEAEKKRATLSGEALAEEELELSEKRREIEQKHEVRAWLTDAASRAGQISLVTHALKFTHSDAKGSSIFSAETVADAKTLSTATLAQPAIDAVGNAAALDVAKLLQTEHEGDSLVAALQRGDHSALEALAESPEQLAQWLASFQQVFTDRQPSSHKLAKQIYFPLENGEYHLLSPLYSSSLAHALHQRVNAVRFGDEAKAIRQAQKANQWHDQLSISYPYLAVQNMGGTKPQNISSLNSSRSGRSYLLSCAPPQWNSIEKPPQQHDSIFRPRGEVDYHTRATLALMQRFLLSVKEVENNRDIRQQRLHYLDQLIDQLFFYVTSVQNLPEGWSTESELKRAQQLWLDPYRAETDTVFRREREAGDWQKAVAYDFGRWLNRRLKHEELIFGEVERREWSTAALFKRRMREMESALKEDLA

SEQ ID NO: 8317 - protein, 423 aa, Vibrio
MEGTKVLDPAISTFFAERKEAWRKKNIKADMEEWEVREKERVCEQQFQLANWLPDAAKRAGQISLSSHPCTFSHPSARKNKNGYVSSIIAQNKSQADGFLRSGNINVELDALGNAAALDVHKFLTLVMFDNRRLLEHIEQESDFAQLLLNQPNCNYHELRDGFLKMIESDEEVVSSSKIKQVYFPIEDGEYHLLSLLTHSGHLFEQRKRIDNLRFGEELKQARECKKSNQYHPNGYREIFGLTTIGFGGTKPQNISVLNNQNAGKAHLLASAPPELKPRNLRLPKTDFFKDSLNPWQGKEVLEALHRLFNIDYNNINIREGRDYRIQEYVDLVIDKMWQVRILLAEYHGELSSELKVEQQIWLYPQFEQQRFEDDEWLDSIIRQISRSLINHYQKVITNPVSLADQELLAIERIVTNNKEALR

SEQ ID NO: 8318 - protein, 430 aa, Pseudoalteromonas citrea; identical to SEQ ID NO: 8071

SEQ ID NO: 8319 - protein, 444 aa, Pasteurella multocida; identical to SEQ ID NO: 7521

SEQ ID NO: 8320 - protein, 122 aa, Coxiella burnetii; identical to SEQ ID NO: 7523

SEQ ID NO: 8321 - protein, 443 aa, Pectobacterium atrosepticum; identical to SEQ ID NO: 7637

SEQ ID NO: 8322 - protein, 469 aa, Chromobacterium violaceum; identical to SEQ ID NO: 7524

SEQ ID NO: 8323 - protein, 452 aa, Photorhabdus; identical to SEQ ID NO: 7636

SEQ ID NO: 8324 - protein, 448 aa, Yersinia pseudotuberculosis; identical to SEQ ID NO: 7552

SEQ ID NO: 8325 - protein, 421 aa, Legionella pneumophila; identical to SEQ ID NO: 7639

SEQ ID NO: 8326 - protein, 421 aa, Legionella pneumophila; identical to SEQ ID NO: 7638

SEQ ID NO: 8327 - protein, 439 aa, Zymomonas mobilis; identical to SEQ ID NO: 7527

SEQ ID NO: 8328 - protein, 418 aa, Psychromonas ingrahamii; identical to SEQ ID NO: 7534

SEQ ID NO: 8329 - protein, 432 aa, Shewanella; identical to SEQ ID NO: 7535

SEQ ID NO: 8330 - protein, 481 aa, Acidovorax sp. JS42; identical to SEQ ID NO: 7536

SEQ ID NO: 8331 - protein, 450 aa, Verminephrobacter eiseniae; identical to SEQ ID NO: 7537

SEQ ID NO: 8332 - protein, 431 aa, Dichelobacter nodosus; identical to SEQ ID NO: 7541

SEQ ID NO: 8333 - protein, 469 aa, Coxiella burnetii; identical to SEQ ID NO: 7545

SEQ ID NO: 8334 - protein, 420 aa, Coxiella burnetii; identical to SEQ ID NO: 7544

SEQ ID NO: 8335 - protein, 435 aa, Enterobacter sp. 638; identical to SEQ ID NO: 7540

SEQ ID NO: 8336 - protein, 453 aa, Shewanella baltica; identical to SEQ ID NO: 7542

SEQ ID NO: 8337 - protein, 448 aa, Yersinia pseudotuberculosis complex; identical to SEQ ID NO: 7543

SEQ ID NO: 8338 - protein, 453 aa, Shewanella baltica; identical to SEQ ID NO: 7547

SEQ ID NO: 8339 - protein, 465 aa, Delftia acidovorans; identical to SEQ ID NO: 7546

SEQ ID NO: 8340 - protein, 122 aa, Coxiella burnetii; identical to SEQ ID NO: 7548

SEQ ID NO: 8341 - protein, 448 aa, Yersinia pestis; identical to SEQ ID NO: 7549

SEQ ID NO: 8342 - protein, 448 aa, Yersinia pseudotuberculosis; identical to SEQ ID NO: 7551

SEQ ID NO: 8343 - protein, 447 aa, Erwinia tasmaniensis; identical to SEQ ID NO: 7644

SEQ ID NO: 8344 - protein, 122 aa, Coxiella burnetii; identical to SEQ ID NO: 7555

SEQ ID NO: 8345 - protein, 420 aa, Coxiella burnetii; identical to SEQ ID NO: 7556

SEQ ID NO: 8346 - protein, 449 aa, Erwinia pyrifoliae; identical to SEQ ID NO: 7651

SEQ ID NO: 8347 - protein, 528 aa, Laribacter hongkongensis; identical to SEQ ID NO: 7559

SEQ ID NO: 8348 - protein, 438 aa, Tolumonas auensis; identical to SEQ ID NO: 7560

SEQ ID NO: 8349 - protein, 441 aa, Dickeya paradisiaca; identical to SEQ ID NO: 7561

SEQ ID NO: 8350 - protein, 445 aa, Dickeya chrysanthemi; identical to SEQ ID NO: 7562

SEQ ID NO: 8351 - protein, 439 aa, Zymomonas mobilis; identical to SEQ ID NO: 7563

SEQ ID NO: 8352 - protein, 445 aa, Dickeya zeae; identical to SEQ ID NO: 7567

SEQ ID NO: 8353 - protein, 455 aa, Xanthomonas albilineans; identical to SEQ ID NO: 7653

SEQ ID NO: 8354 - protein, 424 aa, Thioalkalivibrio; identical to SEQ ID NO: 7568

SEQ ID NO: 8355 - protein, 452 aa, Nitrosococcus halophilus; identical to SEQ ID NO: 7569

SEQ ID NO: 8356 - protein, 457 aa, Moraxella catarrhalis; identical to SEQ ID NO: 7572

SEQ ID NO: 8357 - protein, 457 aa, Desulfurivibrio alkaliphilus; identical to SEQ ID NO: 7573

SEQ ID NO: 8358 - protein, 449 aa, Nitrosococcus watsonii; identical to SEQ ID NO: 7574

SEQ ID NO: 8359 - protein, 445 aa, Dickeya dadantii; identical to SEQ ID NO: 7575

SEQ ID NO: 8360 - protein, 458 aa, Halomonas elongata; identical to SEQ ID NO: 7656

SEQ ID NO: 8361 - protein, 387 aa, Desulfurispirillum indicum; identical to SEQ ID NO: 7579

SEQ ID NO: 8362 - protein, 867 aa, Cellulosilyticum lentocellum; identical to SEQ ID NO: 7583

SEQ ID NO: 8363 - protein, 425 aa, Marinomonas mediterranea; identical to SEQ ID NO: 7584

SEQ ID NO: 8364 - protein, 400 aa, Sphaerochaeta coccoides; identical to SEQ ID NO: 7585

SEQ ID NO: 8365 - protein, 434 aa, Gallibacterium anatis; identical to SEQ ID NO: 7586

SEQ ID NO: 8366 - protein, 465 aa, Delftia sp. Cs1-4; identical to SEQ ID NO: 7587

SEQ ID NO: 8367 - protein, 471 aa, Methylomonas methanica; identical to SEQ ID NO: 7588

SEQ ID NO: 8368 - protein, 383 aa, Megasphaera elsdenii; identical to SEQ ID NO: 7664

SEQ ID NO: 8369 - protein, 437 aa, Klebsiella; identical to SEQ ID NO: 7594

SEQ ID NO: 8370 - protein, 434 aa, Pasteurella multocida; identical to SEQ ID NO: 7593

SEQ ID NO: 8371 - protein, 444 aa, Pasteurella multocida; identical to SEQ ID NO: 7596

SEQ ID NO: 8372 - protein, 384 aa, Selenomonas ruminantium; identical to SEQ ID NO: 7635

SEQ ID NO: 8373 - protein, 417 aa, Spirochaeta africana; identical to SEQ ID NO: 7597

SEQ ID NO: 8374 - protein, 439 aa, Zymomonas mobilis; identical to SEQ ID NO: 7589

SEQ ID NO: 8375 - protein, 451 aa, Xanthomonas campestris; identical to SEQ ID NO: 7590

SEQ ID NO: 8376 - protein, 434 aa, Pseudomonas aeruginosa; identical to SEQ ID NO: 7592

SEQ ID NO: 8377 - protein, 423 aa, Providencia stuartii; identical to SEQ ID NO: 7599

SEQ ID NO: 8378 - protein, 212 aa, Streptomyces
MTTNAAESADEPPARPRRRAPAGAAVLREDVTEAIRAAVFEELAAVGYARMSIEGIARRAGVGKTAVYRRWRSKLHLVLDVVSAMAVTGFPVPDTGSLEGDLRLLYELTSRALRHPVASQIIPDLQAEAARNPEIAEAFQKALRDGQEGVASRIVTAAEGRGEVRAGVDPDLALDLISGPLYWRSVVIRSPKLPKGYLEKLARATAGALKAL

SEQ ID NO: 8379 - protein, 444 aa, Pectobacterium parmentieri; identical to SEQ ID NO: 7602

SEQ ID NO: 8380 - protein, 421 aa, Methylophaga frappieri; identical to SEQ ID NO: 7603

SEQ ID NO: 8381 - protein, 434 aa, Pseudomonas aeruginosa; identical to SEQ ID NO: 7604

SEQ ID NO: 8382 - protein, 436 aa, Zymomonas mobilis; identical to SEQ ID NO: 7605

SEQ ID NO: 8383 - protein, 157 aa, Marinobacter sp. BSs20148; identical to SEQ ID NO: 7606

SEQ ID NO: 8384 - protein, 444 aa, Pectobacterium carotovorum; identical to SEQ ID NO: 7607

SEQ ID NO: 8385 - protein, 299 aa, Alcanivorax dieselolei; identical to SEQ ID NO: 7608

SEQ ID NO: 8386 - protein, 421 aa, Thioalkalivibrio nitratireducens; identical to SEQ ID NO: 7611

SEQ ID NO: 8387 - protein, 458 aa, Desulfovibrio hydrothermalis; identical to SEQ ID NO: 7671

SEQ ID NO: 8388 - protein, 413 aa, Taylorella asinigenitalis; identical to SEQ ID NO: 7666

SEQ ID NO: 8389 - protein, 346 aa, Taylorella equigenitalis; identical to SEQ ID NO: 7665

SEQ ID NO: 8390 - protein, 445 aa, Serratia sp. FGI94; identical to SEQ ID NO: 7612

SEQ ID NO: 8391 - protein, 444 aa, Rahnella aquatilis; identical to SEQ ID NO: 7595

SEQ ID NO: 8392 - protein, 444 aa, Pectobacterium parmentieri; identical to SEQ ID NO: 7564

SEQ ID NO: 8393 - protein, 451 aa, Photorhabdus asymbiotica; identical to SEQ ID NO: 7646

SEQ ID NO: 8394 - protein, 451 aa, Photorhabdus asymbiotica; identical to SEQ ID NO: 7647

SEQ ID NO: 8395 - protein, 454 aa, Desulfovibrio magneticus; identical to SEQ ID NO: 7634

SEQ ID NO: 8396 - protein, 434 aa, Escherichia; identical to SEQ ID NO: 7983

SEQ ID NO: 8397 - protein, 435 aa, Escherichia coli; identical to SEQ ID NO: 7988

SEQ ID NO: 8398 - protein, 435 aa, Escherichia sp. KTE159; identical to SEQ ID NO: 7995

SEQ ID NO: 8399 - protein, 435 aa, Escherichia; identical to SEQ ID NO: 7991

SEQ ID NO: 8400 - protein, 433 aa, Halomonas anticariensis; identical to SEQ ID NO: 7998

SEQ ID NO: 8401 - protein, 468 aa, Delftia acidovorans; identical to SEQ ID NO: 8000

SEQ ID NO: 8402 - protein, 374 aa, Pasteurella multocida
GTHIAKGIHPDTKGDNVNFQPSDSLPPEYVGSQSVSHLVLDANGNAAALPLASFFNFIVDEEKQVKLRDLLLADDPRLAGCFSDDLALSDVYKKQFQQALTGDLTQPETHERNKQVFWANGENPIEDDDYTCLIPLYPSSLTHAFYQKVNNNRYSEQNKQARENRQKKTVEQTHYLSINQLATVVLGGSKPQNISQLMSAQGGRNYLLPSLPPIIPSSRYFRLSPLQTTIFNDRLAYACRYGLRQLFEVVEARKNVYQVRDSRIDALNNILRTFLFHANLLQKQPAGWSKDSQLEMCEKYWLDPKRVHLPDEEAFRAEYEKGEWVAEVERRFALWLNKRLQKRFPHIAKDFDDVEYHEWRRNIRRTLRYRLRHP

SEQ ID NO: 8403 - protein, 188 aa, Pasteurella multocida; identical to SEQ ID NO: 8007

SEQ ID NO: 8404 - protein, 261 aa, Pasteurella multocida; identical to SEQ ID NO: 8006

SEQ ID NO: 8405 - protein, 444 aa, Pasteurella multocida; identical to SEQ ID NO: 8005

SEQ ID NO: 8406 - protein, 169 aa, Ureibacillus thermosphaericus
MSRTDEPLRPLKSRITIFDEPIICSFCTYDVFIPYEVYVNVEEPGIGVYHVRYSAICQHCGQAKIFSDPSHFDEKTKNYIWALNQYLLSERKYKIKIIFYIGKKREDKLQIFLDMLLESQFEIDSILREKTEVSVRAKITTMNELQWIRDTIMNSAGKLFISIKSLSIK

SEQ ID NO: 8407 - protein, 434 aa, Enterovibrio norvegicus
MPTTLTQHIAQYIADRRAVKVEALEKECDKEKAKITSADDADTFEANRSAKVAKLELDFTVTHWLDSAAKRAGQISMATHAIKFSHSAAKGTNVLAENLGSDSRYVDTFSIASPAVDAVGNAAALDVARLLQLKDDAGKSLLEYLQEDSIEPLSPLANTPEQLQEWQHGLKQALRDAAPSSHTLAKQVYFPVAQGEYHLLAPLYSSSLSQALYSEINHSRFSQEMKAVRDAKKANLPCENLLVAYPNLAVTISGGSKPQNVSQLNSGRGGRTYLLDTRPPTWRNQQQQPKDSNQLFNHSSLLFNTERTVKRIADFMLCMLHKPSNLKRREYIQRMVEQIGEQVINDIAIWQQQPAGWTNTYHQLPLHHAQWLDPNNPRWTEENDDWRDRVSTEFGLWLKDRIDKAAGSGQTFRLSQGEADEWRQTFKQLLWEMK

SEQ ID NO: 8408 - protein, 86 aa, Coxiella burnetii
MNSLMEKAMKSENEMEELKKRINDFIQGRLEVKLTKLPPSDKKRQQIIEEYQPKNWISNAARRAWQIQLVTHAIKFQHPDAKGTSK

SEQ ID NO: 8409 - protein, 448 aa, Pasteurella multocida; identical to SEQ ID NO: 8077

SEQ ID NO: 8410 - protein, 416 aa, Acinetobacter haemolyticus
MAESIHAFLNERKELWLKDRIKKAENESVIAELQQQAKDKFSLNEWLPDAAKRVTQLSMVSHPSKFSHPSAKTSSVIANVEQRNDGYLRSGNVNYSLDVFGNAAAMDVFKFLSLPLNEELTVLDGFEENDQGLKNLIADAKLNFETLSAEFLKIKATDNSIRTDHLVKQVYFPVSEVNYHLLSILTPSGLITRLKQSIDVMRFSEETKQAKESRKKNEHHEVGYSDIFDLTVTAYGGTQPQNVSVLNSQNAGRAYLLSSSPPVLEKRTIRLPKTDFFVQCLYRKNYQDSFIQLHKFMQLDLNNIDIRNAIRNIIQFVIDQILLQAFRTREYAVEGWSNQDYYSSLPKLQRIWLDKVHQMTRDEDNDWRDELSREIARWILRSYEKVISDAYTLGTGELLDVKQRVEKSLQRAKEFF

SEQ ID NO: 8411 - protein, 429 aa, Vibrio parahaemolyticus
MEVITVIDPAIEAFFAERKEAWLKKNMSTAMDEQQLREKQQECEQKFLLSNWLPDAARRICSRALTTHPSKFTHPSTGVGKKNKSNGTFVSPILFQGMHRNDGFVRTGNIQCDVVDSVGNSAELDVEDFLRIIISDGMSVIQHIENETGFCRKLLNVEEGEYVKLRENLLAIKNSNDPISTNSKIKQVYFPITDGEYHLLSLLTHSGHLFELRQRLDALRFGEEVKQARECRKNGQFHPNGYQEIYGLTTIGFGGTKQQNISVLNNKNAGRAHLLASTPPELKPRKLRLPTTDFFKESFTAWQAKETLEALHRLFKTDYNNINIRDGRDYRIQEYVDLVIHRMWQVRLFLADYQGDLSSDLKPEQKFWLYPEYEQYRLEENEWLEGIIRQISRSLIFNYSKVTNNSTALADDELLAIERVVRDNKEALR

SEQ ID NO: 8412 - protein, 443 aa, Zymomonas mobilis
MENIMHHNNARIQIFRQAISDFIENRRDEKLKGKADDPAAMRKYDYAIWLEDAARRVGQIHAATHIAKAIHSSAKGSNLYIKPDSLPQREEIGSHLLGENFDIDVVGNAAALDVFKFLKTKVEDKTLLAWAEAGDPDFKAALSENPDQAEEWLSSFAGLLSSDKKVQSHALMKQLYWLRGEDPTQDDQYILLQPLFPSALVNYVHQNIQAVRFGESNKEARSAFSKKEASELVYQEYKKLAVQRLGGTKPQNISQLNSERGGVNYLLASLPPRWKGKRRLLPLNCKSALDVFFKRPDVYGQVDKLIKFLKSNPPDNLNTRQYRQRFEQKLIESLVDFAATIKAEMPVGWSREDGCQLPPYERLWLDPERSLFSLRDDSDEADQIFYNEYMKGDWPDAVAQNFGRRLNAKLKHQDIPVGETEYIHWVRQVTIDAAWPVPWRRRV

SEQ ID NO: 8413 - protein, 397 aa, Aeromonas dhakensis
MSETSLSSAIDDYISARLEAKPDKWPTKGDWLDDAAKRAKQITLVTHAPKFTHGDARGIGARVEGQEGEGFLSTASLTTPAIDVIGNAAALDVANLLLLEADGKRLVDQIQDGDASSLAVFTKDKVQLETWCDGLSQALVGSTLTTHTLAKQTYFPVDRGYHLLSPLFASSLCHALYQRIDQARFGDEAKAAREARRKNECSDLNVVDFPHLAEQHFGGANQQNVSLLNSKRNGRAYLLSCQPPTWQDRLTAPESQEHFWKRYEHRSAATLRELTHFLKSVEQANNNDAIKQRRADLVDDLVGALLNYGAELRTLPSGWSRAMAEPLNEAFCRWLDPIDGQALSDEEANQIALAFGRWFNQRLQKRLAHVGDAELHVWRRLLARQLRLLKQDLEEWA

SEQ ID NO: 8414 - protein, 438 aa, Oligella urethralis
MNLPIHLAIRQQLQKTLNGFFEAKTKKISNDIAKEEDPTKLAELNEKLKQEKDKYQLHNWIENEATKMMSSLKFGTHISKGIHSSSRGHNVTFQPIVDLSEEYYIGSHTPGELAIDANGNSASLPLATFLKTLINDSTLEELIITDSPLLGGVFNDDSTKSEAFRLALKDTLTNTTETPSVDGFNKQILWPTTDNAIQTDSYINLVPLYPSALSNHFYQQVRRIHEIQREVRDKRNKSQDIEAPYRILRGLAITKLGGANAQNVGRLNAQQNGQHYLLPSYPPIFKRIDNIPLSRSDSSIYNDKTRHICRNGFEKLKEVTKLRNNDMHARDRRQAAIDEILFNILFIADEIKANWEGGWSENYSLISEEKQWLDPSSCVDSTATNWIEKVAERFARWILLWLQKELPGRKDEFAAEEFDYMKKEMKDTLIAKNRYEEV

SEQ ID NO: 8415 - protein, 299 aa, Thiobacillus denitrificans
MHFSPETFRAWPTKRITLLGMSGVGKTHISSMLRGHDWFHFSGDYRIGTRYLDEPILDLIKQQAMQVPFLRDLLRNDWIDIKNNIKIHDLGPVLTFVGKLGGPGWGGLSLAEFSRRQAAYRDAEIAAMRDVPGFIRKGQEIYGYPHFVNDVGGSLCELDEPGVVELLAEHTLILYIQTTTREEEDTLIKRAQSDPKPLYFRPAFLAEHLPLYLREKGLEFVAEVEPDDFARWVFPRLFHSRIPRYEAIARPHGYTVTSQEVAQVRDERDFLALLEAAIARKATGAGSREPGRANAAGRA

SEQ ID NO: 8416 - protein, 416 aa, Wohlfahrtiimonas chitiniclastica
MIESIQEYITGRQTSWLEKKIKNAKEDQEAIAQLMEEAADHFHPKIWIEDAAKRAKQLVMTTHPCKFSHPSAKSTPIMATATASHDGYVRTGNIRTVTGADVYGNAAALDVYKFLMLPLTNDCTVIEGFETHHPLLVQYIEGLGLNFDEIAQEFLEIKTDDGELKTDGLLKQVYFPLGEGQYHLLSILTSSNTLMRVKTEIDEMRFSEFSKAARKARREGKWHEPYQDVLDLTLLSHGGTKPQNISSINSQMAGKVYLLPCLPPCLKKRAVRVPTSDFFKQTLYLKKEHSRFKTLHRFVKQDYNTHEVRATIDRIIHGIIDVILRKAYQVRASMPATWSKDERYQNLPKVQKVWLDAQYQTEREDQEWQQEMAKMITKCIVSEYETVDRAHKLDEPARKAIRLAVMACLANDKEFF

SEQ ID NO: 8417 - protein, 457 aa, Desulfovibrio oxyclinae
MGQGDPNRVSGFRSVMEEFLKEQLEPKLKQILNKLEKEEDPEKRVELSEKRDSLVEEYGLRSWVEKAAALVVHIDAATHILKATDSHAKGTNLYCPPASLTPLEEVGSCHLDESFAVDFTNNSARFVLYKFLSLEYEGVPLFKWFKIHDKDLCEAIGGADSISDHCSTFGSISELGNKLASHERMKQIYWLTGEDPVEDVDFTILAPMYSSSLAHEVYGRISEHKYSDNTKAARAAKRKNEYCEYGIHEYPHLGIQKLGGTKPQNVSQLNSERGGRNYLLASLPPVWMSRSVRPPYGRRPLFEQFGLRRDTQAVLKHFQGFLESDPPANMTTRIRRDEYLDQLLGEFSLYCGDLHALDPCWSADPKCLLVECEVMLLDPGRYARDADFAARFREKYASRDWTKDISNRFANWLNGALGGKLPLEDAEQVFWSDVFREDVMTPLLKNVGEKLKEEAHV

SEQ ID NO: 8418 - protein, 327 aa, Thioalkalivibrio sp. AKL8
MSGLDSIANISVSGPARHNASERVTIGPAKLLKAVRLFRGEAVKLDSPPEADLAEQAEVTDAYLDVASKSPAVINGDRLSPRLRQILLPREDGYLAVTPLTSTGVGLAVNEAIRARDDAFFASRKAAEAPSTRRIPLVPQFSVGGSKPQNAGARVGEWTKRPLVFDSVPTLDRELKRAFHLAYAGFRYRLPVKLVAEHQAFLGQLQLAGEDDSSGIVWTVRNREREAAYLMALWQAIENQAASVRSCLRQHEDDLPSPLPALEKQPMLEGWIDPERRSREWRETVSREVAASVVTMVRSSSFSPHRVCELDDEDGRRMAETLAQGGA

SEQ ID NO: 8419 - protein, 492 aa, zeta proteobacterium SCGC AB-133-C04
MTNKNEACLMANEIRRFISERRGKKVLALLKEKPKKGKGGINSRLEKLAEDVLPQSNEKFQAIKKAKKEKEQTPLEFQQTKHQKLLSLLDAFKLDDRLLEIVREYEESLATINQDHEPCTWLSRFSGKATDISFATHVAKLTHSSSKSTSIYDKTNSTSPHYLTTNSLNNLMIDTATANAASAPAGDILTLEINDKTLLDFVKDNDCSPFNELTDNQEEVESWMEGFKQAYEKDKKNSHFLSKQVYFPIGSHKYHLLLPLVSSSMAHSLFWKFKELFNDENKLIKEQKKKNKYHEKLAVSYTKKAVLKVPGKPQTASSLNGERGGRLTLLSAMPPQWTGLQQLPTHQRNLFNKSLGYKLQEEINDLQRLLLVIKSKEIGMKKPAMYRAIVKAVNEIANALFDEINKINLLSDAKGWSVNSDFPLHQQLLLEPDREDEAALEEKNNKQWQEKVAKDFSAWLNKQLHHKNLNLTPVQQRFWIPFFVLADISQVP

SEQ ID NO: 8420 - protein, 417 aa, Fangia hongkongensis
MNKIITAFFTEKKEAWLKKNLKASMTDNEMAVLKSECEHTFSLNVWLPSAAKRAGQISIATHPCTFSHPSARKNKNGYVTSIIANIEQANDGFLKTGNVSVMSDALGNAAALDVYKFLSLVMEDGRSLLSHIQQDSKLAKELLNLDAANYEELKSGFLTMIASSTENITSSKIKQVYFPVGDDYHQLSLLTNSGIVYELRNRLDSLRFSDSVKELRAKKYNNEYSEQGYSEIYNLTTIGYGGTKPQNISVLNNQHGGKAHLLLSVPPSIEKRNTYFPKRDFFIESMQKAHYIGTFKALHKIFQLDYNNIKIRNARDYHLQELMNMIVENMWAVRLVSVAQYHEETSTLEKWQLIWLHENFEKEREDSEQWLEQLVKNISHWISQTYEKIMEKQAIKLGEAEYKHISNIVEQNKEALR

SEQ ID NO: 8421 - protein, 434 aa, Gallibacterium anatis
MLKAKILSFLTELAAKKLAPLEKKREKITAINELSALDEKIKQIKAEYHLDTWMEKAANQMSKQLSFATHLSKAVHPDSKGNNIAFKAQNHTLPFVGSHLIDKAIIDASGNAAALPLAALFDLVIDEQHNLRLRDLLLEDSTLLDGVFSDDEEKSTQYKTLFQQALITNITKPVTYERNKQLLWPNNRQAISEDNYTCLIPLYPSSLAHLLYNKIQDIRYSEHYKEIRENRKKGGITQQSYPTIKSLATIPLGGAQPQNISQLNSRQRGKHYLLPSLPPVFSSSKTNISDDTLFNRHLYFQCQLFFNDLFAVVSSPYNVYTERDKRDAAIENIIEVIFSIAQIYQQKPAGWSKNYQHLDISQKYWLDPERANLDGEVEFKTKFEKANWHNDIAKQFAHWVNSQLKQKFPNIRQDFSEPEFNEWRKAFKRALKRK

SEQ ID NO: 8422 - protein, 444 aa, Teredinibacter turnerae
MSDNSLAEAISVYIAKRWEARLEKLEKDFDKTRKTMVEGSVELAEFNISCETELQREAQKYEPNAWLADAAGRAKQISMVTHALKYSHTDAKGSSVLASADEPVEHAGKWLSSASLSEPAVDVVGNAAALDVAGLLQLQDVHGKTLVSYISENNAASLASFANSSEQVQTWLEGFRLALVDVGLSSHKLAKQIYFPVDNGQYHLLGPLFSSSVAYAVHQKIIDKRFSDEAKAAREARKNQTYWHRPTEDFFNLAVQKFGGTKPQNVSQLNTQRKGQIFLFPAMPPRWKSQSKPPASTLAFIRSFERSAAQTLRFLVRYLKNRVNATSTVSIRDMRAQLVDQLIDCFVQQAALIQMREDWSGWSDSASLTNSEKYWLDPHNPDEQFQQNRELGDWQKDIASLFARWLNRKLRKGGLNVDDGEFSEWHSLMDGKLRELERDIGGWA

SEQ ID NO: 8423 - protein, 148 aa, Streptomyces glauciniger
MGGMPLNDMPWWRWRANVRSALHMISDPVFQREVWLAGQPGYGDVTDAVYRLVEDTWLDNWSAEKYVGTVFRDSQEAALVDVAVLRVLKILHQVGADAPVSAYLEHHAWPEAVRAAREAHVRLASGDGEDPDTPPRSLEILKIYTRTA

SEQ ID NO: 8424 - protein, 411 aa, Acinetobacter tjernbergiae; identical to SEQ ID NO: 8117

SEQ ID NO: 8425 - protein, 430 aa, Arhodomonas aquaeolei
MPTGSTAALRKTIEEFLSERQQTKLDRLASDDPKRARIIDAHQRENWLADATRRVAQLQVVTHALKATHPDARGTSLFAPPETLPAHPAVGTHVLGDGAPRDVVGNAAALDVYKFLQTEHDGRSMLDRALAGEAAFAAALSDDPTQGQAWMEAFAGITRAGDDQASHTRAKQVYWLVGDDPTDDRGFHLLAPLYATSLAHAAFRAINEDRFSEVAKAARTARRERRYSAVESREYPKLAVQKFGGTKPQNISQLNSERRGGNYLLASLPPDWRSADVRAPLHTDSVFPLFGRRRPVRSAVNALLRFLRSEPKPNVATRRHRDELLAELTDALLVFAAELSALPPGWSAHADCRLVEAECLWLDPDRAAEDAEFAMRRAQVDWPREVRERFAAWLNAQLQGPLPVADPERRFWADRLQAEMDELEETLPHV

SEQ ID NO: 8426 - protein, 393 aa, Succinimonas amylolytica
MIDKAIYDFISGLKEELNTPEKFIPNVALNAKYITCATHPCQFSHPYANQDKNSKITPIVFFGSASADGYIRSGNIKSKRNIDMYGSAGYATIMKFLATPMSNGKTVLDNIREDTPEGKELLSSSGNSATELREQILQVFKPCKDTHVTSSKIKQVYFTLGNGQYHILSLLTPSALVYELKNRISAIRDDAKDKKELIRKGEGATTGSFREIYNLTTLKYGGTQPQNISQLNTENGGITKLLFSAPPTLEDHKIRLPRRDFFSECLNKRTFKWEFSRLLKLITLPKDSPIPLEKQRKFRDRIFEEIILSISERMFIVRAALINIPSTLKISQQIWLSKDETLRAQNNSWESEIQNDMARWIIENLKREHSVVLGDAEMVEIKNIIDSYRDLWK

SEQ ID NO: 8427 - protein, 381 aa, Thioalkalivibrio sp. ALE23
MERKPKNFAEAQSSEEIEEFIDEHLVHFAGKVINSNISHAVGVRLKQEDGISDLPHVCARTLMADPSAGPLRLDWIGIQQCGITFKQIQKIAGEKEDPKTEITFSKPAADAVRSRYLELKDGKGERRVVNGDAVKSRNRQLLVPVQGMETSYVSVTPLYAMGVSAEIQRIMNQRFEQEKEEGRSSEKSALRAVDMVKAFSIGGSRPRNVSGLTDEPGIRQALVFEQTVPKMDSNQKRLIRACFSGFRYRIPRDRMKAYTGFLSRTFPPGGDDSEEAPRIWTKRLKEKEKEILMPLIEAIESQAQSLARKLEDQSNELPEIDEAAPGWPWVFPDRRSREWKKQEASSLAKQIHKMDREDKGGTGQVRGQDVARIADALEAML

SEQ ID NO: 8428 - protein, 423 aa, Moraxella boevrei
MVDATIIKQTIDDFLTQKIQTTIEQKQKKAKGVFSEEEKQKIRDEYEILSWLDKVSENINKVFLNVSHVAKLTHSSSQAMSLRDNSQSDKYPYLITTQTINSHFLDSGYSDAKVSPIAEFLSFPVKNSKNQLGEFLAENASFFDKISDDKEKKEYWSSQIKQAYQSQQIRSHTLAKQIYIPIDKDDYHLVSPMYSSSVAHEIALAIKTSNDKTNTAKVARKQNAWSDEIYIFYPGIATLGVTKSNHQNVSALNGQRGGQLYLFPTLPPKWTTNPNPPTSIKQILHKSYRGHLFSQVKYLLDIFKQNDLFINYERKKALKELIEEIVFAVCDEMFLIRKSQLAGWTKDYQIPTYLAIMIDRQILAENNFSQPEIEMYLDELKKEIVSWISQGIDDELRTKSLENLWLKIMTPILQQFYQILKAE

SEQ ID NO: 8429 - protein, 400 aa, Selenomonas bovis
MSIFLDFLQEKADKKKKTKEEWLQATAQNADKCLFATHIGRFTHPSIDTKVSFSAGTPLVRVTGVVSSAGTCMEKDVATGANYLSTADLASLVLENGKTVYENLQEDNPNLKDDFSALAVDYDEIREKLLQIPEHHVPEATDNRLKQVYFPVDGEGQYHLLSVLPPSSLTAELQKRIRQEDTAARETKDSKSENYGRPYDFVAERVEYSVGGTKPQNISRLNNLLHGTFSALLSLPPQLSSDAVRKPHRDFFQETLRDLYYDSSFSDHIFAVHDLLLVDRNNKDIRLTLRRREDELIDAVIWQAMALQQLPGGWTGAAENQLPKEQKIWLDQAYEEERQQGGWEDIIAGQIASWLLRAYRRKCQDKAVVLDDEVWKNLRKNALSALRDDLADNAGERGMI

SEQ ID NO: 8430 - protein, 507 aa, Psychrobacter lutiphocae
MSSEAKKSWRDVITQYIDDLGEQNKIDKMKGAIIATALFNHLVTAKADDTKQNKALQKELNRLNKMSLNERSLPKIEKMYQDFIDNEWITSIDDTLNKLRSMTDYHHIWLRYALLQIDYVTPATHVAKLTHSSSGGSSIMDEVDDVKAEYLTTSSLNNITYDGAYPNASLSKIAKFLLLTIDDKPLGKLLKASNSVPFQNILKEDELNELITGFKNKLNPKPKADSLAKQVYYPVDDDYHLLVVLKPSSLIQAIYDNYFFKDIRKERDKVYKQKEKGKYSADILQSLPNIVTLSTVMSQPQNVSVNNGSRGGNIRLFNSAPPVWQSQLNPPIKLKSMFNARLLNRYAWDNIVALRKMLMTFENADISFKDPNRLKGISNWVKAIAHNVIDYSQTLAILPAGWTNDSECNLPIAQQIFLDFDRKDDEFVKLKQQSDWQGQLVKDFVVWLNKALKGKNNEFIASSEHSRVWRDIFANILREHMEVINEDSGDWKNVQNNDSSMQQEATV

SEQ ID NO: 8431 - protein, 445 aa, Dickeya zeae
MSSEGLQAFILSYIETRKQAKLDAFDKAADKQRAALSGEALAAAEVALLQQRREIEQAYEVRTWLTDAASRAGQISLVTHALKFTHSDAKGSSVFSTEPATATDVLSTASLAQPAIDAVGNAAALDVAKLLQTEHQGDSLVAALQRGDHRALEALAENAEQLTQWLAGFGQVLSDKQPSSHKLAKQIYFPVGDGEYHLLSPLYSSSLSQALDQRLNPARFGEQAKAIREARRQKRWHDEVDVSYPGIAVQNMGGTKPQNISALNSARSGRSYLLNCAPPQWRSQIKLPLEHDTIFRNNGEVDALTYVDRRDMQQFLLSVKEVENNRDIRNQRRRYLDQLIDTLFGYVATVQNLRPAGWSKDSRLNVPLQLWLDPFRCRQDDAFCYAREGGDWKEQVAREFGLWLNDRLQHKKLIFGEVERREWSTAALFKQRLRETERALKEELA

SEQ ID NO: 8432 - protein, 431 aa, Oceanimonas smirnovii
MALEPGARSAELRQLMQSFIDERLAAKLEKLEPDDPKYQDLQLQYRFENWVEDAARRVGQLQVVSHTLKAIHPDAKGTSLFAPLELLAAHPWVGSHLLEENYATDVVGNAAALDVYKFLKLEYQGKTLLARSLERDAALLSALNDDASKAQEWLDAFASITDNKSKVSSSTRAKQIYWLTGDDPTQNDHFHLLSPLYPSSLVHRVYQHIQHDRFSEEAKAARQARRDNKASETGYADYPNLAVQKLGGTKPQNISQLNSERGGNNYLLCSLPPVWQSRDQRPPLKTDSVFPRFVRQQQPRWLLAKLRDFLLSNPPANVRTRTRVDAYIDALIDEMILFSAYFQQLEPGWSADPDCQLVEAEQLWLDPMRAEQDEDVAARRMAGEWVKEVQHRFANQVNKALGKLPVGDGEHSEWMSRVHKKLNALREVLDD

SEQ ID NO: 8433 - protein, 451 aa, Kushneria aurantia
MIRGFIHDRFQTKTEKLAPDDPAYLKLQQQFEPQTWLADAAKRVSQLQVVTHSLKAIHPDAKGTNLYVEPGQLERDALVGSHCLPADFEGDVVGNAAALDVYKFLKLQWQGRSLLERALEGDKALVEALSDDRAMAQSWVQAFANIVEPKGAPSSHARGKQLYWLVGDEPGDDTNYRLLAPLYATALAHPFHARLSEARFGEHAKAGRKARRDDVGFEDGYADYPNLAIQKFGGTKPQNISQLNSERGGQNYLLPSLPPHWASREITAPLRTESVFPRFGRRTPVRHLVNDLVSWMRQNLREDEKRQRQGKAPRKTVQDRNLHNDLVASLADELLLFTFELHRLPAGWSADADCRLVPAEQYWLDPGRAELDTEFDSARRQSQWHEEIAERVARWLRHAIDRRVKAGLGDPEHDFWTGKIETVMESFRRQLDDLQDVLRNDDEDQDEGEAA

SEQ ID NO: 8434 - protein, 417 aa, Vitreoscilla stercoraria
MIEQTYANFLTKQKKIWLEKKSKGKEPSADLIQEANERYTKDNWMHKAIKQARFAITTHTSTFTHPDAKSSCFFYQAPIQNNGFLSTNNVQYQQTFDVFGNAATDSFVKEIYLFLIEPIQDQSIWEHVKNESSEFKKLTASLSLKSDEVKSALSKLMIDPENAKTHPLLKQVYFPINNDYHLLSLLTPSVVTTELLNRLNKIRFNDITKEARTFKKENKFHPFGFDEIFNLTEIALGGSKPQNVSVLNSQNAGRAYLLSSCPPALEKRSVRLPNSDFFTQCLYRKNHQNSFIQLHQFMQLDINNINIRNAIDNILQFVIDEVLLQGLKIRETYPSAWSTKEHYASLPKIQRIWLDDIHADLRENDTQWRTQLSIDIARWITRSYEKAVAESYDLGSAELLEIQNLVEKSLQKAREFF

SEQ ID NO: 8435 - protein, 421 aa, Cycloclasticus pugetii
MKGLDMQDEAIKDFLENKKEDYLKKNVKTNSSDEDKLRVTQEAAEKYNLETWLLDASLRAKQLSLTSHPAKFIHPNAKTSSIIADVKKENDGLLRSGNVEVELDVFGNAAALDVEKFLRVELQDKQTVLQHIEQNTDAIKQQLSTGNINFDDVRNAFMQIKCSDLDQSSEKLKQVYFPIANGYHLLSILNASGIIYKLKEKVNALRFSEENKRLREELKKAKPLKIKGKVTDVIGLTSIGYGGTKPQNISTLNNQNGGVSFLLSSLPPTLEKRQTQPPKKDFFNDCLWAGLFKKDFDQFHKVLSWRKNNKDVRDIRDDIVLNSITKLKRLVDNIREVNAGWSDSENYSDLAIWQKIWLDNKHTEIRNDDRQNQRYLGKAQSYFANWFIGNYKHSTKDNKLLGDDDIEQIKKVLEVEQELLK

SEQ ID NO: 8436 - protein, 420 aa, Vibrio fluvialis; identical to SEQ ID NO: 8008

SEQ ID NO: 8437 - protein, 85 aa, Chlamydia; identical to SEQ ID NO: 8009

SEQ ID NO: 8438 - protein, 441 aa, Thiolinea disciformis
MGSLENVVFLLLLNVYCRLGSLFFTGSLMSNPIVTFLEGRKQKPLKEGKKPAAEIESDYSVLVWVANAAQRAPQLSLVSHPAKFSHPDARTSPILFSTARKADGLLRSGNAHAGQDVVGNAAALDVYTFLSLSLDDGQTVLQHFEAQTDHLKRLLGADEDSFQVWRKSFLQIKTNAEGYKTHPNVKQVYFPVESDYHLLSVLYPSGLMTEHRERLKRMKPYALEVKEARTAKKQQLFHPQGYAEITGTLIQHFGGTKPQNVSKLNSNNGGEAWLLPCFPPELDLLRPTLPQKDFFATLRLDEESKALFKAFRDLLVAGNNNTDITRQDFLQWRDQLLVQLFDWMLLKASAIQNYQGGWSEAKGYTLSLEQQVWLDQAQFSKRAGQSWQTAIAQQMVAWLARRHNRMIKGHPLAAYLELGKEEKDEFYALALQCLAEMEDGQ

SEQ ID NO: 8439 - protein, 506 aa, Psychrobacter sp. G; identical to SEQ ID NO: 7616

SEQ ID NO: 8440 - protein, 261 aa, Paraburkholderia symbiotica
MLIQRQAEKARYGRHVCVVAAAILALSIGVLHLRRGEQQLVATSQSRAPIAGATAFGLGDSAGATESVALSDSGLAIGEGHRLILNGALLDLIDSFLLQNADDDRVDQLRRYLKGKLPTAAYGEAVGIVERYQTYMKAHDDLLAAQNLGHVGDASAIDIDRIAIWRQQRDRLRRSILGDDIVQAWYQNDDAQLDQVLQEWRQRLEDSEAPQAPAQAPRYPVPHWHDKQAEDHHRQYMLRVLEKAVTSFADRRRAHDGNPLR

SEQ ID NO: 8441 - protein, 436 aa, Marinobacterium rhizophilum
MDDINRLHTSRKTQLQAVINGFLQERLQVKLEKLKDGAQDERQKLLEKYQPDTWIPDAAKRVGQIQQVTHAIKFTHPDARGSSFNQPGNPAAGDLLVGTQSLGADVAGDVVGNAAALDVYKFLRLQVNGQTLLELASHQDSELQAAFSDDAEQAQSWMAAFAGLVQSKGQASSHKLAKQLYWPLAGGNYHLLAPLFPTALVHRAWQTIREDRFSDTAKAARAARRAGESYSTGYREYPDLAIQNFGGTKPQNISQLNSERFGENYLLRSVPPNWRSDPLPVPLYIESVFERLFSGRTRVRELGGALAKFLRRASTANNLRIRETRAGLVGDLCNELLLLAAELQALPAGWSRHQDCRLNSDEQCWLDPQRAGLDADFAAERSRGEWQLGISRRFGNWLNARLNKAELSMGQAEAQAWQSVVEQELRMIRMELEADD

SEQ ID NO: 8442 - protein, 419 aa, Streptomyces rapamycinicus; identical to SEQ ID NO: 7617

SEQ ID NO: 8443 - protein, 444 aa, Serratia sp. ATCC 39006; identical to SEQ ID NO: 8123

SEQ ID NO: 8444 - protein, 434 aa, Pseudomonas; identical to SEQ ID NO: 8016

SEQ ID NO: 8445 - protein, 447 aa, Photorhabdus temperata
MNESKLSRFIIDYIESRKQPKLEAFDKEAEKKLAKLTSVEDITLVKQELAEQRNELEKHYEVRNWLDDAANRAKQISLVTHALKFTHSDARGSSIFATSSNAAENTEYLSTTTLYKPVIDSVGNAAALDIAKLLQTEYQGDSLVASLNRSDYSALVELAEDEQQLERWINGFRQALSDETLSSHKLAKQLYFPVSSSEYHLLSPLFSSSLAHAIYQRIAEVRFGELSKEINKAKREERWHPEARVIYPNTSVQNTGGTKPQNISYLNSIRSGRTWLLSCSAPNWQSSTKLPKRHRSIFEQRSQFTLLSYTTVRLMRQFLFSAQKRTEETRRSRQAYVEEIIDILFNYVASVQNQVEFKGWSASDDCELKRAQQLWLDPYRCQLDKEFRFEREGGDWKKEIAADFSYWMNQSLKHERLEMELPERREWVSEFKKRLREFEDELPEVIP

SEQ ID NO: 8446 - protein, 434 aa, Gallibacterium anatis; identical to SEQ ID NO: 8070

SEQ ID NO: 8447 - protein, 303 aa, Listeria monocytogenes; identical to SEQ ID NO: 8073

SEQ ID NO: 8448 - protein, 435 aa, Escherichia coli; identical to SEQ ID NO: 8017

SEQ ID NO: 8449 - protein, 435 aa, Escherichia coli; identical to SEQ ID NO: 8027

SEQ ID NO: 8450 - protein, 435 aa, Escherichia coli; identical to SEQ ID NO: 8036

SEQ ID NO: 8451 - protein, 443 aa, Desulfovibrio gigas; identical to SEQ ID NO: 7626

SEQ ID NO: 8452 - protein, 597 aa, Culturomica massiliensis
MEKFKELGLEGEILKGIADLGFETPSPVQEKVIPVILGEENDLVALAQTGTGKTAAFGLPLLQKLDASLNKIQVLILSPTRELCVQIGNDLKNYSKYRSDLRITCVYGGTDIRRQIRELEKGVHVLVATPGRLCDLIKRGAVNIEAVRAVVLDEADEMLNMGFKEDLNFILEETPAERNTYLFSATMPREVERIARNYLHSPKEISVGKKNQGADTVSHQYYQVRAKDCYETLHRVIDCAPDMYAIIFTRTKMDAREIAHKLQKDGIDCDALHGDLSQSQRDDVMARFRSKRLKVLVATDVAARGLDVDNLTHVINYNLPEDSESYTHRSGRTGRAGREGISVAIINSKEKGKLRRIESILKKKFEYREVPGGEEVCRAQLLYYADKILTAERKDALMPYQQELFEKFEALSKEELIQKIVSYEFGRLLKKYTGVENLNLSEDERHESGREGGKERGGRSRSANNNFTVFSVNVGRDDDFTPRDLMAIVNKYAPQKGLEIGGIRIFDNKTKFEVDITGIENFGSYFRNVNFNGLPFTVTETGERGGEMRKGERGGKRSSTANNKWKGERRKNGGNSRGRFGEKKKGVDNGRRSGKKY

SEQ ID NO: 8453 - protein, 387 aa, Dialister invisus CAG:218; identical to SEQ ID NO: 7676

SEQ ID NO: 8454 - protein, 125 aa, Dialister sp. CAG:357; identical to SEQ ID NO: 7677

SEQ ID NO: 8455 - protein, 401 aa, Megasphaera elsdenii CAG:570; identical to SEQ ID NO: 7678

SEQ ID NO: 8456 - protein, 100 aa, Pseudomonas sp. CMAA1215; identical to SEQ ID NO: 8078

SEQ ID NO: 8457 - protein, 155 aa, Pseudomonas sp. CMAA1215; identical to SEQ ID NO: 8079

SEQ ID NO: 8458 - protein, 117 aa, Pseudomonas sp. CMAA1215; identical to SEQ ID NO: 8080

SEQ ID NO: 8459 - protein, 441 aa, Aquaspirillum serpens
MSEILSEETSPITASDIRTVISSFLTERLQGKLDKLKAEETEARDSLIDAFTPAVWIADAARRVEQIQQVTHALKFNHPDAKGSSLSSTGNKAALHYEFGSHSFNHQLEPDVVGNAAALDVYKFLRLKVAGQTVLDLCLTQHPALMDLFCEYSGGETQEAENWCTAFATLPEPKGELASHKLSKQIYWPLSDGTYHLLLPLFPTSLAHHVWNTMRQDRFSDEAKAAREARKIKKHHDHGYRDYPNIATQHFGGTKPQNISQLNSERHGENWLLASCPPTWQNQNSVQPPLQQRSIFSLFGRRKNVRFTLNALKNLLGKAGDYNNVAIREARAALIDDICDELLQYTAELQALPAGWSKNSILDEAEQYWLDPERGNEDEDFANRRSQGQWLDEVTRNFANWLNSALDKNNKQLHFGDAEAQAWQTVLEDRLQIIRWSLNHG

SEQ ID NO: 8460 - protein, 431 aa, Candidatus Symbiobacter mobilis; identical to SEQ ID NO: 7627

SEQ ID NO: 8461 - protein, 454 aa, Geovibrio sp. L21-Ace-BES
MRDDPDKDSLPKDETVSGVIEAFLLEKKEKELKPEKKKLESEDDFEKRVKILEKIDKINEKFTLENWLENAAKGVEPDRLSSLRLVTHAPKYTHKDAKATGVFLQNPLYSSDELVGTHSLNEKPLDCMGNAAYLGTFPLYRSTVNGVPIYELFMRKDPELLNALSDDPEKSEELYKAFYQALNIGEPYADTLLKQLYFPVGYSYHLLTPLYPSVVVHYVHRCMSDIRFSKEIKEIRDLKSKNKPHSCGYRYYPDLALQGVGGSKPQNASQLNSQRGGQGYLLPSLPPKWVSKDTKPILYIEDPIEKVFSKRKDVWSQFKGYLRILKRYEDRTNLEIREMSSKYREALLDELTLFTFEMRQLEPGWSNDENCRLNQSFRLWLDSGMEVGNLDEEYQNIDWVEDVATAYVKWFTRTFDKEAKKAKYEKPLGDEDIVQVRKEAAEVLKDLARGFDNE

SEQ ID NO: 8462 - protein, 240 aa, Thermodesulfatator atlanticus
VFFVEVYGFCIMGNHFHLLCRMLPPDSFSDDEVIERIKLYYGDRRKIMLTPDRISYFRKRFADLSRFVQEIKQRFSRWYNKIHDRKGYFWSDRFKSVVIEKGEALLNCLAYIDLNPVRAGIVEKPEHYRWCSLGYHLGTGNADGFLSTNLGVAEFTSKGYQERLKMYREFLYGKGGIGDRRGLKEAEVYRQRIRFFSEGLVIGTEKFVKEALAELREKLGLKRRRRKVSSINHLAHLRVC

SEQ ID NO: 8463 - protein, 385 aa, Megasphaera sp. BV3C16-1; identical to SEQ ID NO: 8086

SEQ ID NO: 8464 - protein, 433 aa, Pseudomonas; identical to SEQ ID NO: 8087

SEQ ID NO: 8465 - protein, 434 aa, Pseudomonas aeruginosa; identical to SEQ ID NO: 8089

SEQ ID NO: 8466 - protein, 434 aa, Pseudomonas aeruginosa; identical to SEQ ID NO: 8090

SEQ ID NO: 8467 - protein, 433 aa, Pseudomonas; identical to SEQ ID NO: 8092

SEQ ID NO: 8468 - protein, 434 aa, Pseudomonas aeruginosa; identical to SEQ ID NO: 7629

SEQ ID NO: 8469 - protein, 416 aa, Acinetobacter gyllenbergii; identical to SEQ ID NO: 8116

SEQ ID NO: 8470 - protein, 437 aa, Klebsiella oxytoca; identical to SEQ ID NO: 8118

SEQ ID NO: 8471 - protein, 436 aa, Enterobacteriaceae; identical to SEQ ID NO: 8119

SEQ ID NO: 8472 - protein, 435 aa, Enterobacter cloacae complex; identical to SEQ ID NO: 8121

SEQ ID NO: 8473 - protein, 435 aa, Enterobacter sp. MGH 22; identical to SEQ ID NO: 8122

SEQ ID NO: 8474 - protein, 136 aa, Firmicutes bacterium ASF500
MNAKTVNPLFEDFLRGTGLLAVVLSNPSMPVWLRFCAIPLLLFDLAASIFVGWKRGRLPQEEQLDMKRAETDERNLMVREKAAWLWTRLEFWLMLGAFWAIGVFWVRPVIAFTVLGLAVVHWFGMLASRWWVGRKY

SEQ ID NO: 8475 - protein, 439 aa, Zymomonas mobilis; identical to SEQ ID NO: 7628

SEQ ID NO: 8476 - protein, 445 aa, Dickeya zeae
MEESELTQFIVSYIETRKQAKLDAFDKAADKQRAALSGEALAAAEVTLLQQRREIEQAYAVRTWLTDAASRAGQISLVTHALKFTHSDAKGSSVFSTEPATATDVLSTASLAQPAIDAVGNAAALDVAKLLQTEHQGDSLVAALQRGDHRALEALAENAEQLTQWLAGFGQVLSDKQPSSHKLAKQIYFPVGDGEYHLLSPLYSSSLSQALDQRLNPARFGEQAKAIREARRQKRWHDEVDVSYPGIAVQNMGGTKPQNISALNSARSGRSYLLNCAPPQWRSQIKPPLDSDTIFRNNGEVDALTYVDRRDMRQFLLSVKDVENNRDIRNQRRRYLDQLIDTLFGYVATVQNLRPAGWSKDSRLNVPLQLWLDPLRCRQDDAFRYAREGGDWKEQVAREFGLWLNDRLQHKKLIFGEVERREWSTAALFKQRLRETERALKEELA

SEQ ID NO: 8477 - protein, 445 aa, Erwinia piriflorinigrans; identical to SEQ ID NO: 7667

SEQ ID NO: 8478 - protein, 445 aa, Dickeya dianthicola
MEERELTQFIVSYIGTRKQAKLDAFDKAADKQREALSGEALAAAELTLAQDRREIELAYEVRGWLTDAASRAGQISLVTHALKFTHSDAKGSSVFSTELAGDNAVLSTASLAQPAIDAVGNAAALDVAKLLQTEHHGDSLLAALQRGDHRALEALAENSEQLAQWLAGFRQVLSDKQPGSHFLAKQIYFPVGEGQYHLLSPLYSSSLSQALDQRLNLARFGEQAKATREARRQKRWHDEVDVSYPSIAVQNMGGTKPQNISALNSARSGRSYLLNSAPPQWRSQIKPPLDHDTLFRERGEVDALTYADRRDMRQFLLSVKDVENNREIRNQRRRYLDQLIDTLFGYVASVQNLRPAGWSKDSRLNTPLQLWLDPFRCRQDDAFRYAREGGDWKEQVAHEFGQWLNDRLQHEKLIFGEVERREWSTAALFKQRLRETERALKEELA

SEQ ID NO: 8479 - protein, 274 aa, Aspergillus niger CBS 513.88; identical to SEQ ID NO: 7641

SEQ ID NO: 8480 - protein, 605 aa, Trichomonas vaginalis G3
MKQEAAIKQLCEQIREENNDLMELSSYLFNLSNEDVLNFDTIFEKIRNIFIEKYEMEPANVLKLLYDANVFNNHAGELYWMLCKLLLKEYPISIYKLRVFRGILCDNFNELFNKVIVNKSKYLAQDSDTIPREFKRLQKEELHRIVMNDDIVNFKEYILEHNFDSKKQYKLNDNYKSVSLLEECAYFGSPSIFYFLLYNCNCKITDICLELSFIGGNDDIINECCNVLSVNDRCLENAIRSHNNVLIPKMLEFNNVQIDPESVIDSMNISIMLQQIEENPINIIYYLPGFPIQKFSAKIFDIVAMNFDINSDILFVKSLYYNNVKLAEHLLPNVKDIEISDDTNGKKAIHYASYFNQKELVEKLIKRGANVNSRDSTGRTPLHDAASTNARDLAELLLDNGADFNIVDNFYGAKPLHIAANKNSKETAELLIRKGCDVDTKDDISMLTPLHYTIEYNCKETAKFLIEEGADVNAKDFEGNTALYKSAEHGKTDMVEFFIKNGADYKAKNDDGSSLLHALLSMNNKSSAEYLMTLGLDVNAKNLLGKTPLHIAVESFDRPYVEILLKYGADVNGKDFNGITPLQIASWKGDEELADILISHGATYA

SEQ ID NO: 8481 - protein, 2106 aa, Bombus impatiens
MTVVFFFIHLLPGDPARLVAGPEADDTVVNMIRHELGLDKPLWQQFGQFFINIINGDFGISIRTKRPVIDEIAMRFMPTLLLTLTSMFWSVLVGMAIGMVSAVWRNKWQDRLGWLPTVGAASWQHYILPSLTLGASVAAVMARFTRSSFIDVLHEDYIRTARAKGLKESVVVIKHSLRNAMIPVITMMGLQFGFLLGGSIIVEKVFNWPGLGRLLIDSVEARDYPIIQIEVLLFSLEFILINLVVDFLYAAMNPTILAASFILLLIVVAIFGRWLAPYDAENDFDYMLINEGPSMAHWFGVDALGRDIFSRILIGTQLSLTAGFFSVALGAVVGTMMGLMAGFYGGWWDRITMRISDVLFAFPGMLLAIGVVAIMGNGMINVIVAVSIFSIPAFARLVRGNTLVLKNMTYIEAVKSIGASNWTIIMRHILPGTVSGIVVYFTMRIGTSIITAASLSFLGLGAQPPTPEWGAMLNEAQADMMIAPHVAIFPSLAIFFTVLAFNLLGKLRSGELDLITDIAGITVGHCTLDQGAIQTGVTVIKPHCLDPYLHKVPAAATVINGFGKSVGLMQLDELGVFETPIALTNTFSVSSVAQAQIKQAITLNPEIGRAWPTINPLVFECNDGYLNDIQAMSITAEHYNTAYSQADRYMQQGSVGAGRGMSCFNLKGGIGSASRLVTLNHQQHYCVGALVLANFGILSMLTLAGQALGQQLAPCLQQMMSATEKGSIIMILATDAPLDYRQLKRLSLRAGIGLSRTGSFWGHGSGDIALAFSTAYTLPHDPEQPMPATAFIHETLLDPFFQAAAESVEQAIIHALYHAQAVQGRDNHQHIEGIAGVFHSEQTRAGNNEYEQARRWMAAEANAAALAVLDYAPNYQVTVNDSHGHFRNMNPDSFDPRVQLIQGKPRYLSMASGVELAPDALFMIGYHAKSKSRGILAHTINGFAFSRIWLNDLELGEAGLYAALAGEFNVPVAIASGDDCFIAETQLLLPHVTFIETKQAQGQFSGVSLTPKAACDKIYSTVHQFMQNNPSLPLFQLVAPITCQLQTQTPALADLFAQWPIVERVSGDMIQFNADGQRLINNQHYKLASAKLEKAQQANNLDAINEAKQLLCEINQRFEFENWMEDALNRRAAWFKIATHLSKAIHPSSKGCNVNYNTFQAKNPSSYISSATVAGLPNDATGNAAALDIFSLLNQKVNEKTNLLQLIIDDHPALQLAFSDDKDKAEIYLNNLRRIIYDSWQTPQASELNKQFYWPTSNKAYLAKQDNSYSVLIPLHPSSLCQVMYQKIQARFSEANKQAIANKNKKGTEKQAYFTFHDLAVIGIGGSNPQGVSQLASSQGGNYLLLPSLPPRFNVFRPIRLGKKQKTIFHRGLYYHCRTGFEALFYVVNSNLHNKAIRDKRKQDAFQVIIVELLQVVKQLQTTFKPGWSKDYPKLNIYQQYWLDPQRGQLDGESDFAFKYEQGDWIKEIEKQFALWIYAILQKKYEDMAEAFDDAEIRECQREFKNAIKASQRAIHALSRKIESEYNQSICLDGVMIACHDYELQIYRKNHFADYRFKLTRNPIGKNGKPQAIIQEGKVHLEVSLVVEVRCHSQLLCHQDQQIAFQTWVKQQLLQQRIAGGSVLSIEDVCLFDAMQDPQSIIMRLLPAYVLIDANQQLQEITQELQAIDPDMTGLDALVETAKLHHIPEKDSWQTRSVKKERGWLVPIHMGYQAISPLFAKGTVAHVRDERYPAQFVECLYGLGEWVFPYRLNDHFASAFWHYRTVSTENVETASVLAFNRHFDISDAIFFQQHSHSDKETSPILVTEKSVRGTISNRLKNAIANDPLKLDAEIEKANLQRVDVAMLDSDKDTLVVEWTCKVLPFDGKPSICNNIIYQDQLVSTIQSYIKEQGFTELALRYATNILNGRWLWRNRISAETIAIEVTPLDMLHRKSQAPINIADCKQLSLVDFTDNQTAIQQLANLIEEGLSGQSFVIFKVQAKLKMGFGQEVYPSQELILDTDKNKSKILYSKKDNQAAMHSQKVSNAIRTIDTWYDDMAEFPIAIEPYGAVTTMGHAFRQPKQKLDFYTLFDNWIIKGEKPDISQQHYIVGVLIRGGVFGASGKE

SEQ ID NO: 8482 - protein, 244 aa, Thermothelomyces thermophilus ATCC 42464
MAEPAPKNGDTEPVSQVNHDPVPQPAGPLPVNEADEGKDRTDTKETVTKATAESSAAVADAEISSKGKEKNEPSLPPAEEPKEGDSLSTGPSYPPQHAVTPSHPDAPVCAITLLLPTGARHPYKIDEKYLSKRNVDVPDLTESGARDPFSISVYKLKELILREWREEWEGKPASPSSIRLIHFGKLLDDKEQLKKYHFSQDSPNVVHMSVRPPEMMEEEEAAHSKASGREGRTRDGGSGCCVIL

SEQ ID NO: 8483 - protein, 451 aa, Ceratitis capitata
MRSKQITNCREVTTLEQEHLSAFITDYITARRQPKLEAFDKEAQKRLDQGTPEADIAADRQALEARYHPRTWLADAARRAGQISLVTHAAKFTHSDAKGSSIYSETSAAEGYLSTAALPVLLSDAVGNAAALDVAKLLQTEVGGDSLLTCLRRGEHRPLRAFAESDAELAQWVEGFSRALAPAEPASHKLAKQVYFPVDGGYHLLNPLFATSLAHAVQSRIVEARFGDAAKEAREAWKAKRQHDAPVVFYPGLAEMHFGGTKPQNISALNSARGGRMSLLSCRPPEWERQNSPPKGLRSIFAARGDFNRHARPVIGRVNALLDKSARYNVGQIRRARESYIDQLIDLLFAHVATLQQESWKGWTLNNPDLPAHQQLWLDPWRGQSDAAFRAGREQGDWQKLVADDFARWLNQRLRVAKLEVGNVERREWRTRPQFRYRMREMEAILQEVLK

SEQ ID NO: 8484 - protein, 449 aa, Actinobacillus pleuropneumoniae serovar 5b str. L20; identical to SEQ ID NO: 7538

SEQ ID NO: 8485 - protein, 448 aa, Yersinia pestis Pestoides F; identical to SEQ ID NO: 51

SEQ ID NO: 8486 - protein, 435 aa, Enterobacter sp. 638; identical to SEQ ID NO: 7540

SEQ ID NO: 8487 - protein, 431 aa, Dichelobacter nodosus VCS1703A; identical to SEQ ID NO: 7541

SEQ ID NO: 8488 - protein, 453 aa, Shewanella baltica OS185; identical to SEQ ID NO: 7542

SEQ ID NO: 8489 - protein, 448 aa, Yersinia pseudotuberculosis IP 31758; identical to SEQ ID NO: 7543

SEQ ID NO: 8490 - protein, 469 aa, Coxiella burnetii Dugway 5J108-111; identical to SEQ ID NO: 7545

SEQ ID NO: 8491 - protein, 420 aa, Coxiella burnetii Dugway 5J108-111; identical to SEQ ID NO: 7544

SEQ ID NO: 8492 - protein, 453 aa, Shewanella baltica OS195; identical to SEQ ID NO: 7547

SEQ ID NO: 8493 - protein, 465 aa, Delftia acidovorans SPH-1; identical to SEQ ID NO: 7546

SEQ ID NO: 8494 - protein, 122 aa, Coxiella burnetii RSA 331; identical to SEQ ID NO: 7548

SEQ ID NO: 8495 - protein, 448 aa, Yersinia pestis Angola; identical to SEQ ID NO: 7549

SEQ ID NO: 8496 - protein, 449 aa, Actinobacillus pleuropneumoniae serovar 3 str. JL03; identical to SEQ ID NO: 7550

SEQ ID NO: 8497 - protein, 416 aa, Acinetobacter baumannii AYE; identical to SEQ ID NO: 7557

SEQ ID NO: 8498 - protein, 448 aa, Yersinia pseudotuberculosis YPIII; identical to SEQ ID NO: 7551

SEQ ID NO: 8499 - protein, 448 aa, Yersinia pseudotuberculosis PB1/+; identical to SEQ ID NO: 7552

SEQ ID NO: 8500 - protein, 447 aa, Erwinia tasmaniensis Et1/99; identical to SEQ ID NO: 7644

SEQ ID NO: 8501 - protein, 449 aa, Actinobacillus pleuropneumoniae serovar 7 str. AP76; identical to SEQ ID NO: 7554

SEQ ID NO: 8502 - protein, 122 aa, Coxiella burnetii CbuG_Q212; identical to SEQ ID NO: 7555

SEQ ID NO: 8503 - protein, 420 aa, Coxiella burnetii CbuK_Q154; identical to SEQ ID NO: 7556

SEQ ID NO: 8504 - protein, 416 aa, Acinetobacter baumannii AB0057; identical to SEQ ID NO: 7557

SEQ ID NO: 8505 - protein, 416 aa, Acinetobacter baumannii AB307-0294; identical to SEQ ID NO: 7557

SEQ ID NO: 8506 - protein, 448 aa, Yersinia pestis CO92; identical to SEQ ID NO: 51

SEQ ID NO: 8507 - protein, 435 aa, Escherichia coli S88; identical to SEQ ID NO: 7529

SEQ ID NO: 8508 - protein, 435 aa, Escherichia coli ED1a; identical to SEQ ID NO: 7649

SEQ ID NO: 8509 - protein, 435 aa, Escherichia coli LF82; identical to SEQ ID NO: 7529

SEQ ID NO: 8510 - protein, 449 aa, Erwinia pyrifoliae Ep1/96; identical to SEQ ID NO: 7651

SEQ ID NO: 8511 - protein, 303 aa, Listeria monocytogenes serotype 4b str. CLIP 80459; identical to SEQ ID NO: 7526

SEQ ID NO: 8512 - protein, 528 aa, Laribacter hongkongensis HLHK9; identical to SEQ ID NO: 7559

SEQ ID NO: 8513 - protein, 438 aa, Tolumonas auensis DSM 9187; identical to SEQ ID NO: 7560

SEQ ID NO: 8514 - protein, 454 aa, Desulfovibrio magneticus RS-1; identical to SEQ ID NO: 7634

SEQ ID NO: 8515 - protein, 441 aa, Dickeya dadantii Ech703; identical to SEQ ID NO: 7561

SEQ ID NO: 8516 - protein, 445 aa, Dickeya zeae Ech1591; identical to SEQ ID NO: 7562

SEQ ID NO: 8517 - protein, 451 aa, Photorhabdus asymbiotica; identical to SEQ ID NO: 7646

SEQ ID NO: 8518 - protein, 451 aa, Photorhabdus asymbiotica; identical to SEQ ID NO: 7647

SEQ ID NO: 8519 - protein, 439 aa, Zymomonas mobilis subsp. mobilis NCIMB 11163; identical to SEQ ID NO: 7563

SEQ ID NO: 8520 - protein, 444 aa, Pectobacterium wasabiae WPP163; identical to SEQ ID NO: 7564

SEQ ID NO: 8521 - protein, 445 aa, Dickeya dadantii Ech586; identical to SEQ ID NO: 7567

SEQ ID NO: 8522 - protein, 455 aa, Xanthomonas albilineans GPE PC73; identical to SEQ ID NO: 7653

SEQ ID NO: 8523 - protein, 424 aa, Thioalkalivibrio sp. K90mix; identical to SEQ ID NO: 7568

SEQ ID NO: 8524 - protein, 452 aa, Nitrosococcus halophilus Nc 4; identical to SEQ ID NO: 7569

SEQ ID NO: 8525 - protein, 448 aa, Yersinia pestis Z176003; identical to SEQ ID NO: 51

SEQ ID NO: 8526 - protein, 457 aa, Moraxella catarrhalis RH4; identical to SEQ ID NO: 7572

SEQ ID NO: 8527 - protein, 457 aa, Desulfurivibrio alkaliphilus AHT2; identical to SEQ ID NO: 7573

SEQ ID NO: 8528 - protein, 449 aa, Nitrosococcus watsonii C-113; identical to SEQ ID NO: 7574

SEQ ID NO: 8529 - protein, 445 aa, Dickeya dadantii 3937; identical to SEQ ID NO: 7575

SEQ ID NO: 8530 - protein, 458 aa, Halomonas elongata DSM 2581; identical to SEQ ID NO: 7656

SEQ ID NO: 8531 - protein, 387 aa, Desulfurispirillum indicum S5; identical to SEQ ID NO: 7579

SEQ ID NO: 8532 - protein, 867 aa, Clostridium lentocellum DSM 5427; identical to SEQ ID NO: 7583

SEQ ID NO: 8533 - protein, 425 aa, Marinomonas mediterranea MMB-1; identical to SEQ ID NO: 7584

SEQ ID NO: 8534 - protein, 400 aa, Sphaerochaeta coccoides DSM 17374; identical to SEQ ID NO: 7585

SEQ ID NO: 8535 - protein, 434 aa, Gallibacterium anatis UMN179; identical to SEQ ID NO: 7586

SEQ ID NO: 8536 - protein, 465 aa, Delftia sp. Cs1-4; identical to SEQ ID NO: 7587

SEQ ID NO: 8537 - protein, 471 aa, Methylomonas methanica MC09; identical to SEQ ID NO: 7588

SEQ ID NO: 8538 - protein, 383 aa, Megasphaera elsdenii DSM 20460; identical to SEQ ID NO: 7664

SEQ ID NO: 8539 - protein, 437 aa, Klebsiella oxytoca KCTC 1686; identical to SEQ ID NO: 7594

SEQ ID NO: 8540 - protein, 434 aa, Pasteurella multocida 36950; identical to SEQ ID NO: 7593

SEQ ID NO: 8541 - protein, 444 aa, Rahnella aquatilis CIP 78.65 = ATCC 33071; identical to SEQ ID NO: 7595

SEQ ID NO: 8542 - protein, 453 aa, Shewanella baltica OS678; identical to SEQ ID NO: 7547

SEQ ID NO: 8543 - protein, 444 aa, Pasteurella multocida subsp. multocida str. HN06; identical to SEQ ID NO: 7596

SEQ ID NO: 8544 - protein, 384 aa, Selenomonas ruminantium subsp. lactilytica TAM6421; identical to SEQ ID NO: 7635

SEQ ID NO: 8545 - protein, 417 aa, Spirochaeta africana DSM 8902; identical to SEQ ID NO: 7597

SEQ ID NO: 8546 - protein, 448 aa, Yersinia pestis D106004; identical to SEQ ID NO: 51

SEQ ID NO: 8547 - protein, 448 aa, Yersinia pestis D182038; identical to SEQ ID NO: 51

SEQ ID NO: 8548 - protein, 448 aa, Yersinia pestis A1122; identical to SEQ ID NO: 51

SEQ ID NO: 8549 - protein, 439 aa, Zymomonas mobilis subsp. mobilis ATCC 10988; identical to SEQ ID NO: 7589

SEQ ID NO: 8550 - protein, 448 aa, Yersinia pestis biovar Medievalis str. Harbin 35; identical to SEQ ID NO: 51

SEQ ID NO: 8551 - protein, 451 aa, Xanthomonas campestris pv. raphani 756C; identical to SEQ ID NO: 7590

SEQ ID NO: 8552 - protein, 449 aa, Erwinia pyrifoliae DSM 12163; identical to SEQ ID NO: 7651

SEQ ID NO: 8553 - protein, 434 aa, Pseudomonas aeruginosa M18; identical to SEQ ID NO: 7592

SEQ ID NO: 8554 - protein, 435 aa, Escherichia coli IHE3034; identical to SEQ ID NO: 7529

SEQ ID NO: 8555 - protein, 435 aa, Escherichia coli UM146; identical to SEQ ID NO: 7529

SEQ ID NO: 8556 - protein, 435 aa, Escherichia coli O83:H1 str. NRG 857C; identical to SEQ ID NO: 7529

SEQ ID NO: 8557 - protein, 303 aa, Listeria monocytogenes 07PF0776; identical to SEQ ID NO: 7526

SEQ ID NO: 8558 - protein, 423 aa, Providencia stuartii MRSN 2154; identical to SEQ ID NO: 7599

SEQ ID NO: 8559 - protein, 444 aa, Pasteurella multocida subsp. multocida str. 3480; identical to SEQ ID NO: 7596

SEQ ID NO: 8560 - protein, 212 aa, Streptomyces hygroscopicus subsp. jinggangensis 5008; identical to SEQ ID NO: 8378

SEQ ID NO: 8561 - protein, 444 aa, Pectobacterium sp. SCC3193; identical to SEQ ID NO: 7602

SEQ ID NO: 8562 - protein, 448 aa, Aggregatibacter actinomycetemcomitans D7S-1; identical to SEQ ID NO: 7601

SEQ ID NO: 8563 - protein, 421 aa, Methylophaga frappieri; identical to SEQ ID NO: 7603

SEQ ID NO: 8564 - protein, 434 aa, Pseudomonas aeruginosa DK2; identical to SEQ ID NO: 7604

SEQ ID NO: 8565 - protein, 436 aa, Zymomonas mobilis subsp. mobilis ATCC 29191; identical to SEQ ID NO: 7605

SEQ ID NO: 8566 - protein, 157 aa, Marinobacter sp. BSs20148; identical to SEQ ID NO: 7606

SEQ ID NO: 8567 - protein, 444 aa, Pectobacterium carotovorum subsp. carotovorum PCC21; identical to SEQ ID NO: 7607

SEQ ID NO: 8568 - protein, 303 aa, Listeria monocytogenes ATCC 19117; identical to SEQ ID NO: 7526

SEQ ID NO: 8569 - protein, 303 aa, Listeria monocytogenes SLCC2378; identical to SEQ ID NO: 7526

SEQ ID NO: 8570 - protein, 303 aa, Listeria monocytogenes SLCC2540; identical to SEQ ID NO: 7526

SEQ ID NO: 8571 - protein, 303 aa, Listeria monocytogenes SLCC2755; identical to SEQ ID NO: 7620

SEQ ID NO: 8572 - protein, 303 aa, Listeria monocytogenes serotype 7 str. SLCC2482; identical to SEQ ID NO: 7620

SEQ ID NO: 8573 - protein, 303 aa, Listeria monocytogenes L312; identical to SEQ ID NO: 7526

SEQ ID NO: 8574 - protein, 299 aa, Alcanivorax dieselolei B5; identical to SEQ ID NO: 7608

SEQ ID NO: 8575 - protein, 303 aa, Listeria monocytogenes serotype 4b str. LL195; identical to SEQ ID NO: 7526

SEQ ID NO: 8576 - protein, 421 aa, Thioalkalivibrio nitratireducens DSM 14787; identical to SEQ ID NO: 7611

SEQ ID NO: 8577 - protein, 458 aa, Desulfovibrio hydrothermalis AM13 = DSM 14728; identical to SEQ ID NO: 7671

SEQ ID NO: 8578 - protein, 445 aa, Serratia marcescens FGI94; identical to SEQ ID NO: 7612

SEQ ID NO: 8579 - protein, 241 aa, Morganella morganii subsp. morganii KT; identical to SEQ ID NO: 7615

SEQ ID NO: 8580 - protein, 212 aa, Streptomyces hygroscopicus subsp. jinggangensis TL01; identical to SEQ ID NO: 8378

SEQ ID NO: 8581 - protein, 413 aa, Taylorella asinigenitalis 14/45; identical to SEQ ID NO: 7666

SEQ ID NO: 8582 - protein, 346 aa, Taylorella equigenitalis 14/56; identical to SEQ ID NO: 7665

SEQ ID NO: 8583 - protein, 506 aa, Psychrobacter sp. G; identical to SEQ ID NO: 7616

SEQ ID NO: 8584 - protein, 303 aa, Listeria monocytogenes; identical to SEQ ID NO: 7526

SEQ ID NO: 8585 - protein, 303 aa, Listeria monocytogenes; identical to SEQ ID NO: 7526

SEQ ID NO: 8586 - protein, 303 aa, Listeria monocytogenes; identical to SEQ ID NO: 7620

SEQ ID NO: 8587 - protein, 303 aa, Listeria monocytogenes; identical to SEQ ID NO: 7526

SEQ ID NO: 8588 - protein, 303 aa, Listeria monocytogenes J1816; identical to SEQ ID NO: 7526

SEQ ID NO: 8589 - protein, 303 aa, Listeria monocytogenes J1-220; identical to SEQ ID NO: 7526

SEQ ID NO: 8590 - protein, 303 aa, Listeria monocytogenes; identical to SEQ ID NO: 7620

SEQ ID NO: 8591 - protein, 303 aa, Listeria monocytogenes; identical to SEQ ID NO: 7526

SEQ ID NO: 8592 - protein, 303 aa, Listeria monocytogenes; identical to SEQ ID NO: 7526

SEQ ID NO: 8593 - protein, 435 aa, Escherichia coli PMV-1; identical to SEQ ID NO: 7529

SEQ ID NO: 8594 - protein, 443 aa, Desulfovibrio gigas DSM 1382 = ATCC 19364; identical to SEQ ID NO: 7626

SEQ ID NO: 8595 - protein, 431 aa, Candidatus Symbiobacter mobilis CR; identical to SEQ ID NO: 7627

SEQ ID NO: 8596 - protein, 458 aa, Desulfovibrio hydrothermalis; identical to SEQ ID NO: 7671

SEQ ID NO: 8597 - protein, 419 aa, Streptomyces rapamycinicus NRRL 5491; identical to SEQ ID NO: 7617

SEQ ID NO: 8598 - protein, 434 aa, Pseudomonas aeruginosa SCV20265; identical to SEQ ID NO: 7629

SEQ ID NO: 8599 - protein, 303 aa, Listeria monocytogenes serotype 4b str. F2365; identical to SEQ ID NO: 7526

SEQ ID NO: 8600 - protein, 443 aa, Pectobacterium atrosepticum SCRI1043; identical to SEQ ID NO: 7637

SEQ ID NO: 8601 - protein, 448 aa, Yersinia pseudotuberculosis IP 32953; identical to SEQ ID NO: 7552

SEQ ID NO: 8602 - protein, 421 aa, Legionella pneumophila str. Lens; identical to SEQ ID NO: 7639

SEQ ID NO: 8603 - protein, 421 aa, Legionella pneumophila str. Lens; identical to SEQ ID NO: 7638

SEQ ID NO: 8604 - protein, 439 aa, Zymomonas mobilis subsp. mobilis ZM4 = ATCC 31821; identical to SEQ ID NO: 7527

SEQ ID NO: 8605 - protein, 450 aa, Nitrosococcus oceani ATCC 19707; identical to SEQ ID NO: 7528

SEQ ID NO: 8606 - protein, 435 aa, Escherichia coli UTI89; identical to SEQ ID NO: 7529

SEQ ID NO: 8607 - protein, 448 aa, Yersinia pestis Nepal516; identical to SEQ ID NO: 51

SEQ ID NO: 8608 - protein, 448 aa, Yersinia pestis Antiqua; identical to SEQ ID NO: 51

SEQ ID NO: 8609 - protein, 434 aa, Pseudomonas aeruginosa UCBPP-PA14; identical to SEQ ID NO: 7533

SEQ ID NO: 8610 - protein, 435 aa, Escherichia coli APEC O1; identical to SEQ ID NO: 7529

SEQ ID NO: 8611 - protein, 418 aa, Psychromonas ingrahamii 37; identical to SEQ ID NO: 7534

SEQ ID NO: 8612 - protein, 432 aa, Shewanella sp. W3-18-1; identical to SEQ ID NO: 7535

SEQ ID NO: 8613 - protein, 481 aa, Acidovorax sp. JS42; identical to SEQ ID NO: 7536

SEQ ID NO: 8614 - protein, 450 aa, Verminephrobacter eiseniae EF01-2; identical to SEQ ID NO: 7537

SEQ ID NO: 8615 - protein, 291 aa, Treponema pallidum subsp. pallidum str. Nichols
MRTHDIPRSPLVGHKKNAAPDGIGASRACCPARENEPFKKGSTNSRGGGVEWSRSSTRRVRGSALERGMKQLKWWAVGPVLGICAGVWGAAHPVHADPWDTTAAGRSTIRLSAMGAVPLFQVDWCNSGRGDDRNANAQTNGHKYIYPAFSAALGFEHFVCRGLSLGIDASVQYHCSYPNNTYSPTTPYYYLAIPVALTAGYTVAFWRIRLPLTVGAGFNYQHYYTSTYYGLVLKAAAGCYFQLTEHWSLGVSATYSGVPRSCEKIIEEDRQQTNTRTAQFIAAGVDVRYHL

SEQ ID NO: 8616 - protein, 327 aa, Pasteurella multocida subsp. multocida str. Pm70
MFQTDFYILFDHIKVQSANAISGPLSYGFPALTGLTGAMHALNRKLTHHPVQFGGVMVACHDYELQTYQNSAFSDRTFKQTRNPIKRNGETASIIEEGKIHLDLSLVVEVHVQDDRVFEALTDKTSQASQDFLQTCKNLLWQQRIAGGSVLEIGNVQLFNLEEDQDIPLALMPAFVLMDAKQELANITEELKTGLRIGQLDEEGNVQKSCLPSCPEATALDALLEMATVHHIPEHANATASAWQTYSVKKGRGWLVPLPVGYQAISPLFAPGQLQHCRTQQYPSQYVETLYSLGKWVFPLSLPENLSQCFWRYTAPQNNLYLISQGE

SEQ ID NO: 8617 - protein, 316 aa, Yersinia pestis KIM10+; identical to SEQ ID NO: 53

SEQ ID NO: 8618 - protein, 332 aa, Chromobacterium violaceum ATCC 12472
MPINPRSLAQGLLILPRLRVQNANALSSPHTWGFPALSAFTGLMTALERKLGADSELAFHGVGVICHGYQAHTNGDYIQRFNLSRNPVDKDGGTAAIVEEGRIHLDLTLVFGVSGNALAQNDDALAERAAAISRALETMRVAGGTLIPPPAGHYAPKPQLITLPEGEDERAARFRALRRRWLPGFALVARDDLLSGHHARLRETAPGATLLDAWLDKSRLNHWPEAGDGGQTIWRHSRQQGEGWIVPIPVGYGALSELYPAGSVANARDAAAPFRFVESLYSLGEWISPHRLQDAADLLWYPAYDAELGVYRCRNDYQPPSPSTQNDLGVEA

SEQ ID NO: 8619 - protein, 316 aa, Yersinia pestis biovar Microtus str. 91001; identical to SEQ ID NO: 53

SEQ ID NO: 8620 - protein, 337 aa, Zymomonas mobilis subsp. mobilis ZM4 = ATCC 31821
METELPASSHMLILPHIRVQNANAISSPLTHGFPSITAFMGFMWALERKAHAAGIDDIMFNAVGVVCHDFQEQVTDSGFTYAFNLTRNPIEKDGKTAPIIEEGRIHLDVSLLLAIAFKNEDIENYQIDEYVEKIAIFVQNMRIAGGSIIPPSPNMAKHRKPHWIECNTFSDNDNNFSDFRKNCYRLLPGYALVERSDLIPERSKKMQETQPDATSLDAWLSLSRVNWRCKSEAQSPKTETKKENIWENDRDNGWIVPMPVGYGAVGEMQPSGSVSSARDNTIPFQPVESLFSIGEWIAPFRLKHPNDLLWYPSSSLGEKNLLEKSVYRCHNFYQYSL

SEQ ID NO: 8621 - protein, 309 aa, Nitrosococcus oceani ATCC 19707
MSSYYLLLPTLHVTGCNWESSHLTRSLPLTAMAGFADYLVYFELADNAAEAGADLKGFAVCLHDGQIHEGLSKNPLALCKGNGLSQARDDLLNPPLLPEVKGSLSLSLVVALELEDKSALDEWLKNRATAFLQTRRLAGGDIIGIGQPKIYSKRSELAREMGRLPPGWFIGNGAEFISNAPDPFAALINATAWFPVEDKEPQTTSAHPSPSKRRQHPRHWLYATCVGYQLLESPQPRRNRSHGSSDTNSATNHAYAEPVHSLAELVWARKLLQPQDDSTTDNWLTENNLLWRWETDPPSRTVYLSTQAL

SEQ ID NO: 8622 - protein, 70 aa, Escherichia coli UTI89
MSYLLLLPHIRIENANAVSGLTWGFPSMTHFLGYVHALSRKVVDEFGVSFDGCAVVSHEQHIQAYSSGRD

SEQ ID NO: 8623 - protein, 213 aa, Escherichia coli UTI89
MHLTVSLLIECNGEITNGEYGRKVLCDYLKMLCQSHKLAGGSIVSMRDPQLFHAPEDEKQLRKIVWRLMPGYALYDRSEWLAEHHQQHPDISLLDAWLDFAAIKYQAESPAEDNSAKWVYQPKPIPGFLVPLMCGYQRISPVYAPGEVENARDTVTPFAFAEAVYGIGEWRGLHRTTDLQALMWRYRTTDTGYYCSATPVVDDFTFNEYDDLE

SEQ ID NO: 8624 - protein, 316 aa, Yersinia pestis Antiqua; identical to SEQ ID NO: 53

SEQ ID NO: 8625 - protein, 316 aa, Yersinia pestis Nepal516; identical to SEQ ID NO: 53

SEQ ID NO: 8626 - protein, 213 aa, Escherichia coli APEC O1; identical to SEQ ID NO: 8623

SEQ ID NO: 8627 - protein, 327 aa, Pseudomonas aeruginosa UCBPP-PA14
MSVTDPEALLLLPRLSIQNANAISSPLTWGFPSPGAFTGFVHALQRRVGISLDIELDGVGIVCHRFEAQISQPAGKRTKVFNLTRNPLNRDGSTAAIVEEGRAHLEVSLLLGVHGDGLDDHPAQEIARQVQEQAGAMRLAGGSILPWCNERFPAPNAELLMLGGSDEQRRKNQRRLTRRLLPGFALVSREALLQQHLETLRTTLPEATTLDALLDLCRINFEPPATSSEEEASPPDAAWQVRDKPGWLVPIPAGYNALSPLYLPGEVRNARDRETPLRFVENLFGLGEWLSPHRVAALSDLLWYHHAEPDKGLYRWSTPRFVEHAIA

SEQ ID NO: 8628 - protein, 701 aa, Shewanella sp. ANA-3
MVKNLHLRELLDIEDVQARSTALRRAFAAYTEPLDVTGEESSALIILLNLTYPKKLVDDLLDKRLARTTVNNQTHIDVCIDEVQWLHTHNLKYPDIRVSKQRLVASSPQLHPNMLSSANCQRTLGWSHDSAKVNFAKLFGCQFIWQDKVTCLATLMCEAPKHWKEAFQELGMPVKQFMNICGRVKHVLPAQLSPDKVDKYSVQVRMPFRDGYIAITPVVSHALQSELQQAAIKKQGRYTSLEFIRPAAVSELVASLGGNAKALNYPPRINKKTHGLGNNLLARVLSGHDVLNQNVLSQPRFMRVLDELLSSESALALKQRRQQKVANLRQIRTMLSEWLAPMLEWRLEVKEGPILLSELEPINGSLEYQFLTFENELLPELLLPLFDRLNSVMSHSAMISQYAFHQRLMPLLRNSLKWLLTHLAYKEPLLQNDAADEHFQRYLHLKGIRVFDAQALSNPYCVGIPSLTAVWGMMHNYQRRLNEGLGTQLRFTSFSWFIRQYSSVSGKKLPEYGMQGSKENQFRRAGIIDNRHCDLVFDLVIHIDGYEDALAILDNRTEMLKASFPANFAGGVMHPPELDAVGAWCQLYQCEAELFSTLKRLPMSGKWIMPTRYSMGNVNDLLFLLDKNSSLCPTMFGYLPLTEPVSRVGSLEPLHCYAEPALGVVECASAIEIRLQGQINYFKRAFWMLEAKEHSMLMKRI

SEQ ID NO: 8629 - protein, 318 aa, Psychromonas ingrahamii 37
MSEIQRVLLLPHIKVHNANALSSPFTIGFPAMTAWLGAVHALQRKLNAKGYDAVKFISVGVVSHQCDLQTHKGVGDYVHSIIGTGNPLDKTGSRSAFIEEARCHLDVSLIIEYTGTAKENEDAVKDKITQLLNSSMKMAGGDILTFNLPDFFKIEAGNTKDIHKLIRKVMPGYALIERRDLMIEAMEQGQDAIDAVLDNLAIHHTATTDENTKGESTVTWSSKRKTKGWIVPIATGFHGLTELGQAKNQRDPNTLHRFAESVVTLGEFKMPHRIKSLNEILWSYHADIPNNLYLCTQNCVTKTTNLSPITNQLSTLFD

SEQ ID NO: 8630 - protein, 316 aa, Shewanella sp. W3-18-1
MIGEVKKLLIIPHIKVHNANALSSPFTIGFPAMTAWLGGVHALQRHVNAQDIPVNFLATGVVSHDVNLQTYKGDNDYVHSIVGTGNPLDKTGARSAFIEEARCHLEISLVIEFNGITIDEHEHLLSAVTQLLHAKMKLAGGDIKSFQPPFCINNSEGDDKDLRKLQRHLMPGYVLIERRDLMQAAMAEGVDALNALIDYLAVHHSCDQDEEGNIEWRSYRKTLENKPAGWVVPIATGYHALSELSDAKNQRDPNTSHRFAESLVTLGEFKMPHRLHSVEQMLWRYHIDGDLYLCQQKHSESPKSASSGLTSIESEF

SEQ ID NO: 8631 - protein, 360 aa, Acidovorax sp. JS42
MSPQQTQAILVLPHLRIQNANAIGSPLTHGFPSITAFTGVMWALERKLAEAGVPLQLHGVGVVCHHHQEQVTQGYVRNFNLTRNPVDKDGSTAAIVEEGRMHLQITLVLAVSEKRAPGTPAALVQSNQAKLDEWAAQAGHILAGMRVAGGSVLPSRPVPGKRVRPWMAVVPEDPVAAEKEFRQWRRQWLPGFALVGRDDLLAQYLQALRTAQPDATLLDAWLHAARFNYAPVVPDGEASAPDGQVKWEDPQRRKGSGWVVPIPVGYAALTPSHAPGTVRNARDASVPMRFVESVYALGEWISPHRLTHLAQLLWHAEANEAQGLYRCRNGYQPAQSEDANSNSNTETLDEWDDDEAYAYT

SEQ ID NO: 8632 - protein, 347 aa, Verminephrobacter eiseniae EF01-2
MTTPPPKAILVLPHLRVQNANAISSPLTHGFPSITAFMGLMWALERKLAQEKIALHLQAVGVICHHHQEQVTQGFVRTFNLTRNPVDEHGDTAAIVEEGRIHLDITLLFVVTEKRTAGESARLGNEEQMQEWASAAGAILAQMRVAGGTLLPSRPAPGKRRRPWMAMLDEEGQARAKQFRLWRRQWLPGFALVGRDHLLSDRLAALRVTKPETTLLDAWLHAARRNRQPVPPKEGEVIPADQLWEDPWRRKGGGWTVPIPVGYAALAPGHQAGTVQNARDMSTPLRFVESVYSFGEWISPHRLSQPEELWWYPESDQAKGLYRCRNGHATASENNNQDWDIDSDDDY

SEQ ID NO: 8633 - protein, 319 aa, Actinobacillus pleuropneumoniae serovar 5b str. L20
MNYPNFYLLFDHVEIQAANTISSPITYGFPSLTGFTGAIHALSRKLFPQQVELGGVMIACHDYQILGYKNSDFSDLTFNQTRNPLKKNGDSPSIIEEGKIHLDISLVVEMEVKDPELYYALNSQDSEQKTQFLEHCKKLLMQQRIAGGSVFQIENVELFNLSDTKEIKLALMPAFVLMDAKQTLADITQSLQSGISNNEITIYPATPNANALDALLEVATLHHIPLSEHATSQEWETFNVNQGKGWLVPIPVGYQAISPLFTAGEMQNCRVTEYPSQYVETVYSLGKWVFPFSLPDDLSQCFWHYNTPQDNLYLITQGA

SEQ ID NO: 8634 - protein, 227 aa, Treponema paraluiscuniculi
MERGMKQLKWWAVGPVLGICAGVWGAAHPVHADPWDTTAAGRSTIRLSAMGAVPLFQVDWCNSGRGDDRNANAQTNGHKYIYPAFSAALGFEHFVCRGLSLGIDASVQYHCSYPNSTYSPTTPYYYLAIPVALTAGYTVAFWRIRLPLTVGAGFNYQHYYTSTYYGLVLKAAAGCYFQLTEHWSLGVSATYSGVPRSCEKIIEEDRQQTNTRTAQFIAAGVDVRYHL

SEQ ID NO: 8635 - protein, 316 aa, Yersinia pestis Pestoides F; identical to SEQ ID NO: 53

SEQ ID NO: 8636 - protein, 310 aa, Enterobacter sp. 638
MSSIILLRRIRVENANAVAGLTYGFPSITHFLGFTHLLSRKLPDDGLILNNCAVICHDHHVHKYSVGWDNHFSLTRNPLRKDARPASFNEEGRMHMTVSLLIECHGEIANGEYGQQALTEYLRQICPTLRLAGGIIIDIQDITVLDMPTTENELCDLQWRLMPGFVLRDRSAWLVEHHQSLLANNPQTTLLDAWLDFAALKMQAETPEEGDINEGDSAQWKHIPKPKPGYLVPLMTGYQRISELYAPGVVANARDDQTPFAFTEAVYGVGEWCGLHRIKSLEEIFWRYHTTETGYYCQGADAPLATQHQN

SEQ ID NO: 8637 - protein, 316 aa, Dichelobacter nodosus VCS1703A
MSSIESFIYPDLKRVGFLLIKRLEVINANALSSPLTYGFPAITAFTGAVHALSRKINRSEALADIFLDGVLIAAHSCQPQTYREYFNKPFTFIQSRHPVEKTGDTAPIIQEGYCHLTVSLLIGVYAKDGYLSEEQIEALKKQLFIAIQQQPLAGGNVIGLDAQEPIQFYKDDVDQCVSELLPAFVLIDAHKELTAITQELQKDNPAATALDALIETASLHHIPSDEQENNWEIYSVKKGRGWLVPIPIGYQGISPQYDAGVMKNARNPHYPSQYVEALYSLGKWVFPYSIDLIDNAMWYQKYDAEKDLYLVTHLME

SEQ ID NO: 8638 - protein, 331 aa, Shewanella baltica OS185
MSQYLLIKKLDVQNANAIAGLTYGFPAITNFLGFAHALSRKLSRELDVSLGGVCVVSHKNRVHARQPKGWGDYVFALTRNPLTQQGNTAPINEEGRMNLQVSLLIEIKGLIQGDNQTEQMLIDQINALLPAMRLAGGQITHYGQIEILSDHEQQQKALRRLMPGFILIDRSDYLASHVNGLQQEVVHGAKPSLFDAWCDFATLNYQATRLDTEPEISGPSDTIKADWHYVPKPQAGYLVPIATGYCAISPVYEAGQVANVRDKSVPVAFAETAYSVGEWLSIHRLIDISAGIWRYSYQHPWYLAKTEPFQVDIPSIADVDAALTSFNLDDY

SEQ ID NO: 8639 - protein, 316 aa, Yersinia pseudotuberculosis IP 31758
MSSLIVLHQVRVENANAIAGLTYGFPAITHFLGYSHALSRKLQSSHGLTLRGCAVICHHQQVHAYSSGRDYVFSLTRNPLTKEAKTAAFNEEGRMHMTVSLVIECDGTIANGDDGANALEKHLASLCLTQRLAGGTITNIRRVKVINYPETEVATRRLLCRLLPGFALLDRSELLAEHLNRLRQTNPQAEMLDAWLDFSALKIQAIPPQSDTPVESGAPAPWGYVGKPAAGYLVPIVTGYRAISPLYAPGEVDKTRDPHTPFRFVESLYGIGEWRGLHRITDLRQLLWGYHQEGDNYLCRCALPASVDTYLLNDEE

SEQ ID NO: 8640 - protein, 320 aa, Coxiella burnetii Dugway 5J108-111
MSYNKILLIPHLRIHNANALSSPFTIGFPAMTAWLGATHALQRNLNERGIPVTIPATGVVSHQMDLQTYRGNDDYVSSIINTGNPLVPKTKREKGEPWHNFERPPFIEEARCHLDVSLLIEFRGVSQEQDDEIKEQVSHLLNCKMKVAGGDIQSFNPPAILLIEDGNDADLRRLSRKIMPGYVLIERRDLMIEAMQQGQDALDALIDYVAIHHSCEKTEDGDVLWESHRKTQIDKPPGWIVPIATGFHGISELGQAKNQRDPETPHRFAESLVTLGEFKMPHRFESVTDMLWCYQVDSTNNLYQCVALNTITENLYDEFG

SEQ ID NO: 8641 - protein, 339 aa, Coxiella burnetii Dugway 5J108-111
MEKEVKERTFFVKGDIMNNIDAYVILPNLRVKNVNTISSPLTWGFPSLTAIFGFVHALERKLRERYHLKFKDIAVTCHYFEAEAYRPLPYSDYSFSLTRNPPRTKKQIRNFEKGQPPSFVEEGRAHMEITLVIQAAGEAWREQKELLETEIMEVASTLRLAGGSILSYSMPLVNDEFIVKCPDVLEDQEIMGRKILKKLLPGSILIDRKDLLKARTQELQEENSDSTALDALLEFSSLNYEYDAESEIAWTPRKKSGWLVPIPVGYQAISKLYEPGYVRGARDAVSPCCFVESIYSLGQWVSPHRFKQISDIFWSYDEKSEAGLYRLVNSPENFIRNFN

SEQ ID NO: 8642 - protein, 640 aa, Vibrio campbellii ATCC BAA-1116
MQTLKELIASNPDDLKATLKRVFRPLTPHIAIDGKELDALTILVNLTDKTDDQKDLLDRAKCKQKLRDEKWWASCLNGVNYRQSHNPKFPDIRSEGIIRTEALSELPSFLLSSSKIPPYHWSYAHDSKYVNKSAFLTNEFCWNGGISCLAELLRDVDHPLWKTLAKLGCYQKTRKAIAKQLASIAHMTISVPLAPNYLTQISLPDSNTSYISLSPVTSLSMQSHFYQGLQDEYLHTATTRYSRSTNMGVTAMTCDGAFRMLKSNTKISTTPHHRLNSKRSWLTSEHVQSLTKYQRLNKRLMPENARKALRRKCKIEVLNLVNAWLAMQDCTLDSTILVQHLNHDLSCIGATKRFAYDPAMTKLFTELLKRALSNSINNGTQHTNGSYLVLPNIRVCGATALSSPVTVGVPSLTAFFGYVHAFERKLNSIYTAFRIESFAICIHQLHVEKRGLTAEFVAKGNGTISAPATHDDWQCDAVFSLILNTNFAQRIDQKTLITALPKRLARGSAKIAIDDFKYLNSFTTIETAIQSLPIKVGRWISLHTQPNNNLGDLLAAIKEDSQLMASCVGYHLLEEPKDKPNSLRGYKHAFAESIVGLIKSITFGSTTDANTILWSLNSHKNYLVVQPRSISDETTLESSL

SEQ ID NO: 8643 - protein, 362 aa, Delftia acidovorans SPH-1
MTQSPQPQAILTFPHLRVQNANAISSPLTHGFPSITAFTGLMWALERKLAQAGIPLRLHAVGVVCHHHQEQVTQGYVRSFNLTRNPVDKDGSTAAIVEEGRIHLDISLVFTVSEKRVPGSNSAPTLVQSAAEPMQQWADEAGQILSQMRVAGGSLLPSRAAPGRRVRPRLSVLAEDATERSRQFREWRRQWLPGFALVGRDDLLADRLHRLRDKAAHTTLLDAWLHASRFNHEPVSAAEGQPPPADGKHPWADPWRGPGSGWIVPVPVGYAALSPSHAAGEVLNARDATTPLRFVESVYSLGEWISPHRLTHLEQLLWHAHTDEKRGLYRCRSGYVPDPAAVADPDDAAAQEQEDDDSYAYT

SEQ ID NO: 8644 - protein, 331 aa, Shewanella baltica OS195
MSQYLLVKKLDVQNANAIAGLTYGFPAITNFLGFAHALSRKLSRELDVSLGGVCVVSHKNRVHARQPKGWGDYVFALTRNPLTQQGNTAPINEEGRMNLQVSLLIEIKGLIQGDNQTEQMLIDQINALLPAMRLAGGQITHYGQIEILSDHEQQQKALRRLMPGFILIDRSDYLASHVNGLQQEVVHGAKPSLFDAWCDFATLNYQATRLDTEPEISGPSDTIKADWHYVPKPQAGYLVPIATGYCAISPVYEAGQVANVRDKSVPVAFAETAYSVGEWLSIHRLIDISAGIWRYSYQHPWYLAKTEPFQVDIPSIADVDAALTSFNLDDY

SEQ ID NO: 8645 - protein, 316 aa, Yersinia pestis Angola; identical to SEQ ID NO: 53

SEQ ID NO: 8646 - protein, 319 aa, Actinobacillus pleuropneumoniae serovar 3 str. JL03
MNYPNFYLLFDHVEIQAANTISSPITYGFPALTGFTGAIHALSRKLFSQQVELGGVMIACHDYQILGYKHSDFSDLTFNQTRNPLKKNGDSPSIIEEGKIHLDISLVVEMEVKDPEFYYALNSQDSEQKTQFLEHCKKLLMQQRIAGGSVFQIENVELFNLSEESEIKLALMPAFVLMDAKQILTDITQSLQNGISNNEIMIYPATPNANALDALLEVATLHHIPLSENATSQEWETFNVNQGKGWLVPIPVGYQAISPLFTAGEMQNCRTNEYPSQYVETVYSLGKWVFPFSLPDDLSQCFWHYNTPQDNLYLITQGA

SEQ ID NO: 8647 - protein, 316 aa, Yersinia pseudotuberculosis YPIII
MSSLIVLHQVRVENANAIAGLTYGFPAITHFLGYSHALSRKLQSSHGLTLRGCAVICHHQQVHAYSSGRDYVFSLTRNPLTKEAKTAAFNEEGRMHMTVSLVIECDGTIANGDDGANALEKHLASLCLTQRLAGGTITNIRRVKVINYPETEAATRRLLCHLLPGFALLDRSELLAEHLNQLRQTNPQTEMLDAWLDFSALKIQAIPPQSDTPVESGAPAPWGYVGKPAAGYLVPIVTGYRAISPLYAPGEVDKTRDPHTPFRFVESLYGIGEWRGLHRITDLRQLLWGYHQEGDNYLCRCALPASVDTYLLNDEE

SEQ ID NO: 8648 - protein, 316 aa, Yersinia pseudotuberculosis PB1/+
MSSLIVLHQVRVENANAIAGLTYGFPAITHFLGYSHALSRKLQSSHGLTLRGCAVICHHQQVHAYSSGRDYVFSLTRNPLTKEAKTAAFNEEGRMHMTVSLVIECDGTIANGDDGANALEKHLASLCLTQRLAGGTITNIRRVKVINYPETEVATRRLLCHLLPGFALLDRSELLAEHLNQLRQTNPQTEMLDAWLDFSALKIQAIPPQSDTPVESGAPAPWGYVGKPAAGYLVPIVTGYRAISPLYAPGEVDKTRDPHTPFRFVESLYGIGEWRGLHRITDLRQLLWGYHQEGDNYLCRCALPASVDTYLLNDEE

SEQ ID NO: 8649 - protein, 327 aa, Pseudomonas aeruginosa; identical to SEQ ID NO: 8627

SEQ ID NO: 8650 - protein, 291 aa, Treponema pallidum subsp. pallidum SS14; identical to SEQ ID NO: 8615

SEQ ID NO: 8651 - protein, 319 aa, Actinobacillus pleuropneumoniae serovar 7 str. AP76
MNYPNFYLLFDHVEIQAANTISSPITYGFPALTGFTGAIHALSRKLFSQQVELGGVMIACHDYQILGYKHSDFSDLTFNQTRNPLKKNGDSPSIIEEGKIHLDISLVVEMEVKDPEFYYALNSQDSEQKTQFLEHCKKLLMQQRIAGGSVFQIENVELFNLSEESEIKLALMPAFVLMDAKQILTDITQSLQNGISNNEIMIYPATPNANALDALLEVATLHHIPLSENATSQEWETFNVNQGKGWLVPIPVGYQAISPLFTAGEMQNCRTTEYPSQYVETVYSLGKWVFPFSLPDDLSQCFWHYNTPQDNLYLITQGA

SEQ ID NO: 8652 - protein, 690 aa, Aliivibrio fischeri MJ11
MEFTDILIIQDVKERNRALKVAFAHYSSAICIDEHEVEAITCLLNLCTPKTEDYLDKTSASLFLNNHDNIQKCLDELKWFHSHNVKYPDCRVKGQSIISLPIDSVSNTINSNVVPYRLGWSHDSGKVNYTHFLLSCFKWRGVQTTLSQLFITDTLFWLDIIKKIQCNWTKKQTEQFIHSIQKEMPAKTLPENISPYSKQILFPYKNDYLTLTPVTSNSVQTWLEHQSRKPDDIRWIKRESKHSASVGALSSSIGGYHSLLFSPPSTSQSPHSYHDNMASKTGCREAFCTSAITEKSTTDALQRLISSEVRMNVKHRKKIRKSGVHFIRQKIALWLTPLIRWRDHIDNNQIQITNDHPSLVNLFLSSPIASFPDLLAPLHNHLNQTLGKNKYTKRFAYHPDLMPIFKSQLSWILNKLAQDENINQQPVLPRTQFIHLKNLRLYNGNALSSPYVCGLPSLTGFWGFMHDFERRLKTKIEENIHFEAFSLFVHQYELQSSPPLCEASDIYKKRELSPAKRLLTQPSYSCDMRFDLIIKVHTEVNLSDISQRMLSAMPARCVGGTLHQSSLHESLEWLTSYASSEHLYEELACLPNSGRWIYPPSETFNTPDEFLSILGNSTHLAICNGYSFLEDPTNRENVSLNQHVFCEPLIGLAEQVIPIDMRLNRQKYYFSNAFWSINSDFNSILIQKHE

SEQ ID NO: 8653 - protein, 320 aa, Coxiella burnetii CbuG_Q212
MSYNKILLIPHLRIHNANALSNPFTIGFPAMTAWLGATHALQRNLNERGIPVTIPATGVVSHQMDLQTYRGNDDYVSSIINTGNPLVPKTKREKGEPWHNFERPPFIEEARCHLDVSLLIEFRGVSQEQDDEIKEQVSHLLNCKMKVAGGDIQSFNPPAILLIEDGNDADLRRLSRKIMPGYVLIERRDLMIEAMQQGQDALDALIDYVAIHHSCEKTEDGDVLWESHRKTQIDKPPGWIVPIATGFHGISELGQAKNQRDPETPHRFAESLVTLGEFKMPHRFESVTDMLWCYQVDSTNNLYQCVALNTITENLYDEFG

SEQ ID NO: 8654 - protein, 320 aa, Coxiella burnetii CbuK_Q154
MSYNKILLIPHLRIHNANALSSPFTIGFPAMTAWLGATHALQRNLNERGIPVTIPATGVVSHQMDLQTYRGNDDYVSSIINTGNPLVPKTKREKGEPWHNFERPPFIEEARCHLDVSLLIEFRGVSQEQDDEIKEQVSHLLNCKMKVAGGDIQSFNPPAILLIEDGNDADLRRLSRKIMPGYVLIERRDLMIEAMQQGQDALDALIDYVAIHHSCEKTEDGDVLWESRRKTQIDKPPGWIVPIATGFHGISELGQAKNQRDPETPHRFAESLVTLGEFKMPHRFESVTDMLWCYQVDSTNNLYQCVALNTITENLYDEFG

SEQ ID NO: 8655 - protein, 701 aa, Shewanella piezotolerans WP3
MVDKLKFQELLDIDDISERNIVLRRAFTAYTVPLDVTGNEAAALTILLNLTYPRKRVDDLLDMRLAKQTLNTDAHVDACIGEVQWLHTHNLKYPDIRVSKQRLIAASPLLHPHVLSSANCINTLGWSHDSAKVNLAKLFSCHFIWQERVCCLATLLADAPKGWKEAFQALGMLVKDFMNLCGRIKASLPNDDTPNHVDKYSIQVRLPYQDGYLAITPVVSHALQAEIQQAAMAKQGRYTNIEFTRPAGVSELSASLGGNVKALNYPPRIENAEHGLSDSWALKVQSGQTVLNQGALSQPRFKRALEGLLSKNFELALKQRRQQKVACMRQIRATLTEWLSPLLEWRLEVEENKVNTSELGCIHGSFEYQFLTTQKENFVELLSPMFSLLNTVLSNSNTLQKYAFHQHLMKPLKNSLKWLLDNLSKESNAVAIDSDEDNQQRYLYLKGIRVFDAQALSNPYCAGIPSLTAVWGMMHNYQRRLNERLGTQLRLTSFSWFIRQYSSLAGKKLPEYGMQGQKENQFRRAGIVDNKHSDLVFDLVVHIDGYEEDLDAIDNSIDAIKASFPATFAGGVMHPPEIGSVDEWCELYCSEASLYSKLRRLPASGKWIMPTRYQMDSLDGLLQLLKLNVALCPVMSGYLMLGSAESRNYSLEPLHCYAEPAIGVVECATAIDIRLQGMSNFFRRAFWMLDIKETSMLMKRI

SEQ ID NO: 8656 - protein, 294 aa, Acinetobacter baumannii AB307-0294
MRHFLLIPHLKLHNANAMSSPYTIGFPAMTAWLGAVHALQRKLQTKDCDVALTKVAVSCHEFNLQTYKGQGDFVHSIIGTANPLDKDGSRPAFIEEARCHLEVSLLIEIENLGIKKREQLLKIVPDFVSSMKFASGDVLSVQKCQIIDFDEDESHDKELRPILNKLMLGHVLIERRDLVVESMNQGRDALDAVLDYLKVTHSSAVDENGKVTWNSKRQTHGWLVPIAIGFQGISELGQAKNQRDANTPHRFAESVLTLGEFVMPYRIEHIDQLLWQYHVDLENNLYLCKNISTI

SEQ ID NO: 8657 - protein, 701 aa, Shewanella baltica OS223
MVKNLHLRALLDIEDVQVRTAALRRAFAAYTEPLDVTGEESSTLIILLNLTYPKKLVDDLLDKRLARKTVNNQTHIDVCIDEVQWLHTHNLKYPDIRVSKQRLVAPSPQLHPSILSSVNCQRTLGWSHDSAKVNFTKLFVCHFIWQGKVTCLAKLMCEAPKYWKEAFQELGMPVKQFMNICGRVKHFLPEQLSPDKVDKYSVQVRMPYRDGYIAVTPVVSHALQSELQQAAIKKQGRYTGLEFIRSAAVSELVASLGGNVKALNYPPRINKKTHGLGDNLLARVLSGQDVLNQNVLSQPRFVRVLDELLSSESALALKQRRQQKVANLRQIRAMLSEWLAPMLEWRLEVKEGPILLSELEPIKGSLEYQFLTFENELLPELLANLFGRLNSVMSHSTMISQYAFHQRLMPLLRNSLKWLLTHLAYKEPLLQKDAEDEHFQRYLHLKGIRVFDAQALSNPYCVGIPSLTAVWGMMHNYQRRLNEGLGTQLRLTSFSWFIRQYSSVSGKKLPEFGMQGAKENQFRRAGIIDNRHCDLVFDLVIHIDGYEDDLAILDNQTEMLKASFPANFAGGVMHPPELDAVDAWCQLYQSEAELFSTLKRLPMSGKWIMPTRYSMGNISDLLFLLDKNSSLCPTMVGYLPLTEPVSRVGSLEPLHCYAEPALGVVECASAIEIRLQGQINYFKRAFWMLEAKEHSMLMKRI

SEQ ID NO: 8658 - protein, 336 aa, Laribacter hongkongensis HLHK9
MSQPELPDIDALLYIPQLSVQNANAISGPHSWGHPGPTHFTGLMTALERKLGADFGLHFVAVGIISHGYQAQTNGDYVQRFNLSRNPVGKDGATCAIVEEGRIHLQLSLVFGLQLDEARKTASDDVLDELEQQAGRTLATLRIAGGSVLPGRSALKPRLTRLADPDGNNGAEKRAAQFRNLRRYLMPGYALVARDDLLHSHLATLQQDNPDASLPDAWLDQSRLNHTPTQDDEGNTVWQAQRGSGKGWIVPLPVGYGAISPLYAAGTVAGTRDDSTPVRFVESLYSLGQWLSPHRLHDVRQLLWYPTHDSASGVYRCRNDYQAATQTEHDTVGVTA

SEQ ID NO: 8659 - protein, 325 aa, Tolumonas auensis DSM 9187
MKSLLLLRQINVENANAISGLTYGFPGISHFLGFTHALSRQLMQAHNLRLGGCAVVCHHHQLQAYQPGGRGDFVFALTRNPLTKEANTASFNEEGRMHLQISLMIECEFDADDLPFGSGQPEQDVTMLTDWFSQKVPCLRLAGGTITSVGHVSWLELKQDSEEQHKQVRRLMMRLLPGFALIGRHELLLAHHQKCLAESSDAQLIDSWLDFVALRYRSERADASGHANWVMQPKPESGYLVPMVVGYQAISPLYGTGAVANSRDSDTPFCFVESAYSIGQWLSPHRVQSLEQIIWRYHYSDGLYLCHNGYTSVVNEEFENSEENY

SEQ ID NO: 8660 - protein, 316 aa, Dickeya paradisiaca Ech703
MSSLIILRRIQVENANAIAGHTYGFPAISQFLGFTHALSRQLQASHGLTLEGCGVVCHQHQLHAYGSGWNRSFALTRNPLTKEEKTAAFNEEGRMHLSVSLLMECHGMLPGEDGLEALKQRLQQLALRQRLAGGLIVDIEQVNVHDMPADEGTTRVLMRRLLPGFVLLDRTALLQPHFATLQQSDPQAEMLDAWLDFAALKHHAVRASGDEVSWQPLPKPEEGYLVPLMTGYRAISPLYAPGEVEKTRDPSTPFCFAEAIYGVGEWRGAHRIDDINRIFWRYLYQRDNQHHTYRCLQAADELDNAADDYPELEFNY

SEQ ID NO: 8661 - protein, 313 aa, Dickeya chrysanthemi Ech1591
MSSLMILRRIQVENANAIAGHTYGFPAISHFLGFTHALSRQLQASHGLRLEGCGVVCHQHQVHAYGNGWNRSFALTRNPLTKEEKTAAFNEEGRMHLTVSLLIECHGMLPGEDGREALRQQVQQQAQQQRLAGGLIVDIEQVSFHDIPTNGADTRSLMRRLLPGFVLLDCTSLLPSHLETLQQADAQADMLDAWLDFAALKYQAVRSSDDAVSWQPLPKPDRGYLVPLMTGYRAISPLYNPGEVEKTRDPSTPFCFAEAIYGVGEWRGAHRIDDINHIFWRYHYQHGTYRCLQTVNDAGSAADDDYPELEFNY

SEQ ID NO: 8662 - protein, 337 aa, Zymomonas mobilis subsp. mobilis NCIMB 11163
METELPFSSHLLILPHIRVQNANAISSPLTHGFPSITAFIGFMWALERKAHAAGIDDITFNAVGVVCHDFQEQMTDSGFTYAFNLTRNPIEKDGKTAPIIEEGRIHLDVSLLLAIAFKNEDIENYQIDEYVEKIAIFAQNMRIAGGSIIPPSPNMAKHRKPHWIECNTFSDNDNDFSDYRKNCYRLLPGYALVERSDLIPERLKKMQETQPEATPLDAWLSLSRVNWRCKSEAQSPKTETKKENIWENDQDNGWIVPMPVGYGAVGEMQPSGSVSSARDNTIPFQPVESLFSIGEWIAPFRLKHPNDLLWYPSSFLGENNFIEKSVYRCHNFYQYSL

SEQ ID NO: 8663 - protein, 310 aa, Pectobacterium parmentieri WPP163
MSTLIILRRIQVENANAIAGLTYGFPAITHFLGFTHALSRKLQASHGLTLDGCGVVSHQHQLHAYGSSWERSFALTRNPLTKEAKTAAFNEEGRMHMTVSLLIRCDGQIPADTTALCEHLKQQAQCQRLAGGTVIDIERVTIQSLPVDEVENRGVMRRLLPGFVLRDRTSLLHRHFQALQQDNPQAEMIDAWLDFAALKMQAERDPSDNAVQWKYLPKPGDGGFLTPLMIGYRAISPLYAPGEVDKTRDPHTSFCFAEAAYGIGEWQGAHRINDIRQILWEYDHQNGDYHCRQLADTDSAAEDTSYEFDY

SEQ ID NO: 8664 - protein, 275 aa, Yersinia pestis D106004
MQSSHGLTLRGCAVICHYQQVHAYLSGWDYVFSLTRNPLTKEAKTAAFNEEGRMHMTVSLVIECDGTIANGDDGANALEKHLASLCLTQRLAGGTITNIRRVKVINYPETEVATRRLLCRLLPGFALLDRSELLAEHLNRLRQTNPQAEMLDAWLDFSALKIQAIPPQSDTPVESGAPAPWGYVGKPAAGYLVPIVTGYRAISPLYAPGEVDKTRDPHTPFRFVESLYGIGEWRGLHRITDLRQLLWGYHQEGDNYLCRCALPASVDTYLLNDEE

SEQ ID NO: 8665 - protein, 316 aa, Yersinia pestis D182038; identical to SEQ ID NO: 53

SEQ ID NO: 8666 - protein, 318 aa, Dickeya zeae Ech586
MSKLMILRRIVVENANAIAGHTYGFPAISHFLGFTHALSRQLQASHGLRLEGCGVVCHQHQVHAYGNGWNRSFALTRNPLTKEEKTAAFNEEGRMHLTVSLLIECHGMLPGEDGREALRQQVRQQAQQQRLAGGLTVDIEQVSFHDIPARGAATRGLMRRLLPGFVLVDRTALLSSHLETRQQADAQADMLDAWLDFAALKYQAVRSSDDAVSWQPLPKPDRGYLVPLMTGYRAISPLYNPGEVEKTRDPSTPFCFAEAIYGVGEWRGAHRIDDINRIFWRYLYQHDDQHHTYRCLQTGQGTDSAADDYDEFELNDFE

SEQ ID NO: 8667 - protein, 322 aa, Thioalkalivibrio sp. K90mix
MLDEPQHLLEIPRLRVQNANAISSPMTWGFPAMSAFVGLMHTLERSLVDRGVDIVFDAVGVICHRIEPQITEDTFPITFRLTRNPVGKDGATAAIVEEGRTHLEITLVFAVRGDAGPDVAQTAEHLVHQLRIAGGTVQPPLHDKQRRWPSRIIPMSDDPAKRPNEYRRLLRRWLPGFTLVARDDLLQGHLQNLRQEDPECSLLDAWLDLARLNMECRTQPPENDEEEPRAQWEARLPRETGWFVPIPVGYGALGPLLDPGTVKAARDLETPFRFVESLYSIGQWLSPHRLTTPTQLLWYPDSDPDQGRYRLQNDFTRHNTPA

SEQ ID NO: 8668 - protein, 309 aa, Nitrosococcus halophilus Nc 4
MSLYYLLLPTLNVTGCNWESSHLTRSLPLTAIAGFADYLVSFELADNAADAGAGLEGFVVCLHDGQIHEGLSKNPLALCKGNGLSQTQDDLLNPPLIPEVKGSMSLSLVVALELENKSALDEWLKTRSTAFLQTRRLAGGDIIGIGQPKIYIKRSDLAREMGRLPPGWFISNGADLIAHEPDHFAALINAVAWFPAEDKESQNMSAQSSPFRRRQHPGHWLYATCVGYQLLESPQPRRNRSHASSDADSSTNHAYAEPVHSLAKLLWTRGVLRLQNDSTVDNWLTKNKLLWRWDTNAPSRTVYLSTKAL

SEQ ID NO: 8669 - protein, 461 aa, Coraliomargarita akajimensis DSM 45221
MNIDMTKKYALVVIVFVLGGVLGWVIHPDGHSVVHHEVHTDGPRPLTESANETVLQQETVSVVEEGQLFQHLDASEMAHLAAVAAQSDDPLEKEALLRLLVNEWAKTDPDAALTFANEAQRNDLLQIALARLGATQPDAALAWLDTQINDPGLQDYLSMSVYQGIARLNPTTAMDLALSLPQGSQRDSILHVVVDEWAKKDVHAVFDWIETVEMSAEVESLYSGVMYRYITAEPQEAAALVAEMHPCALKVNFAATSARLQAQEDPVSALAWADGLDPEAREAAMIGIMDSWAARPDASGAIDFIIAGSESMSSDLARSAIISLVHQQPEQVIASIPKMSRRDQLLAVEQVAGTLSVSAPERCASWMQTLPQGPLRDGAIEHSLDASIRRDTSDAFRLSETVDDESLRLALVSRVVERWSAWDFVAAEAALADSSSISEEAKDALLDRVSQNLRMNDILLP

SEQ ID NO: 8670 - protein, 316 aa, Yersinia pestis Z176003; identical to SEQ ID NO: 53

SEQ ID NO: 8671 - protein, 297 aa, Moraxella catarrhalis BBH18
MVIYDANTISSPLTYGLPALTGFTGAFHALSRTLMADERFADLALGGVLLACYECTPKTYRAGRYHDHTFNQTRNPLKKDGKTAPIVEEGKCNLVMSFAVEVLASDLLSEKRSQELTQFLSQAIFRQRIAGGSVMNIAKTHPVRYFGFESMHQIVPLLMPAFVLMDASSEFSELIDKAQSTDPKATPLDVLLDVCTLHHLPKLDLDGNTKWHTKSIKTGHGWIVPMPMGYQAISEQFEAGKMDNVRNPEYPSQYVEVVYGLGKWVYPHHLKDNIETAFWRQHYDETGLYLLTQNELS

SEQ ID NO: 8672 - protein, 319 aa, Desulfurivibrio alkaliphilus AHT 2
MMDTMLILRNIKVENANAIAGVTWGFPAISNFLGFVHAISRKLPPHFSLQPNGCGIVCHDFQVNAHQPKGWGDYVFALTRNPLTKQGETASFVEEGRMHMDVSMIIPCDGEVPINLDPEEVTEQIEQLLLEHRLAGGTILEVGAIELVRLPEEEASLAKFERRQLRKLLPGFALVQRADLLAQHTEKCFQQNPEMDAMDAWLDFSALKFMAVVEGDNENQDDHSGKVEWQYIPKPGKGWLVPITVGYRGISDLFEPGEVLKARDSSVPFRFVESAYSIGEWLSPHRLGKIQQLVWRYDVDPESGWYLCKNDYQPEKTAN

SEQ ID NO: 8673 - protein, 309 aa, Nitrosococcus watsonii C-113
MSSYHLLLPTLNVTGCNWESSHLTRSLPLTAMAGFVDYLMSFELADNAAEAGANLEGFAICLHGGQIYEGLSKNPLALCKGNGLSQARDDLLNPPLTPEVKGSVSLSLVVALELEDKSALNEWLKNRATAFLQTCRLAGGDIIGIGQPKVYIERSKLAQEIRRLPPGWFIGNGAELISNAPDPFAALLNAVAWFPVKDKEPQTTSAHPSPSRQRPYPGHWLYATCVGYQLLESPQPRRNRSHASSDADSATNHAYAEPVHSLAELVWARNLLRPQDDSTADDWLTENNLLWRWESDAPSRTVYLSTQAL

SEQ ID NO: 8674 - protein, 335 aa, Dickeya dadantii 3937
MVNRRAVQTAPARNRACIEGRIGMSSLIILRRIQVENANAIAGHTYGFPAISHFLGFTHALSRQLQASHGLTLEGCGVVCHQHQLHAYGSGWNRSFALTRNPLTKEEKTAAFNEEGRMHLTVSLLIECHGMLPGEDGLEALKQQLQRLSLRQRLAGGLIVDIERVSIDDMPADDGSTRGLMRRLLPGFVLLDRTPLLQSHFQDLQQANPQAEMLDAWLDFAALKHQAVRSPDDEVNWQALPKPEGGYLVPLMTGYRAISPLYAPGEVEKTRDPSTPFCFAEAIYGVGEWRGAHRINDINRILWRYHYQHGTYRCLQTADDLNRAADDYDELEFNY

SEQ ID NO: 8675 - protein, 291 aa, Treponema pallidum subsp. pertenue; identical to SEQ ID NO: 8615

SEQ ID NO: 8676 - protein, 307 aa, Escherichia coli O83:H1 str. NRG 857C
MSYLLLLPHIRIENANAVSGLTWGFPSMTHFLGYVHAISRKVVDEFGVSFDGCAVVSHEQHIQAYSSGRDFQFALTRNPLTREGKTASFNEEGRMHLTVSLLIECNGEITNGEYGRKVLCDYLKMLCQSHKLAGGSIVSMRDPQLFHAPEDEKQLRKIVWRLMPGYALYERSEWLAEHHQQHPDISLLDAWLDFAAIKYQAESPAEDNSAQWVYQPKPMPGFLVPLMCGYQRISPVYAPGEVENARDTVTPFAFAEAVYGIGEWRGLHRTTDLQALMWRYRTTDTGYYCSATPVVDDFTFNEYDDLE

SEQ ID NO: 8677 - protein, 227 aa, Treponema pallidum subsp. pertenue
MERGMKQLKWWAVGPVLGICAGVWGAAHPVHADPWDTTAAGRSTIRLSAMGAVPLFQVDWCNSGRGDDRNANAQTNGHKYIYPAFSAALGFEHFVCRGLSLGIDASVQYHCSYPNNTYSPTTPYYYLAIPVALTAGYTVAFWRIRLPLTVGAGFNYQHYYTSTYYGLVLKAAAGCYFQLTEHWSLGVSATYSGVPRSCEKIIEEDRQQTNTRTAQFIAAGVDVRYHL

SEQ ID NO: 8678 - protein, 227 aa, Treponema pallidum subsp. pertenue str. Gauthier; identical to SEQ ID NO: 8677

SEQ ID NO: 8679 - protein, 227 aa, Treponema pallidum subsp. pallidum; identical to SEQ ID NO: 8677

SEQ ID NO: 8680 - protein, 227 aa, Treponema pallidum subsp. pallidum str. Mexico A; identical to SEQ ID NO: 8677

SEQ ID NO: 8681 - protein, 227 aa, Treponema pallidum str. Fribourg-Blanc; identical to SEQ ID NO: 8677

SEQ ID NO: 8682 - protein, 682 aa, Pseudoalteromonas sp. SM9913
MNLQDALAIESLKEKTTTLRKLFAPYMPHVAVDGFEEQALTVLINLVYKRSEIDDLTSVRTAKSVLRDEVLLSKCINEVKWFHTHNLKYPDIRVSHQRLISKVVSEDIAGICSRSLPLSFGWSHNSAEINHAKLFLTSFNWQGGVTCLAKLLITEEPVWINLIRAYGFSKKAVLDIAGKIKQQLPVAELPLEVSSFSLQLQMPYLQSYLAVTPVVSHVMLAKIQQLTTERKLNSGLVEHSRPANVGDLASSVGGNLRVLRYFPKTYSKAINRSKVANNDIEKAFKVRALLSSQFQQALLVLVDIKQFNTLRQKRLARVAAIRQVRVSLQLWLDNILEAKNNAQEQSYPDWAKHYLDQSITNCISQFSNILNESLGNLSKLKRFAYHPNLMGLFKTQLNYVFTQCATEETLNDEQIVYVHCQDMRVFDAEAMANPYIQGMPSLTALNGLAHNFERKLKNFIDPSIKCIGSAIYIENYQLHTDKPLPEPSKLKQVAGRSHVIRSGIIDKPKCDITLDLVFRLFVPNTELLDKLNSQFIKPALPSSFAGGTMHPPSLYQNIDWCHVHTKPSELFKNIKAKALNGSWLYPSKKVVKSLEQLIDALNGNFNLRPAAIGFAALEEPVKRDTALHEYHCYAEPVIGLLECVSNTSVKYAGAKQFFHDAFWVMDVQKESMLMKKSKFEYE

SEQ ID NO: 8683 - protein, 331 aa, Shewanella baltica OS678; identical to SEQ ID NO: 8644

SEQ ID NO: 8684 - protein, 328 aa, Desulfurispirillum indicum S5
MKSLLILKRLRIENANAISGMTWGFPAITNFLGLTHALSRFTQERQGVSLGGCGVICHWHQVKAYQPGGRGEYVFGLTRNPLVQDKKNKDKWTTPPFNEEGKMHLEVSLLIECDFRPKKLNFNTGNPDEDAELFSRQIQEKLLTLRLAGGIIQSIQEVRFETLPETTEDQQKWTRKKLLKLLPGFALVDRSELLTEHFQQLKEQHPEAELLDAWLDFAALKYQAQPDPDSEELTEKTPAIWELQPKPAEGWLVPIMTGYQSISPLYEPGEVAHTRDPSVPFRFVESAYGIGQWLSPHRINKLEYLIWRYYQKDDCYLGINHYQPEAPI

SEQ ID NO: 8685 - protein, 316 aa, Yersinia pestis biovar Medievalis str. Harbin 35; identical to SEQ ID NO: 53

SEQ ID NO: 8686 - protein, 276 aa, Burkholderia sp. CCGE1001
MQSPAVGTPTLHFAELPGSASREPLRIEYRWLNPAAAGAPLAVFLHEGLGSIAMWRDWPQALCERLGLRGLVYSRPGYGWSTPREHHVKWPVDFMTDQARDILPALLDALSVDMHERRRMWVIGHSDGGSIALLYAALFPGALAGAVAIAPHLFVEDLSVQSIAQTKVLYETTDLRNKLSRYHADVDSAFYGWNDVWLNPAFRQWSIAEQLASIDKPLLAVQGYDDNYGTMAQIDTIARYVAHAQLAKLEACGHSPHRDAPDRLNDVIAAFVSRHV

SEQ ID NO: 8687 - protein, 248 aa, Vibrio phage ICP1_2005_A
MRKFVIVKNIRVDGINAKSSDITVGMPPATTFCGLGEAMSIKTGIVVKAVSYGSVKFEVRGSRFNTSVTKFAWQDRGNGGKAKDNSPIQPKPLADGVFTLCFEVEWEDSAAVLVDKVTNFINTARIAGGTIASFNKPFVKVAKDAEELASVKNAMMPCYVVVDCGVEVDIFEDAVNRKLQPMVNGYKKLEKIVDNKHMRDKVTPAYLATPTYTMIGYKMVSNVDNFDQALWQYTNDTKVKTIGGIYND

SEQ ID NO: 8688 - protein, 248 aa, Vibrio phage ICP1_2004_A
MRKFIIVKNVKVDGINAKSSDITVGMPPATTFCGLGETMSIKTGIVVKAVSYGSVKFEVRGSRFNTSVTKFAWQDRGNGGKANNNSPIQPKPLADGVFTLCFEVEWEDCAEVLVDKVTNFINTARIAGGTIASFNKPFVKVAKDAEELASVKNAMMPCYVVVDCGVEVNIFEDAVNRKLQPMVNGYKKLEKIVDNKHMRDKFTPAYLATPTYTMIGYKMVSNVDNFDQALWQYGENTKVKTIGGIYND

SEQ ID NO: 8689 - protein, 331 aa, Marinomonas mediterranea MMB-1
MSDVKKLLMLPHIQVHNANALSSPYTIGFPAMTAWLGAVHALQRRLNQHGIGVRFEAVGVVSHDVNLQTYKGTNDFVSSIIGTGNPLDKSGERSSFIEEARCHLEVSLVIECSHIEIEDQEQALAAIVHLLNGSMKLAGGDIQKFTQPYFMVVEEGDDENMRRFKRALMPGYALIERRDLIVEAMKEGADALEAIIDHLAIHHTCTVSQADSEKENEEENAAGENIEKVDWKTHRKTRDGMSLGWLVPIATGFQGVSELGEAKNQRDPDTPHRFAESVVTLGEFKMPHRLNRVEELLWRYHQEGDLYLCHQSSHEHLSSSLNEDQEYSEFE

SEQ ID NO: 8690 - protein, 297 aa, Sphaerochaeta coccoides DSM 17374
MSIVMVLPHICVLNANAHSSPYTVGFPAMTAWLGAAHFLQREIVQNENMKLVKCEGVGIVCHDFTMHSYRDREKYVASLIGTSNPLDKKGDRPSFIEEAKCSLEVSLIIQISGLDLMYRNDFINLVNGILIGRMKIASGDVMKAGKPRLENADTESLPRLMGSLMPGYVLVERRKLMVDALKENPQADAMDVVLDYLKVHNTCSQADDVVEWSQNRKGMGWIVPISVGYQAITGFVDSPGQRDTSVPHRFVESVVTLGEFKMVYRIRKLDDMLWHYHVTADNELYVCRNEKLIEGDE

SEQ ID NO: 8691 - protein, 372 aa, Delftia sp. Cs1-4
MRQSPQPQAILTFPHLRVQNANAISSPLTHGFPSITAFTGLMWALERKLAQAGIPLRLHAVGVVCHHHQEQVRGSGKLYDPHTFHLRKPYVATADQARKLEEGTPPSIVEEGRIHLDISLVFAVSEKRAAGAAATLVQSAEPQMQQWADEAGQILSQMRVAGGSLLPSRAAPGRRVRPRLSVLAEDATERSRQFREWRRQWLPGFALVGRDDLLADRLHRLRDKAAHTTLLDAWLHASRFNHEPVAAAEGQPPPADGKHPWADPWRGPGSGWIVPVPVGYAALSPSHAAGEVLNARDATTPLRFVESVYSLGEWISPHRLTHLEQLLWHAHTDEKRGLYRCRSGYVSDPAAVADPDDAAAQEQEDDDSYAYT

SEQ ID NO: 8692 - protein, 295 aa, Methylomonas methanica MC09
MSYRQFLLLPHLKIHNANALSSPYTIGFPAMTAWLGAVHALQRQLRQQGLSELQLNGVAVSCHQFDLQTYQGPGDFVRSIVGTANPLDKDGRRPAFVEEARCHLEVSLLIEIQGLDSDDDQRFIELVNQQVQRMKFAGGDLLSSRPVEILPVNEDEPASMKKALNKLMLGYVLIERRALLADSMRQEGQDALDALLDYLTIQHRATQDGETVSWESKRKTAGWLVPIAVGFQGISKPGVAKHQRDPDTPHRFAESVVTLGEFVMPHRINTLDDMLWQYRVDLQRNLYLCQTLSNA

SEQ ID NO: 8693 - protein, 223 aa, Treponema paraluiscuniculi Cuniculi A
MKQLKWWAVGPVLGICAGVWGAAHPVHADPWDTTAAGRSTIRLSAMGAVPLFQVDWCNSGRGDDRNANAQTNGHKYIYPAFSAALGFEHFVCRGLSLGIDASVQYHCSYPNSTYSPTTPYYYLAIPVALTAGYTVAFWRIRLPLTVGAGFNYQHYYTSTYYGLVLKAAAGCYFQLTEHWSLGVSATYSGVPRSCEKIIEEDRQQTNTRTAQFIAAGVDVRYHL

SEQ ID NO: 8694 - protein, 337 aa, Zymomonas mobilis subsp. mobilis ATCC 10988
METELPFSSHMLILPHIRVQNANAISSPLTHGFPSITAFMGFMWALERKAHAAGIDDIMFNAVGVICHDFQEQVTDSGFTYAFNLTRNPIEKGGKTAPIIEEGRIHLDVSLLLAIAFKGEGKENYQIDEYVEKIAVIAQNMRIAGGSIIPPSPNMAKHRKPHWIECNTSSDNDNNFSDYRKNCYRLLPGYALVERSGLIAERLKKMQETQPEATSLDAWLSLSRVNWRCKSEAQSPKTETKKENIWENDQDNGWIVPIPVGYGAVGEMQPSGSVSSARDNTIPFQPVESLFSIGEWIAPFRLKHPNDLLWYPSSFLGEKNIIEKSVYRCHNFYQYSL

SEQ ID NO: 8695 - protein, 335 aa, Xanthomonas campestris pv. raphani 756C
MNRCPAFSHLLVLPHLHIHNANAISSPLTHGFPSMTALLGLMWALQRKVHAAGLELTFDAIGAVCHAHQEQVTEGGFVKAFHLTRNPVGKDGKTAAIVEEGRIHLELSLVLGVHSQRWGDDPQAQQADTDTVAELLAGMRIAGGSVRPPSQSGRHRYQPWTLDLTGTEDDRAKKFRKARMRLLPGFALVERADLLDARLAELQAADPDANRLDAWLSLSRINWRYRSHTPDETPGWSNDRSGRGWTVPIPVGYGALGELQAAGSVANARDPSTRCRFVESLYSLGQWISPHRLDAPQQLLWYPSSDPDLGLYRCRNDFAAAVVDDEMPDFNFSLD

SEQ ID NO: 8696 - protein, 316 aa, Yersinia pestis A1122; identical to SEQ ID NO: 53

SEQ ID NO: 8697 - protein, 327 aa, Pseudomonas aeruginosa M18; identical to SEQ ID NO: 8627

SEQ ID NO: 8698 - protein, 327 aa, Pasteurella multocida 36950
MFQTDFYILFDHIKVQSANAISGPLSYGFPALTGLTGAMHALNRKLTHHPVQFGGVMVACHDYELQTYQNSAFSDLTFKQTRNPIKRNGETASIIEEGKIHLDLSLVVEVHVQDDRVFEALTDKTSQASQDFLQTCKNLLWQQRIAGGSVLEIGNVQLFNLEEDQDIPLALMPAFVLMDAKQELTNITEELKTGLRIGQLDEEGNVQKSCLPSCPDATALDALLEMATVHHIPEHANATASAWQTYSVKKGRGWLVPLPVGYQAISPLFAPGQLQHCRTQQYPSQYVETLYSLGKWVFPLSLPENLSQCFWRYTALQNNLYLISQGE

SEQ ID NO: 8699 - protein, 577 aa, Burkholderia sp. YI23
MTRALYAMRIEGERDIVAARVKARDASAALGFSPQDQTRISTSVLEAARTVLLAGHEARADFYVDDATHPPRFVVRFLAAKGAGERLRAMRNDSKDDAQAALGLLAAQRLMDHCAIADEAGGDTSISLAKTLPDHAPRELQPVIEILSRQSADDTAAELQRQNRELIAALADLRERQEELTRLTRELEDTNRGVVALYAELDARADHLRRADESKSRFLSNMSHEFRTPLSSIRALSKLLLERIDGELTEEQEKQVRFIRKAAEDLSETVDDLLDLAKIEAGKIEVRPAEFEVDTLFSALRGMLRPLSPGGAVELVFDSCEGLPPIRTDEGKVAQVLRNFVSNALKFTERGDVRVSASYDDARRLITFSVSDTGIGIAPEHQQVVFEEFGQVENRLQQYVKGTGLGLPLCRKLCKLLGGDVSLESEVGRGSVFSATIPAFYGADFDATHHAASDTRPAVLIVASNPIERLDCEAALRDSPYRAMNAATLDEASRLLSRTQPAALLLAVRPAPSEAWIWLAALRAQAATRSIPILVLGEAEDRTEAQALGATVFIEKPVGGRQLPGVLDAVTGKERPS

SEQ ID NO: 8700 - protein, 311 aa, Klebsiella michiganensis KCTC 1686
MSYLLLLPYIRIENANAVAGLTWGFPAITHFLGYVHALSRRVSDSGISFTGCAVISHEHHIQAYSSGRDYQFALTRNPLTKEGKTAPFNEEGRMHLTVSLLVECQGEIINGEYGKAALCSSLLTLCQSHKLAGGSIVSMGEPQIFNAPDDERKLRQLLWRLMPGFALCDRSEWLMEHYRQLQQLSPESSLLDAWLDFAAIKYQAVQQGPEDSVSWEYQSKPKPGYLVPLMCGYQRISRLYEPGEVANVRDSTTPFAFTEAVYGVGEWRGLHRIADLQPLIWRYRTSDTGYYCSAMSVADDDLTFNEDDDLE

SEQ ID NO: 8701 - protein, 699 aa, Vibrio sp. EJY3
MKLSDVLRIEDEVLKQTTFKKVFMPYSEDIEIDGCEKEALIILLNLSYYPKGTKHINWLDDERALDYLTEQDNLTASLAEVQWFHTHNLKYPDCRVSKQKIIGEPLPADDVFISSATLKPILGWAHNSAAYRYTIWLLNSFIWQSQPTNILTLIEQQNPIWLDLLRAFGLREKSLELLRTEIELQLSSQSFPRYVDSYSKQLRFPWNGDYLSVTPVVSHAMQRELEHRYRNAESHLKFVTLSFPNSASIGNLCGSVGGNMQVLNYPLDVPSSTNRSTLRKTLADSRLASGRYFDDFQLTNERICKVLSRLTGTETSTTHKRRIKSRKDQSRILRKQVALWMLPLIELRDRFDSDEREGVIEEHESLVQDFLTLSESDLPVLVSQFNQRLHYVFQENKFTRKFAYHPKLLQVVKSQIVWVLNKLSKPQEDEVSGQGEQYIYLSSLRVQDSLAMSCPYLCGVPSLTAIWGFVHHYQREFNRSINSDVFYEFAGFSIYVRSQSITVGAKLTEPNSVEKVRTLSNAKRPTIRTDRFADLEIDLVICVKSNGRLSDYRAALKSVLPLSLAGGSLFQPLISSKIDWLRTFDSQSSLFHALKGLPAYGRWLYPCELQPDSFDELESTLDQNSGCLPVSNGYHFLEIPIHRNNALTALHTYAENTLTVAKQVIPIEMRFAGSKQFFQEAFWSLECSSTTILVKKYKE

SEQ ID NO: 8702 - protein, 317 aa, Rahnella aquatilis CIP 78.65 = ATCC 33071
MSYLIVLPHIQVENANAISGLTYGFPAITHFLGFTHALSRQVEQSHGLKFTGCGVVCHQQQIQAYQASERGDHYFALTRIPLTREAKTAPFNEEGRMHMTVTLFIECEGSVAHGDAGAREFEHHLQSLCISRRLAGGTVTSMKPARMLALPQNGDELKNITRREMYRALPGFALVDRSELLAQHFAERLAQDPQVEMIDVWLDFASITYRAEPHDDGSAEWEYQPKPAKGYLVPLMVGFTPISPLYAPGEVAKTRDTATPFRFVEAAYGVGEWRSPHRVTDIHQLIWRYPVSTENYLCSHAKPLQEADLTEQDHSDF

SEQ ID NO: 8703 - protein, 223 aa, Treponema pallidum subsp. pertenue str. CDC2
MKQLKWWAVGPVLGICAGVWGAAHPVHADPWDTTAAGRSTIRLSAMGAVPLFQVDWCNSGRGDDRNANAQTNGHKYIYPAFSAALGFEHFVCRGLSLGIDASVQYHCSYPNNTYSPTTPYYYLAIPVALTAGYTVAFWRIRLPLTVGAGFNYQHYYTSTYYGLVLKAAAGCYFQLTEHWSLGVSATYSGVPRSCEKIIEEDRQQTNTRTAQFIAAGVDVRYHL

SEQ ID NO: 8704 - protein, 223 aa, Treponema pallidum subsp. pertenue str. Gauthier; identical to SEQ ID NO: 8703

SEQ ID NO: 8705 - protein, 223 aa, Treponema pallidum subsp. pallidum DAL-1; identical to SEQ ID NO: 8703

SEQ ID NO: 8706 - protein, 327 aa, Pasteurella multocida subsp. multocida str. HN06
MFQTDFYILFDHIKVQSANSISGPLSYGFPALTGLTGAVHALNRKLTHHPVQFGGVMVACHDYELQTYQNSAFSDRTFKQTRNPIKRNGEPASIIEEGKIHLDLSLVVEVHVQDDRVFEALTDKTSQASQDFLQTCKNLLWQQRIAGGSVLEIGNVQLFNLEEDQDIPLALMPAFVLMDAKQELANITEELKTGLRIGQLDEEGNVQKSCLPSCPDATALDALLEMATVHHIPEHANATASAWQTYSVKKGRGWLVPFPVGYQAISPLFAPGQLQHCRTQQYPSQYVETLYSLGKWVFPLSLPENLSQCFWRYSAPQNNLYLISQGE

SEQ ID NO: 8707 - protein, 295 aa, Spirochaeta africana DSM 8902
MKRLLIIPHLIVQNANAQSSPYTLGFPAMTAFLGATHAFQRILSKQYPEFQVKSTGVVCHNMELRTHKGYGDFVHSVINTANPITKDGKRPSFIEEPKCSLDITLIMEVDGMPLGSEEHKFQKTASEVLDSKMRIAGGDILAYQPMIYQSVDSEDPVTLSRFKRLLMPGYVLVERRDLMIQEMQDGNDALDALLNCMKIDHSCEQSEDGTVEWQSKRKYPGWLVPVAVGYQGVSELGRVSRQRDPTVQHRFAEAIVTLGEFVMPYRLKKVDSLLWHYESDQEKGLYFCTQTNNQK

SEQ ID NO: 8708 - protein, 315 aa, Providencia stuartii MRSN 2154
MNNSMNLIKLSHLKVHNANALSSPFTIGFPAMTAWLGFMHALELKLRKIGFLELQLESIAVISHECNLQTYKGPSDFVSSIVGTGNPLDKEGNRSAFIEEARCHLDVSLLIEFSDRNDEYGNVLTDKSIVDRIYELIPMMKLAGGDILSVDLPQMHYLPANDDMGKYRRSLFNSLMPGYALIERRDLMVSAMEDGQDAMDALLDYVTVHNQCVEVDSQNESKNKHYEWKVQRKTAGWIVPIATGYQGISPLGQAKNQRDPNVPHRFAESLVTLGQFVMVNKIGHPNEILWKYSNNLENSLYLCQQVESKYFTSGE

SEQ ID NO: 8709 - protein, 327 aa, Pasteurella multocida subsp. multocida str. 3480; identical to SEQ ID NO: 8706

SEQ ID NO: 8710 - protein, 319 aa, Aggregatibacter actinomycetemcomitans D7S-1
MNTDFYLLFKHIKIQSANAISGPLSYGFPAVSGFVGAIHALSRKLNEKAMLDGVTIACHNYDLQAYQSTPFSDRTFIQTRNPLKKNGETAPIIEEGKVHLDISLVIELHISDKMLSHQVENNLNCDEAKIFLSECKNLLLKQRIAGGSVLSIEDVQLHYLEDEWKIKRQLLPGFVLMNAQAELIKITEELQQGLKQGDFVVLEANPDATAFDALIETAILHHIPNHPHAKTNEWQTYSIKQGRGWLVPIPVGYQAISPLFEAGQLQHCRTQDYPSQYVETLYSLGKWVSPLNLPEDLSRCFWRYTEPKNNLYLISQGDQ

SEQ ID NO: 8711 - protein, 310 aa, Pectobacterium parmentieri
MSTLIILRRIQVENANAIAGLTYGFPAITHFLGFTHALSRKLQTSHGLTLDGCGVVSHQHQLHAYGSSWERSFALTRNPLTKEAKTAAFNEEGRMHMTVSLLIRCDGQIPADTTALCEHLKQQAQCQRLAGGTVIDIERVTIQSLPVDEVENRGVMRRLLPGFVLRDRTSLLHRHFQALQQDNPQAEMIDAWLDFAALKMQAERDPSDNAVQWKYLPKPGDGGFLTPLMIGYRAISPLYAPGEVDKTRDPHTPFCFAEAAYGIGEWQGAHRINDIRQILWEYDHQNGDYHCRQLADTDSAAEDTSYEFDY

SEQ ID NO: 8712 - protein, 313 aa, Methylophaga frappieri
MSENLILLPHIKVQNANALSSPFTIGFPAMTAWLGAVHALQRKLNMQDSPVEFSAIGVVVHHFDLQTYKGPGDFVHSIIGTGNPLEPKSEKDKPKGNAVRPSFIEEARCHLEVSLVIEYNCIEAQDESQMLERLHQLLLGNIKLAGGDILSCGTPEIVRDFDMAKRKLMPGYALVERRDLMQEAMEQGQDAMDAMLDYLAIHHTSSKDEKGGEERVHWLSQRKATGPNGERGWIVPIATGFHGISDLGNALNQRDPDTPHRFAESLVTLGEFKMPYRLASPEDLLWRYLVEPENNLYLCVQQTHESETTLSDY

SEQ ID NO: 8713 - protein, 327 aa, Pseudomonas aeruginosa DK2; identical to SEQ ID NO: 8627

SEQ ID NO: 8714 - protein, 337 aa, Zymomonas mobilis subsp. mobilis ATCC 29191
MKTELPSSSHLLIFPHIRVQNANAISSPLTHGFPSITAFIGFMWALERKAHATGLEDIIFNAVGVICHDFQEQVTDSGFTYAFNLTRNPIEKDGKTAPIIEEGRIHLDVSLLLAIAFKGEGKENYQIDEYVEKIAVFVQNMRIAGGSIIPPSPNMAKHSQPHWIECKTSSDNDNNFSDFRKNCYRLLPGYALVERSDLIPERLKKMQEIQPKASSLDAWLSLSRVNWRCKSETQSPKTETKKENIWENDRDNGWIVPIPVGYGAVGEMQPSGSVSSVRDNTIPFQPVESLFSIGEWVAPFRLKHPNDLLWYPSSYLGEENLLEKSVYRCHNFYQYSL

SEQ ID NO: 8715 - protein, 310 aa, Pectobacterium carotovorum subsp. carotovorum PCC21
MSTLLILRRIKVENANAIAGLTYGFPAITHFLGFTHALSRKLQASHGLTLEGCGVVSHQHQLHAYGSSWERSFALTRNPLTKEAKTAAFNEEGRMHMTVSLLIRCEGQIPADTTALCDFLTQQAQCQRLAGGTIVDIERVTIQSLPSDEAETRKVMRRLLPGFVLKDRTSLLHDHFQTLQQDNPQAELIDAWLDFAALKMRAERDPKGSNVQWQYQPKPGGGGFLIPLMIGYRAISPLYAPGEVDKTRDPHTPFCFAEAAYGIGEWQGAHRISDIRQILWEYDYQNGDYHCRQLADTHSAAEDISYEFDD

SEQ ID NO: 8716 - protein, 328 aa, Alcanivorax dieselolei B5
MSDVRNLLILPHLRIQNANAVSSPMTWGFPAMSAFVGLMQALERKLPETLDLEFDAVGVVCHHYQAQATEGGFTRAFHLTRNPVDKTGATAAIVEEGRIHLDITLIFSVQGGACAGEGAELGQVANEIAGIVAGMRVAGGSVMPALSGGRPSRLKPELIQLDDNAEARAMQFKRLRRRCLPGFVLVSRDDLLQQHLDELRSVNPEFSMLDAWLDLSRLNHTCRLETTTNSQGESHDAVEWEVRHRPGWIVPIPVGYGALSRLYDPGEVARTRDASTPFRFVESLYSVGQWVSPHRLERPEQLLWYVDNDLDSGLYRLRNDYRDKPITA

SEQ ID NO: 8717 - protein, 223 aa, Treponema pallidum subsp. pallidum str. Mexico A; identical to SEQ ID NO: 8703

SEQ ID NO: 8718 - protein, 331 aa, Thioalkalivibrio nitratireducens DSM 14787
MLEEPNYLLEIPRLRVQNANAISSPLTWGFPAMTAFVGLMHTLERKLDERSLELFFDSVGVICHRHEPQISTATFPRTFRLTRNPIFQSKRDVQSNRPAAIVEEGRTHLEITLVFSVRGDSCKSSENEQVARQIEELVHTLRIAGGTVQPTRNARRRSTRIIPVTEDAEARPKEYRKLLRQWLPGFALVARDDLLQSHWKTLREERPESTLLDAWLDLSRLTWECHGEESADTEQAPTVHWEPRRPRGSSGWIVPIPVGYGALGPLHDPGTVAAVRDAETPFRFVESLYSIGQWIGPHQLTSPKQLLWYPESEPDNGRYRLRNDYEPNVYA

SEQ ID NO: 8719 - protein, 640 aa, Vibrio parahaemolyticus BB22OP
MATLAEILDNKTDDLNKDLRRAFRPLSAPVDISDTPIEALTILVNLTDRVIEQKNLLDRQKCKDKLRDEKWWANCFRTVKYRQSHNPKFPDIRANGVIRAAPVGHLPACMLSSSKLPKNSWAYANDSSQMNKSCFLTSEFIWNGDVHCLGQLLTELEHPLWNVLRKLGCYVKTAKYISKELALIPPLEINTSLVRNYLAQISLPNGEDSYISLSPVVSQSMQEDCYQVLSEHYRFSAITRFSRATNMGTLAMSCGGKFKMIRSLPPIEKYQHHHLDSVNWLTKRSVRAIRDYTESSVWVISPNKLALRKKSIIGDIKMMLSQWLRTTPTHEEKLDIRKLTERFNVDLAKTKFANRYAYDPLLTQLIYNCIGSIIHSSPQYAPKCEGNDDKYLLLPNLRISGASAMNTSVSIGIPSMMAFYGFVHAFQRNVQTANPNFKIESFAVCIHNIHVENRGLTREWVPNTKGQITAPATRDDWQCDVAVSLILRCSHYSQLIPRDFIRLLPGRIARGKVTVSISDIKHLGRCLSLADAIKAIPVETGRWLSLNNEVTLNSIQDVIDELKNNKLQTVNCIGYHRLETPCEKRGSLHGYKHAFVETILGIIKFLTISENTNPSQYFWQYHYSKQGPILLPRSVSDETS

SEQ ID NO: 8720 - protein, 309 aa, Serratia sp. FGI94
MSSLIVLRHVRVENANAIAGLTYGFPAISHFLGFTHALSRKLQHSRGLTLDNCGVVCHQQQLQAYSSGYDKVFALTRNPLTKEAKTAAFNEEGRMHLTVSLVMECNGIIDGGEAGAQALADELQRLSLTQRLAGGTIVDIGSVSVLAYPSTPAALRRITRRLLPGFTLLDRSELLYSHYQTLRAGNPQAEMLDAWLDFAALKQQAEGDEQSERVEWRYLPKPAAGYLVPLQTGYRAISPLYAPGEVKNTRDAATPFRFAEALYGVGEWRSLHRISDLPQMLWQYQHEDDCYLCRGVMLAQEEYAEFNEE

SEQ ID NO: 8721 - protein, 248 aa, Vibrio phage ICP1_2006_E; identical to SEQ ID NO: 8687

SEQ ID NO: 8722 - protein, 248 aa, Vibrio phage ICP1_2011_A; identical to SEQ ID NO: 8688

SEQ ID NO: 8723 - protein, 223 aa, Treponema pallidum str. Fribourg-Blanc; identical to SEQ ID NO: 8703

SEQ ID NO: 8724 - protein, 223 aa, Treponema pallidum subsp. pallidum str. Nichols; identical to SEQ ID NO: 8703

SEQ ID NO: 8725 - protein, 223 aa, Treponema pallidum subsp. pallidum SS14; identical to SEQ ID NO: 8703

SEQ ID NO: 8726 - protein, 640 aa, Vibrio parahaemolyticus O1:Kuk str. FDA_R31
MATLAEILDNKTDDLNKDLRRAFRPLSAPVDISDTPIEALTILVNLTDRVIEQKDLLDRKKCKDKLRDEKWWADCFRTVKYRQSHNPKFPDIRANGVIRAAPVGHLPPFMLSSSKLPQNSWAYANDSGQVNKSCFLTSEFIWNGDVLCLGQLLTELEHPLWNVLRKLGCYVKTAKYISKELALIPPLEINTSLVRNYLAQISLPNDEDSYISLSPVASQSMQEDCYQVLSEHCRFSAITRFSRATNMGTLAMSCGGKFKMIRSLPPIEKYQHHHLDSVNWLTKRSVRAIRDYTESSVWVISPNKLALRKKSIIEDIKIMLSQWLRTTPTHEEKLDIRKLTERFNVDLAKTEFANRYAYDPLLTQLIYNCIGSIIHSPPQDAPKCEGNDDKYLLLPNLRISGASAMNTSVSIGIPSMMAFYGFVHAFQRNVQTANPNFKIESFAVCIHNIHVENRGLTREWVPNTKGQITAPATRDDWQCDVAVSLILRCSHYSQLIPRDFIRLLPGRIARGKVTVSISDIKHLGRCLSLADAIKAIPVETGRWLSLNNEVTLNSIQDVIDELKNNRLQTVSCIGYQLLEPPCEKRGSLHGYKHAFVETILGIIKLLAISKNTNPDQYFWQYHYSKQGPILLLKSISDETS

SEQ ID NO: 8727 - protein, 640 aa, Vibrio campbellii ATCC BAA-1116; identical to SEQ ID NO: 8642

SEQ ID NO: 8728 - protein, 309 aa, Desulfovibrio gigas DSM 1382 = ATCC 19364
MIVPRLRIQNANAISSPMTWGFPSMTAFLGLMWKLERLLAGDIAVVFNGIGVVCHAFEPQVSRGGFTKSFCLTRNPVGKDGGSASIVEEGRVHLEVTLVFGVVGDILMASTTEREAAAAHIAGLLARMRVAGGTVLPGVSPRSPQLIALEEDEEKQAAQIHAVRRMLLPGSCLVERNDLLERRHQQLQATTPATSRLDAWLDLARTNWRSVVAQDENGTETVTWQHDRTDGWVVPIPLGYAGLADLEAPGTVLNARDTTTPFRFVESIYGIGQWVGAHRLKNMHQMLWYSSADDAAGMYRCCNDFTQYL

SEQ ID NO: 8729 - protein, 351 aa, Candidatus Symbiobacter mobilis CR
MPTDAPQHAALLVLPRLRVQNANAISSPMTWGFPAITAFSGFMAALARRLVPDAGIQFHGVGVVCHHFEAQVTQGGYVRNFHLTRNPVLADGSTAAIVEEGHIHLDITLVFDVSLAHHLQDDTTRTSLAAHVGEVVAGMRLAGGSIMPPLPGTLRRAPRAQLKLLHDETDARRAQEFRHLSRRWLPGFALVSADEVLQRTHQDALQAQAPNGTPPPTLFDTWLDLSRINHRPVKKTVWDEAIGDYQNTVTWETDKRPGWLVPIPVGFAALSALHPPGAVAGARDAATPFRFVECVYSMGQWISPHRLRDTQQMMWYAEHDAESGLYRCTNGYQVPPQSQAPLSVTPPVHQD

SEQ ID NO: 8730 - protein, 337 aa, Zymomonas mobilis subsp. mobilis str. CP4 = NRRL B-14023
METELPASSHMLILPHIRVQNANAISSPLTHGFPSITAFMGFMWALERKAHAAGIDDIMFNAVGVVCHDFQEQVTDSGFTYAFNLTRNPIEKDGKTAPIIEEGRIHLDVSLLLAIAFKNEDIENYQIDEYVEKIAIFAQNMRIAGGSIIPPSPNMAKHRKPHWIECNTFSDNDNNFSDFRKNCYRLLPGYALVERSDLIPERSKKMQETQPGATSLDAWLSLSRVNWRCKSEAQSPKTETKKENIWENDRDNGWIVPMPVGYGAVGEMQPSGSVSSARDNTIPFQPVESLFSIGEWIAPFRLKHPNDLLWYPSSSLGEKNLLEKSVYRCHNFYQYSL

SEQ ID NO: 8731 - protein, 327 aa, Pseudomonas aeruginosa SCV20265; identical to SEQ ID NO: 8627

SEQ ID NO: 8732 - protein, 327 aa, Pasteurella multocida subsp. multocida str. HB03
MFQTDFYILFDHIKVQSANAISGPLSYGFPALTGLTGAMHALNRKLTHHPVQFGGVMVACHDYELQTYQNSAFSDRTFKQTRNPIKRNGETASIIEEGKIHLDLSLVVEVHVQDDRVFEALTDKTSQASQDFLQTCKNLLWQQRIAGGSVLEIGNVQLFNLEEDQDIPLALMPAFVLMDAKQELTNITEELKTGLRIGQLDEEGNVQKSCLPSCPDATALDALLEMATVHHIPEHANATASAWQTYSVKKGRGWLVPLPVGYQAISPLFAPGQLQHCRTQQYPSQYVETLYSLGKWVFPLSLPENLSQCFWRYTALQNNLYLISQGE

SEQ ID NO: 8733 - protein, 328 aa, Thioalkalivibrio paradoxus ARh 1
MLEEPNYLLEIPRLRVQNANAISSPLTWGFPAMTAFVGLMHTLERKLADRDVAILFDSVGVICHRHEPQISTATFPRTFRLTRNPIFQSKRDVQSNRPAAIVEEGRTHLEITLVFSVRGDACQSPENEQVTRQIEELVHTLRIAGGTVQPTRNPRRRITRIIPVTEDAEARPKEYRKLLRQWLPGFALVARDDLLQSHWKMLREKNGDSTLLDAWLDLSRLNMECHLEESAGTGKEPTVHWEPRRPAGWLVPIPVGYGALGPLHDPGTVAAARDAETPFRFVESLYSIGQWIGPHRLTSPKQLLWYPESDPDNGRYRLRNDYEPNVYA

SEQ ID NO: 8734 - protein, 296 aa, Thiomicrospira aerophila AL3
MSDVKNLLLIPYIKIHNANALSSNFTIGFPAMTAWLGGVHFLQRTLADTEFSDIKFTSVAVACHTIKLHTHKAENGFISSIIGTGNPLDKDGSRPSFIEEARCDLTVSLVIELKNWGLHDSDKFLDLVNHRIRGKMKLASGDILSARAGRIYQVNSTESFAKVRNALMPSYCLIERRDLMINAMEHGDDALTALLDSQLSHRACEQDEQGNVTWHPPKRKYPGWIVPIATGYQGLTELGKAQHQRDANTPHRFAESVLTLGEFKMPIRFNHWDEMAWHYHSDTQNNLYLCQQNQLN

SEQ ID NO: 8735 - protein, 687 aa, Advenella mimigardefordensis DPN7
MSNALQSMNPAQREAVLYLNGPCLVLAGAGSGKTRVITQKIAYLINECGYDARGIIALTFTNKAAREMAERIQQSVEKKRLKGLTISTFHALGVRFLREEAVLAGLKPGFSILDSTDALGVIQELLATTDKGRLRSVQQQISLWKNALITPDDSEKIAQTPDEMDAARVYRSYDATLRAYQSVDFDDLIVMPATLMSTNDELRERWQRRCRYMLLDEYQDTNVCQYQWVRSLTGLRDMFTAVGDDDQAIYAWRGATIENLAKLPQDYPALRIIKLEQNYRSVATVLDAANQVISRNPNLFGKKLWSTLGQGEPIQVVVMDNEEAEAESVGMRISASRFERNARWKDYAVLYRGNHQGRLFEQTFRELRIPYVIAGGQSFFDKAEVRDIIAYLRIVANEEDDPAFIRAVTTPKRGVGQASLTALGDTATQLNCSLFDAVHDELAATRIAPRQLEPLKVFVDFIRNIQWRSGRGRTDGGAATPAEGATELLDELMKYIDYERYLYDTQEERAAQSRWQNVLELTNWLKRKAQEDGLTLAQLVQHIALITMLERSEDDEDPDAVRLTTIHASKGLEYPYVHMVGVEEGLLPHFGKDDEYGDANKDAEALEVRIQEERRLMYVGITRAQFHLTLTWCKKRRKAREDLIREPSRFISEMGLETGVKTVVDPFSGMTPKERLVRLKEMLQKKG

SEQ ID NO: 8736 - protein, 327 aa, Pseudomonas aeruginosa YL84; identical to SEQ ID NO: 8627

SEQ ID NO: 8737 - protein, 698 aa, Vibrio parahaemolyticus UCM-V493
MIKLGDVLAIEEDEVKQATLKKVFMPYSENIDIDGREREALTVLINLSSHHKGSKCTDWLDIDRAKSYLSQEANVDLSLAEIKWFHTHNLKYPDCRVSAQRIIAEPLPAEDAFISSSGLPPSLGWAHNSASYRHTIWLLSSFCWQSRTFSIVSLIQQQNPVWLDLLQEFGLSVKSLNLISEEIELQLLSTAFPTEVNTYSKQLRFPWNGDYLSVTPVVSHAMQSELEHRQRSEDSHLKFVTMLLPNSASIGNLCGSVGGYMKVLNYPLDISPKVNRASSEQTLGASRQRNGRCFDDYQITNIRICEILNRLVGAEPLKTHKQRVKARKDQSKILRKQIALWMLPLIELRDRMVNDERERTMHGDQLIHDFLFLPERELSSLATSLNQKLHLVLQGNKFTRKFAYHPRLMQLIKAQIVWILDVLSKPQQQEGGCGAEEQYIYLSSLRVQDALAVSSPYLCGVPSLTAIWGFVHQYQRDFNTLTNGDAFYDFTGFAFYVRSQNIIATAKLTEPCSLAKARTLSNAKRSTIRGDRLTDLEIDLVIRVQSRGRLSDCSSELKNALPVSFAGGSVFQPRISSKIDWLRTFCSRSSLLHILKGLPAYGSWLYPSERQPESFDELELMLLENENYLPVSNGYHLLEVPTQRKNSLTDLHAYVENTLSVANQVNPIEMRFSGRAPFFEQAFWSLECRPTTILIKKL

SEQ ID NO: 8738 - protein, 640 aa, Vibrio parahaemolyticus RIMD 2210633
MATLAEILDNKTDDLNKDLRRAFRPLSAPVDISDTPIEALTILVNLTDRVIEQKNLLDRQKCKDKLRDEKWWANCFRTVKYRQSHNPKFPDIRANGVIRAAPVGHLPACMLSSSKLPQNSWAYANDSSQMNKSCFLTSEFIWNGDVHCLGQLLTELEHPLWNVLRKLGCYVKTAKYISKELALIPPLEINTSLVRNYLAQISLPNNEDSYISLSPVVSQSMQEDCYQVLSEHYRFSAITRFSRATNMGTLAMSCGGKFKMIRSLPPIEKYQHHHLDSVNWLTKRSVRAIRDYTESSVWVISPNKLALRKKSIIGDIKMMLSQWLRTTPTHEEKLDIRKLTERFNVDLAKTKFANRYAYDPLLTQLIYNCIGSIIHSPPQYAPKCEGNDDKYLLLPNLRISGASAMNTSVSIGIPSMMAFYGFVHAFQRNVQTANPNFKIESFAVCIHNIHVENRGLTREWVPNTKGQITAPATRDDWQCDVAVSLILRCSHYSQLIPRDFIRLLPGRIARGKVTVSISDIKHLGRCLSLADAIKAIPVETGRWLSLNNEVTLNSIQDVIDELKNNKLQTVNCIGYHRLETPCEKRGSLHGYKHAFVETILGIIKFLTISENTNPSQYFWQYHYSKQGPILLPRSVSDETS

SEQ ID NO: 8739 - protein, 553 aa, Vibrio parahaemolyticus
MATLAEILDNKTDDLNKDLRRAFRPLSAPVDISDTPIEALTILVNLTDRVIEQKDLLDRQKCKDKLRDEKWWADCFRTVKYRQSHNPKFPDIRANGVIRAAPVGHLPPFMLSSSKLPQNSWAYANDSGQVNKSCFLTSEFIWNGDVLCLGQLLTELEHPLWNVLRKLGCYVKTAKYISKELALIPPLEINTSLVRNYLAQISLPNDEDSYISLSPVVSQSMQEDCYQVLSEHYRFSAITRFSRATNMGTLAMSCGGKFKMIRSLPPIEKYQHHHLDSVNWLTKRSVRAIRDYTESSVWVISPNKLALRKKSIIEDIKIMLSQWLRTTPTHEEKLDIRKLTERFNVDLAKTKFANRYAYDPLLTQLIYNCIGSIIHSPPQDAPKCEGNDDKYLLLPNLRISGASAMNTSVSIGIPSMMAFYGFVHAFQRNVQTANPNFKIESFAVCIHNIHVENRGLTREWVPNTKGQITAPATRDDWQCDVAVSLILRCSHYSQLIPRDFIRLLPGRIARGKVTVSISDIKHLGRCLSLADAIKAIPVETGRWLSLNNEVTLK

SEQ ID NO: 8740 - protein, 335 aa, Desulfovibrio magneticus RS-1
MTELPKYDGVLVLPRMMIQNVNCISSSFTWGFPSVTALMGFMWAMQRNCRDKEIMFEDVLFKGVGVVCHDLSPQVHKNNFIHTFNLTRNPLDHQGKTAPIVEEGRAHLNISLLLAYEGEAHDFPNKYRDAMLRIVRDALVAMRVAGGTILPPRYKSQEPRFIGLAEAENLRTQFVVERRRFLPGFALVSRDDLLAEHLLYLRGQDPDSSLLDAWLDLSRWNSRAEKQEEVVGDTGLAAGRVEWKREKREGWIVPIPVGYASISELYQAGEVLNARDASTPFRFVESVYSMGQWIGPHRLQEVGELLWFAHVDDQKGLYRCYNIYGDLRGAEKECE

SEQ ID NO: 8741 - protein, 310 aa, Selenomonas ruminantium subsp. lactilytica TAM6421
MIKQYLMIPHLQIQNANAASSPYTVGFPAMTAWLGMTHALQRRIRQRDELQEVGLPRVAVICHAFDLQVFNEKGNFYGSLIGTANPLKKSRKTGEFERPPFVEEARCHLEISLLVELTGMKGSLKERFEETVRRELPRLKAAGGDIVLRHGEQQDWQVVSVDDDDERDVNRVKARLMPGYAIIERQDLLQHESGKDALDSLLNAMQVQYTANRDAEGAFLGWQRSKVAADGWLVPIAVGFHDLSGNLQVKEQRSYEYEHHFVEPLVTVGEFVMPYRCEAIQEMMWEYEYNEAEGLYLCRNMGKQDLRGEE

SEQ ID NO: 8742 - protein, 54 aa, Papilio polytes
LRRIRVGNASAIADVYGQRSLRHFGGFRRPLARLPPYIIKKNLFKNSCKLNFLS

SEQ ID NO: 8743 - protein, 322 aa, Photorhabdus laumondii subsp. laumondii TTO1
MSHLIILRKIKVENANAITGITYGFPAITHFLGFTHSISRKLQKSYNLKLENCGVICHNHQLHAYRSDPIKDKVFALTRNPLTKEAKTATINEEGRMHMTVSLLIECSGEIAGDTEANELEQYLLEICPTQRLAGGTITEIAKVDVIAFPQEGQDTRKLMRRLLPGFALLDRSELLAKHYEELKQDNPQAEMIDAWLDFSAIKMRAIPKQDDKQPEIGDPAYWEYVPKPASGYLVPLMTGYQAISPLYPAGKVDKTRDPNAPFCFVEAIYGVGEWKSPHRIDDIRQLLWCYDYQEGEGVYRCCNQQTVSRQSKPNKKVRIID

SEQ ID NO: 8744 - protein, 294 aa, Acinetobacter baylyi ADP1
MSRYAVIPRIRVQNANMQSNGLLLGGVPLFAANMFAHHLARQLGTTDEGIIYIHHNQQRLGGQAYGRFTPAQRRGAVFIGKKDYSSKNKYALSLQPTASCHLEFSLVIKFSSSRISPEKLTHILKRSRFAGGQIIEFLEITTHAENELEAALKKIKTGFAILDRQDLLIEYQQRQQINRVQAFTQLLALKVDTLRAFFNDQNLSWISATNLGYALLEPLTDQRAGIRQAQDQETTAHAYAEPLTGIVQYFSLGEILRKNTEVEDDSWHNLQKLLWTYHWSQDDIFLLKQNCIHA

SEQ ID NO: 8745 - protein, 310 aa, Pectobacterium atrosepticum SCRI1043
MSTLIILRRIQVENANAIAGLTYGFPAITHFLGFTHALSRKLQASHGLTLEGCGVVSHQHQLHAYGSSWERSFALTRNPLTKEAKTAAFNEEGRMHMTVSLLIRCDGQIPADTTALCEHLKQQAQCQRLAGGTVIDIERVTVQSLPVDEAETRGVMRRLLPGFVLRDRTSLLHRHFQTLQQAKPQAEMIDAWLDFAALKMQAERDPSDETVQWKYLPKPGDGGFLTPLMIGYRAISPLYAPGEVDKTRDPHTPFCFAEAAYGIGEWQGAHRISDISQILWEYDYQNGDYHCRQVADTHSVAEDTSYEFDY

SEQ ID NO: 8746 - protein, 313 aa, Legionella pneumophila str. Lens
MSSNLILLPRIRVQNANALSSPFTIGFPAMTGWLGGVHALQRKLNTNSIAVMFSAVGVVVHRFDLQIYKGPGDFVHSIVGTGNPLEPKSEKDKPKGNAVRPSFIEEPRCHLEVSLLVEYSGIEAQDEQLMLERIYQLMLGNMKLAGGDILNCKEPEILRDFQKAKRKLMPGYALIERRDLMQAAMEQGQDAMDAMLDYVAVHYSCTKEIVNGQERVIWQRKRKSTGLDDQTGWIVPIATGFHGISELGTAINQRDPDTPHLFAESVVTLGEFKMPYRLESPDDLLWRYHVESENNLYLCIQQKSISETSNDDY

SEQ ID NO: 8747 - protein, 313 aa, Legionella pneumophila str. Lens
MRSNLILLPSIRVQNANALSSPFTIGFPAMTGWLGGVHALQRKLNTNSIAVMFSAVGVVVHRFDLQTYKGPGDFVHSIIGTGNPLEPKSEKDKPKGNAVRPSFIEEARCHLEVSLLVEYSGIEAQDEQLMLERVYQLMLGNMKLAGGDVLNCKEPEILRDFQKAKRKLMPGYALIERRDLMQAAMEQGQDAMDAMLDYVAVHYSCTKEIVNGQERVIWQRKRKSTGPDGQTGWIVPIATGFHGISELGTAINQRDPDTPHRFAESLVTLGEFKMPYRLESLDDLLWRYHVESENNLYLCIQQKSISETSNDDY

SEQ ID NO: 8748 - protein, 316 aa, Yersinia pseudotuberculosis IP 32953; identical to SEQ ID NO: 8648

SEQ ID NO: 8749 - protein, 316 aa, Yersinia pestis CO92; identical to SEQ ID NO: 53

SEQ ID NO: 8750 - protein, 294 aa, Acinetobacter baumannii AYE; identical to SEQ ID NO: 8656

SEQ ID NO: 8751 - protein, 313 aa, Erwinia tasmaniensis Et1/99
MSALIVLRHLRVENANAIAGITWGFPAITHFLGFTHALSRKLQQSHNMTLSGCGVICHQQQVHAYTSGRDYQFALTRNPLTKEAKTAAFNEEGRMHMTVSLLMECHGSIAGGEQGAAELKQTLANLCQRLRLAGGTVISIGQVQISGWPQDDGETRKIMRRLLPGFALLDRSALLAQHHDQQPQPEMLDAWLDFAALKMQADDGATPADGNVQWQYQPKPGAGYLVPLMTGYRAISPLYPPGEVANSRDTETPFCFTEAVYGVGEWRGLHRIDDLRHLFWRYHHQDDYYLCRGEETACDQDYPDDADDDINYN

SEQ ID NO: 8752 - protein, 320 aa, Photorhabdus asymbiotica
MSHLIVLRHLQVENANAIAGLTYGFPAITHFLGFTHVLSRKLQQSYGLKLENCGVICHNHQLHVHQSDPIRDAAFSLTRKPLTKEAKTAAFNEEGRMHMTVSLLIECSGEIAGDTKANELVKYLLEICPTQRLAGGTITEIDKVDIIAFPQEEQETCKLMRRLLPGFALLDRSELLAKHYEKLKQDNSQVEMIDAWLDFTTIKMQAIPKQRDKQPEIGDPAYWEYVPKPASGYLVPLMTGYQAISPLYPAGQVDKTRDPNTPFRFVEAIYGIGEWKSPHHINDIRQLLWCYDYQEGVYRCCNQQTIARQSKPNKKVRIID

SEQ ID NO: 8753 - protein, 307 aa, Escherichia coli ED1a
MSYLLLLPHIRIENANAVSGLTWGFPSMTHFLGYVHALSRKVVDEFGVSFDGCAVVSHEQHIQAYSSGRDFQFALTRNPLTREGKTASFNEEGRMHLTVSLLIECNGEITNGEYGRKVLCDYLKMLCQSHKLAGGSIVSMRDPQLFHAPEDEKQLRKIVWRLMPGYALYDRSEWLAEHHQQHPDISLLDAWLDFAAIKYQAESPAEDNSAKWVYQPKPMPGFLVPLMCGYQRISPVYAPGEVENARDTVTPFAFAEAVYGIGEWRGLHRTTDLQALMWRYRTTDTGYYCSATPVVDDFTFNEYDDLE

SEQ ID NO: 8754 - protein, 314 aa, Erwinia pyrifoliae Ep1/96
MSALIVLRHLRVENANAIAGLTWGFPAITHFLGFTHALSRKLQQSHNITLSGCGVICHQQQVHAYTSGQDYWFALTRNPLTKEAKIAAFNEEGRMHMTVSLLVECHGSIVGGEQGAAELMQTLANLCQRFRLAGGTVTSVGQVQISGWPQDDGETRRIMRRLLPGFALLDRSALLAAHHSQPPQAEMLDTWLDFAALKMQADDGATPADGNVQWQYQPKPGTGYLVPLMTGYRAISPLCPPGEVANSRDNETPFRFTEAVYGVGEWRGLHRIDDLRHLLWRYHHQDEYYLCRSEETACDQDYPDDDEDDDINYN

SEQ ID NO: 8755 - protein, 314 aa, Erwinia pyrifoliae DSM 12163; identical to SEQ ID NO: 8754

SEQ ID NO: 8756 - protein, 327 aa, Xanthomonas albilineans GPE PC73
MSSCPPFDHLLVVPHLRVQNANAVSSPLTHGFPSITAFLGLMWALERKARIAGLDLAFNAVGVVCHDHQEQVTQGNFVKSFCLTRNPVNKDGATAAIVEEGRIHLELSLVFAVHSMRWLGDPATHVADLAVVTKLLAGMRVAGGSVLPSTHGWRPRHQAQVIACTGTPSDQQALFRKLRLRLLPGFALVARDDLLGTRLAELQEHTPEATGLHAWLSLSRINWRHVPDAAAGKGEWQHDRSGRGWIVPIPVGYGALGAVHKAGSVANARDANTPFRFVESLYSVGEWISPHRLQTPHHLLWYADSQPAADLYRCRNDYRPATTHHFD

SEQ ID NO: 8757 - protein, 299 aa, Arsenophonus nasoniae
MSHLPHIRIHNANALSSPFTIGFPAMTAWLGFSHALQRKLNQHGYPTLKFWSTAVISHACDLQTYKGPGDFVQSIIGTANPLQKDGSRASFIEEARCHLDVSLLIEYENMEQGEQQPLNQQQLDKISQLLLTMKIAGGDILAFANPKIWAVNDDDDNDKEKRQLKSSLMPGYVLIERRELMKEAMEAGKDAIDALLDYLTVDHQCEKQQNGQIEWHSKRKTTGWIVPIATGFHGISSLAKALNQRDPNTPHRFAESIVTLGEFKMVHRLEQLADSLWYYATDAENNLYLCQQNKHNEFN

SEQ ID NO: 8758 - protein, 319 aa, Halomonas elongata DSM 2581
MSDVKNLLVLPRLRVQNANAISSPMTWGFPAMSAFVGMMHALERKLVEADIQVSLDRVGVVCHDTEAQATEGGYTRAFHLTRNPVDKAGNTAAIVEEGRIHLDITLIFAIAGKVVEGERQDIAHQISEMVAGMRVAGGSVMPNRSVAANYQKSAWVALDDEPSEREKQFKKLKRRWLPGFSLVLRDDRLAEHTRTLQAQDENATALDAWLDLSRLNHECHVDPESEEVRWQVRRPYRGWLVPMPVGYGAISKQFEPGSVENARDTQIPFRFVESIYSIGEWISPHRLTCPEDMLWYVDNDLDAGLYRLNNDYVQRAHRA

SEQ ID NO: 8759 - protein, 303 aa, Desulfobacterium sp.
MIGDIRRLLLLPHIKIHNANALSSPFTIGFPAMTAWLGAVHALQRKVNGSGLTNVNFDSVAVVIHDMELQTYKGAGDYVHSIIGMGNPLDKDGERSSFIEEARCHLDVSLLIEFPRIDKDDEEALIENVSHHLDASLKIAGGDILYFQKPLLHRIEEGNYTELRKLTRQLMPGYAIIERCELMMEAMEQGQDAIAALLDYLAVHHTCEQDDTGNIIWTSQRQTSGWIVPIATGFHGITELGQAKNQRDPETPHRFAESVVTLGEFRMPHRIHSLDEILWSYHTDLEKNLYLCQQTDRNKLNNQ

SEQ ID NO: 8760 - protein, 886 aa, Leishmania major strain Friedlin
MKSAVTLVFLTEFFFVAVDRKDTGMSEKQDRINDVLAQRIKQLEGELRNAQHDLSSALGQKERAEEEKKMLKDEAFDVVEQWSAENTELRRKLAVMEKESAADKATLRNRDEIVACLKEELDVAQQLTAQYFTQIEDQQEKHRNLEQQNAQLIESLAASRSDLASSAQRVADYERLVAKFEGELKAALASRKKDTEALDHLRSSLAQATAENQALRNAGENVSSSMEKLLERVAKLKEENESLRQNCDQLLSANDELTRQLHRDCQERRQLSDELGSLSARVAASESEAQQLRQKCERTEKQLAASDSALQDSQTAAEQQLQLIQTLESDVLELKDREMTMGKALCDLQAELLRLHQQLDETSQQKEDLQTEFTAVKESYATALMELDNHKRASSKALAAMQSEFAAFKSDSTERCMLAEQNCSSAWLSVQELTDALRAQQLSELAQREQISRSSILLNQQASIGGALEQRFHAVLVELSDCCRALERAEERIRQNKLNAAKTAEQISALSNRCRTSEQTVSEQRKALSLLESQLSQGAVRLNEIILERDTFAKDNAWLRDQVESMRQELGELDELLNSNLNEMREENERLQLENNSMRHDIAAANHKEQEAALRITALQVSVSDLESELRAQTKTLEITEAELQALKAQVENLSTSLDFSKRRCEELEVVRTEADKSNAALILQAAQLQERLGSQESKLSLILSEKRKESESLKRKLNAYVEKCEKCEQLLHAEIKARKEVESASAAAKEHNGKLRSALDELKTRCASDASTLKELLAERDNLIRDREIIVGKYNRLHDAFRNVRREAHSKVADELKRVMELAMSQETELQTLRKQNSTLKKSISMFVESAQPKAEAVFMERLNLTEGPLRHPKKRSTASTTEQQ

SEQ ID NO: 8761 - protein, 295 aa, Megasphaera elsdenii DSM 20460
MREAVLIVSGIHIQNANALSSTFTIGFPAMTAWLGAVHALQRRLNRQSEFSELRFTKTGVICHGYQLQTHKGTGDWISSIIGTTNPLRKKGNAFVRPPFIEEARIHLLVDLVIEVQKLGPEMGDLLEPMVRENMLTMKIAGGDVLSVDKIDVQRIDRDNESAVVRKLILPLMSGYAVIERRDLMNEDTGEDTLGVLLHYLAVYSTPLVDKEGRVISWQQQRATPGWLVPLAVGFRALSPLQKVKRQRDAEKTHCFVEPLVTLGEFKMLHRLRSLDDLFWHYEYDETQGTYLCKNE

SEQ ID NO: 8762 - protein, 289 aa, Taylorella equigenitalis 14/56
MIRTFLIIPRMKVFNANAMSAPFIIGVPSITSFMGFSHKLQLEIQNNINQNIRFIKTGISVHSFNLRSIKSGKYSLLSVTRNPLLRSGKPRSFIEEAKCNFEVSIINEVSGLPVSDNDKLVSRINNSLLGYKVSSGDLLSFKKPFIYSIDLDKYEEVKGLLKKLMLGYVLTERKDLIIKRNNEEKRKNSLDSLLDYLKVFVHEDKDNIKNHFKIESGWLVPITVGYHGLTTPEENINECREPKFNHVFCESLVTLGEFKLPTTINNIDDFLWKYAYESEKNYFYCTTHN

SEQ ID NO: 8763 - protein, 295 aa, Taylorella asinigenitalis 14/45
MTRTFLIIPRVRVINANAMSAPFIIGLPSITSFMGFTHKLQLDIHEEINRDIRFLRTGISIHSFNLRAYKEGSRNLLSITRNPLKKDGTSPSFVEEAKCNFEVSIVIEVSGINCEENITDIISYLNSSLMKYKISSGDLLSFSNPLSDSINVENISEVKGFLKKLMIGYVLTERKDLIKNRINEEKCTNSLDAMLDFLKINIKDENGNKEFFKIESGWFVPISVGYHGITPLISNKEGSSLDNNQRDPRFKHVFCESLITLGEFKLPTTLNNIDDFLWKYAYESEKNYFYCTTHN

SEQ ID NO: 8764 - protein, 313 aa, Erwinia piriflorinigrans CFBP 5888
MSALIVLRHLRVENANAIAGLTWGFPAITHFLGFTHALSRKLQQSHNITLSGCGVICHQQQVHAYTSGHDYQFALTRNPLTKEAKTAAFNEEGRMHMTVSLLMECHGSIAGGEQGVAELTQTLANLCQRLRLAGGTVTSVGQVQIGGWPQDDGETRKIMRRLLPGFALLDRSALLAQHHDQQPQAEMLDAWLDFAALKMQADDGATPADSNVQWQYQPKPGAGYLVPLMTGYRAISPLYPPGEVANSRDTETPFRFTEAVYGVGEWRGLHRIDDLRHLLWRYHHQDDYYLCRGEQTACDQDYPDDEDDDINYN

SEQ ID NO: 8765 - protein, 333 aa, Pseudomonas pseudoalcaligenes CECT 5344
MSELPTSNGLLIVPHLRVQNANAISSPLTWGFPAISAFIGLMQAVERKLEGRFALMFDSVGVVCHSHDTQVTGGYQRAFRLTRNPVNERGETAAIVEEGRIHLDITLIFGVSGYSEDGQPDPVQGDWQKRRTIAAEIANLLGSMRIAGGSVFLDPQHQPVLEPLAQGEERSKQFRRLRRRWLPGFALVSRDDLLQNHLQQLRGENASADLLDGWLDLSRLNLRAQEARPASESQPAKVEWRAQRVMPNGWLVPIPVGYGALGPMQAAGSVANARDGQTPLRFVESLYSIGQWLSPHRLRDVDDLLWYASADPQAGLYRCHNLYSQTLCTDDME

SEQ ID NO: 8766 - protein, 318 aa, Cronobacter dublinensis 582
MSSLILLSHLRVENANTVAGLTWGFPAITHFLGYMHALSRRLTDSHGVRLDGCAVICHEHQVHAYSSGRDYQFALTRNPLTREGKTAAFNEEGRMHLTVSLVFECHGEIANGEQGRAALADHLHTLCQRHKLAGGSIVALRDVKVMDYPQEEGDTRRLLYRLLPGFALLDRSPLLAEHHQALMTKTPHATLLDAWLDFAALKIAAAASEDNPAPTPDDPAQWRYVEKPAPGFLVPLMTGYQRLSELYPAGEVANARDDKTPFAWVEAAYGIGEWCGLHRIKTLTDLFWRYRITETGYYCCGTPQSEDVQCHDDIFNYE

SEQ ID NO: 8767 - protein, 336 aa, Desulfovibrio hydrothermalis
MSHKFKTPDAILSLHHLRIINCNSISSPLTWGFPAISAFAGFTEALNRKIQKVADFDVELKGVGVICHEFDPQVNKADGQFEWTFKQTRNPLEKKGGNAVSASLQEEGRCHIDITLVIGVYGDLEDDKDEDNLETFVLETMQTMRIAGGSVLPATKRYPRCKFMTVPPNKAEREKLFRRFRRSLMPGFALVDRSDYLEAHVEQMQKNTPNVTAIDGLLDLSRLTSKCAELSEDKDYRNQEEKEDKKYEWEVQRKPGWFVPIPIGYVGISELYGPGEIARCRDMHVPAQFVESVYSIGEWVSPHRISELNNILWFHDYREDDDLYLLVNNYQENINN

SEQ ID NO: 8768 - protein, 336 aa, Desulfovibrio hydrothermalis AM13 = DSM 14728; identical to SEQ ID NO: 8767

SEQ ID NO: 8769 - protein, 327 aa, Pseudomonas aeruginosa 18A
MSVTDPEALLLLPRLSIQNANAISSPLTWGFPSPGAFTGFVHALQSRVGISLDIELDGVGIVCHRFEAQISQPAGKRTKVFNLTRNPLNRDGSTAAIVEEGRTHLEVSLLLGVHGDGLDDHPAQEIARQVQEQAGAMRLAGGSILPWCNERFPAPNAELLMLGGSDEQRRKNQRRLTRRLLPGFALVSREALLQQHLETLRTTLPEATTLDALLDLCRINFEPPATSSEEEASPPDAAWQVRDKPGWLVPIPAGYNALSPLYLPGEVRNARDRETPLRFVENLFGLGEWLSPHRVATLSDLLWYHHAEPDKGLYRWSTPRFVEHAIA

SEQ ID NO: 8770 - protein, 303 aa, Dialister invisus CAG:218
MKNYLLLSRVSVHNANAMSSIFTIGVPAMTAWLGAMHALERKLGERCDQFLSDIRFTQMAVSYHKTSLQTIRKNGIGYIVMTANPLVVDKKKSSKDNYIFKRAPLLEEPRIHLLVSLLIEVEGADGNNMELLEQAVKEILPRMKMAGGDILDTGRIKVMRIDEDNPISVRKVISTLMPGYIPIERRDLMEAKELEGKDSLDRLLHYLKVHQTAEKDESGKITGWKYEKAAAGWIVPLAVGFKGLSPLGKVKNQRDPDTPHRFAESIVTLGEFKMAHRFRDIDGMMWHYAYEKTNQLYLCKNKE

SEQ ID NO: 8771 - protein, 302 aa, Dialister sp. CAG:357
MSTYLVIRKMQIHNANAMSSTYTIGVPAMTAWLGAVHALERKVRGLNQKKREDTDFSEIHFTGVAVSFHKTRLHVFKGAYGNAVVNTANPLIKKGADWERPPTIEEPHIDLSASILIEIDGLDPDDKDAILEKVQSEIWRMKIAGGDINRIQSMSIQYTDVDDPATIRRVRGMLMPGYVIIERRDILKQEMENGTNGLDALLDYTKVNMSARKDENGKITGWNLSRKGTGWIIPISVGFKGLSPLGICRNQRDKETQHRFAESVVTLGEFRMPYHFDSIDDMMWRYAYDENQELYLCRNQKI

SEQ ID NO: 8772 - protein, 321 aa, Megasphaera elsdenii CAG:570
MNRIKTYLLLRQVKIHNTNAFSSPLTIGFPAMTAWLGAMHALERKLRQHEALSGIRLKKLAVSCHDFDLQTYKGPGDYVNSVIITANPLRKKGASFERPPFIEEARVHLTVSLLIAIDGLMPGDFPIFEEKVTEALERMKIAGGDILGFSPIQDAIHLTSTRHSRILLVDEKNEENKRRAIRSLMPGYVLVERRQLLQQRQEELDYQDTLQAMLDLLALHYEYDDEHDTWNVQPHKEKGWLVPIVTGFKGLTPLGHVANQRDASTLHRFAEPVLTLGEFKMAHRFDCVDDMMWQYHYDEDKDLYVCVNEQMESDEEAKGED

SEQ ID NO: 8773 - protein, 294 aa, Acinetobacter baumannii 107m
MRHFLLIPHLKLHNANAMSSPYTIGFPAMTAWLGAVHALQRKLQTKDCDVALTKVAVSCHEFNLQTYKGQGDFVHSIIGTANPLDKDGSRPAFIEEARCHLEVSLLIEIENLGFKKREQLLKIVPDLVSSMKFASGDVLSVQKCQIIDFDEDESHDKELRPILNKLMLGHVLIERRDLVVESMNQGRDALDAVLDYLKVTHSSAVDENGKVTWNSKRQTHGWLVPIAIGFQGISELGQAKNQRDANTPHRFAESVLTLGEFVMPYRIEHIDQLLWQYHVDLENNLYLCKNISTI

SEQ ID NO: 8774 - protein, 71 aa, Escherichia coli PMV-1
MSYLLLLPHIRIENANAVSGLTWGFPSMTHFLGYVHALSRKVVDEFGVSFDGCAVVSHEQHIQAYSSGRDF

SEQ ID NO: 8775 - protein, 213 aa, Escherichia coli PMV-1; identical to SEQ ID NO: 8623

SEQ ID NO: 8776 - protein, 299 aa, Marinomonas sp. MED121
MNLLILPHLKIHNANALSSPFTIGFPAMTAWLGFSHALERKLHDQGFKALTFSSTAVISHDFDLQTHKGEGDFVSSIIGTANPLDKDGTRSAFIEEARCHLDVSLVIELEGDEEAGIYDQQDVITQLQNIIARMKVASGDLISMQMPEIKSIDINDDKETAQVLRQLMPGYALIERRDLMADTMAQGEDALDAMLSYLTVNHTCEQLEDESIVWSSQRKVTGWIVPIATGFQGLSYPSKAKNQRDPDVPHRFAESIITLGEFVMAHKIRHLDDMLWHYYPDLENDLYLCQQNNPINSYE

SEQ ID NO: 8777 - protein, 641 aa, Photobacterium angustum S14
MILINLTVPRKKIDDLLDAKHAEELWRNDVHLNKCLSEACWYHSHNLKYPDPRVSHQVYRGVTPSLYPDVLTSANLPCSFGWSNNSAMVNIAKLFSSEFLWNGNLTTLGLLLLKRQSLWLDLLISLGVKQDTLDLIISFFSDELGKQKIPTEVSDYSKQLQFVMDGQPVAITPIVSHTVQVKIYQLSLVLRSSIIQHGHPASVSGFVASTGGFTRVLNYRPLVRKRIDNGLLKNFRNKKDCFDNQVLSSQRFINALKCISKEELAPTLRQRRQLRISALRFIRKQLALWLAPIMEWRDCESDPKNHPEIKTIGEKLVFTPLAQLPELASELNVKFHQSIQYSKHVSRYAFHPELMLPIKTQLLWLLRYLSVPQDAPKSSCSSVYLHLRRLKVSDASALSNPYISGIPSLTALWGFVNNYQSRIKKLTKTVVEVQSVAWFINDYSEVKSKKLPEPSIPESKRKVGNIKRSGIIDGKYCDMTIDLVIKLKIGDNFPEIQLLQAALPSRFAGGTLLPPSLYELRDWLEVFDDKSELFSVISRKSRFGCWIYPSDEKLESFEQLEQKLTLEPDLKPVNMGFIPLDVPCNRENSISNFHCYAESCIGVVQCKNPIEVRLEASSKFFESAFWHLDNENGAILMRKYQ

SEQ ID NO: 8778 - protein, 695 aa, Vibrio alginolyticus 12G01
MTKLSSLLAIDDEAVKQVTLKKMFMPYTEDVCVEGFEKEALTILLNLSSSHQADRCSDWLDLARAKRHLKAAENLEASLDEIKWFHTHNLKFPDCRVKDQRIVAQPRTTTEVFISSGVLEQRLGWAHNSAVYRHTLWLLNPFSWQSQPVCILSLITQENPIWLELLKEFGLGAKSLARLKHTIEEQLPEYHFPDSVSTYSKQLRFPWGDDYVSVTPVVSHAMQSELEVRSRSRESKLRFMSSSLPNSASIGNLCGSLGGHMKALNYPLDVKPARGGTLPESCKKSGHYFDDYQVTNAKICQVLNHLIGSEPSKTQKQRESARKVRSKILRKQIALWMLPLIELRDIGDADPNQQQLEHDDTLAQAFLTLPESDLGSLASEFNCRLHLTFQNNKYAAKFAYHPKLMQLVKAQIVWILEQLSKPTGNEDKVTGEQYIYLSSMKVQDAVAMSSPYLCGAPSLTAIWGFMHRYQREFNKLVNCNSLFEFSSFSFYVRSENIQSTAKLTEPNSVAKARTVSNAKRPTIRSERLADLEIDLVIRVHSESRISDFKAALKTALPVAFAGGALYQPQLSTQIEWLRTFTSRSELFHVIKGLPAYGRWLYPSDNQPSDFDDLEHLITKDADNLPVSIGYHLLERPTKRCNSITDCHAYAENAIGLAKKVNPIEVRFSGRDHFFNHAFWSIECSSETILIKNYRD

SEQ ID NO: 8779 - protein, 324 aa, delta proteobacterium MLMS-1
MDTLLVLRHLRVENVNAVAGLTWGFPAISNFLGFVHALSRKLSPEFGVALEGCGVVCHEHHMLAHRPRGYGDYVFALTRNPLTKGGDTSSFVEEGRMHMTVSLLIPCAGLLDTRRDPSEVVEAITMLIYQQRLAGGTVVDIGKVEWLEVPEEDEFLSKFERIQLKKMLPGFALVNRSDLLTDHVKRCREENGDIEEFDAWLDFAALKFQAVLPEDQDKEKADSQTPAEWQYVPKPGKGWLVPLTIGYRGISELFAPGKVARARDTGTPFRFVESVYGVGEWVSPHRLENIEQMVWRYSAEPESGWYLCRNDYQPKNQLIQEKEG

SEQ ID NO: 8780 - protein, 148 aa, Aedes aegypti
EVQVLKALVLGEEERGQSQYQVMCFVTKFQKGDFITADAMAKLRQKNPSTIRTPEEDKGKENYTMTGWVVLDRASPISRHIAPLCSEAPEATYARDVDLKAWAELPGEEEIKKNNSGESENEKQTHRKESLRITVWLCAAVTRVRGEL

SEQ ID NO: 8781 - protein, 311 aa, Chlorobium ferrooxidans DSM 13031
MNQNPDALLVLPWLRVQNANCISSPLTWGFPAMSAILGFVHSLERKLKPRYTDLGFSGVAVICHRFEPQIYSPDRGDKVFRLTRNPLNEKGESPSFAEEGRAHITISLLIQVKSENYSNNLNLSQKEEMAEEILKTAQGLRLAGGSILSPFTKKSKVRLSDWDVIGDALKAELRRLLPGFLLTSREDLLSERTTELQTLDPEATSLDALLDFSSLNYEPISTEPDADVVEWQVRKKPGWIVPIPVGYRSISTCYGAGEVLNARDTETPFSFVECIFSLGQWISPHRLTDAGKIFWKHEADVEKGLYRCICS

SEQ ID NO: 8782 - protein, 320 aa, Coxiella burnetii 'MSU Goat Q177'; identical to SEQ ID NO: 8654

SEQ ID NO: 8783 - protein, 327 aa, Pseudomonas aeruginosa C3719
MSVTDPEALLLLPRLSIQNANAISSPLTWGFPSPGAFTGFVHALQRRVGISLDIELDGVGIVCHRFEAQISQPAGKRTKVFNLTRNPLNRDGSTAAIVEEGRAHLEVSLLLGVHGDGLDDHPAQEIARQVQEQAGAMRLAGGSILPWCNERFPAPNAELLMLGGSDEQRPKNQLRLTRRLLPGFALVSREALLQQHLETLRTTLPEATTLDALLDLCRINFEPPATSSEEEASPPDAAWQVRDKPGWLVPIPAGYNALSPLYLPGEVRNARDRETPLRFVENLFGLGEWLSPHRVAALSDLLWYHHAEPDKGLYRWSTPRFVEHAIA

SEQ ID NO: 8784 - protein, 327 aa, Pseudomonas aeruginosa 2192; identical to SEQ ID NO: 8627

SEQ ID NO: 8785 - protein, 695 aa, Vibrionales bacterium SWAT-3
MKKLSDLLAIEDEAVKQSALKKMFMPYTEDVCVQGCEKEALTILLNLSSSHQSDRCSDWLDVARAKRHLKAAESLEASLDEIKWFHTHNLKFPDCRVKDQRIIAQPLVTTEAFISSAVLEQRLGWAHNSAVYRHTLWLLNPFRWQSQPVCILSLIKQENPIWLELLKEFGLGTKSLARLKHTIEEQLPENSSPDSVSTYSKQLRFPWGDDYVSVTPVVSHAIQRELEVRSRSRESKLRFVSSSLPNSASIGNLCGSLGGHMKVLNYPLDVKPAQGGTLTESREKSGHYFDDYQVTNAKICQVLNHLIGSEPSKTQKQRESARKVRSKILRKQIALWMLPLIELRDIVDADPNQQQLEHDDTLAQAFLALPESDLGSLASEFNRRLHLAFQNNKFAAKFAYHPKLMQVAKAQIVWVLEQLSKPNGNEDKVTGEQYIYLSSMRVQDAVAMSCPYLCGAPSLTAIWGFMHRYQREFNKLANCDSLFEFSSFSFYVRSENIQPTAKLTEPNSVAKARTVSNAKRPTIRSERLADLEIDLVIRVHSDSRISDFKSALKTALPVVFSGGALYQPQLSTQIEWLRTFTSRSELFHVIKGLPAYGRWLYPSENQPSDFDELERFITKDADNLPVSIGYHLLERPTKRGNSITGCHAYAENAIGLAQRVSPIEVRFSGRDHFLNHAFWSIECSSEAILIKTYRD

SEQ ID NO: 8786 - protein, 316 aa, Yersinia pestis CA88-4125; identical to SEQ ID NO: 53

SEQ ID NO: 8787 - protein, 640 aa, Vibrio parahaemolyticus AQ3810; identical to SEQ ID NO: 8719

SEQ ID NO: 8788 - protein, 703 aa, Moritella sp. PE36
MVIQLMTFKELLKIEDRDERQRSIKRAFASYSEYIEIYDSELKALIVLLNLTYVAKENVYLLSRVSARHILQKYNKAHTKTLLNLRTDEVSWLHTHNLKYPNSQVSKQNVYAPQIDKVSSALNSANLPLMTGWSHNGPDVNKAKLFCSNFLYQGRITNLAFELRDHPENWQVFFIELGLTKTRFLDMCNQVEQIFSDKALPTNVDIHSKQVRFPYKESYCSITPVVSHAVQYQIQQYTNIKSIRTKDVMHSKSYNVGSLASSLGGHVSALFYPPPVWRKPVKFLQTIKNSNYGYFNINALADKDFIKSLDIVMKRTGTTNKLRRKLKVGALRKIRECLVNWILPIMDIRDGLDELSLEYIEPGSIFDALVNLPIDELNSLITPLSNELNTQLQLSRKLSAYSFHPALLEPLRSQLKWMLSYLASDQHDVQDSCDYCYIYLNSIRVESAQALSCPYLIGTPSLTALGGFSHKLQRNLQERLSADVEVECSAWFIRQYELSKYKPSPQINRFDRKKEVLIRDGIIDDYLCNMTMDIVIKLNMKKDKFKDIHGPNFINKLKGIIPKRFAGGSIYQPFYDTKINWLQVYSSESALFSVLSRLPKSGCWVAPSSEPLTSFNDMFEKIKINSKLKPVLIGYQAVEEPSSRLYSLEKYHCYAESLIGVAQFLNPITVRLNGQKRLFEDIFWQHYFESKTMLMVKYQRKDD

SEQ ID NO: 8789 - protein, 316 aa, Shewanella benthica KT99
MSGEIKTLLILPHIKVHNANALSSPFTIGFPAMTAWLGAMHALQRKLNQDGFADLTFSATGVVSHQCDLQTHKGVGDYVSSIIGTGNPLDKTGSRSAFIEEARCHLDVTLLVELDGLNKTDEVAVLERISHHLHGHMKMAGGDIKGLHAPSIQRIEEGEASDLAMLTRQLMPGYALVERRDLMIAAMESGQDAMDALLDYLVVHQSCTQDDDGNVTWQAKRKTYQDKPAGWIVPIATGFHGITELGEAKNQRDPETPHRFAESIVTLGEFKMPYRINSLNEIMWHYAIEPENNLYVCQQTHSLQKPTSADDWSDFY

SEQ ID NO: 8790 - protein, 316 aa, Yersinia pestis biovar Orientalis str. IP275; identical to SEQ ID NO: 53

SEQ ID NO: 8791 - protein, 320 aa, Coxiella burnetii Q321; identical to SEQ ID NO: 8654

SEQ ID NO: 8792 - protein, 316 aa, Yersinia pestis biovar Orientalis str. F1991016; identical to SEQ ID NO: 53

SEQ ID NO: 8793 - protein, 316 aa, Yersinia pestis biovar Antiqua str. E1979001; identical to SEQ ID NO: 53

SEQ ID NO: 8794 - protein, 201 aa, Yersinia pestis biovar Antiqua str. B42003004
MSSLIVLHQVRVENANAIAGLTYGFPAITHFLGYSHALSRKLQSSHGLTLRGCAVICHYQQVHAYLSGWDYVFSLTRNPLTKEAKTAAFNEEGRMHMTVSLVIECDGTIANGDDGANALEKHLASLCLTQRLAGGTITNIRRVKVINYPETEVATRRLLCRLLPGFALLDRSELLAEHLNRLRQTNPQAEMLDAWLDFSAL

SEQ ID NO: 8795 - protein, 78 aa, Yersinia pestis biovar Antiqua str. B42003004
GYRAISPLYAPGEVDKTRDPHTPFRFVESLYGIGEWRGLHRITDLRQLLWGYHQEGDNYLCRCALPASVDTYLLNDEE

SEQ ID NO: 8796 - protein, 316 aa, Yersinia pestis biovar Orientalis str. MG05-1020; identical to SEQ ID NO: 53

SEQ ID NO: 8797 - protein, 316 aa, Yersinia pestis biovar Antiqua str. UG05-0454; identical to SEQ ID NO: 53

SEQ ID NO: 8798 - protein, 276 aa, Paraburkholderia graminis C4D1M
MQNPAVETPASHFADLPATASHGPLRIEYRWLNAAANAAPIAVFLHEGLGSIAMWRDWPQTLCERLGMRGLVYSRPGYGRSTPREHHVKWPVHFMTDQARDVLPALLDALHIDTRERRRMWVIGHSDGGSIALLYAALFPDALAGAVAIAPHLFVEDVSVQSIAQTKVLYETTDLRNKLSRYHADVDSAFYGWNDVWLNPAFRQWSIAEQLTSIDKPLLAVQGHDDNYGTMAQIDTIQDYVPHAQLARLDACGHSPHRDAPDRLNDVIAAFVSEHQ

SEQ ID NO: 8799 - protein, 315 aa, Providencia stuartii ATCC 25827
MNNSMNLIKLSHLKVHNANALSSPFTIGFPAMTAWLGFMHALELKLRKIGFLELQLESIAVISHECNLQTYKGPSDFVSSIVGTGNPLDKEGNRSAFIEEARCHLDVSLLIEFSDRNDEYGNVLTDKSIVDRIYELIPMMKLAGGDILSVDLPQMHYLPANDDMGKYRRSLFNSLMPGYALIERRDLMVSAMEDGQDAMDALLDYVTVHNQCVEVDIQNESKNKHYEWKVQRKTAGWIVPIATGYQGISPLGQAKNQRDPNVPHRFAESLVTLGQFVMVNKIGHPNEILWKYSNNLENSLYLCQQVESKYFTSGE

SEQ ID NO: 8800 - protein, 307 aa, Escherichia coli B7A
MSYLLLLPHIRIENANAVSGLTWGFPSMTHFLGYVHALSRKVVDEFGVSFDGCAVVSHEQHIQAYSSGRDFQFALTRNPLTREGKTASFNEEGRMHLTVSLLIECNGEITNGEYGRKALCDHLKMLCQSHKLAGGSIVDMREPQLFHAPEDEKQLRKIIWRLMPGYALYDRSEWLAERHQQHPDISLLDAWLDFAAVKYQAESPAEDNSAKWTYQPKPMPGFLVPLMCGYQRISPVYAPGEVENARDTVTPFAFAEAVYGIGEWRGLHRITDLQPLMWHYRTTDTGYYCSATPVVDDFTFNEYDDLE

SEQ ID NO: 8801 - protein, 309 aa, Nitrosococcus oceani AFC27; identical to SEQ ID NO: 8621

SEQ ID NO: 8802 - protein, 704 aa, Vibrio sp. 16
MRIFAGVVSMTKLIELLSIEDANKKQAMLKKWFMPYTADIEVDGLEETALTVLVNLSSHHKGDKCNDWLDKVRAKQHLSDSENIDSSIGELKWFHSHNLKYPDCRVAEQRLIAKPLQTDEVFISGRSLEPSLGWAHNSAYYRHVLWLLNPFRWQSKSTNVLTLVREGHHIWLALLQDFGLEVKTLVALQKAINAQVPDSTFPTSVSSYSKQLRFPWENDYVSITPVVNHSIQRELEVRARDKESKLSFVTSSLPNSASIGSLCGSLGGNMKIMNYPLGVKSTLNGTLATNRNKTGRYFDDYQVTNHQVCLVLSRLTGSEPLKTNKQRDKARNVQSKILRKQIALWMLPLIELRDRANLNPSEQFLNSLDSLASAFLTLPESELKSLATQFNHRLHYVLQENKFTHKFAYHPKLLQVIKCQIVWVLNQLSKPSTSDETTQSEQYIYLTSMRVQDAVAMSSPYLSGAPSLTALWGFMHRYQREFSQLIGSDSSLEFSSFSFFVRSEDIQSTAKLTEPNSVATKRTVSNAKRPTIRSERLADLEIDMVIRVKGHERLADHFSELKASLPMAFAGGYLFQPPISSEVNWLNIFGSQSEVFHAIKGAPTYGRWLYPSELQPSSFDELELQISSDADIHPVSLGYHLLEKPTFRENSITECHAYAENAIGVAKRVNPIEVRFSGRGHYFEHAFWSLEYSYATILMKNYRN

SEQ ID NO: 8803 - protein, 582 aa, Micromonas pusilla CCMP1545
MASTLVATTPLAASPRRANASAPRKMMRSRLAGARGDNNPVVVRVSRVSLTGPRRTRAITVARATATAPPETESSATNETSAYQFDWAKAWYPMSPIAFLDPTIPNPMKVLGKSLVAWKSEDGTWSVANDECPHRMAPLSMGFLSETNQLVCRYHGWEFNGKGEATRVPMSVDAKAERTACASPRGCAVSYPVKEQSGVLWVWPTPGADAWLEASAVPVATEAAEFGDLPGDWGMVELPVGYAPALENQFDPSHAEWLHAKYDEITGGLSETMNVKFEPMTRFNVKEGSMNKIGFIVQHGGYNAGNKDVSAERLFTAPCSSRSEYKDASGNRYLSAAILYTPTEPGRCLMFTKFQAHTRRAVQGAGGKKITTGDRVNALLSAPAQNAFRWYMEFMVKDPALVRVGLNHGVYGNAAYTLGDQDIQAMHGVEVAMESREKSWKQSYYLPSPSDAGVAGFRKWMDDHAGGGVRWAEGVRDDASKVKPIAQRLERYERHTRHCRHCKETLKELGILEERCVALSNAMLAGGLALGLGGAIVGQEGPAVVSLCIAGIMMNAAEQVRDMQNEFKTSVPRRGDPIPKLW

SEQ ID NO: 8804 - protein, 235 aa, Escherichia sp. 3_2_53FAA
FALTRNPLTREGKTASFNEEGRMHLTVSLLIECNGEITNGEYGRKVLCDYLKMLCQSHKLAGGSIVSMRDPQLFHAPEDEKQLRKIVWRLMPGYALYDRSEWLAEHHQQHPDISLLDAWLDFAAIKYQAESPAEDNSAKWVYQPKPIPGFLVPLMCGYQRISPVYAPGEVENARDTVTPFAFAEAVYGIGEWRGLHRTTDLQALMWRYRTTDTGYYCSATPVVDDFTFNEYDDLE

SEQ ID NO: 8805 - protein, 271 aa, Oxalobacter formigenes OXCC13
MSYLLIPDMRVQTANIHHSSFLLGGPPVMAAFFFAHAMGRQLGKNVRVNGTAYIHHHMDVLGQSFYGRLSLQQRRGAAFTFSNKPKKDYSSKNEHALSLQPVANAHLRLSLIIDIDNLESMAGVNRFLHKARFSGGHIISHGEPGQYDDLDEAIDDLPAGFFVMDRSDLMKTGTSDNPAQTFIDRLGTRYESETGNTWLSAACLGYAMLTPYASREGAREGYEHAFAEPLVGLVQYRSSRQFDKDYETVLWKPEWVKDDVYRLHQDSENLD

SEQ ID NO: 8806 - protein, 316 aa, Yersinia pestis Nepal516; identical to SEQ ID NO: 53

SEQ ID NO: 8807 - protein, 316 aa, Yersinia pestis biovar Orientalis str. India 195; identical to SEQ ID NO: 53

SEQ ID NO: 8808 - protein, 316 aa, Yersinia pestis biovar Orientalis str. PEXU2; identical to SEQ ID NO: 53

SEQ ID NO: 8809 - protein, 316 aa, Yersinia pestis Pestoides A; identical to SEQ ID NO: 53

SEQ ID NO: 8810 - protein, 313 aa, Yersinia kristensenii ATCC 33638
MQQVRVENANAIAGLTYGFPAITHFLGYSHALSRKLQASHGLTLQGCAVICHQQQVHAYSSGYDYVFSLTRNPLTKEAKVAAFNEEGRMHMTVSLVIECEGVIADGDAGAKALAKHLALLCLSQRLAGGTITHIGQIKVINYPETETATRRLLCRLLPGFVLVDRSELLAEHFNRLKQSQPQAEMLDAWLDFSAFKMQAVAAPGDNSPEQGAPAQWDIIAKPGKGGYLVPIVTGYRAISPLYAPGEVEKSRDPETPFRFAESVYGIGEWSGLHRIKDLRHILWQYHQQDDHYLCRCALPAPVDNYAFNDDEEF

SEQ ID NO: 8811 - protein, 292 aa, Yersinia rohdei ATCC 43380
MGYTHALSRKLQQSHGIELQGCAVVCHHHQIQAYQPSGWGDYVFALTRNPLTKEGNTAPIVEEGRMQMEISLVLECQGLISGGEAGIAALREYLFPLCQSQRLAGGTISRLQDIDIVAFPTTAQERSRFTRRLLPGFVLLDRSSLLQQHLLRLQQDQPEADLLDAWLDFSALKYQAIPLQDENGVQDDNNKAQWAYQPKPESGWLVPIMTGFRAISPCYEPGIVNNSRDWATPFRFAEAVYGIGEWKSPHNIDDLRQMFWQYSHDQDWYLCQAQPNTVTGSAFQLEEDFDFF

SEQ ID NO: 8812 - protein, 327 aa, Enhydrobacter aerosaccus SK60
MSFLAVIPHIRVQGANLQTSGILLGGVPLMASTMFAHALARKLSVKDTGVIYIHHDRQDLGGFAYGRFTPAQRRGSAFINKNDYSSKNPNALSLQPTASCHLHLSLVIRFDGRRRPRLADLQKLLMNSRFAGGQITSYGEVEWADDNEKTLKDVLGNTIKTGFVVLDRHDVLLAYQQSQNLNRLQAFTRLLALTKDGLNHAFGEYHGLSFLSATNLGYALLEEPKTDRTGVRQAYTLDNDVIETPHAYAEPLIGLVQYVSIRQLLNFAKVQPSDDVDLSEEEQEPYQPQNPIAEPLRQLSDNPQELFWQYQWHTHNGGDVFLLRQSI

SEQ ID NO: 8813 - protein, 295 aa, Vibrio mimicus VM603
MNVLILPHLKIHNANALSSPFTIGFPALTAWLGFVHALERKLNQAGLSDLMLHSAAVVSHRCDVQTHKGEGDFVHSIIGTANPLDKDGSRSAFIEEARCHLDVSLVIEWSGNEEQVQQPEFTLQLQAVIATMKVAGGDVLSFGKPSVKSVITQEDTAQVLRQLMPGYVLIERRDLMIDAMQQGDDAIDALLGYLTVDHHCEQLEDQSVAWHSQRKTSGWIVPIATGFQGISPLGEAKNQRDPSVPHRFAESVVTLGEFVMAHKIKHLDDILWQYHPDLENDLYLCQQVNAINEHQ

SEQ ID NO: 8814 - protein, 295 aa, Dialister invisus DSM 15470
MKAYLLISRLRIHNANAMSSTLTIGVPAMTAWLGAVHALERKLGERREPALEGIRLVKTAVSYHKTNLQIYKGPGDYVNSLVGTANPLNEKGERPSFIEDARIHLSVSLLIEAERVDGNNMELLEQVVKEILPRMKMAGGDILDIRKIQVMRINEDNPISVRKVISTLMPGYIPIERRDLMEAKELEGKDSLDRLLHYLKVHQMAEKDESGKVTDWKYEKAAAGWIAPLAVGFKGLSPLGKVKNQRDPDTPHRFAESIVTLGEFKMAHRFRDIDEMMWHYAYEETNQLYLCKNKE

SEQ ID NO: 8815 - protein, 294 aa, Acinetobacter baumannii ATCC 19606 = CIP 70.34 = JCM 6841
MSRYVVIPRMRVQNANMQTNGFLLGGVPLFAANMFAHHLARQLGTQEEGIIYIHHDQQRLGGQAYGRFTPAQRRGAVFIGKKDYSSKNKYALSLQPTASCHLEFSLVIKFSSSRISPEKLTNILKCSRFAGGQIIEFLEITTHSENELETALKKIKTGFAILDRQDLLIEYQQRKQINRVQAFTQLLALKADALRAFFNDQNLSWISATNLGYALLEPLTDQRAGIRQAQDQENTAHAYAEPLTGIIQYFSLGEILRRNTEAEDDTWHNLQKLLWTYHWPQDDIFLLKQNCINA

SEQ ID NO: 8816 - protein, 327 aa, Pasteurella dagmatis ATCC 43325
MFQTDFYILFDHIKVQSANAISGPLSYGFPALTGFTGAMHALNRKLSHHNVQFGGVMVACHDYELQTYQSSSFSDRTFKQTRNPIKRDGKTASIIEEGKIHLDVSLVVELSVPNDELFGALQYAGSQIAQDFLQECKDLLWKQRIAGGSVLEIGDSQLFKVEEDQDIPLALMPAFVLMDAKQDLVNITEELRTGIRVEQLDENGNAQQSFIKAQPEATALDALLEMATLHHIPNHINAGPSDWQTYSVKKGRGWLVPIPVGYQAISPLFDAVKVQHCRTQQYPSQYVETIYSLGKWVFPLSLPKDLSQCFWRYNAPQNNLYLISQGE

SEQ ID NO: 8817 - protein, 318 aa, Mitsuokella multacida DSM 20544
MSKIKTYLLLRQVKIHNANAFSSPLTIGFPAMTAWLGAMHALERKLRRNEALSSIRLKKLAVSCHDFNLQTYKGPGDYVNSVIITSNPLRKKGASFERPPFIEEARIHLTVSLLIEVDGLSSSNYSIFNEKTTKVLNGMKIAGGDILAFSPIDDPIKSTSTRGSRILLVDEDSEKDVRRAIRSLMPGYVLIERRQLLKQRQEKLEAQDTLQALLDLLALHYEHDDEHDTWHLQPRQEQGWLVPIVTGFKGLTPLGHVANQRDASTLHRFAEPVLTLGEFKMPHHFQDIDQMMWQYQYDENKDLYVCVNEKIELNEGED

SEQ ID NO: 8818 - protein, 695 aa, Vibrio mimicus VM223
MTKLSDLLAIEDEAIKQTALKKMFMLYTEDVCVDGYEQETLTILLNLSSSHQADRCSDWLDVARAQRYLKDRENLDASLAEIQWFHTHNLKFPDCRVKDQRIIARPLSTAEEFISSAVLDQRLGWAHNSAVYRHTLWLLNPFKWQSQPVCILSLIQQKNPVWLDLLKEFGLDVKSLAHLQSAIEEQLPENSFPDSVSTYSKQLRFPWGDDYVSITPVVSHAIQCELEIRARSPENKLSFVSSSLPNSASIGNLCGSLGGYMRVLNYPLGVKQAKGGTLTASRQKSGHYFDDYQVTNAKICQVLNRLIGSEPSKTQRQRERARQVRSKILRKQIALWMLPLIELRDIAESEPNQQQLEHDDTLAQAFLSLPELELGSLASEFNRRLHLTFQNNMYSAKFAYHPKLMQVAKAQVTWVLEQLSKPINNQDTVTGEQYIYLSSMRVQDAAAMSNPCLCGVPSLTAIWGFMHDYQRKFNQLVNNDSPVEFSSFAFYVRNENIQSTAKLTEPNSVAKARTVSNAKRPTIRSERLVDLEIDLVIRVHSESRISDFRSALKTALPVAFAGGALYQPQLSMQIEWLRTFTGRSELFHVLKGLPAYGRWLYPSEKQPTNFDELERLLTQGDDNLLVSLGYHLLEHPTKRGNAITGCHAYAENAIGLAKRINPIEVRFSGRDHFLNHAFWSIECSSETILIKNYRD

SEQ ID NO: 8819 - protein, 321 aa, Phytophthora infestans T30-4
MDPPSNPVNSDLVAGSAESPPLNYLFLGNPGTGKSTLINCLVGTALFNSGLSYGGGLTKEFQTRLHGNVQYMDTPGLADRNIQQKAAAAITEALQQSGIHKLFFMVRLENGRVVSDDLATIKIVVRSIQLDEIPFTVVVNNVKKRQYNKMMEKGDDYFKVVALISSVECKPQRIVFIPVIDNLDEQDNAVTQLPADVQRFIRTEAATVQIAPSDVTPIKIEDFKNVSERLRAEQEELLNNNALLRRRIAELMERSSTTQCLWRSVGKFLSPVTERFANLVHSSRHSDPSSNASRHVNNKKAKNGWLTAEEDGNVSADVAVV

SEQ ID NO: 8820 - protein, 299 aa, Acinetobacter lwoffii SH145
MSCFVTIPYIKVQAANFQSNGLMMGGAPLMAAAMFSHHLARQIETEDLGFYYIHHDMQALGGEAYGRFTPSQRRGATFIGKTDYSSKNKYALSLQPTASCHLLFSLVIEFDARRPDLDTLIQTLKRSKFAGGHILEFGQIQDAKNVDDALAHISSGFLIRDRHDLLSAYQREYQVNRLQAFTQLLAHRPQAKNSETPVLERLPNEDLAWISATTLGYALLEQPTTERAGIRHADDQEKTAHAYAEPLTGLIQYHSLNQILNEINNENSIYPEDYLEQIKWSHQWIQDDVFLLQQTLTTQ

SEQ ID NO: 8821 - protein, 316 aa, Yersinia pestis KIM D27; identical to SEQ ID NO: 53

SEQ ID NO: 8822 - protein, 311 aa, Enterobacter cancerogenus ATCC 35316
MSTLILLRHVRVENANAIAGITYGFPAITHFLGFTHALSRILTQTHGLTLEGCAVVSHGHQIHAHTSGRDYQFALTRNPLTREGKTASFNEEGRMHMTVSLLLECHGEIVNGDYGQQALAEFLKARCPTLRLAGGIIVSIKDIAVMDKPTTDEQLAYLKWQLTPGFVLRDRSAWLGEHHQNLLEDNPQATMLDAWLDFAALKFQAETPEEDDIQEGEPAAWQRVPKPYPGYLVPLMTGYQRISELYAPGVVTHARDDQTPFAFTEAVYGVGEWCGLHRITSLEDIFWRYHTTETGYYCQGANAPQAAKQHS

SEQ ID NO: 8823 - protein, 323 aa, Neisseria sp. oral taxon 014 str. F0314
MNTDFYLLFDRVEIQGANCISSPLTYGFPALSGFLGAIHALQRRLPQDCGLTLGGVLIACHRCSPQIFRADAYSDATFIQSRNPLKKDGSTASIIEEGKTDLTVSLVVEVGGAPNDIRKNKEQRETLLQSLLQQQRIAGGSVRHIERTALYESYQAEELKAALFPAYILADAGNDLAAITQELQLGCRVTADKDGGTAVYEDRPTGLPPQPEATALDALFATAQFFHLPPDDEHPQWHSYHIRQGRGWLVPIPVGYQAIAPEHAAGVMQHVRNPEYPSRYVETVYSLGKWLFPNKLSDGLHAYFWRYAPPQDNLYLITQTTRP

SEQ ID NO: 8824 - protein, 278 aa, Desulfonatronospira thiodismutans ASO3-1
MSIYLIFNNLMVRRANMMQSPYLYAPVPVFPSVCTGHKLGCMLDCEVDGVGVVHHRAEPLIEQMAQMNQGSNRVNIVTSPIQFRGTPSGKQVNTKDPIGLPMQPTMTAHLEISLIFRVNGRVPTVEAAREAMQGLRIAGGSLNYISSRRVKLKDDLIGALAEVSNGFWISDAMHLVQQRLDEGFDPVSAIFQKADKGWYVPANLGYCAVTDFKQRQGGRTLVWEDGRVDEPEIALADNMIGLVRYDPLYGVKQELNSGGTVGMWHFDFTDDTFFVVKQ

SEQ ID NO: 8825 - protein, 319 aa, Actinobacillus pleuropneumoniae serovar 2 str. 4226
MNYPNFYLLFDHVEIQAANTISSPITYGFPALTGFTGAIHALSRKLFSQQVELGGVMIACYDYQILGYKNSDFSDLTFNQTRNPLKKNGDSPSIIEEGKIHLDISLVVEMEVKDPEFYYALNSQDSEQKTQFLEHCKKLLMQQRIAGGSVFQIENVELFNLSEESEIKLALMPAFVLMDAKQILTDITQSLQNGISNNEIMIYPATPNANALDALLEVATLHHIPLSEHATSQEWETFNVNQGKGWLVPIPVGYQAISPLFTAGEMQNCRTTEYPSQYVETVYSLGKWVFPFSLPDDLSQCFWHYNTPQDNLYLITQGA

SEQ ID NO: 8826 - protein, 319 aa, Actinobacillus pleuropneumoniae serovar 6 str. Femo
MNYPNFYLLFDHVEIQAANTISSPITYGFPALTGFTGAIHALSRKLFSQQVELGGVMIACHDYQILGYKHSDFSDLTFNQTRNPLKKNGDSPSIIEEGKIHLDISLVVEMEVKDPEFYYALNSQDSEQKTQFLEHCKKLLMQQRIAGGSVFQIENVELFNLSEESEIKLALMPAFVLMDAKQTLADITQSLQNGISNNEITICPATPNANALDALLEVATLHHIPLSEHATSQEWETFNVNQGKGWLVPIPVGYQAISPLFTAGEMQNCRTTEYPSQYVETVYSLGKWVFPFSLPDDLSQCFWHYNTPQDNLYLITQGA

SEQ ID NO: 8827 - protein, 109 aa, Bifidobacterium dentium ATCC 27679
MQRYGRIGASHHVTEWERSSGVRRLRHVGTQAQTWFTRHAYIGGCYYHFRKNKEAGWLEPSATGFMRIEPEPCGGGVRVPFGARDTRRINPGLGGIGIEPGMGAIVKRD

SEQ ID NO: 8828 - protein, 307 aa, Escherichia coli NC101
MSYLLLLPHIRIENANAVSGLTWGFPSMTHFLGYVHALSRKVVDEFGVSFDGCAVVSHEQHIQAYSSGRDFQFALTRNPLTREGKTASFNEEGRMHLTVSLLIECNGEITNGEYGRKVLCDYLKMLCQSHKLAGGSIVSMRDPQLFHAPEDEKQLRKIVWRLMPGYALYDRSEWLAEHHQQHPDISLLDAWLDFAAIKYQAESPAEDNSAKWVYQPKPMPGFLVPLMCGYQRISPVYAPGEVENARDTVTPFAFAEAVYGIGEWRGLHRTTDLQALMWRYHTTDTGYYCSATPVVDDFTFNEYDDLE

SEQ ID NO: 8829 - protein, 319 aa, Actinobacillus pleuropneumoniae serovar 1 str. 4074
MNYPNFYLLFDHVEIQAANTISSPITYGFPALTGFTGAIHALSRKLFSQQVELGGVMIACHDYQILGYKHSDFSDLTFNQTRNPLKKNGDSPSIIEEGKIHLDISLVVEMEVKDPEFYYALNSQDSEQKTQFLEHCKKLLMQQRIAGGSVFQIENVELFNLSEESEIKLALMPAFVLMDAKQILTDITQSLQNGISNNEIMIYPATPNANALDALLEVATLHHIPLSEHATSQEWETFNVNQGKGWLVPIPVGYQAISPLFTAGEMQNCRTTEYPSQYVETVYSLGKWVFPFSLPDDLSQCFWHYNTPQDNLYLITQGA

SEQ ID NO: 8830 - protein, 319 aa, Actinobacillus pleuropneumoniae serovar 2 str. S1536; identical to SEQ ID NO: 8825

SEQ ID NO: 8831 - protein, 319 aa, Actinobacillus pleuropneumoniae serovar 4 str. M62
MNYPNFYLLFDHIEIQAANTISSPITYGFPALTGFTGTIHALSRKLFSQQVELGGVMIACHDYQILGYKNSDFSDLTFNQTRNPLKKNGDSPSIIEEGKIHLDISLVVEMEVKDPELYYALNSQDSEQKTQFLEHCKKLLMQQRIAGGSVFQIENVELFNLSEESEIKLALMPAFVLMDAKQTLADITQSLQNGISNNEITICPATPSANALDALLEVATLHHIPLSEHATSQEWETFNVNQGKGWLVPIPVGYQAISPLFTAGEMQNCRTTEYPSQYVETVYSLGKWVFPFSLPDDLSQCFWHYNTPQDNLYLITQGA

SEQ ID NO: 8832 - protein, 319 aa, Actinobacillus pleuropneumoniae serovar 6 str. Femo; identical to SEQ ID NO: 8826

SEQ ID NO: 8833 - protein, 319 aa, Actinobacillus pleuropneumoniae serovar 9 str. CVJ13261; identical to SEQ ID NO: 8829

SEQ ID NO: 8834 - protein, 319 aa, Actinobacillus pleuropneumoniae serovar 10 str. D13039
MNYPNFYLLFDHVEIQAANTISSPITYGFPALTGFTGAIHALSRKLFSQQVELGGVMIACHDYQILGYKHSDFSDLTFNQTRNPLKKNGDSPSIIEEGKIHLDISLVVEMEVKDPEFYYALNSQDSEQKTQFLEHCKKLLMQQRIAGGSVFQIENVELFNLSEESEIKLALMPAFVLMDAKQILTDITQSLQNGISNNEIIIYPATPNANALDALLEVATLHHIPLSEHATSQEWETFNVNQGKGWLVPIPVGYQAISPLFTAGEMQNCRTTEYPSQYVETVYSLGKWVFPFSLPDDLSQCFWHYNTPQDNLYLITQGA

SEQ ID NO: 8835 - protein, 319 aa, Actinobacillus pleuropneumoniae serovar 11 str. 56153; identical to SEQ ID NO: 8829

SEQ ID NO: 8836 - protein, 319 aa, Actinobacillus pleuropneumoniae serovar 12 str. 1096
MNYPNFYLLFDHVEIQAANTISSPITYGFPALTGFTGAIHALSRKLFSQQVELGGVMIACHDYQILGYKHSDFSDLTFNQTRNPLKKNGDSPSIIEEGKIHLDISLVVEMEVKDPEFYYALNSQDSEQKTQFLEHCKKLLMQQRIAGGSVFQIENVELFNLSEESEIKLALMPAFVLMDAKQILTDITQSLQNGISNNEIMIYPATPNANALDALLEVATLHHIPLSENATSQEWETFNVNQGKGWLVPIPVGYQAISPLFTAGEMQNCRVTEYPSQYVETVYSLGKWVFPFSLPDDLSQCFWHYNIPQDNLYLITQGA

SEQ ID NO: 8837 - protein, 319 aa, Actinobacillus pleuropneumoniae serovar 13 str. N273; identical to SEQ ID NO: 8651

SEQ ID NO: 8838 - protein, 640 aa, Vibrio parahaemolyticus Peru-466; identical to SEQ ID NO: 8738

SEQ ID NO: 8839 - protein, 640 aa, Vibrio parahaemolyticus AN-5034; identical to SEQ ID NO: 8738

SEQ ID NO: 8840 - protein, 640 aa, Vibrio parahaemolyticus K5030; identical to SEQ ID NO: 8738

SEQ ID NO: 8841 - protein, 307 aa, Escherichia coli MS 145-7; identical to SEQ ID NO: 8800

SEQ ID NO: 8842 - protein, 109 aa, Bifidobacterium dentium JCVIHMP022; identical to SEQ ID NO: 8827

SEQ ID NO: 8843 - protein, 213 aa, Escherichia coli MS 110-3; identical to SEQ ID NO: 8623

SEQ ID NO: 8844 - protein, 71 aa, Escherichia coli MS 110-3; identical to SEQ ID NO: 8774

SEQ ID NO: 8845 - protein, 460 aa, Bilophila wadsworthia 3_1_6
MNDFSELVDFSSRFINSNSSFGIRISQSSALSLPYLSARTCLAAGISLPMDTAGGAVEAGKVSKMYNALENGTVEEQEEIEGELLRVRKIPFIKGGGKSIDRRIRQLLLPQKSAATGYVSVSPLTAIGLSALLFGPSGLVSKHNDSLNHPDALRIRRAHLAFGGANPHNLGYFSARWMMQYPILLSAPDCEEGMPERRNPSKRGRYLILPNLRVQCANILTNQILVNGPPISAAWGMGHALEREMGRRIEGVCLVMHYVEPLGEREYGAFEPSQKRGAAFTFEKSRNGSDYTKGTINLSLQPGVCAHMRVSVVYELSRDLTSLPRAVEAFLATGRFAGGLITSYGKPDLHDDRDTLLECLPVGRVIVDRRDLMASGNPLENLVNAIGYRHKQEWLSATNIGYSAITDFGLRGGARDGHLHAFAEPLIGIVEYVNTLDRAQSYFWHDRWLDDSFLLEGGQD

SEQ ID NO: 8846 - protein, 277 aa, Bilophila wadsworthia 3_1_6
MSYLVFPRVRVQAANMLSASFLMGGPPVFAAYGLGEALCFHLGGGAKVTGMALIHHNREALGQSFYGVFSPQQRRAAAFTFGKSANGSDYSSKNPHALSLQPVACAHLRVSIIWELEQVAGVKEAREFLHRARLSGGLVTGHGEIVLEDSLEAAFDRVGNGYVVTDRRDMLEDKGKNQAELLVEALGAQPSAGEDNTWLSAACLGYAAITPFEHRGGARCGYTHAFAEPLVGMVQYRSLRQWRKEADAEEALWRPVWLDDRRGAFVLRQEQTEPEDM

SEQ ID NO: 8847 - protein, 79 aa, Actinobacillus ureae ATCC 25976
MVFLHSPVLPEQFMHLAANFFPQQMELGGVMIACHDYQILGYKNSNFSDLTFNQTRNPLKKMAIRLPLSRKEKFTWIFH

SEQ ID NO: 8848 - protein, 183 aa, Actinobacillus ureae ATCC 25976
MDISLVVEMEVKDPELYYALNSQDSEQKTQFLEHCKKLLMQQRIAGGSVFQIENVELFNLSDTKEIKLALMPAFVLMDAKQTLADITQSLQSGISNNEITISPATPNANALDALLEVATLHHIPLSEHATSQEWEIFNVNQGKGWLVPIPVGYQAISPLFTAGEMQNCRTNEYPSQYVETVYT

SEQ ID NO: 8849 - protein, 213 aa, Escherichia coli H252; identical to SEQ ID NO: 8623

SEQ ID NO: 8850 - protein, 71 aa, Escherichia coli H252; identical to SEQ ID NO: 8774

SEQ ID NO: 8851 - protein, 213 aa, Escherichia coli H263; identical to SEQ ID NO: 8623

SEQ ID NO: 8852 - protein, 307 aa, Escherichia coli MS 57-2; identical to SEQ ID NO: 8676

SEQ ID NO: 8853 - protein, 122 aa, Trichophyton rubrum CBS 118892
MQRMKFLCLLPAFSFREKQWIKVIPNSLETRHLQMLDALVGLSILHHIPGPADTRRWNRQFPDSGPVLLQKHEILQNCALTQKMCINRLPVIESSNAATAVMTKNLTRDATMTLVRVDQPQA

SEQ ID NO: 8854 - protein, 311 aa, Moraxella catarrhalis 46P47B1
MNDKVRVGCVYFHKMVIYDANTISSPLTYGLPALTGFTGAFHALSRTLMADERFADLALGGVLLACYECTPKTYRAGRYHDHTFNQTRNPLKKDGKTAPIVEEGKCNLVMSFAVEVLASDLLSEKRSQELTQFLSQAIFRQRIAGGSVMNIAKTHPVRYFGFESMHQIVPLLMPAFVLMDASSEFSELIDKAQSTDPKATPLDVLLDVCTLHHLPKLDLDGNTKWHTKSIKTGHGWIVPMPMGYQAISEQFEAGKMDNVRNPEYPSQYVEVVYGLGKWVYPHHLKDDIETAFWRQHYDETGLYLLTQNELS

SEQ ID NO: 8855 - protein, 311 aa, Moraxella catarrhalis 7169
MNDKVRVGCVYFHKMVIYDANTISSPLTYGLPALTGFTGAFHALSRTLMADERFADLALGGVLLACYECTPKTYRAGRYHDHTFNQTRNPLKKDGKTAPIVEEGKCNLVMSFAVEVLASDLLSEKRSQELTQFLSQAIFRQRIAGGSVMNIAKTHPVRYFGFESMHQIVPLLMPAFVLMDASSEFSELIDKAQSTDPKATPLDVLLDVCTLHHLPKLDLDGNTKWHTKSIKTGHGWIVPMPMGYQAISEQFEAGKMDNVRNPEYPSQYVEVVYGLGKWVYPHHLKDNIETAFWRQHYDETGLYLLTQNELS

SEQ ID NO: 8856 - protein, 311 aa, Moraxella catarrhalis 103P14B1; identical to SEQ ID NO: 8855

SEQ ID NO: 8857 - protein, 311 aa, Moraxella catarrhalis 12P80B1; identical to SEQ ID NO: 8855

SEQ ID NO: 8858 - protein, 311 aa, Moraxella catarrhalis BC1; identical to SEQ ID NO: 8855

SEQ ID NO: 8859 - protein, 311 aa, Moraxella catarrhalis BC7; identical to SEQ ID NO: 8855

SEQ ID NO: 8860 - protein, 311 aa, Moraxella catarrhalis BC8; identical to SEQ ID NO: 8855

SEQ ID NO: 8861 - protein, 311 aa, Moraxella catarrhalis CO72; identical to SEQ ID NO: 8855

SEQ ID NO: 8862 - protein, 311 aa, Moraxella catarrhalis 101P30B1; identical to SEQ ID NO: 8855

SEQ ID NO: 8863 - protein, 311 aa, Moraxella catarrhalis O35E; identical to SEQ ID NO: 8855

SEQ ID NO: 8864 - protein, 640 aa, Vibrio parahaemolyticus 10329
MATLAEILDNKTDDLNKDLRRAFRPLSAPVDISDTPIEALTILVNLTDRVIEQKDLLDRQKCKDKLRDQKWWANCFRTVKYRQSHNPKFPDIRANGVIRAAPVGHLPSCMLSSSKLPQNSWAYANDSSQMNKSCFLTSEFIWNGDVHCLGQLLTELEHPLWNVLRKLGCYVKTAKYISKELALIPPLEINTSLVRNYLAQISLPNDEDSYISLSPVVSQSMQEDCYQVLSEHYRFSAITRFSRATNMGTLAMSCGGKFKMIRSLPPIEKYQHHHLDSVNWLTKRSVRAIRDYTESSVWVISPNKLALRKKSIIEDIKIMLSQWLRTTPTHEEKLDIRKLTERFNVDLAKTKFANRYAYDPLLTQLIYNCIGSIIHSPPQDSPKYEENDDKYLLLPNLRISGASAMNTSVSIGIPSMMAFYGFVHAFQRNVQTTNPNFKIESFAVCIHNIHVENRGLTREWVPNTKGQITAPATRDDWQCDVAVSLILRCGHYSQLIPRDFIRLLPGRIARGKVTVSISDIKHLGRCLSLADAVKTIPVETGRWLSLNNEVTLNSIQDVIDELKNNKLQTVNCIGYHRLETPCEKRGSLHGYKHAFVETILGIIKFLTISENTNPSQYFWQYHYSKQGPILLPRSVSDETS

SEQ ID NO: 8865 - protein, 307 aa, Escherichia coli D9; identical to SEQ ID NO: 8800

SEQ ID NO: 8866 - protein, 294 aa, Acinetobacter baumannii 6013150; identical to SEQ ID NO: 8656

SEQ ID NO: 8867 - protein, 294 aa, Acinetobacter baumannii 6013113; identical to SEQ ID NO: 8656

SEQ ID NO: 8868 - protein, 84 aa, Shigella flexneri VA-6
MPCFTAMRAEIALMSGSAFAVTHHAFSSGAGRTSDGNGSHASTLKSPSYTKSVSWQHYPLIKPPGWMVNLSVGLNKGYQPSISL

SEQ ID NO: 8869 - protein, 329 aa, Rheinheimera sp. A13L
MSNYILLEHIKVQNANCIAGFTYGFPAITHFLGYTHALSRKLQQEFGVELTGCAVVCHQHQVQAYQPGGWGDYVFALTRNPLTKEGNTAPIVEEGRMHLTVSLILESNKAFSSNQQQQIIETLTLLAQRQKLAGGQVINLKGVSLYSDDDEQALSRKLLRKVLPGFVLTDRSELLKRHYQQLTAAQPNATMLDAWLDFSALSYRAVVDDNVDTATEPCPAMWERVPKPDKGYLVPITTGYKAISALHDAGAVANSRDPQYPFCFVESAYGVGQWLSPHRVPDVRDVIWRYRQQGPWYLCTTNTTQNTLKLHPEQDAALAEITETELTYF

SEQ ID NO: 8870 - protein, 107 aa, Pasteurella multocida subsp. gallicida str. Anand1_poultry
  misc_feature (76)..(76): Xaa can be any naturally occurring amino acid
MFQTDFYILFDHIKVQSANAISGPLSYGFPALTGLTGAIHALNRKLAHHPVQFGGVMVACHDYELQTYQNSAFSDXTFKQTRNPIKRNGETASIIEEGKIHLDLSLV

SEQ ID NO: 8871 - protein, 327 aa, Pasteurella multocida subsp. multocida str. Anand1_goat
MFQTDFYILFDHIKVQSANAISGPLSYGFPALTGLTGAIHALNRKLAHHPVQFGGVMVACHDYELQTYQNSAFSDRTFKQTRNPIKRNGETASIIEEGKIHLDLSLVVEVHVQDDRVFEALTDKTSQASQDFLRECQTLLWQQRIAGGSVLDIGNVQLFNLEEDQDIPLALMPAFVLMDAKQELANITEELKTGLRIGQLDEEGNVQKSCLPSCPEATALDALLEMATVHHIPEHANATASAWQTYSVKKGRGWLVPLPVGYQAISPLFEPGQLQHCRTQQYPSQYVETLYSLGKWVFPLSLPENLSQCFWRYSAPQNNLYLISQGE

SEQ ID NO: 8872 - protein, 404 aa, Pasteurella multocida subsp. multocida str. Anand1_goat
MIGTHAPKLFSSKVKQSAINADIIENLPKHYISSKTINIRKKYWALPLSAAEIGMYRAMSEEEREQQPQKIPNIEDPRLVKQLLMPFQNSYISVSPVPSCGVLHEISQRGFENKIFPIYRRTIQPVFSAWSNHGEMLLAQKGRIALLIKSLIESRQRKKSKSAYLTIKCRVEKMNVSSGMTAVLFPSITAIGGAVHTIERAVNKRLDFAIGFKNLSFTKSGIMGNAVKGKKVIPQLTLDEITATADIIILLKLKRGTSEEEKKEVLDYLQSNPLNRIAGGTTWEYNAYFAPYNDNYTFVVDDSREVEQELQEGMDVLDVAFDKYKNKGEVNETGIFEITEKTGVIINHTGYAFLESPRPREHTRNNYHHAWVEPVFSVVKQEIFSKSVFWTRKEEKFGVIFSQR

SEQ ID NO: 8873 - protein, 295 aa, Vibrio cholerae HC-02A1
MNVLILPHLKIHNANALSSPFTVGFPAMTAWLGFVHALERKLSQAGLSDLMLHSAAVVSHRCDVQTHKGEGDFVHSIIGTANPLDKDGSRSAFIEEARCHLDVSLVIEWSGNEEQVQQPEFTEQLQAVIATMKVAGGDVLAVGKPSVKSVITEDDTGRVLRQLMPGYVLIERRDLMIDAMQQGDDAIDALLGYLTVHHHCEQLEDQSVVWHSQRKTSGWIVPIATGFQGISPLGEAKNQRDPSVPHRFAESVVTLGEFVMVHKIKHLDDILWQYHPDLENDLYLCQKVNAINEHQ

SEQ ID NO: 8874 - protein, 277 aa, Bilophila sp. 4_1_30
MSYLVFPRVRVQAANMLSASFLMGGPPVFAAYGLGEALCFHLGGGAKVTGMALIHHNREALGQSFYGVFSPQQRRAAAFTFGKSANGSDYSSKNPHALSLQPVACAHLRVSIIWELEQVAGVMEAREFLHRARLSGGLVTGHGEIVLEESLEAAFDRIGNGYVVKDRRDMLENRGKNQAELLVEALGAQPAAGEDNTWLSAACLGYAAITPFEHRSGARCGYIHAFAEPLVGMVQYRSLRQWRKEADVEEAFWRPVWLGDRRGAFVLRQEQAEPEDM

SEQ ID NO: 8875 - protein, 302 aa, Escherichia coli 3030-1
MLPHIRIENANAVSGLTWGFPSMTHFLGYVHALSRKVVDEFGVSFDGCAVVSHEQHIQAYSSGRDFQFALTRNPLTREGKTASFNEEGRMHLTVSLLIECNGEITNGEYGRKALCDHLKMLCQSHKLAGGSIVDMREPQLFHAPEDEKQLRKIIWRLMPGYALYDRSEWLAERHQQHPDISLLDAWLDFAAVKYQAESPAEDNSAKWTYQPKPMPGFLVPLMCGYQRISPVYAPGEVENARDTVTPFAFAEAVYGIGEWRGLHRITDLQPLMWHYRTTDTGYYCSATPVVDDFTFNEYDDLE

SEQ ID NO: 8876 - protein, 319 aa, Aggregatibacter actinomycetemcomitans serotype a str. H5P1; identical to SEQ ID NO: 8710

SEQ ID NO: 8877 - protein, 319 aa, Aggregatibacter actinomycetemcomitans serotype d str. I63B; identical to SEQ ID NO: 8710

SEQ ID NO: 8878 - protein, 331 aa, Aggregatibacter actinomycetemcomitans serotype e str. SCC393
MNTDFYLLFKHIKIQSANAISGPLSYGFPAVSGFVGAIHALSRKLNEKAMLDGVTIACHNYDLQAYQSTPFSDRTFIQTRNPLKKNGETAPIIEEGKVHLDISLVIELHISDKMLSHQVENNLNCDEAKIFLSECKNLLLKQRIAGGSVLSIEDVQLHYLEDEWKIKRQLLPGFVLMNAQAELIKITEELQQGLKQGDFVVLEANPDATAFDALIETAILHHIPNHPHAKTNEWQTYSIKQGRGWLVPIPVGYQAISPLFEAGQLQHCRTQDYPSQYVETLYSLGKWVSPLNLPEDLSRCFWRYTEPKIIYTSFHKETNNEKINHTNRISF

SEQ ID NO: 8879 - protein, 319 aa, Aggregatibacter actinomycetemcomitans serotype f str. D18P1; identical to SEQ ID NO: 8710

SEQ ID NO: 8880 - protein, 319 aa, Aggregatibacter actinomycetemcomitans D17P-3; identical to SEQ ID NO: 8710

SEQ ID NO: 8881 - protein, 71 aa, Escherichia coli cloneA_i1; identical to SEQ ID NO: 8774

SEQ ID NO: 8882 - protein, 213 aa, Escherichia coli cloneA_i1; identical to SEQ ID NO: 8623

SEQ ID NO: 8883 - protein, 422 aa, Novosphingobium pentaromativorans US6-1
MALPSQGSAIHRTLPPPFRTLVPGKVVQSSSIGVTAMSRISPVSHRSIRQQLHACGLLLASSLVLAGCGGGGGLASVSSAPGPIAPSSGEVTADPQAAKELIVGDALAPTPALTSGGYDTIALVIEEDTPPSFLAPGSLTVAVDSTTNTYSFTFDPVAVPELSAKSFDDPDGQIDFQVDDEAYGHEYVATFSEDGVLVSVEGEGRSASLYSHIFDEAMFTTSVGQSYVSLGQWSWPHTVTDANGVLWTGDWVGGSLLYVYGDRTAPGDIPTLGTATYRVASATDILATVPINTAGGIKDFGNPGPFNLDIAMTADFGAQSIAAAVEYDILSDDVEAYHYDLSGHAPISELGDFDIALSGSRLAGSFSEGMFASGSELATASPDGQLVGAFFGPNADQIGGTMAIPGSRDYNMIGVAFVATQP

SEQ ID NO: 8884 - protein, 322 aa, Halomonas boliviensis LC1
MSEVKNLLVLPRLRVQNANAISSPMTWGFPAMSAFVGLMHALERKLYAAGINVSLSNVGVICHDFDAQATEGGYIRGFHLTRNPVDKTGGTAAIVEEGRIHLDITVVFTIDSAAAESEHEHIAEKIGEIVAGMRIAGGSVIPNRAVPSHKQRPQWVTLDDDEERRESKFARLKRRWLPGFALTLRDDYLTEHHQTLQQQNPEASLLDAWLDLSRLNHYCALENKGESNEKPVWQVQRPYRGWLVPIPVGYGAISDLFNPGEVANARDNKTQFRFVESLYSIGEWVSPHRMKQPEDLLWYVENDEEAGLYRLNNDYHLRASAQ

SEQ ID NO: 8885 - protein, 686 aa, Halomonas sp. GFAJ-1
MSLSTLLELDEPNRSEAIRKAFAPYTQPLEVSEDVNAAILVLLNLSHKRQDAPDLLNKKRAIETLKDWQYIESCAQEVQWLHSHNLKHPDTRVAHQRLLVKAEKPSDSIVSSYNSVSRLGWSHNSAAVNKAKLFGANFIFKGVVYCLAAIFLDNNKQWRKEFMNLGMSDGQWTYLQSLFDNYFTKNLSPSYVERHSVQVTFLYQGKDVSITPVTSHSLLADIQIARRNKCGDFATIKHWHSSSVGDLASSLGGNISALSYPPRLLACSQNKENENSSGVFFVDFHHSSLRSKSFILACTEIVESKSLLTGKKRRDHRRSAIKLLRQSLSEWLSPVSYWRNVGGEALSERQNNSACLLISAPDEDLLEILPEINKELHSILVRYPQTQSFAYHPELLIPFKAQLKSLLIGMKIKEDEAMAEEPYYYLHLKNLHVFDAQALSCPYLVGLPSLLAVWGTVYNYQLRLRSILKRNIAFEGVAWFLRQYESSSGAKIPAPYLAPTKPGEAPKRPGLIDMRFCDLRMDLVIRYRLEDGHDTPLGNDELPMLQSALPGRFAGGTMQPPPLYEALQWCQLHGDANSLLAAISLLPDEGRWVVDSEKQVQSIDSLVAWLSKHPHHLPAMSGYQLFEEPCYRSGSHRELHAYAEPLVGLTETLSPASVRLNGKADFLKNAFWRLKSQNLTMLMKKA

SEQ ID NO: 8886 - protein, 179 aa, Anaeroglobus geminatus F0357
MKKYILISELAIHNANAMSSTITIGVPAMTAWLGAVHALERKINKSYKFEGVQFPCTTVSYLKTDLQVYKGHGDYANSIIGTANPLDDKGKRASFIEEPRIHLKVSLLIETEGLAGDCEDKFIEIFSKELYKSKFAGGDVMDFERVRLVYSNGDVHDTRKIVSMLMPGFVVVERKFRFR

SEQ ID NO: 8887 - protein, 99 aa, Anaeroglobus geminatus F0357
MLNYLAVYNTKEQHEGNAEWIKSKKESGWLVPIAVGFKRISEIGKIKGQRDKSKNHCFVEPVVTIGEFKMAYRFESIDDMMWHYEYKENEKLYLCVNQQ

SEQ ID NO: 8888 - protein, 71 aa, Escherichia coli H397; identical to SEQ ID NO: 8774

SEQ ID NO: 8889 - protein, 213 aa, Escherichia coli H397; identical to SEQ ID NO: 8623

SEQ ID NO: 8890 - protein, 307 aa, Escherichia coli SCI-07; identical to SEQ ID NO: 8753

SEQ ID NO: 8891 - protein, 282 aa, Thiorhodovibrio sp. 970
MTYLLLPNLDVLHANASACFGLISPAPVFAATQLAHALGRRIDCKITGTGIIHHSAQMLGEGPGTKGFFDFKPQQRRGATFINKSDYSSSNKTALSSQPTASLHLRVSLLLEVQGQVDLPEVERFLQRGRLAGGTIIRHGRISQKAPGDDPLSGLPAGPRYWLIERRDLMEREPDPLDALLKALALEASSAQSTASDTLPHRGMPVSWLTPAVLGYAALTEFQERQGVRMLDDDACTLPLHAFVEPMIGLTQYVSVRQYQNGLIPLWRPKWIQSDILTVSQI

SEQ ID NO: 8892 - protein, 291 aa, Methylomicrobium album BG8
MNRFLIVPQLKIHNANALSSPYTLGFPAMTAWFGGIHALQRQLNAGAFAGLRFTRAAVACHRIDQQTYKGSGDFVHSIIGTGNPLDKTGERPSFIEEARCHLTVSLAIECQGVGQGDIAEFTQAVESRLYRLKLAGGDILSFKTPETLTIDGDNELARLTRKLMPSYVLQERRELMTEAMRNGQDAIDALLSYLKVEHRSRPLGNGKGEWTAKRKAEGWLVPIATGFHGITELGFAENQRDPDTPHRFAESLVTLGEFVMPYRIKRLDDLLWHTRYDAENNLYLCQQNNRI

SEQ ID NO: 8893 - protein, 327 aa, Pseudomonas aeruginosa PADK2_CF510; identical to SEQ ID NO: 8627

SEQ ID NO: 8894 - protein, 282 aa, Burkholderia sp. Ch1-1
MQNPAIGNVADTTASDFAELPATASHGPLRIEYRWVNEAAGNAPIAVFLHEGLGSIAMWRDWPQALCERLGMRGLVYSRPGYGLSTPRPHDVKWPTDFMTTQARDILPALLDALGIDMRERRRMWVIGHSDGGSITLLYAALHPEELAGAVAIAPHVFVEDISVESIAQTRQLYETTDLRNKLSRYHADVDSAFYGWNDIWLNPAFRQWSIAGELASIRKPLLAVQGHDDNYGTMAQIDTIAVHVSHAQLVKLDACGHSPHRDAPRPLNEAIAAFVLKDGVA

SEQ ID NO: 8895 - protein, 310 aa, gamma proteobacterium BDW918
MSQISHYLLLDRIKVEKANAISSPLTYGFPAISGIMGAVHALNRKIVDAGFSVDLSGVLIACHAIHVHSYRPHRYADYSFNQSRNPIKKDGSTAAIIEEGKADLTFSLVIEVSASRSVARDIDDNQEKLEKQCKEWVLQQRMVGGSVHAVKQVRLLDGSEEKEIIKHLLPGFVLMQATQELLEITRELQQAKPEATALDALIEVSTLHHEPVETKVNKNGWQTRSVKTGKGWLVPIPVGFQSIAPQFAPGELANCRTNQYPSQYVESIYSLGKWVFPYRLPKQFSNSFWRYKQSNNLFLFSQSIQNQQGE

SEQ ID NO: 8896 - protein, 303 aa, Cellvibrio sp. BR
MSDLKRLLIIPRVQVQNANALSSPFTIGFPAMTAWLGAVHVLQRNLQQAGFKSLKLESVGVVSHQFDLQTHRHNGDYVTSIIGTGNPLDKDGNRPSFIEEARAHLTASLVIEYTGLDADDKDNTLIQITQLMHGKLKIAGGDILAFGKPYFTNAENSADTQKVLRKLMPGYVLLERRELIQAAMQTGQDALDALIDYLAIHHSCTQENEKVEWKSGRKEKGWLVPIAVGFQGVSPIGQALNQRDADTPHRFAEALVTLGEFKMAHHIDDIESILWRYQTDLDKNLYFCQPRKIEASDDLSAYF

SEQ ID NO: 8897 - protein, 307 aa, Escherichia coli KD1; identical to SEQ ID NO: 8753

SEQ ID NO: 8898 - protein, 320 aa, Rhodanobacter sp. 115
MSCPTYTHIVVLPHLKVHNANAVSSPLTHGFPSITAFLGLMWALERKTRAMGLDLEFSAVGVVCHDHEEQTTDGGFVKSFRLTRNPVGKDGGTAAIVEEGRIHLELSLLLAVNAVNWDAEARQRDTQIISELLQGMRVAGGTLVPSVQAHGSRHRPWIVDFTDDEHNDFQRLCTRLLPGSTLVARDDLIDKRLAKLQESHPGTTRLDAWLSLSRFNWQYDATAEGGKGAWQHDHPKGSGWIVPMPVGYGALGELHAAGSVPNTRDTTTPFRFVESLYSVGEWIGPHRLHAPNDLLWYADSQPDEGLYRCRNDYRATTDTL

SEQ ID NO: 8899 - protein, 84 aa, Shigella flexneri K-1770; identical to SEQ ID NO: 8868

SEQ ID NO: 8900 - protein, 316 aa, Yersinia pestis PY-01; identical to SEQ ID NO: 53

SEQ ID NO: 8901 - protein, 316 aa, Yersinia pestis PY-02; identical to SEQ ID NO: 53

SEQ ID NO: 8902 - protein, 316 aa, Yersinia pestis PY-03; identical to SEQ ID NO: 53

SEQ ID NO: 8903 - protein, 316 aa, Yersinia pestis PY-04; identical to SEQ ID NO: 53

SEQ ID NO: 8904 - protein, 316 aa, Yersinia pestis PY-05; identical to SEQ ID NO: 53

SEQ ID NO: 8905 - protein, 316 aa, Yersinia pestis PY-06; identical to SEQ ID NO: 53

SEQ ID NO: 8906 - protein, 316 aa, Yersinia pestis PY-07; identical to SEQ ID NO: 53

SEQ ID NO: 8907 - protein, 316 aa, Yersinia pestis PY-08; identical to SEQ ID NO: 53

SEQ ID NO: 8908 - protein, 316 aa, Yersinia pestis PY-09; identical to SEQ ID NO: 53

SEQ ID NO: 8909 - protein, 316 aa, Yersinia pestis PY-10; identical to SEQ ID NO: 53

SEQ ID NO: 8910 - protein, 316 aa, Yersinia pestis PY-11; identical to SEQ ID NO: 53

SEQ ID NO: 8911 - protein, 316 aa, Yersinia pestis PY-12; identical to SEQ ID NO: 53

SEQ ID NO: 8912 - protein, 316 aa, Yersinia pestis PY-13; identical to SEQ ID NO: 53

SEQ ID NO: 8913 - protein, 316 aa, Yersinia pestis PY-15; identical to SEQ ID NO: 53

SEQ ID NO: 8914 - protein, 316 aa, Yersinia pestis PY-14; identical to SEQ ID NO: 53

SEQ ID NO: 8915 - protein, 316 aa, Yersinia pestis PY-16; identical to SEQ ID NO: 53

SEQ ID NO: 8916 - protein, 316 aa, Yersinia pestis PY-19; identical to SEQ ID NO: 53

SEQ ID NO: 8917 - protein, 316 aa, Yersinia pestis PY-25; identical to SEQ ID NO: 53

SEQ ID NO: 8918 - protein, 316 aa, Yersinia pestis PY-29; identical to SEQ ID NO: 53

SEQ ID NO: 8919 - protein, 316 aa, Yersinia pestis PY-34; identical to SEQ ID NO: 53

SEQ ID NO: 8920 - protein, 316 aa, Yersinia pestis PY-32; identical to SEQ ID NO: 53

SEQ ID NO: 8921 - protein, 316 aa, Yersinia pestis PY-36; identical to SEQ ID NO: 53

SEQ ID NO: 8922 - protein, 316 aa, Yersinia pestis PY-42; identical to SEQ ID NO: 53

SEQ ID NO: 8923 - protein, 316 aa, Yersinia pestis PY-45; identical to SEQ ID NO: 53

SEQ ID NO: 8924 - protein, 316 aa, Yersinia pestis PY-46; identical to SEQ ID NO: 53

SEQ ID NO: 8925 - protein, 316 aa, Yersinia pestis PY-47; identical to SEQ ID NO: 53

SEQ ID NO: 8926 - protein, 316 aa, Yersinia pestis PY-48; identical to SEQ ID NO: 53

SEQ ID NO: 8927 - protein, 316 aa, Yersinia pestis PY-52; identical to SEQ ID NO: 53

SEQ ID NO: 8928 - protein, 316 aa, Yersinia pestis PY-53; identical to SEQ ID NO: 53

SEQ ID NO: 8929 - protein, 316 aa, Yersinia pestis PY-54; identical to SEQ ID NO: 53

SEQ ID NO: 8930 - protein, 316 aa, Yersinia pestis PY-55; identical to SEQ ID NO: 53

SEQ ID NO: 8931 - protein, 316 aa, Yersinia pestis PY-56; identical to SEQ ID NO: 53

SEQ ID NO: 8932 - protein, 316 aa, Yersinia pestis PY-58; identical to SEQ ID NO: 53

SEQ ID NO: 8933 - protein, 316 aa, Yersinia pestis PY-60; identical to SEQ ID NO: 53

SEQ ID NO: 8934 - protein, 316 aa, Yersinia pestis PY-59; identical to SEQ ID NO: 53

SEQ ID NO: 8935 - protein, 316 aa, Yersinia pestis PY-61; identical to SEQ ID NO: 53

SEQ ID NO: 8936 - protein, 316 aa, Yersinia pestis PY-63; identical to SEQ ID NO: 53

SEQ ID NO: 8937 - protein, 316 aa, Yersinia pestis PY-64; identical to SEQ ID NO: 53

SEQ ID NO: 8938 - protein, 316 aa, Yersinia pestis PY-65; identical to SEQ ID NO: 53

SEQ ID NO: 8939 - protein, 316 aa, Yersinia pestis PY-66; identical to SEQ ID NO: 53

SEQ ID NO: 8940 - protein, 316 aa, Yersinia pestis PY-71; identical to SEQ ID NO: 53

SEQ ID NO: 8941 - protein, 316 aa, Yersinia pestis PY-72; identical to SEQ ID NO: 53

SEQ ID NO: 8942 - protein, 316 aa, Yersinia pestis PY-76; identical to SEQ ID NO: 53

SEQ ID NO: 8943 - protein, 316 aa, Yersinia pestis PY-88; identical to SEQ ID NO: 53

SEQ ID NO: 8944 - protein, 316 aa, Yersinia pestis PY-89; identical to SEQ ID NO: 53

SEQ ID NO: 8945 - protein, 316 aa, Yersinia pestis PY-90; identical to SEQ ID NO: 53

SEQ ID NO: 8946 - protein, 316 aa, Yersinia pestis PY-91; identical to SEQ ID NO: 53

SEQ ID NO: 8947 - protein, 316 aa, Yersinia pestis PY-93; identical to SEQ ID NO: 53

SEQ ID NO: 8948 - protein, 316 aa, Yersinia pestis PY-92; identical to SEQ ID NO: 53

SEQ ID NO: 8949 - protein, 316 aa, Yersinia pestis PY-94; identical to SEQ ID NO: 53

SEQ ID NO: 8950 - protein, 316 aa, Yersinia pestis PY-95; identical to SEQ ID NO: 53

SEQ ID NO: 8951 - protein, 316 aa, Yersinia pestis PY-96; identical to SEQ ID NO: 53

SEQ ID NO: 8952 - protein, 316 aa, Yersinia pestis PY-98; identical to SEQ ID NO: 53

SEQ ID NO: 8953 - protein, 316 aa, Yersinia pestis PY-99; identical to SEQ ID NO: 53

SEQ ID NO: 8954 - protein, 316 aa, Yersinia pestis PY-100; identical to SEQ ID NO: 53

SEQ ID NO: 8955 - protein, 316 aa, Yersinia pestis PY-101; identical to SEQ ID NO: 53

SEQ ID NO: 8956 - protein, 316 aa, Yersinia pestis PY-102; identical to SEQ ID NO: 53

SEQ ID NO: 8957 - protein, 316 aa, Yersinia pestis PY-103; identical to SEQ ID NO: 53

SEQ ID NO: 8958 - protein, 316 aa, Yersinia pestis PY-113; identical to SEQ ID NO: 53

SEQ ID NO: 8959 - protein, 294 aa, Acinetobacter baumannii OIFC143; identical to SEQ ID NO: 8773

SEQ ID NO: 8960 - protein, 640 aa, Vibrio cholerae HE-45
MQTLKELIASNPDDLTTELKRAFRPLTPHIAIDGNELDALTILVNLTDKTDDQKDLLDRAKCKQKLRDEKWWASCINCVNYRQSHNPKFPDIRSEGVIRTQALGELPSFLLSSSKIPPYHWSYSHDSKYVNKSAFLTNEFCWDGEISCLGELLKDADHPLWNTLKKLGCSQKTCKAMAKQLADITLTTINVTLAPNYLTQISLPDSDTSYISLSPVASLSMQSHFHQRLQDENRHSAITRFSRTTNMGVTAMTCGGAFRMLKSGAKFSSPPHHRLNSKRSWLTSEHVQSLKQYQRLNKSLIPENSRIALRRKYKIELQNMVRSWFAMQDHTLDSNILIQHLNHDLSYLGATKRFAYDPAMTKLFTELLKRELSNSINNGEQHTNGSFLVLPNIRVCGATALSSPVTVGIPSLTAFFGFVHAFERNINRTTSSFRVESFAICVHQLHVEKRGLTAEFVEKGDGTISAPATRDDWQCDVVFSLILNTNFAQHIDQDTLVTSLPKRLARGSAKIAIDDFKHINSFSTLETAIESLPIEAGRWLSLYAQSNNNLSDLLAAMTEDHQLMASCVGYHLLEEPKDKPNSLRGYKHAIAECIIGLINSITFSSETDPNTIFWSLKNYQNYLVVQPRSINDETTDKSSL

SEQ ID NO: 8961 - protein, 329 aa, Alishewanella aestuarii B11
MSNYILLEHIKVQNANCIAGFTYGFPAITHFLGYTHALSRKLQQQFGIELTGCAVVCHQHQVQAYQPGGWGDYVFALTRNPLTKEGNTAPIVEEGRMHLTVSLILESSKAFSGAQQQQLVETLTVLAQRQKLAGGQVSCLKGVSLYSDDDEQALSRKLLRKVLPGFVLTDRSELLKQHYQQLISTQPNATMLDAWLDFAALTYQAVTTEDADSPTEQHAVEWVRVPKPDKGYLVPITTGYKAISALYPAGAVANSRDPQYPFCFVESAYGVGQWLSPHRVPDLRDVIWRYRQQGPWYLCTTNTAQNTLKLHPEQEAALVELTETELTYF

SEQ ID NO: 8962 - protein, 295 aa, Rhizobium sp. CF142
MDFDASQGDRKYPTSKQVGGLVECSGLQVELRHFDPGWQVDLTLECTEIAVLLSGQSKIRWTGDGHRREAIARPGVAWICPAGVNESGVEIVGTMPESLHIFLPPSLVGESALSNFDIDPAKVQLAYAGGVPDPVVLQIGELFRSVLNRKLEATDRLFLDGIQLALAAHLLGTYSSARWRPPTRTPAIDPKRLRRVLDFIEARIAVEISLEDLAAEACLSPFHFSRVFRAATGFAPHRYVTQRRIEAAKEKLRLAQSSLVEIAIDTGFGSQANFTRVFRKMTGLTPGQYRTLFTS

SEQ ID NO: 8963 - protein, 347 aa, Pseudomonas sp. GM48
MKSRIWRLAGVGLLCASVAAQTLADEQQNRGHDGGQHGQDGRQGNNQGHGGNNQPPPQNNQQQNQPRAQNDGNRHDEHDGQNQHQNNGQWQNRPAPDFNSRVRSPPPPPQLPATDMPIQPRPDTVRQTQQPQRGYYQDQPRRNNYNQHWSGYTNAPSYDNHWQGRSSGYGNGWGPGPRYRPGQVIDRFPERNFRVPYRGMDYYYSGGYWYRPLGPRYEVVQPPRGIRVRYLPDYAQQVWIGGALLFLAAGSYYAYEESTQDYVVVEPPVGQSQPPAGSNGYDVEAYPANGQSPEQVSRDGYECYQYAVQQSGFDPRTATYQPDPSVVQAYRQAQGNCLSSRGYQVNY

SEQ ID NO: 8964 - protein, 353 aa, Pseudomonas sp. GM55
MKARIWRLAGVGLLCVSVTAQTMADEPQNHGRDGGQHGQDGHQDGHQGGNQGHGDNNQPPPQNGQPQNQPRAQNNDSRQFEHNGQHQHQNNAQWQNRPVPDFNSPVRSPPPPPQLPANDFPIQPRPDTVRQTQQPQRGYYQDQPHRNDYNQRWGGYMGAPTNYNNWQGHPEGRGNGWGPGPRYRPGQVIDRFPERNYRVPYRGMDYYYSAGYWYRPLGPRYEVVQPPRGIRVRYLPDYAQQVWIAGTLFFLAAGSYYAYQESTQDYEVVEPPFGQAQSQPTAASNSYDVEAYPANGQSPEQVNRDGYECYQYAVQQSGFDPRTATYQPDPSVVQTYRQAQGNCLSSRGYQVNY

SEQ ID NO: 8965 - protein, 348 aa, Pseudomonas sp. GM49
MKSRIWRLAGVGLLCASVAAQTLADEQQNRGHDGGQHGQDGRQGNNQGHGGNNQPPQNSQQQNQPRAQNNDNRHDEHNGQNQHQNNGQWQNRPAPDFNSRVRSPPPPPQLPATDMPIQPRPDTVHQTQQPQRGYYQDQPRRNNYNQHWSGYTNAPSYDNHWQGRSSGYGNGWGPGPRYRPGQVIDRFPERNFRVPYRGMDYYYSGGYWYRPLGPRYEVVEPPRGIRVRYLPDYAQQVWIGGVLLFLAAGSYYAYQESTQDYVVVEPPVGQPQSQPPAAGNGYDVEAYPANGQSPEQVSRDGYECYQDAVQQSGFDPRTATYQPDPSVVQAYRQAQGNCLSSRGYQVNY

SEQ ID NO: 8966 - protein, 294 aa, Acinetobacter baumannii Canada BC-5; identical to SEQ ID NO: 8656

SEQ ID NO: 8967 - protein, 294 aa, Acinetobacter baumannii Naval-18; identical to SEQ ID NO: 8773

SEQ ID NO: 8968 - protein, 327 aa, Pasteurella multocida subsp. multocida str. P52VAC
MFQTGFYILFDHIKVQSANAISGPLSYGFPALTGLTGAMHALNRKLTHHPVQFGGVMVACHDYELQTYQNSAFSDRTFKQTRNPIKRNGETASIIEEGKIHLDLSLVVEVHVQDEHVFEALTDKTSQASQDFLQTCKNLLWQQRIAGGSVLEIGNVQLFNLEEDQDIPLALMPAFVLMDAKQELVNITEELKTGLRIGQLDEEGNVQKSPVPSCPDATALDALLEMATVHHIPEHANATASAWQTYSVKKGRGWLVPLPVGYQAISPLFAPGQLQHCRTQQYPSQYVETLYSLGKWVFPLSLPENLSQCFWRYTALQNNLYLISQGE

SEQ ID NO: 8969 - protein, 119 aa, Pasteurella multocida subsp. multocida str. Anand1_cattle
TCKNLLWQQRIAGGSVLEIGNVQLFNLEEDQDIPLALMPAFVLMDAKQELVNITEELKTGLRIGQLDEEGNVQKSPVPSCPDATALDALLEMATVHHIPEHANATASAWQTYSVKKGRG

SEQ ID NO: 8970 - protein, 310 aa, Pectobacterium wasabiae CFBP 3304
MSTLIILRRIQVENANAIAGLTYGFPAITHFLGFTHALSRKLQASHGLTLEGCGVVSHQHQLHAYGSSWERSFALTRNPLTKEAKTAAFNEEGRMHMTVSLLIRCEGQIPADTKALCEHLKQQAQCQRLAGGTVIDIERVSVQSLPVDEAENRGVMRRLLPGFVLRDRTSLLHRHFQTLQQTNPQAEMIDAWLDFAALKMQAERDPRDNAVQWKYLPKPGDGGFLTPLMIGYRAISPLYAPGEVDKTRDPHTPFCFAEAAYGIGEWQGAHRISDIRQILWEYDHQNGDYHCRQLADTDSAAEDTSYEFDY

SEQ ID NO: 8971 - protein, 334 aa, Mycolicibacterium fortuitum subsp. fortuitum DSM 46621 = ATCC 6841
MRKQTSGSVHRHRLTVAVFAVAVLAFAPACAAGHSPDSSAPAAPQSDAGFAPAAPAPAPESGPGHKQAPAPADVKRDIVKTASMSITTGNPVAVADKAVALATDAGGRVDSRSEDAGSSSGRAHIALALRVPAAELEGTLDEFKKLGTVQTVEVRADDVTSQRVDLDARIKALQTSVDRLLGIMRDARDPDALIKAEDALSQRQAELDSLRAQRTQLGDQIDYSTVNLDITAEQIGGPAPQYQGFWGQVERGWHGLVSAASGFVMLFGLLLPWLAVFALAAVIIVAAVRLARSRRGPGSAAGQAGRQDGQLQGQGSATDEDQDGESDPVARPGP

SEQ ID NO: 8972 - protein, 327 aa, Pasteurella multocida subsp. gallicida X73
MFQTDFYILFDHIKVQSANAISGPLSYGFPALTGLTGAMHALNRKLTHHPVQFGGVMVACHDYELQTYQNSAFSDRTFKQTRNPIKRNGETASIIEEGKIHLDLSLVVKVHVQDDRVFEALTDKTSQASQDFLQTCKNLLWQQRIAGGSVLEIGNVQLFNLEEDQDIPLALMPAFVLMDAKQELTNITEELKTGLRIGQLDEEGNVQKSCLPSCPDATALDALLEMATVHHIPEHANATASAWQTYSVKKGRGWLVPLPVGYQAISPLFEPGQLQHCRTQQYPSQYVETLYSLGKWVFPLSLPENLSQCFWRYTALQNNLYLISQGE

SEQ ID NO: 8973 - protein, 330 aa, Pasteurella multocida subsp. gallicida P1059
MFSTDYYILFDRIKIQGANTISGPLSYGFPALTGILGAMHALSRKLSYRNVLLGGVMVACHNYEVQAYRENNNDDFKFTLNRHPMQKKNGEWSAPPIIEEGKINLELSLLVELHVPDDELFSTLEDEKNQDCQDFLQTCKNLLWQQRIASGSVLDIGHVKLFGLHEAKEIPFALMPAFVLMDAKQDLINITEELQTGFRANGKIEDSELQKSDIEMSKSANELDALLEVASLHHISDDSSGSEKVCKTYSVKQGRGWLVPIPVGYQAISPMFGQGQLRNSRTPQYPSQYVETIYSLGKWVFPLSLPEELSQCFWRYNAPQNNLYLISQGE

SEQ ID NO: 8974 - protein, 327 aa, Pseudomonas aeruginosa CI27; identical to SEQ ID NO: 8627

SEQ ID NO: 8975 - protein, 327 aa, Pseudomonas aeruginosa E2; identical to SEQ ID NO: 8627

SEQ ID NO: 8976 - protein, 294 aa, Acinetobacter baumannii IS-58; identical to SEQ ID NO: 8656

SEQ ID NO: 8977 - protein, 334 aa, bacterium
MSDISALILLPRLKVQNANAISGPLTWGFPSPTAFIGFVHAMERKFASELNEGFAGVGIICHHFEPQVSSPSRSHIPHVFSLTRNPVGKDGGTMALVEEGRAHMEVSLVIAVKDYKEKSKGDYLAEDLHHAAQGMRLAGGSLLHQEGKRYQAQWWPLAGDAEGDAAVFRKLRRRLLPGFALVQRDDLLASHLAELRQTRPESNALDALLDLSRLNIEPVVSQSNDVETVKWEVRRKPGWLVPLPIGYAGISPLYAPGEVENARDSTTPFRFVESLYSLGQWISPHRLDGLNQLLWTQEWTQKSDADQGIYRCINRYAESLPASLSESFAHSQEQ

SEQ ID NO: 8978 - protein, 297 aa, Moraxella catarrhalis RH4; identical to SEQ ID NO: 8671

SEQ ID NO: 8979 - protein, 295 aa, Vibrio cholerae HC-50A1; identical to SEQ ID NO: 8873

SEQ ID NO: 8980 - protein, 295 aa, Vibrio cholerae HC-52A1; identical to SEQ ID NO: 8873

SEQ ID NO: 8981 - protein, 295 aa, Vibrio cholerae HC-56A1; identical to SEQ ID NO: 8873

SEQ ID NO: 8982 - protein, 295 aa, Vibrio cholerae HC-55A1; identical to SEQ ID NO: 8873

SEQ ID NO: 8983 - protein, 295 aa, Vibrio cholerae HC-57A1; identical to SEQ ID NO: 8873

SEQ ID NO: 8984 - protein, 295 aa, Vibrio cholerae HC-51A1; identical to SEQ ID NO: 8873

SEQ ID NO: 8985 - protein, 294 aa, Acinetobacter baumannii IS-235; identical to SEQ ID NO: 8656

SEQ ID NO: 8986 - protein, 294 aa, Acinetobacter baumannii IS-251; identical to SEQ ID NO: 8656

SEQ ID NO: 8987 - protein, 295 aa, Vibrio cholerae HC-1A2; identical to SEQ ID NO: 8873

SEQ ID NO: 8988 - protein, 295 aa, Vibrio cholerae HC-55C2; identical to SEQ ID NO: 8873

SEQ ID NO: 8989 - protein, 295 aa, Vibrio cholerae HC-60A1; identical to SEQ ID NO: 8873

SEQ ID NO: 8990 - protein, 295 aa, Vibrio cholerae HC-59A1; identical to SEQ ID NO: 8873

SEQ ID NO: 8991 - protein, 292 aa, Vibrio cholerae HC-61A2
MILPHLKIHNANALSSPFTVGFPAMTAWLGFVHALERKLSQAGLSDLMLHSAAVVSHRCDVQTHKGEGDFVHSIIGTANPLDKDGSRSAFIEEARCHLDVSLVIEWSGNEEQVQQPEFTEQLQAVIATMKVAGGDVLAVGKPSVKSVITEDDTGRVLRQLMPGYVLIERRDLMIDAMQQGDDAIDALLGYLTVHHHCEQLEDQSVVWHSQRKTSGWIVPIATGFQGISPLGEAKNQRDPSVPHRFAESVVTLGEFVMVHKIKHLDDILWQYHPDLENDLYLCQKVNAINEHQ

SEQ ID NO: 8992 - protein, 294 aa, Acinetobacter baumannii OIFC074; identical to SEQ ID NO: 8656

SEQ ID NO: 8993 - protein, 294 aa, Acinetobacter baumannii Naval-83; identical to SEQ ID NO: 8656

SEQ ID NO: 8994 - protein, 295 aa, Vibrio cholerae HC-02C1; identical to SEQ ID NO: 8873

SEQ ID NO: 8995 - protein, 295 aa, Vibrio cholerae HC-55B2; identical to SEQ ID NO: 8873

SEQ ID NO: 8996 - protein, 295 aa, Vibrio cholerae HC-59B1; identical to SEQ ID NO: 8873

SEQ ID NO: 8997 - protein, 294 aa, Acinetobacter baumannii Naval-21; identical to SEQ ID NO: 8656

SEQ ID NO: 8998 - protein, 294 aa, Acinetobacter baumannii Canada BC1; identical to SEQ ID NO: 8656

SEQ ID NO: 8999 - protein, 316 aa, Yersinia pestis INS; identical to SEQ ID NO: 53

SEQ ID NO: 9000 - protein, 321 aa, Providencia burhodogranariea DSM 19968
MNPTHFIKLSHLKVQNANALSSPFTIGFPAMTAWLGFMHALERKLKYQLKADDLDSLEFASVAVISHECNLQTYKGPGDFVSSIIGTGNPLDKEGNRSAFIEEARCHLDVSLLIEYSVAAKDEDGDTDLPEGHPIFSTLREIIPTMKLAGGDILSVDVPQRCTLPANELDGSSKRKLLNSMMPGYALIERRDLMIGAMEEGQDAMDALLDHVAVNNQCVEIETDSEQKKNQFEWKAQRKTSGWVVPIATGFQGISPLGEAKNQRDPDVPHRFAESVVTLGQFVMVNKIGHPEEMLWKHHYDLENNLYLCQQVESKYFTSGE

SEQ ID NO: 9001 - protein, 294 aa, Acinetobacter sp. WC-323
MSRYVVIPRMRVQNANMQSNGLLLGGVPLFAANMFAHHLARQLGTQEQGIIYIHHDQQRLGGQAYGRFTPAQRRGAVFIGKKDYSSKNKYALSLQPTASCHLEFSLVIKFSSSRISPEKLTNILKRSRFAGGQIIEFLDISTHAENELEAALKKIKTGFAILDRQDLLVEYQQRKQINRVQAFTQLLALKADALRAFFNDPNLSWISATNLGYALLEPLTDQRAGIRQAQDQETTAHAYAEPLTGIVQYFSLGEILRKNTEAEDDTWHNLQKLLWAYHWPQDDIFLLKQNCVNA

SEQ ID NO: 9002 - protein, 375 aa, Theileria equi strain WA
MFGNGMMARNIFILGYGINGALEAFICFSAAGVVSKLFLNSTYSLIYTGFPAGSIFLGTTQTILNRVVGTSTISQMRKNLVLCHGCQALISTIAAIWATLLYIKYGHLVKEDDKKDEGEENKTEDEKKSESENKKLSVGQKFSQTIESFKYARFYYSRLILVVCAYFLRYFFFPCLIPFVLDIPHHTKLICSLSLILSEFISKLNTVGVNEAINPSEKEPSQSHAMFLLMRDAYLHFTIIICITSSSFVLWSSLTGRYHFSKSPIFIFCFIITMGISYGYLSTRSINGCKPVLDYYTKQLDKDGKPMVEEKVANGPGVSDVATLTINVALMFISAFANVTEEFILKYKGSRSYISNNKGDLSIETVNALLMQFKS

SEQ ID NO: 9003 - protein, 319 aa, Aggregatibacter actinomycetemcomitans Y4; identical to SEQ ID NO: 8710

SEQ ID NO: 9004 - protein, 71 aa, Escherichia coli KTE4; identical to SEQ ID NO: 8774

SEQ ID NO: 9005 - protein, 213 aa, Escherichia coli KTE4; identical to SEQ ID NO: 8623

SEQ ID NO: 9006 - protein, 213 aa, Escherichia coli KTE4; identical to SEQ ID NO: 8623

SEQ ID NO: 9007 - protein, 71 aa, Escherichia coli KTE5; identical to SEQ ID NO: 8774

SEQ ID NO: 9008 - protein, 213 aa, Escherichia coli KTE5; identical to SEQ ID NO: 8623

SEQ ID NO: 9009 - protein, 307 aa, Escherichia sp. KTE11
MSYLLLLPHVRIENANAVSGLTWGFPSMTHFLGYVHALSRKVVDEFGVSFDGCAVVSHEQHIQAYSSGRDFQFALTRNPLTREGKTASFNEEGRMHLTVSLLIECNGEITNGEYGRKALCDYLKMLCQSHKLAGGSIVDMREPQLFHAPEDEKQLRKIIWRLMPGYALYDRSEWLAEHHQQHPDISLLDAWLDFATIKYQAESPAEDNSAKWIYQPKPMTGFLVPLMCGYQRISPVYAPGEVENARDIVTPFAFAEAVYGIGEWRGLHRITDLQPLMWRYRTTDTGYYCSAIPLVDDPTTNEDDDSE

SEQ ID NO: 9010 - protein, 307 aa, Escherichia coli KTE16; identical to SEQ ID NO: 8828

SEQ ID NO: 9011 - protein, 307 aa, Escherichia coli KTE15; identical to SEQ ID NO: 8828

SEQ ID NO: 9012 - protein, 307 aa, Escherichia coli KTE224; identical to SEQ ID NO: 8828

SEQ ID NO: 9013 - protein, 307 aa, Escherichia coli KTE47; identical to SEQ ID NO: 8753

SEQ ID NO: 9014 - protein, 71 aa, Escherichia coli KTE55; identical to SEQ ID NO: 8774

SEQ ID NO: 9015 - protein, 213 aa, Escherichia coli KTE55; identical to SEQ ID NO: 8623

SEQ ID NO: 9016 - protein, 71 aa, Escherichia coli KTE58; identical to SEQ ID NO: 8774

SEQ ID NO: 9017 - protein, 213 aa, Escherichia coli KTE58; identical to SEQ ID NO: 8623

SEQ ID NO: 9018 - protein, 71 aa, Escherichia coli KTE62; identical to SEQ ID NO: 8774

SEQ ID NO: 9019 - protein, 213 aa, Escherichia coli KTE62; identical to SEQ ID NO: 8623

SEQ ID NO: 9020 - protein, 307 aa, Escherichia coli KTE72; identical to SEQ ID NO: 8828

SEQ ID NO: 9021 - protein, 307 aa, Escherichia coli KTE86; identical to SEQ ID NO: 8828

SEQ ID NO: 9022 - protein, 307 aa, Escherichia coli KTE93; identical to SEQ ID NO: 8828

SEQ ID NO: 9023 - protein, 307 aa, Escherichia coli KTE169; identical to SEQ ID NO: 8828

SEQ ID NO: 9024 - protein, 307 aa, Escherichia coli KTE45; identical to SEQ ID NO: 8676

SEQ ID NO: 9025 - protein, 307 aa, Escherichia coli KTE43; identical to SEQ ID NO: 8828

SEQ ID NO: 9026 - protein, 71 aa, Escherichia coli KTE22; identical to SEQ ID NO: 8774

SEQ ID NO: 9027 - protein, 213 aa, Escherichia coli KTE22; identical to SEQ ID NO: 8623

SEQ ID NO: 9028 - protein, 307 aa, Escherichia coli KTE46; identical to SEQ ID NO: 8676

SEQ ID NO: 9029 - protein, 71 aa, Escherichia coli KTE59; identical to SEQ ID NO: 8774

SEQ ID NO: 9030 - protein, 213 aa, Escherichia coli KTE59; identical to SEQ ID NO: 8623

SEQ ID NO: 9031 - protein, 71 aa, Escherichia coli KTE65; identical to SEQ ID NO: 8774

SEQ ID NO: 9032 - protein, 213 aa, Escherichia coli KTE65; identical to SEQ ID NO: 8623

SEQ ID NO: 9033 - protein, 71 aa, Escherichia coli KTE118; identical to SEQ ID NO: 8774

SEQ ID NO: 9034 - protein, 213 aa, Escherichia coli KTE118; identical to SEQ ID NO: 8623

SEQ ID NO: 9035 - protein, 71 aa, Escherichia coli KTE123; identical to SEQ ID NO: 8774

SEQ ID NO: 9036 - protein, 213 aa, Escherichia coli KTE123; identical to SEQ ID NO: 8623

SEQ ID NO: 9037 - protein, 307 aa, Escherichia coli KTE194; identical to SEQ ID NO: 8828

SEQ ID NO: 9038 - protein, 307 aa, Escherichia coli KTE183; identical to SEQ ID NO: 8828

SEQ ID NO: 9039 - protein, 307 aa, Escherichia coli KTE207; identical to SEQ ID NO: 8828

SEQ ID NO: 9040 - protein, 307 aa, Escherichia coli KTE215; identical to SEQ ID NO: 8828

SEQ ID NO: 9041 - protein, 71 aa, Escherichia coli KTE227; identical to SEQ ID NO: 8774

SEQ ID NO: 9042 - protein, 213 aa, Escherichia coli KTE227; identical to SEQ ID NO: 8623

SEQ ID NO: 9043 - protein, 71 aa, Escherichia coli KTE229; identical to SEQ ID NO: 8774

SEQ ID NO: 9044 - protein, 213 aa, Escherichia coli KTE229; identical to SEQ ID NO: 8623

SEQ ID NO: 9045 - protein, 307 aa, Escherichia coli KTE113; identical to SEQ ID NO: 8828

SEQ ID NO: 9046 - protein, 307 aa, Escherichia coli KTE133; identical to SEQ ID NO: 8828

SEQ ID NO: 9047 - protein, 307 aa, Escherichia coli KTE145; identical to SEQ ID NO: 8828

SEQ ID NO: 9048 - protein, 307 aa, Escherichia coli KTE168; identical to SEQ ID NO: 8828

SEQ ID NO: 9049 - protein, 71 aa, Escherichia coli KTE176; identical to SEQ ID NO: 8774

SEQ ID NO: 9050 - protein, 213 aa, Escherichia coli KTE176; identical to SEQ ID NO: 8623

SEQ ID NO: 9051 - protein, 71 aa, Escherichia coli KTE179; identical to SEQ ID NO: 8774

SEQ ID NO: 9052 - protein, 213 aa, Escherichia coli KTE179; identical to SEQ ID NO: 8623

SEQ ID NO: 9053 - protein, 71 aa, Escherichia coli KTE180; identical to SEQ ID NO: 8774

SEQ ID NO: 9054 - protein, 213 aa, Escherichia coli KTE180; identical to SEQ ID NO: 8623

SEQ ID NO: 9055 - protein, 307 aa, Escherichia coli KTE88; identical to SEQ ID NO: 8828

SEQ ID NO: 9056 - protein, 295 aa, Vibrio cholerae HC-78A1; identical to SEQ ID NO: 8873

SEQ ID NO: 9057 - protein, 169 aa, Aggregatibacter actinomycetemcomitans serotype a str. A160
MSIEDVQLHYLEDEWKIKRQLLPGFVLMNAQAELIKITEELQQGLKQGDFVVLEANPDATAFDALIETAILHHIPNHPHAKTNEWQTYSIKQGRGWLVPIPVGYQAISPLFEAGQLQHCRTQDYPSQYVETLYSLGKWVSPLNLPEDLSRCFGVIPNLNNLYLISQGDQ

SEQ ID NO: 9058 - protein, 695 aa, Vibrio campbellii CAIM 519 = NBRC 15631
MTKLCDLLAIEDEAVKQVTLKKMFMPYTEDVCVEGFEKEALTILLNLSSSHQADRCSDWLDLARAKRHLKAAENLDASLDEIKWFHTHNLKFPDCRVKDQRIVAQALTTTEVFISSGVLEQRLGWAHNSAVYRHTLWLLNPFSWQSQSVCILSLIKQESSIWIELLKEFGLSAKSLARLKHTIEELLPDNHFPDSVSSYSKQLRFPWEDGYISVTPVVSHAIQSELEVRSRNRESKLSFVSSSLPNSASIGNLCGSLGGNMKALNYPLDIKPARGGTLPESRKKSGHYFDDYQVTNTKVCQVLNHLIGSEPSKTQKQRESDRKVRSKILRKQIALWMLPLIELRDIVDADPNQQQLEHDDTLAQAFLALPESDLSSLASEFNRHLHLTFQNNKYAAKFAYHPKLMQVVKAQIVWTLEQLSKPNGNEDKVTGEQYIYLSSMRVQDAVAMSSPYLCGAPSLAAIWGFMHHYQREFNKLVNCDSPFEFSSFSFYVRSENIQSTAKLTEPNSVAKARTVSNAKRPTIRSERLADLEIDLVIRVHSESRISDFKTALKTALPVAFAGGALYQPQLSTQIEWLRTFTSRSELFHVIKGLPAYGRWLYPSENQPSNFDELERLLTKGADNLPVSIGYHLLERPTKRRNSITDCHAYAENAIGLAKKVNPIEVRFSGRDHFFNHAFWSIECSSETILIKNYRD

SEQ ID NO: 9059 - protein, 294 aa, Acinetobacter baumannii Naval-57
MSRYVVIPRMRVQNANMQTNGVLLGGVPLFAANMFAHHLARQLGTQDEGIIYIHHDQQRLGGQAYGRFTPAQRRGAVFIGKKDYSSKNKYALSLQPTASCHLEFSLVIKFSSSRISPEKLTNILKRSRFAGGQIIEFLEITTHAENELETALKKIKTGFAILDRQDLLIEYQQRKQINRVQAFTQLLALKADALRTFFNDQNLSWISATNLGYALLEPLTDQRAGIRQAQDQETTAHAYAEPLTGIVQYFSLGEILRRNTEAEDDTWHNLQKLLWTYHWPQDDIFLLKQNCINA

(The sequence listing continues in the following parts.)

That which is claimed is:

1. A method for repressing expression of a first target gene in a bacterium or an archaeon, the method comprising introducing into the bacterium or the archaeon:

(a) a first nucleic acid sequence encoding at least three polypeptides of a Type I CASCADE, wherein the Type I CASCADE is a Type I-B CASCADE, a Type I-C CASCADE, a Type I-E CASCADE, a Type I-F CASCADE, a Type I-A CASCADE or a Type I-D CASCADE; and (b) a second nucleic acid sequence encoding at least one CRISPR array comprising two or more repeat sequences and at least one spacer sequence that is complementary to a first target sequence from the first target gene, wherein the at least one spacer sequence is increased in length by about 1 to about 100 nucleotides when compared to a normal spacer length, wherein:

the Type I-B CASCADE comprises a Cas6b polypeptide having at least 95% sequence identity to any one of the sequences of SEQ ID NOs:18-20 or 335-340, a Cas8b (Csh1) polypeptide having at least 95% sequence identity to any one of the sequence of SEQ ID NOs:21, 22, or 1043-1158, a Cas7 (Csh2) polypeptide having at least 95% sequence identity to any one of the sequences of SEQ ID NOs:23, 24, or 1159-1209, and a Cas5 polypeptide having at least 95% sequence identity to any one of the sequences of SEQ ID NOs:25, 26, or 1210-2372, the Type I-C CASCADE comprises a Cas5d polypeptide having at least 95% sequence identity to any one of the sequences of SEQ ID NOs:27, 28, or 2373-2973, a Cas8c (Csd1) polypeptide having at least 95% sequence identity to any one of the sequences of SEQ ID NOs:29, 30, or 2974-3847, and a Cas7 (Csd2) polypeptide having at least 95% sequence identity to any one of the sequences of SEQ ID NOs:31, 32, or 3848-4371, the Type I-E CASCADE comprises a Cse1 (CasA) polypeptide having at least 95% sequence identity to any one of the sequences of SEQ ID NOs:41, 42, or 5235-6111, a Cse2 (CasB) polypeptide having at least 95% sequence identity to any one of the sequences of SEQ ID NOs:43, 44, or 6112-6823, a Cas7 (CasC) polypeptide having at least 95% sequence identity to any one of the sequences of SEQ ID NOs:45, 46, or 6824-7032, a Cas5 (CasD) polypeptide having at least 95% sequence identity to any one of the sequences of SEQ ID NOs:47, 48, or 7033-7251, and a Cas6e (CasE) polypeptide having at least 95% sequence identity to any one of the sequences of SEQ ID NOs:49, 50, or 7252-7520, the Type I-F CASCADE comprises a Cys1 polypeptide having at least 95% sequence identity to any one of the sequences of SEQ ID NOs:51, 52, or 7521-8614, a Cys2 polypeptide having at least 95% sequence identity to any one of the sequences of SEQ ID NOs:53, 54, or 8614-9867, a Cas7 (Cys3) polypeptide having at least 95% sequence identity to any one of the sequences of SEQ ID NOs:55, 56, or 9868-11057, and a Cas6f polypeptide having at least 95% sequence identity to any one of the sequences of SEQ ID NOs:57, 58, or 11058-11528, the Type I-A CASCADE comprises a Cas7 (Csa2) polypeptide having at least 95% sequence identity to any one of the sequences of SEQ ID NOs:1-3, a Cas8a1 (Csx13) polypeptide having at least 95% sequence identity to any one of the sequences of SEQ ID NOs:4, or 341-640 or a Cas8a2 (Csx9) polypeptide having at least 95% sequence identity to any one of the sequences of SEQ ID NOs:5, 6, or 641-666, a Cas5 polypeptide having at least 95% sequence identity to any one of the sequences of SEQ ID NOs:7-9, or 667-871, a Csa5 polypeptide having at least 95% sequence identity to any one of the sequences of SEQ ID NOs:872-1042, a Cas6a polypeptide having at least 95% sequence identity to any one of the sequences of SEQ ID NOs:10, 11, or 325-328, a Cas3' polypeptide having at least 95% sequence identity to any one of the sequences of SEQ ID NOs:12-14, or 329-331, and a Cas3" polypeptide having no nuclease activity and having at least 95% sequence identity to any one of the sequences of SEQ ID NOs:15-17, or 332-334, said polypeptides having at least 95% sequence identity to one of the sequences of SEQ ID NOs:1-17, 325-334, or 341-1042, and the Type I-D CASCADE comprises a Cas10d (Csc3) polypeptide having at least 95% sequence identity to any one of the sequences of SEQ ID NOs:33, 34, or 4372-4678, a Csc2 polypeptide having at least 95% sequence identity to any one of the sequences of SEQ ID NOs:35, 36, or 4679-4985, Csc1 polypeptide having at least 95% sequence identity to any one of the sequences of SEQ ID NOs:37, 38, or 4986-5234, a Cas6d polypeptide having at least 95% sequence identity to any one of the sequences of SEQ ID NOs:39 or 40, thereby repressing expression of the first target gene in the bacterium or archaeon.

2. The method of claim 1, wherein repressing expression of the target gene comprises an increase in repression of the target gene.

3. The method of claim 1, wherein the CRISPR array is operably linked to a promoter and/or a terminator.

4. The method of claim 1, wherein the first nucleic acid sequence is operably linked to a promoter, regulatory element, or any combination thereof.

5. The method of claim 1, wherein the at least one CRISPR array comprises at least two spacer sequences, a first spacer sequence and a second spacer sequence, the first spacer sequence being complementary to a first target site in the first target gene and the second spacer sequence being complementary to a second target site in the first target gene, thereby modulating expression of the first target gene.

6. The method of claim 1, wherein the at least one CRISPR array comprises at least two spacer sequences, a first spacer sequence and a second spacer sequence, the first spacer sequence being complementary to the first target gene and the second spacer being complementary to a second target sequence in a second target gene, thereby modulating expression of at least two genes in the bacterium or the archaeon.

7. The method of claim 1, wherein the first target sequence comprises all or a part of a promoter sequence.

8. The method of claim 1, wherein the first target sequence is located on a coding strand of a transcribed region of the target gene.

9. The method of claim 6, wherein the second target sequence comprises all or a part of a promoter sequence.

10. The method of claim 6, wherein the second target sequence is located on a coding strand of a transcribed region of the target gene.

11. The method of claim 1, wherein the first nucleic acid sequence and the second nucleic acid sequence are on the same or a different expression cassettes or vectors.

12. The method of claim 1, wherein the first nucleic acid sequence and the second nucleic acid sequence are operably linked together on the same expression cassette or vector.

13. The method of claim 1, wherein the first nucleic acid sequence and the second nucleic acid sequence are transiently or stably incorporated into the bacterium or the archaeon.

14. The method of claim 1, wherein the two or more repeat sequences comprise a first repeat sequence and a second repeat sequence and the first repeat sequence is linked to the 5' end of the spacer sequence and the second repeat sequence is linked to the 3' end of the spacer sequence and the first repeat sequence or the second repeat sequence comprises a portion of a wild type repeat sequence having at least three contiguous nucleotides of a wild type repeat sequence.

15. The method of claim 1, wherein the bacterium is pathogenic.

16. The method of claim 1, wherein the at least one spacer sequence comprises a length of about 32 nucleotides to about 100 nucleotides.

17. The method of claim 1, wherein the at least one spacer sequence is increased in length by 6, 12, 18, 24, 30 or 36 nucleotides when compared to a normal spacer length.

* * * * *

UNITED STATES PATENT AND TRADEMARK OFFICE
CERTIFICATE OF CORRECTION

PATENT NO. : 11,439,712 B2
APPLICATION NO. : 15/302655
DATED : September 13, 2022
INVENTOR(S) : Beisel et al.

It is certified that error appears in the above-identified patent and that said Letters Patent is hereby corrected as shown below:

On the Title Page

Item (56) References Cited; OTHER PUBLICATIONS, Page 4, Column 2, Line 18: Please correct "Internatianal" to read --International--

In the Specification

Column 6, Line 36: Please correct "NM500 cas3'" to read --NM500 cas3$^+$--

Column 6, Line 44: Please correct "NM500 cas3$_+$" to read --NM500 cas3$^+$--

Column 9, Line 34: Please correct "5'-A-G-T-3′″" to read to read --"5'-A-G-T-3'"--

Column 18, Line 4: Please correct "0.1 SM" to read --0.1 5M--

Column 21, Line 55: Please correct "T3lac" to read --T3-lac--

Column 23, Line 49: Please correct "(Prm)" to read --(Prrn)--

Column 30, Line 47: Please correct "BAB84980.2" to read --BAB64980.2--

Column 30, Line 48: Please correct "YP_005844988.1" to read --YP_005644988.1--

Column 30, Line 49: Please correct "YP_005848062" to read --YP_005648062--

Column 123, Line 6: Please correct "$P_{araB}$a promoter" to read --$P_{araB}$ promoter--

Column 127, Table 3, SEQ ID NO: 288 Name: Please correct "xylArev" to read --xylA.rev--

Column 129, Line 59: Please correct "cas3*" to read --cas3$^+$--

Signed and Sealed this
Twenty-fourth Day of January, 2023

Katherine Kelly Vidal
*Director of the United States Patent and Trademark Office*

Column 132, Line 5: Please correct "$2^{\Delta Ct}$" to read --$2^{-\Delta Ct}$--

In the Claims

Column 139, Line 7, Claim 1: Please correct "sequence" to read --sequences--